United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 10

SEQ ID NO: 29665 - DNA, 2561 bp, Artificial Sequence
  chemically treated genomic DNA (Homo sapiens) CpG-island No: 29665
ggcgtgcgcgtcgcggagtcgttgttgtttttcgaagtgataggcgttttttttagtggcgttgtcgttttttgagttcggtatttcggtcgcggcgatcgtaggcggaggcgcgttcgtcgcggggttgttaaagggcgttttgtcggtgttagggaaggtgagtacgtcgaatatgttgggtttgggttcggtttttcgggcggtttttttcggggagtcgggagtcgaggtttcgtcgttcgtcgtttcgggtcgtttttttcggagggttttttttttgcgtattttttttttgcggcggttgtaggtggtggcgatggcgatgatggcggttagtagtagcgtgtagttttcggttagtacgatgatgacgattagcggcgtgttttattgtagtatcgattcggatatttcgagtcgagagttaggcgggcgggaacgtttcgggttttttgtattggtaggcgtagtcggtttacgttcgttttttgttgttattacgaagttgatagttgcggtggtggtgagcgggggacggtcgtcgtcggatatgattaggagcgttttgaatacgcgatcgggtggtttttgcgagaggtcgtcggtgagtagtatttttttcgtgcggcggtcgatggcgaaggtttcgcgcggtttttgttgttgtagttcgaacgttagtttttcgttggttttttcgtttgtatttcgggtttgtatacgggttataatcgtgttttttgcggtgcgtttaggtatcgttatttttagggagttattggttggcgtcgggtgtattaggattggcgtatggtcgttttggtttagtacgcgtatttgtattagggcgttgttggaaagttgaggggagtcgtcgtcgttagtttggatgcgaacgtcgagttggcgtagcgttttatagtcgaagttgcgtagcgcgtagatggtttcggtagttgggtttatcgagatataagtggatacggcgttttcggcgcggtttatttcggtttttagtagtcggtaggtgatttggtcgttgcggtttaggtttcggtcgcgggcggttatcgtggttaggtaggcgtttggcgggttgttttcgcgtatcgatattttatagatcggtcgcgtgaagagcggcgcgttgtcgttttcgtcgtttatacgtatcgtgtagggtcgtattgtgcgtagcgggggcgcgtcgcgattttcggttattagcgttaagttgtattcggcgatgcgttcgcggtttagcgacgtcgcggttattattaggtagttgttcgcgtaggtcggttgtagtcggaagtgttcgtgtttatagagggcgtagcgtatttgttcgttggcgttcgagtttttgttcgaggtgttgattagggttattaggttttcgcgcgtcgtttttttcggtattagcgaagtggtattagttttcggcgtttcggttttcgtcggcgagttagcgttcgttttttcgagtgtagcggcggcggcggtagcggcgaagggtgaggttgtcggcgcgtttggggcggttagcggggtgatggcgatgtcgggtgcgttgttattgacgtttcggatgcgtacgatgattttgtaggtggtagcgcggggttcgggttcgcggttttgcgttcgtacgtttagttcgtaggtgttttgacgttcgtagtttacgggttcggttagggtgaggcggtttgatcgcgggttaagtcgaaagaggcggcgcgttttcggcggggtgcgggcgttaaatgcgaatattacgtcgtcgttaggtttttcgtcggggtcggttgcgtttaggtcgagaagtagggagtttacgggcgcgtttttcgttagttttatttcggttacggcgttttgcgggaaggtcgggttgtggttattcgtatttaggacgcgtacgttgagggtagtcgtggcggagcgcggcgggcggtcgtcgttttgggttattagttttaggttgtaggcggtttggttttcgcggtttagtttttgtagtagtattaggtttgcgtattgagcgtcgttcgttcgcgtttgtagttttacgcgaaaggggttgtgcggttcggttaggcgtacggtttgtagttcgttggcgtttacgttttcgtttatcggtatttttaaggggatgcgcgtgtttattgtcgtattttcggatatttttatcgggatttgggttttggggaagcgcggcgcgtggtcgttgacgttttttatttttatttttacgtgtattagtcggaattgtttttgcgagaagttgattatatcgaaggttagtacgtattgcggggtttggttatatagtcgttcgcggtttaggtcggcgttttcgacggttagttgttcgtcgttttcgcgtattcggagtagagagttgttgaattgttttattaggcggaagtttgtgttattcgatatttttatatgtaggttttcggttagggtttcgatgatcgtgtcgggggtatttttttcgaaggtgttgtatcggattgttttgttttgggttattgagagta

SEQ ID NO: 29666 - DNA, 2561 bp, Artificial Sequence
  chemically treated genomic DNA (Homo sapiens) CpG-island No: 29666
tactctcaataacccaaaacaaaacaatccgatacaacaccttcgaaaaaaatacccccgacacgatcatcgaaaccctaaccgaaaacctacatataaaaatatcgaataacacaaacttccgcctaataaaacaattcaacaactctctactccgaatacgcgaaaacgacgaacaactaaccgtcgaaaacgccgacctaaaccgcgaacgactatataaccaaaccccgcaatacgtactaaccttcgatataatcaacttctcgcaaaaacaattccgactaatacacgtaaaaataaaaataaaaaacgtcaacgaccacgcgccgcgcttccccaaaacccaaatcccgataaaaatatccgaaaatacgacaataaacacgcgcatccccttaaaaataccgataaacgaaaacgtaaacgccaacgaactacaaaccgtacgcctaaccgaaccgcacaacccctttcgcgtaaaactacaaacgcgaacgaacgacgctcaatacgcaaacctaatactactacaaaaactaaaccgcgaaaaccaaaccgcctacaacctaaaactaataacccaaaacgacgaccgcccgccgcgctccgccacgactaccctcaacgtacgcgtcctaaatacgaataaccacaacccgaccttcccgcaaaacgccgtaaccgaaataaaactaacgaaaaacgcgcccgtaaactccctacttctcgacctaaacgcaaccgaccccgacgaaaaacctaacgacgacgtaatattcgcatttaacgcccgcaccccgccgaaaacgcgccgcctctttcgacttaacccgcgatcaaaccgcctcaccctaaccgaacccgtaaactacgaacgtcaaaacacctacgaactaaacgtacgaacgcaaaaccgcgaacccgaaccccgcgctaccacctacaaaatcatcgtacgcatccgaaacgtcaataacaacgcacccgacatcgccatcaccccgctaaccgccccaaacgcgccgacaacctcacccttcgccgctaccgccgccgccgctacactcgaaaaaacgaacgctaactcgccgacgaaaaccgaaacgccgaaaactaataccacttcgctaataccgaaaaaaacgacgcgcgaaaacctaataaccctaatcaacacctcgaacaaaaactcgaacgccaacgaacaaatacgctacgccctctataaacacgaacacttccgactacaaccgacctacgcgaacaactacctaataataaccgcgacgtcgctaaaccgcgaacgcatcgccgaatacaacttaacgctaataaccgaaaatcgcgacgcgcccccgctacgcacaatacgaccctacacgatacgtataaacgacgaaaacgacaacgcgccgctcttcacgcgaccgatctataaaatatcgatacgcgaaaacaacccgccaaacgcctacctaaccacgataaccgcccgcgaccgaaacctaaaccgcaacgaccaaatcacctaccgactactaaaaaccgaaataaaccgcgccgaaaacgccgtatccacttatatctcgataaacccaactaccgaaaccatctacgcgctacgcaacttcgactataaaacgctacgccaactcgacgttcgcatccaaactaacgacgacgactcccctcaactttccaacaacgccctaatacaaatacgcgtactaaaccaaaacgaccatacgccaatcctaatacacccgacgccaaccaataactccctaaaaataacgatacctaaacgcaccgcaaaaaacacgattataacccgtatacaaacccgaaatacaaacgaaaaaaccaacgaaaaactaacgttcgaactacaacaacaaaaaccgcgcgaaaccttcgccatcgaccgccgcacgaaaaaaatactactcaccgacgacctctcgcaaaaaccacccgatcgcgtattcaaaacgctcctaatcatatccgacgacgaccgtcccccgctcaccaccaccgcaactatcaacttcgtaataacaacaaaaaacgaacgtaaaccgactacgcctaccaatacaaaaaacccgaaacgttcccgcccgcctaactctcgactcgaaatatccgaatcgatactacaataaaacacgccgctaatcgtcatcatcgtactaaccgaaaactacacgctactactaaccgccatcatcgccatcgccaccacctacaaccgccgcaaaaaaaaaatacgcaaaaaaaaaaccctccgaaaaaaacgacccgaaacgacgaacgacgaaacctcgactcccgactccccgaaaaaaaccgcccgaaaaaccgaacccaaacccaacatattcgacgtactcaccttccctaacaccgacaaaacgccctttaacaaccccgcgacgaacgcgcctccgcctacgatcgccgcgaccgaaataccgaactcaaaaaacgacaacgccactaaaaaaaacgcctatcacttcgaaaaacaacaacgactccgcgacgcgcacgcc

SEQ ID NO: 29667 - DNA, 2561 bp, Artificial Sequence
  chemically treated genomic DNA (Homo sapiens) CpG-island No: 29667
tgtttttagtggtttagagtaaaatagttcgatatagtattttcgaggaggatgttttcggtacggttatcgggattttggtcgaggatttgtatatgaaagtatcgggtgatataagttttcgtttgatgaagtaatttaatagttttttgtttcgggtgcgcgaaggcgacgggtagttgatcgtcggggacgtcggtttggatcgcgagcggttgtgtggttaggtttcgtagtgcgtgttggttttcgatgtggttagtttttcgtaggagtagtttcggttggtgtacgtggaggtagaggtgagggacgttaacgattacgcgtcgcgtttttttagggtttagatttcggtagaggtgttcgagggtgcggtagtgggtacgcgtatttttttggaggtgtcggtggacgaggacgtgggcgttaacgggttgtagatcgtgcgtttggtcgagtcgtatagtttttttcgcgtggagttgtagacgcgagcggacggcgtttagtgcgtagatttggtgttgttgtaggagttggatcgcgagagttaggtcgtttatagtttggagttggtggtttaggacggcggtcgttcgtcgcgtttcgttacggttgtttttagcgtgcgcgttttggatgcgaatgattatagttcggttttttcgtagggcgtcgtggtcgaagtggagttggcggaagacgcgttcgtgggttttttgtttttcgatttggacgtagtcgatttcgacgagggatttaacggcgacgtggtgttcgtatttggcgttcgtatttcgtcggaggcgcgtcgtttttttcggtttgattcgcgattaggtcgttttattttggtcgggttcgtggattacgagcgttaggatatttacgagttggacgtgcgggcgtaggatcgcggattcgggtttcgcgttgttatttgtaaggttatcgtgcgtattcgagacgttaatgataacgtattcgatatcgttattatttcgttggtcgttttaggcgcgtcggtaattttatttttcgtcgttgtcgtcgtcgtcgttgtattcgggggagcggacgttagttcgtcggcgggagtcgggacgtcggaggttggtgttatttcgttggtgtcggagggggcggcgcgcgagagtttggtggttttggttagtatttcggatagggattcgggcgttaacgggtaagtgcgttgcgttttttatgggtacgagtattttcggttgtagtcggtttacgcgggtagttatttggtggtgatcgcggcgtcgttggatcgcgaacgtatcgtcgagtataatttgacgttggtggtcgaggatcgcggcgcgttttcgttgcgtatagtgcggttttatacggtgcgtgtgggcgacgagaacgataacgcgtcgttttttacgcggtcggtttatgaggtgtcggtgcgcgagaataattcgttaggcgtttatttggttacggtggtcgttcgcgatcgggatttgggtcgtaacggttaggttatttatcggttgttggaggtcgaggtgggtcgcgtcgggggcgtcgtgtttatttatgtttcggtggatttagttatcggagttatttacgcgttgcgtagtttcgattatgagacgttgcgttaattcgacgttcgtatttaagttagcgacggcggttttttttagttttttagtagcgttttagtgtaagtgcgcgtgttggattagaacgattatgcgttagttttggtgtattcggcgttagttaatggttttttagaagtggcggtgtttgggcgtatcgtaaaggatacggttgtggttcgtgtgtaggttcgggatgtagacgagggagttaacggggagttggcgttcgagttgtagtagtaggagtcgcgcgaagttttcgttatcggtcgtcgtacgggggagatattgtttatcggcgatttttcgtaggagttattcggtcgcgtgtttagggcgtttttggttatattcgacggcggtcgtttttcgtttattattatcgtaattgttagtttcgtggtaatagtagggggcgggcgtgggtcggttgcgtttgttagtgtaggaagttcggagcgttttcgttcgtttggttttcggttcggggtgttcgggtcggtgttgtaatgggatacgtcgttgatcgttattatcgtgttggtcgggagttgtacgttgttgttggtcgttattatcgttatcgttattatttgtaatcgtcgtaagaaggaggtgcgtaaagggggggtttttcgggaagagcggttcggggcggcgggcggcggagtttcggttttcggtttttcggaggaggtcgttcggggagtcgggtttaggtttaatatgttcgacgtgtttattttttttggtatcggtaaagcgttttttggtagtttcgcggcggacgcgttttcgtttgcggtcgtcgcggtcgaagtgtcgggtttagagggcggtagcgttattggggaaagcgtttgttatttcgaggggtagtagcggtttcgcggcgcgtacgtt

SEQ ID NO: 29668 - DNA, 2561 bp, Artificial Sequence
  chemically treated genomic DNA (Homo sapiens) CpG-island No: 29668
aacgtacgcgccgcgaaaccgctactacccctcgaaataacaaacgctttccccaataacgctaccgccctctaaacccgacacttcgaccgcgacgaccgcaaacgaaaacgcgtccgccgcgaaactaccaaaaaacgctttaccgataccaaaaaaaataaacacgtcgaacatattaaacctaaacccgactccccgaacgacctcctccgaaaaaccgaaaaccgaaactccgccgcccgccgccccgaaccgctcttcccgaaaaaccccccctttacgcacctccttcttacgacgattacaaataataacgataacgataataacgaccaacaacaacgtacaactcccgaccaacacgataataacgatcaacgacgtatcccattacaacaccgacccgaacaccccgaaccgaaaaccaaacgaacgaaaacgctccgaacttcctacactaacaaacgcaaccgacccacgcccgccccctactattaccacgaaactaacaattacgataataataaacgaaaaacgaccgccgtcgaatataaccaaaaacgccctaaacacgcgaccgaataactcctacgaaaaatcgccgataaacaatatctcccccgtacgacgaccgataacgaaaacttcgcgcgactcctactactacaactcgaacgccaactccccgttaactccctcgtctacatcccgaacctacacacgaaccacaaccgtatcctttacgatacgcccaaacaccgccacttctaaaaaaccattaactaacgccgaatacaccaaaactaacgcataatcgttctaatccaacacgcgcacttacactaaaacgctactaaaaaactaaaaaaaaccgccgtcgctaacttaaatacgaacgtcgaattaacgcaacgtctcataatcgaaactacgcaacgcgtaaataactccgataactaaatccaccgaaacataaataaacacgacgcccccgacgcgacccacctcgacctccaacaaccgataaataacctaaccgttacgacccaaatcccgatcgcgaacgaccaccgtaaccaaataaacgcctaacgaattattctcgcgcaccgacacctcataaaccgaccgcgtaaaaaacgacgcgttatcgttctcgtcgcccacacgcaccgtataaaaccgcactatacgcaacgaaaacgcgccgcgatcctcgaccaccaacgtcaaattatactcgacgatacgttcgcgatccaacgacgccgcgatcaccaccaaataactacccgcgtaaaccgactacaaccgaaaatactcgtacccataaaaaacgcaacgcacttacccgttaacgcccgaatccctatccgaaatactaaccaaaaccaccaaactctcgcgcgccgccccctccgacaccaacgaaataacaccaacctccgacgtcccgactcccgccgacgaactaacgtccgctcccccgaatacaacgacgacgacgacaacgacgaaaaataaaattaccgacgcgcctaaaacgaccaacgaaataataacgatatcgaatacgttatcattaacgtctcgaatacgcacgataaccttacaaataacaacgcgaaacccgaatccgcgatcctacgcccgcacgtccaactcgtaaatatcctaacgctcgtaatccacgaacccgaccaaaataaaacgacctaatcgcgaatcaaaccgaaaaaaacgacgcgcctccgacgaaatacgaacgccaaatacgaacaccacgtcgccgttaaatccctcgtcgaaatcgactacgtccaaatcgaaaaacaaaaaacccacgaacgcgtcttccgccaactccacttcgaccacgacgccctacgaaaaaaccgaactataatcattcgcatccaaaacgcgcacgctaaaaacaaccgtaacgaaacgcgacgaacgaccgccgtcctaaaccaccaactccaaactataaacgacctaactctcgcgatccaactcctacaacaacaccaaatctacgcactaaacgccgtccgctcgcgtctacaactccacgcgaaaaaaactatacgactcgaccaaacgcacgatctacaacccgttaacgcccacgtcctcgtccaccgacacctccaaaaaaatacgcgtacccactaccgcaccctcgaacacctctaccgaaatctaaaccctaaaaaaacgcgacgcgtaatcgttaacgtccctcacctctacctccacgtacaccaaccgaaactactcctacgaaaaactaaccacatcgaaaaccaacacgcactacgaaacctaaccacacaaccgctcgcgatccaaaccgacgtccccgacgatcaactacccgtcgccttcgcgcacccgaaacaaaaaactattaaattacttcatcaaacgaaaacttatatcacccgatactttcatatacaaatcctcgaccaaaatcccgataaccgtaccgaaaacatcctcctcgaaaatactatatcgaactattttactctaaaccactaaaaaca

SEQ ID NO: 29669 - DNA, 865 bp, Artificial Sequence
  chemically treated genomic DNA (Homo sapiens) CpG-island No: 29669
agaggattcgggttaaggcgttgagtcgttaatatgaaggtcggttttagaagaggattcgggttaaggcgttgagtcgttaatatgaaggtcgggtttagaagaggattcgggttaaggcgttgagttattaacgtgaaggttggttttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtcgttaacgtgaaggtcgggtttagaagaggattcgggttaaggcgttgagtttcgtttggggttgttgtgtattttagttggagatgttataggggagggtggaagcggatattgggagttgtag

SEQ ID NO: 29670 - DNA, 865 bp, Artificial Sequence
  chemically treated genomic DNA (Homo sapiens) CpG-island No: 29670
ctacaactcccaatatccgcttccaccctcccctataacatctccaactaaaatacacaacaaccccaaacgaaactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaacccgaccttcacgttaacgactcaacgccttaacccgaatcctcttctaaaaccaaccttcacgttaataactcaacgccttaacccgaatcctcttctaaacccgaccttcatattaacgactcaacgccttaacccgaatcctcttctaaaaccgaccttcatattaacgactcaacgccttaacccgaatcctct

SEQ ID NO: 29671 - DNA, 865 bp, Artificial Sequence
  chemically treated genomic DNA (Homo sapiens) CpG-island No: 29671
ttgtagtttttagtattcgtttttatttttttttgtgatatttttaattgaaatgtatagtaattttaaacggaatttagcgttttagttcgaatttttttttgagttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgggttcggtttttacgttagcgatttagcgttttagttcgaatttttttttgaggttagtttttacgttagtgatttagcgttttagttcgaatttttttttgagttcggtttttatgttagcgatttagcgttttagttcgaatttttttttgaggtcggtttttatgttagcgatttagcgttttagttcgaatttttt

SEQ ID NO: 29672 - DNA, 865 bp, Artificial Sequence
  chemically treated genomic DNA (Homo sapiens) CpG-island No: 29672
aaaaaattcgaactaaaacgctaaatcgctaacataaaaaccgacctcaaaaaaaaattcgaactaaaacgctaaatcgctaacataaaaaccgaactcaaaaaaaaattcgaactaaaacgctaaatcactaacgtaaaaactaacctcaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaacccaaaaaaaaattcgaactaaaacgctaaatcgctaacgtaaaaaccgaactcaaaaaaaaattcgaactaaaacgctaaattccgtttaaaattactatacatttcaattaaaaatatcacaaaaaaaaataaaaacgaatactaaaaactacaa

SEQ ID NO: 29673 - DNA, 527 bp, Artificial Sequence
  chemically treated genomic DNA (Homo sapiens) CpG-island No: 29673
gttcgcgtcgtcgaattgttcggggattattcggtttatgagaagtcgtcggtagtttatgattggagagcgtcgtcggaggtcgtcgttttgcgatggaaaggaacggtttagacggatgtatttacggtcgatttaaaggttttggcgtggatattcgttttgtaaattatttagaagttaatagtggttattacgtgcgacgggaaaacgggatcgatagatttattattttgttattttaatcggaagttttttatcgtttcgttcggaagtttgatttgagcggaagtttcgtttttgcgtcgagttgggagttcggagttttttggatggcgcgttgtatagggttgtggatgttttgtgtttttaggaaggcgtgttgagtagtcggtacggcgaggttcgtgttggtcgttttttttcggagttttcgtttttgtattttattttgtgtttattgcggtaggaggcgttagttagtttataggttgttcggtttagggggtcgtatttttttaatttta

SEQ ID NO: 29674 - DNA, 527 bp, Artificial Sequence
  chemically treated genomic DNA (Homo sapiens) CpG-island No: 29674
taaaattaaaaaaatacgaccccctaaaccgaacaacctataaactaactaacgcctcctaccgcaataaacacaaaataaaatacaaaaacgaaaactccgaaaaaaaacgaccaacacgaacctcgccgtaccgactactcaacacgccttcctaaaaacacaaaacatccacaaccctatacaacgcgccatccaaaaaactccgaactcccaactcgacgcaaaaacgaaacttccgctcaaatcaaacttccgaacgaaacgataaaaaacttccgattaaaataacaaaataataaatctatcgatcccgttttcccgtcgcacgtaataaccactattaacttctaaataatttacaaaacgaatatccacgccaaaacctttaaatcgaccgtaaatacatccgtctaaaccgttcctttccatcgcaaaacgacgacctccgacgacgctctccaatcataaactaccgacgacttctcataaaccgaataatccccgaacaattcgacgacgcgaac

SEQ ID NO: 29675 - DNA, 527 bp, Artificial Sequence
  chemically treated genomic DNA (Homo sapiens) CpG-island No: 29675
tgaagttaggaaggtacgattttttaggtcgaatagtttgtgggttagttggcgttttttgtcgtagtaaatataaagtggggtatagaaacgaaaatttcgggaagaaacggttagtacgggtttcgtcgtgtcggttatttaatacgtttttttgagagtatagaatatttatagttttatatagcgcgttatttagagagtttcggatttttagttcggcgtaggggcgggattttcgtttaagttagattttcgggcgaggcggtgaggggttttcggttggggtggtagggtggtggatttgtcggtttcgttttttcgtcgtacgtggtggttattgttggtttttgaatggtttgtaaggcggatatttacgttaaggtttttggatcggtcgtgggtatattcgtttgagtcgtttttttttatcgtagagcggcggttttcggcggcgttttttagttatggattatcggcggttttttatgagtcgggtggttttcgggtaattcgacgacgcggat

SEQ ID NO: 29676 - DNA, 527 bp, Artificial Sequence
  chemically treated genomic DNA (Homo sapiens) CpG-island No: 29676
atccgcgtcgtcgaattacccgaaaaccacccgactcataaaaaaccgccgataatccataactaaaaaacgccgccgaaaaccgccgctctacgataaaaaaaaacgactcaaacgaatatacccacgaccgatccaaaaaccttaacgtaaatatccgccttacaaaccattcaaaaaccaacaataaccaccacgtacgacgaaaaaacgaaaccgacaaatccaccaccctaccaccccaaccgaaaacccctcaccgcctcgcccgaaaatctaacttaaacgaaaatcccgcccctacgccgaactaaaaatccgaaactctctaaataacgcgctatataaaactataaatattctatactctcaaaaaaacgtattaaataaccgacacgacgaaacccgtactaaccgtttcttcccgaaattttcgtttctataccccactttatatttactacgacaaaaaacgccaactaacccacaaactattcgacctaaaaaatcgtaccttcctaacttca

SEQ ID NO: 29677 - DNA, 739 bp, Artificial Sequence
  chemically treated genomic DNA (Homo sapiens) CpG-island No: 29677
atagagcggcgataacggtgggcgtcggcgggcgcggggggaagttgttcgggttcgagttaggtaggggttgttacggagttcgggtttcgggttggagagaggtagattgggttcggagcgcggcgttagggaggaggtcggagagggttaggaagggtttaggatcgtcgggggtcggcgttggcgtttttatcgggataggtgttttaggatttgttttttaatgatttcggttatgtcggagtcgcggttcgcgtggaaggcgggtgggtcggtagttgtggtttttttagttgtggagaagaggcggtttttttatttcgtcgcggcgtgagtatcggatatagtcgtcgtcgtcgttatggcgttttttcgtttttttttgggcgtttggcgtttcgttacgattttatttattagcgcggcgtcgcggtcgttcgtttagagcgacgcgaagatcgcgcgttattcgtcggttttgtttgcggcggttagaggcgcgcgcggtgaggggcggcggcgcgcgtagcgtcggggttggttggttcgagtttttttttttcgcgttttcgttcgtttttcgggtttgaaacgtttttttcgtttttgaggggtgtgcggtttttttcgtattcggtagtcgttttgaaatttaggagaaaggcggggtagttgtaatttttgtagaaattcgttagattattgcgtagttttcggatgttagcgttcgtttttt

SEQ ID NO: 29678 - DNA, 739 bp, Artificial Sequence
  chemically treated genomic DNA (Homo sapiens) CpG-island No: 29678
aaaaaacgaacgctaacatccgaaaactacgcaataatctaacgaatttctacaaaaattacaactaccccgcctttctcctaaatttcaaaacgactaccgaatacgaaaaaaaccgcacacccctcaaaaacgaaaaaaacgtttcaaacccgaaaaacgaacgaaaacgcgaaaaaaaaaaactcgaaccaaccaaccccgacgctacgcgcgccgccgcccctcaccgcgcgcgcctctaaccgccgcaaacaaaaccgacgaataacgcgcgatcttcgcgtcgctctaaacgaacgaccgcgacgccgcgctaataaataaaatcgtaacgaaacgccaaacgcccaaaaaaaaacgaaaaaacgccataacgacgacgacgactatatccgatactcacgccgcgacgaaataaaaaaaccgcctcttctccacaactaaaaaaaccacaactaccgacccacccgccttccacgcgaaccgcgactccgacataaccgaaatcattaaaaaacaaatcctaaaacacctatcccgataaaaacgccaacgccgacccccgacgatcctaaacccttcctaaccctctccgacctcctccctaacgccgcgctccgaacccaatctacctctctccaacccgaaacccgaactccgtaacaacccctacctaactcgaacccgaacaacttccccccgcgcccgccgacgcccaccgttatcgccgctctat

SEQ ID NO: 29679 - DNA, 739 bp, Artificial Sequence
  chemically treated genomic DNA (Homo sapiens) CpG-island No: 29679
gagaggcggacgttggtattcgggagttgcgtaatgatttaacgaatttttgtaaaaattataattatttcgttttttttttaggttttaaggcgattgtcgggtgcgaaaggaatcgtatattttttagaggcgaaagaagcgttttagattcgagaggcggacgggagcgcggagggaggaagttcgagttagttagtttcggcgttgcgcgcgtcgtcgttttttatcgcgcgcgtttttggtcgtcgtaagtaaggtcggcgggtggcgcgcgattttcgcgtcgttttgggcgggcggtcgcggcgtcgcgttggtgggtgggatcgtggcggagcgttaggcgtttaaagaggggcgagaaagcgttatggcggcggcggcggttgtgttcggtgtttacgtcgcggcgaggtgaggggatcgttttttttttataattgaggaggttatagttgtcggtttattcgttttttacgcgggtcgcggtttcggtatggtcgggattattaagaagtagattttgaaatatttgtttcggtgagagcgttagcgtcggttttcggcggttttgggttttttttaatttttttcgattttttttttgacgtcgcgtttcgggtttagtttgtttttttttagttcggagttcggatttcgtggtagtttttgtttaattcgagttcggatagttttttttcgcgttcgtcggcgtttatcgttgtcgtcgttttgt

SEQ ID NO: 29680 - DNA, 739 bp, Artificial Sequence
  chemically treated genomic DNA (Homo sapiens) CpG-island No: 29680
acaaaacgacgacaacgataaacgccgacgaacgcgaaaaaaaactatccgaactcgaattaaacaaaaactaccacgaaatccgaactccgaactaaaaaaaaacaaactaaacccgaaacgcgacgtcaaaaaaaaaatcgaaaaaaattaaaaaaaacccaaaaccgccgaaaaccgacgctaacgctctcaccgaaacaaatatttcaaaatctacttcttaataatcccgaccataccgaaaccgcgacccgcgtaaaaaacgaataaaccgacaactataacctcctcaattataaaaaaaaaacgatcccctcacctcgccgcgacgtaaacaccgaacacaaccgccgccgccgccataacgctttctcgcccctctttaaacgcctaacgctccgccacgatcccacccaccaacgcgacgccgcgaccgcccgcccaaaacgacgcgaaaatcgcgcgccacccgccgaccttacttacgacgaccaaaaacgcgcgcgataaaaaacgacgacgcgcgcaacgccgaaactaactaactcgaacttcctccctccgcgctcccgtccgcctctcgaatctaaaacgcttctttcgcctctaaaaaatatacgattcctttcgcacccgacaatcgccttaaaacctaaaaaaaaaacgaaataattataatttttacaaaaattcgttaaatcattacgcaactcccgaataccaacgtccgcctctc

SEQ ID NO: 29681 - DNA, 1501 bp, Artificial Sequence
  chemically treated genomic DNA (Homo sapiens) CpG-island No: 29681
cgtatttcgacgaattcgagacgcgtttcgcgttgcgtaggaggttcggcgggttttgttgttagttcggggtgggtacgtattttttagtcggtagagttgttgttgtcgtttttatttttgaagtagggtacgtaacgtattatttattcgtagatttgggatagagtgagtcgtttgttcggggagttttcgatggcgcgggtgattaggttcgcgtaggataggtttttttaggcgtttcgtcgcgacgaatattttttcggttgttcggagtttttagtcgttttcggttgcggcggtggtagcggttgttgaggttgtagtagcgtttgtgtattttcgtttagttcgttcgtcgcggtggttggtttagattcggggttttgtttttcgggtgttagtattcgggtcgagtttttaaggagtagttcggagtttagcgtgtcgttttcgtcgtcgtcgtcgatcgttatggtcgagtcggttcgtttttcgtcgttttcgtcgtttttatcgttttttttttcggggattatggagtcggcggtcgtttttttcgagggtttggtagggttcgtttggagtttcggtttttgtaggggttacgtataggatcgcggacggttttggggttcgaatttcgggtttagttttatttcgagcggagagagcggggtcggggaagtcggtgtttttgttattttcgtcgttcgttcgttcgcggttggggttttcgcgtttttttttcgcgtcggggcggggtgtagcgggggagggacgtggacgtcgcgaaggtttcggttttcgggcgtcgtcgtcgtcgtttggggaagtattaaagaagagagaaggagagttggttatttcgggtcggagtttcgttttcggcgagttttcgttcgttgtcgttattttttagttttgtcgcgttcgttttttaggaataggaggatttgaagacgtgcggttagcgaatttggcgtagtagatatcgtttttcggttaggtcgcgatggagtcgcgagcgaatcgacggtttcgcgcggggtagtttttttttttcgtcgtttagtcgtaggtttttttcgggttaggcggcggggcggggagaagggggaggggcgttcgggggaggggcggtcgcgtttttaaagcgggtagcggtcggagttggcgtagtcgagtcgcggttagagttcgagttcgggtgtgcgtgcgtttgtttatgtttcgttcgggttcgttttagtgtttttcgcggcgtcgtcgtttaagtttgtgttgttttcggtttttttttttttttttagtttggtcgttttcgcgatttttcgttattttttattcggtcgaatggttcgagttcggggattgcgcgggtagttttttttttttttttcgttcgcgggttagagggcgaacgggggtttgggcgtagatgggtttttgttatttttaaaaaataaaggaaagatagaaagaagggggagtagtagtt

SEQ ID NO: 29682 - DNA, 1501 bp, Artificial Sequence
  chemically treated genomic DNA (Homo sapiens) CpG-island No: 29682
aactactactcccccttctttctatctttcctttattttttaaaaataacaaaaacccatctacgcccaaacccccgttcgccctctaacccgcgaacgaaaaaaaaaaaaaaaactacccgcgcaatccccgaactcgaaccattcgaccgaataaaaaataacgaaaaatcgcgaaaacgaccaaactaaaaaaaaaaaaaaaaaccgaaaacaacacaaacttaaacgacgacgccgcgaaaaacactaaaacgaacccgaacgaaacataaacaaacgcacgcacacccgaactcgaactctaaccgcgactcgactacgccaactccgaccgctacccgctttaaaaacgcgaccgcccctcccccgaacgcccctcccccttctccccgccccgccgcctaacccgaaaaaaacctacgactaaacgacgaaaaaaaaaaactaccccgcgcgaaaccgtcgattcgctcgcgactccatcgcgacctaaccgaaaaacgatatctactacgccaaattcgctaaccgcacgtcttcaaatcctcctattcctaaaaaacgaacgcgacaaaactaaaaaataacgacaacgaacgaaaactcgccgaaaacgaaactccgacccgaaataaccaactctccttctctcttctttaatacttccccaaacgacgacgacgacgcccgaaaaccgaaaccttcgcgacgtccacgtccctcccccgctacaccccgccccgacgcgaaaaaaaaacgcgaaaaccccaaccgcgaacgaacgaacgacgaaaataacaaaaacaccgacttccccgaccccgctctctccgctcgaaataaaactaaacccgaaattcgaaccccaaaaccgtccgcgatcctatacgtaacccctacaaaaaccgaaactccaaacgaaccctaccaaaccctcgaaaaaaacgaccgccgactccataatccccgaaaaaaaaaacgataaaaacgacgaaaacgacgaaaaacgaaccgactcgaccataacgatcgacgacgacgacgaaaacgacacgctaaactccgaactactccttaaaaactcgacccgaatactaacacccgaaaaacaaaaccccgaatctaaaccaaccaccgcgacgaacgaactaaacgaaaatacacaaacgctactacaacctcaacaaccgctaccaccgccgcaaccgaaaacgactaaaaactccgaacaaccgaaaaaatattcgtcgcgacgaaacgcctaaaaaaacctatcctacgcgaacctaatcacccgcgccatcgaaaactccccgaacaaacgactcactctatcccaaatctacgaataaataatacgttacgtaccctacttcaaaaataaaaacgacaacaacaactctaccgactaaaaaatacgtacccaccccgaactaacaacaaaacccgccgaacctcctacgcaacgcgaaacgcgtctcgaattcgtcgaaatacg

SEQ ID NO: 29683 - DNA, 1501 bp, Artificial Sequence
  chemically treated genomic DNA (Homo sapiens) CpG-island No: 29683
ggttgttgtttttttttttttttgttttttttttattttttggaagtgataagggtttatttgcgtttagattttcgttcgttttttggttcgcgggcgaagaggggagagggagttgttcgcgtagttttcgggttcgggttattcgatcgggtggggggtgacggggggtcgcggaggcggttaggttaggaaaggggagaagagtcgaagatagtatagatttgagcggcggcgtcgcgggaggtattagagcgggttcgagcgaaatataaataaacgtacgtatattcgagttcgggttttgatcgcggttcggttgcgttagtttcggtcgttgttcgttttaaaggcgcggtcgtttttttttcgggcgtttttttttttttttttcgtttcgtcgtttagttcgggagggatttgcggttgggcggcggggggagggggttgtttcgcgcgaggtcgtcgattcgttcgcggttttatcgcggtttggtcggggggcggtgtttgttgcgttaggttcgttggtcgtacgtttttaggtttttttgtttttgggaggcgggcgcggtaggattgggaggtggcggtagcgggcgaggattcgtcgaggacggggtttcggttcgggataattaatttttttttttttttttttggtgtttttttaggcggcggcggcggcgttcgggagtcggagttttcgcggcgtttacgtttttttttcgttgtatttcgtttcggcgcgagaggagagcgcgagagttttagtcgcgggcgggcgggcggcgaagatggtagaggtatcggttttttcggtttcgtttttttcgttcgaagtggagttggattcggagttcgagttttagagtcgttcgcgattttgtacgtggtttttgtaaaggtcggagttttaagcgagttttgttaagttttcgggggagacggtcgtcgattttatgattttcgaggaggaggacgatgaagacgacgaggacggcgggggacgggtcggttcggttatggcgatcggcggcggcggcgggagcggtacgttgggtttcgggttgttttttgaggattcggttcgggtgttggtattcggagggtaagatttcgggtttgggttagttatcgcggcgggcgggttgagcgggggtatataggcgttgttgtagttttagtaatcgttgttatcgtcgtagtcgggggcggttgggggtttcgggtagtcgaggaaatgttcgtcgcggcggaacgtttggggaaatttgttttacgcggatttgattattcgcgttatcgagagtttttcggataaacggtttattttgttttagatttacgagtggatggtgcgttgcgtgttttattttaaggataagggcgatagtaatagttttgtcggttggaaggtgcgtatttatttcgggttggtagtaggattcgtcgggttttttgcgtagcgcgagacgcgtttcggattcgtcggagtgcg

SEQ ID NO: 29684 - DNA, 1501 bp, Artificial Sequence
  chemically treated genomic DNA (Homo sapiens) CpG-island No: 29684
cgcactccgacgaatccgaaacgcgtctcgcgctacgcaaaaaacccgacgaatcctactaccaacccgaaataaatacgcaccttccaaccgacaaaactattactatcgcccttatccttaaaataaaacacgcaacgcaccatccactcgtaaatctaaaacaaaataaaccgtttatccgaaaaactctcgataacgcgaataatcaaatccgcgtaaaacaaatttccccaaacgttccgccgcgacgaacatttcctcgactacccgaaacccccaaccgcccccgactacgacgataacaacgattactaaaactacaacaacgcctatatacccccgctcaacccgcccgccgcgataactaacccaaacccgaaatcttaccctccgaataccaacacccgaaccgaatcctcaaaaaacaacccgaaacccaacgtaccgctcccgccgccgccgccgatcgccataaccgaaccgacccgtcccccgccgtcctcgtcgtcttcatcgtcctcctcctcgaaaatcataaaatcgacgaccgtctcccccgaaaacttaacaaaactcgcttaaaactccgacctttacaaaaaccacgtacaaaatcgcgaacgactctaaaactcgaactccgaatccaactccacttcgaacgaaaaaaacgaaaccgaaaaaaccgatacctctaccatcttcgccgcccgcccgcccgcgactaaaactctcgcgctctcctctcgcgccgaaacgaaatacaacgaaaaaaaaacgtaaacgccgcgaaaactccgactcccgaacgccgccgccgccgcctaaaaaaacaccaaaaaaaaaaaaaaaaaaattaattatcccgaaccgaaaccccgtcctcgacgaatcctcgcccgctaccgccacctcccaatcctaccgcgcccgcctcccaaaaacaaaaaaacctaaaaacgtacgaccaacgaacctaacgcaacaaacaccgccccccgaccaaaccgcgataaaaccgcgaacgaatcgacgacctcgcgcgaaacaaccccctccccccgccgcccaaccgcaaatccctcccgaactaaacgacgaaacgaaaaaaaaaaaaaaaaacgcccgaaaaaaaaacgaccgcgcctttaaaacgaacaacgaccgaaactaacgcaaccgaaccgcgatcaaaacccgaactcgaatatacgtacgtttatttatatttcgctcgaacccgctctaatacctcccgcgacgccgccgctcaaatctatactatcttcgactcttctcccctttcctaacctaaccgcctccgcgaccccccgtcaccccccacccgatcgaataacccgaacccgaaaactacgcgaacaactccctctcccctcttcgcccgcgaaccaaaaaacgaacgaaaatctaaacgcaaataaacccttatcacttccaaaaaataaaaaaaaaacaaaaaaaaaaaaaaacaacaacc

SEQ ID NO: 29685 - DNA, 969 bp, Artificial Sequence
  chemically treated genomic DNA (Homo sapiens) CpG-island No: 29685
gagttcggcggggacggttatttcggggttttgtgtggtttgtattttcgcggacgtcgtttttttcgttttttttttagtcgggattcgggggagggagcgagtcggaatataaattttttaataggtcgggaagcgttaagtttttcgggttgttagaaaattcggattagtacgtttattatttttttgttttcgttgttgttattttgatagttttttttttttcgagttttttaaaaatattagcgggcgagaaggggggcgcgtatatcgcggtttagggaggggaaagggaagcgttcggtttagttcggaagtagattcggagttatcgggaaggcggtcgttcgttgtacggtttcggcgtttatttcgtttttttttttttagggacgcggcgggacgacgtacgatttcgcgcgggttcggggtacggcgaggagggggcgcgtaatttcggcgaaggagaagcgttcgggtcgtcgtcgtagttcgttcgaggaatcgtttgttagttcgcgcgtcgttattttttatattttttttttttttttttacgagtagggcggtcgcggtagtagtataaagttatagatatacgtagggcgttttaatttaggttgacggcgggcgggttttcgtttagggggagggttgggcggcgggttgggcggcgggtcgggcgcgcggcgggcgtgcgtgtgtgagtgcgcgtgtgtgagttcgcgcgcgtttgcgcggttcggtttcgcggggttgcgggcgtgggtgttcgggcgcgcgtcgtgggtcgggattcggcgggttttcgttgttgttttcgttgggttttttttttttttcgagagttttaacgataataaagcgcggcgttggttcgggagaggagggagaaggggggagaagggaggagaggaggaagaagtggggagaggagggagaagggggagcggtaggagcgtatag

SEQ ID NO: 29686 - DNA, 969 bp, Artificial Sequence
  chemically treated genomic DNA (Homo sapiens) CpG-island No: 29686
ctatacgctcctaccgctcccccttctccctcctctccccacttcttcctcctctcctcccttctccccccttctccctcctctcccgaaccaacgccgcgctttattatcgttaaaactctcgaaaaaaaaaaaaaacccaacgaaaacaacaacgaaaacccgccgaatcccgacccacgacgcgcgcccgaacacccacgcccgcaaccccgcgaaaccgaaccgcgcaaacgcgcgcgaactcacacacgcgcactcacacacgcacgcccgccgcgcgcccgacccgccgcccaacccgccgcccaaccctccccctaaacgaaaacccgcccgccgtcaacctaaattaaaacgccctacgtatatctataactttatactactaccgcgaccgccctactcgtaaaaaaaaaaaaaaaaaatataaaaaataacgacgcgcgaactaacaaacgattcctcgaacgaactacgacgacgacccgaacgcttctccttcgccgaaattacgcgccccctcctcgccgtaccccgaacccgcgcgaaatcgtacgtcgtcccgccgcgtccctaaaaaaaaaaaaacgaaataaacgccgaaaccgtacaacgaacgaccgccttcccgataactccgaatctacttccgaactaaaccgaacgcttccctttcccctccctaaaccgcgatatacgcgccccccttctcgcccgctaatatttttaaaaaactcgaaaaaaaaaaaactatcaaaataacaacaacgaaaacaaaaaaataataaacgtactaatccgaattttctaacaacccgaaaaacttaacgcttcccgacctattaaaaaatttatattccgactcgctccctcccccgaatcccgactaaaaaaaaaacgaaaaaaacgacgtccgcgaaaatacaaaccacacaaaaccccgaaataaccgtccccgccgaactc

SEQ ID NO: 29687 - DNA, 969 bp, Artificial Sequence
  chemically treated genomic DNA (Homo sapiens) CpG-island No: 29687
ttgtgcgtttttgtcgttttttttttttttttttttttttatttttttttttttttttttttttttttttttttttttttttttttcgggttagcgtcgcgttttgttgtcgttgagattttcgggagggaggaggagtttagcggggatagtagcgggagttcgtcgagtttcggtttacggcgcgcgttcggatatttacgttcgtagtttcgcggagtcgggtcgcgtaggcgcgcgcgagtttatatacgcgtatttatatacgtacgttcgtcgcgcgttcggttcgtcgtttagttcgtcgtttagttttttttttgggcggggattcgttcgtcgttagtttaggttgaggcgttttgcgtgtgtttataattttgtgttgttgtcgcggtcgttttgttcgtggaagggaggaggaggaatgtggaaggtggcggcgcgcgagttgataggcggtttttcgggcgggttgcggcgacggttcgagcgtttttttttcgtcgaggttgcgcgtttttttttcgtcgtgtttcgggttcgcgcgggatcgtgcgtcgtttcgtcgcgtttttgaagggaaggaagcgaggtaggcgtcggagtcgtgtagcgggcggtcgttttttcggtgatttcggatttgttttcgagttgggtcgggcgttttttttttttttttttgagtcgcggtgtgcgcgttttttttttcgttcgttagtgtttttaaaggattcgggaagggggaaattgttaagatggtagtagcgggagtaaggaggtgatgaacgtgttggttcgggttttttagtagttcgggagatttggcgtttttcgatttgttggaagatttatgtttcgattcgttttttttttcggatttcgattgggaagggggcggaggggacgacgttcgcgagaatgtaaattatataaaatttcgaagtggtcgttttcgtcgggttt

SEQ ID NO: 29688 - DNA, 969 bp, Artificial Sequence
  chemically treated genomic DNA (Homo sapiens) CpG-island No: 29688
aaacccgacgaaaacgaccacttcgaaattttatataatttacattctcgcgaacgtcgtcccctccgcccccttcccaatcgaaatccgaaaaaaaaaacgaatcgaaacataaatcttccaacaaatcgaaaaacgccaaatctcccgaactactaaaaaacccgaaccaacacgttcatcacctccttactcccgctactaccatcttaacaatttcccccttcccgaatcctttaaaaacactaacgaacgaaaaaaaaaacgcgcacaccgcgactcaaaaaaaaaaaaaaaaaacgcccgacccaactcgaaaacaaatccgaaatcaccgaaaaaacgaccgcccgctacacgactccgacgcctacctcgcttccttcccttcaaaaacgcgacgaaacgacgcacgatcccgcgcgaacccgaaacacgacgaaaaaaaaacgcgcaacctcgacgaaaaaaaaacgctcgaaccgtcgccgcaacccgcccgaaaaaccgcctatcaactcgcgcgccgccaccttccacattcctcctcctcccttccacgaacaaaacgaccgcgacaacaacacaaaattataaacacacgcaaaacgcctcaacctaaactaacgacgaacgaatccccgcccaaaaaaaaaactaaacgacgaactaaacgacgaaccgaacgcgcgacgaacgtacgtatataaatacgcgtatataaactcgcgcgcgcctacgcgacccgactccgcgaaactacgaacgtaaatatccgaacgcgcgccgtaaaccgaaactcgacgaactcccgctactatccccgctaaactcctcctccctcccgaaaatctcaacgacaacaaaacgcgacgctaacccgaaaaaaaaaaaaaaaaaaaaaaaaaaaaaaaaaaaaaaaaaaaaataaaaaaaaaaaaaaaaaaaaaaaacgacaaaaacgcacaa

SEQ ID NO: 29689 - DNA, 1059 bp, Artificial Sequence
  chemically treated genomic DNA (Homo sapiens) CpG-island No: 29689
agtagggacgttagggatagtcgttatcgttgcgttcgttcggagtcggcgtaaggtttgtcgttcggtttgggagtttagtagtagtagtagtagtagatagttagcgcggcggcgtttttttcgggttatatttaagcgtttttgaatatattttaggggggttcgggttggagggaataggtaggcgcgaggttagacggtcgtttggggcgggcgggttgcgcgtcgttttgcgtttttcggcgtcgtttaggttttatttcgggggttgtatggtgaggtaggtcggtcggttcgatgtttcgtttaggtcggagtcgcggggcgttttggtgtcgttttcgcgtcgttttcgcgtttcgtcgtttttagttcgggcgtcgtcgttcggttcgttaggcgttgttcggcgtttcggttgggggcggtgcggggtattggggcggtggcggttgcggcggcggcgtcgtattttttatagtgtcgggttttttagttgttttcggattcgtgttattttatttcgcgtcggcggtcgttcggttcgtattttaaatcggtcgtttcggttcggcgtagttttgcgttttttagcgtcgtcgtgcgggtttcgtcgtcgcgtttcgtttcgtttttttcgtttcgcgtcgtttcgttttcgttcgttcgttcgttgttcgttttacgtcgttttttgtttcgttcgcgtttttttaggtcggtcggtcggttcgttgtcgggtttttcgggtttcgttcgcgtttcgggtgttcgtcggggttagtttttggcgggtttcgttttggtttcgtattcgttgtttttggagtttcggttcgggcgggttatttggttttcggtagcgttataggcgtcggacgtagatatcgggttttatttagtgcgtttttcgttttcgtttttcgttcgtatcgttgtggttgtagtttagcggtacggtttcgtggttttcgttggttatgtatttttagtttgtcgttatttttcgttgtgcggagaatattttgagagtttttgtgtaagtgtgtttggcg

SEQ ID NO: 29690 - DNA, 1059 bp, Artificial Sequence
  chemically treated genomic DNA (Homo sapiens) CpG-island No: 29690
cgccaaacacacttacacaaaaactctcaaaatattctccgcacaacgaaaaataacgacaaactaaaaatacataaccaacgaaaaccacgaaaccgtaccgctaaactacaaccacaacgatacgaacgaaaaacgaaaacgaaaaacgcactaaataaaacccgatatctacgtccgacgcctataacgctaccgaaaaccaaataacccgcccgaaccgaaactccaaaaacaacgaatacgaaaccaaaacgaaacccgccaaaaactaaccccgacgaacacccgaaacgcgaacgaaacccgaaaaacccgacaacgaaccgaccgaccgacctaaaaaaacgcgaacgaaacaaaaaacgacgtaaaacgaacaacgaacgaacgaacgaaaacgaaacgacgcgaaacgaaaaaaacgaaacgaaacgcgacgacgaaacccgcacgacgacgctaaaaaacgcaaaactacgccgaaccgaaacgaccgatttaaaatacgaaccgaacgaccgccgacgcgaaataaaataacacgaatccgaaaacaactaaaaaacccgacactataaaaaatacgacgccgccgccgcaaccgccaccgccccaataccccgcaccgcccccaaccgaaacgccgaacaacgcctaacgaaccgaacgacgacgcccgaactaaaaacgacgaaacgcgaaaacgacgcgaaaacgacaccaaaacgccccgcgactccgacctaaacgaaacatcgaaccgaccgacctacctcaccatacaacccccgaaataaaacctaaacgacgccgaaaaacgcaaaacgacgcgcaacccgcccgccccaaacgaccgtctaacctcgcgcctacctattccctccaacccgaacccccctaaaatatattcaaaaacgcttaaatataacccgaaaaaaacgccgccgcgctaactatctactactactactactactaaactcccaaaccgaacgacaaaccttacgccgactccgaacgaacgcaacgataacgactatccctaacgtccctact

SEQ ID NO: 29691 - DNA, 1059 bp, Artificial Sequence
  chemically treated genomic DNA (Homo sapiens) CpG-island No: 29691
cgttaaatatatttgtataggggtttttaaggtgtttttcgtatagcggaagatggcgatagattgagggtgtatggttagcgggagttacggggtcgtgtcgttgggttgtagttatagcggtgcgaacgagaggcggaagcgagaggcgtattaagtaaagttcggtgtttgcgttcggcgtttgtggcgttgtcgggagttaggtggttcgttcgagtcggaattttaggagtagcgggtgcggagttagagcggagttcgttagggattggtttcggcgaatattcggagcgcgaacgaagttcgaagggttcggtaacggatcggtcggtcggtttaggagggcgcgagcgaggtagggagcggcgtggagcgggtagcgggcggacgggcgggagcggagcggcgcggggcgaggggagcggagcggagcgcggcggcggggttcgtacggcggcgttgaggggcgtagagttgcgtcgaatcgagacggtcggtttggagtgcgagtcgggcggtcgtcggcgcggagtgaagtggtacggattcgagggtagttgaggggttcgatattatgaggagtgcggcgtcgtcgtcgtagtcgttatcgttttagtgtttcgtatcgtttttagtcgggacgtcgggtagcgtttagcgggtcgggcggcggcgttcgggttgagagcgacggagcgcgggagcggcgcggagacggtattagagcgtttcgcgatttcggtttgagcggggtatcgggtcggtcggtttgttttattatgtagttttcgaggtagagtttggacggcgtcgaggagcgtagagcggcgcgtagttcgttcgttttagacggtcgtttggtttcgcgtttgtttgttttttttagttcggatttttttgaaatatgtttaggggcgtttggatgtggttcgggaaagacgtcgtcgcgttgattatttgttgttgttgttgttgttgggtttttaggtcgagcgataaattttgcgtcgatttcgagcgggcgtagcgatggcgattgtttttggcgtttttgtt

SEQ ID NO: 29692 - DNA, 1059 bp, Artificial Sequence
  chemically treated genomic DNA (Homo sapiens) CpG-island No: 29692
aacaaaaacgccaaaaacaatcgccatcgctacgcccgctcgaaatcgacgcaaaatttatcgctcgacctaaaaacccaacaacaacaacaacaacaaataatcaacgcgacgacgtctttcccgaaccacatccaaacgcccctaaacatatttcaaaaaaatccgaactaaaaaaaacaaacaaacgcgaaaccaaacgaccgtctaaaacgaacgaactacgcgccgctctacgctcctcgacgccgtccaaactctacctcgaaaactacataataaaacaaaccgaccgacccgataccccgctcaaaccgaaatcgcgaaacgctctaataccgtctccgcgccgctcccgcgctccgtcgctctcaacccgaacgccgccgcccgacccgctaaacgctacccgacgtcccgactaaaaacgatacgaaacactaaaacgataacgactacgacgacgacgccgcactcctcataatatcgaacccctcaactaccctcgaatccgtaccacttcactccgcgccgacgaccgcccgactcgcactccaaaccgaccgtctcgattcgacgcaactctacgcccctcaacgccgccgtacgaaccccgccgccgcgctccgctccgctcccctcgccccgcgccgctccgctcccgcccgtccgcccgctacccgctccacgccgctccctacctcgctcgcgccctcctaaaccgaccgaccgatccgttaccgaacccttcgaacttcgttcgcgctccgaatattcgccgaaaccaatccctaacgaactccgctctaactccgcacccgctactcctaaaattccgactcgaacgaaccacctaactcccgacaacgccacaaacgccgaacgcaaacaccgaactttacttaatacgcctctcgcttccgcctctcgttcgcaccgctataactacaacccaacgacacgaccccgtaactcccgctaaccatacaccctcaatctatcgccatcttccgctatacgaaaaacaccttaaaaacccctatacaaatatatttaacg

SEQ ID NO: 29693 - DNA, 750 bp, Artificial Sequence
  chemically treated genomic DNA (Homo sapiens) CpG-island No: 29693
ggtcgacgtcgagtttgtcgttttttttcgcgcgggtataggaaaggtggagttcgtagtcgtgggtttcgtttcgtggcgcggagggtcggggtttcggcgtcgtttcgtttttcgtttcgttattgcggtacggttgagttattatcgttttcgtttcgcggcggggtcgtttaggttagaggtcgggaaggtcgcgtttttcgggtttggatagtcgtcggggtcggagttagggttggggtcggggtttttaggcgagtttcgcgttttgttcgttgtttcggggcggggaatttgcggttcgggttatttacgcggaggttcgggggagtttacgggtggcgtcgggttcggtttttcgaggtcgaagggagtcgggtattaagaagttaggttgggttattcgtcgttttatatcggttcggtttcgcggtcgttttcgtttcggttttttatttttatcgttcgtcgtttcgtttatttggttttgaggcgtagtagttttttaaattgttcggttgagtcgattttttttacggtcgttatagttgttttagtcgttttcgtcgttatgttgtcgtcgttagatagaagtaatttagtgtcggcggtcggatgtgggcggggttacggggagttgagcggttgcgcgagggaaagtttcgtttttgtttgcgttgaggttgtcgagtttgagaaattttaaaaggggtttcggcggcgggttttggatttcgttggggggtt

SEQ ID NO: 29694 - DNA, 750 bp, Artificial Sequence
  chemically treated genomic DNA (Homo sapiens) CpG-island No: 29694
aaccccccaacgaaatccaaaacccgccgccgaaaccccttttaaaatttctcaaactcgacaacctcaacgcaaacaaaaacgaaactttccctcgcgcaaccgctcaactccccgtaaccccgcccacatccgaccgccgacactaaattacttctatctaacgacgacaacataacgacgaaaacgactaaaacaactataacgaccgtaaaaaaaatcgactcaaccgaacaatttaaaaaactactacgcctcaaaaccaaataaacgaaacgacgaacgataaaaataaaaaaccgaaacgaaaacgaccgcgaaaccgaaccgatataaaacgacgaataacccaacctaacttcttaatacccgactcccttcgacctcgaaaaaccgaacccgacgccacccgtaaactcccccgaacctccgcgtaaataacccgaaccgcaaattccccgccccgaaacaacgaacaaaacgcgaaactcgcctaaaaaccccgaccccaaccctaactccgaccccgacgactatccaaacccgaaaaacgcgaccttcccgacctctaacctaaacgaccccgccgcgaaacgaaaacgataataactcaaccgtaccgcaataacgaaacgaaaaacgaaacgacgccgaaaccccgaccctccgcgccacgaaacgaaacccacgactacgaactccacctttcctatacccgcgcgaaaaaaaacgacaaactcgacgtcgacc

SEQ ID NO: 29695 - DNA, 750 bp, Artificial Sequence
  chemically treated genomic DNA (Homo sapiens) CpG-island No: 29695
agttttttagcgggatttagagttcgtcgtcgaggttttttttgggattttttaggttcggtagttttagcgtaggtaggggcggggttttttttcgcgtagtcgtttagtttttcgtggtttcgtttatattcggtcgtcggtattggattgtttttgtttggcggcggtagtatggcggcgggggcggttgaggtagttgtagcggtcgtggaggaggtcggtttagtcgggtagtttgaggagttgttgcgttttaaagttaagtaagcggggcggcgagcggtaggagtgaggagtcggagcgggagcggtcgcgagatcgggtcggtgtggggcggcgggtggtttagtttggttttttggtgttcggtttttttcggtttcgggggatcgggttcggcgttattcgtagattttttcgagttttcgcgtgagtggttcgagtcgtaggtttttcgtttcggaatagcgagtagggcgcgaggttcgtttggaagtttcggttttagttttggtttcgatttcgacggttgtttaagttcgggggacgcgattttttcggtttttggtttgggcggtttcgtcgcgggacggaggcggtggtgatttagtcgtgtcgtagtggcggggcgggggacggggcggcgtcgagatttcggtttttcgcgttacggagcgggatttacggttgcgggttttattttttttgtgttcgcgcgggggggagcggtaggttcggcgtcggtt

SEQ ID NO: 29696 - DNA, 750 bp, Artificial Sequence
  chemically treated genomic DNA (Homo sapiens) CpG-island No: 29696
aaccgacgccgaacctaccgctcccccccgcgcgaacacaaaaaaaataaaacccgcaaccgtaaatcccgctccgtaacgcgaaaaaccgaaatctcgacgccgccccgtcccccgccccgccactacgacacgactaaatcaccaccgcctccgtcccgcgacgaaaccgcccaaaccaaaaaccgaaaaaatcgcgtcccccgaacttaaacaaccgtcgaaatcgaaaccaaaactaaaaccgaaacttccaaacgaacctcgcgccctactcgctattccgaaacgaaaaacctacgactcgaaccactcacgcgaaaactcgaaaaaatctacgaataacgccgaacccgatcccccgaaaccgaaaaaaaccgaacaccaaaaaaccaaactaaaccacccgccgccccacaccgacccgatctcgcgaccgctcccgctccgactcctcactcctaccgctcgccgccccgcttacttaactttaaaacgcaacaactcctcaaactacccgactaaaccgacctcctccacgaccgctacaactacctcaaccgcccccgccgccatactaccgccgccaaacaaaaacaatccaataccgacgaccgaatataaacgaaaccacgaaaaactaaacgactacgcgaaaaaaaaccccgcccctacctacgctaaaactaccgaacctaaaaaatcccaaaaaaaacctcgacgacgaactctaaatcccgctaaaaaact

SEQ ID NO: 29697 - DNA, 669 bp, Artificial Sequence
  chemically treated genomic DNA (Homo sapiens) CpG-island No: 29697
gttacgtaggtatcgcggattttatttcgttttcgtaggtagagtacggtgcgtgtaggtaacgttcgagtcggtcgtagtattaggtgagtttcgtatacgtgtgtaggtatgcgttttcggtttggcgcgttttcgagacgttttagtcgtttcgtttgcgaaggaggttcggataggtcggtcgcgcgttttggatttagtatacggcggggcgcgcgtttcggtattcgcgggtttatttttgcgtttttttcggttttcgtacgttttttggcgttaggagatcgtttttgtagaaggcgaggtcgggttgaagcgcggtgcgtagcgttttcgcgtggatacgcgtcgttatcgttcgtcgtcgaggtttgtagtcgacgtggtttatttgggatttgtcgcgcgttgatttcgatggtgtagtagcgattagggtacgagggtattatggatcgttttgtatacgtggaaattgaggttttcgaggttttggagatggtgtattgatttcgtatatgatagtagatttagttcgcgtttcggttttgtttttttaaatttatataaggtcgtagcggtagtaaagtttttagttggcgcggggttttggatattatttgtcgtcgttggtttcggggtgtttttgtagttttaacgtttagg

SEQ ID NO: 29698 - DNA, 669 bp, Artificial Sequence
  chemically treated genomic DNA (Homo sapiens) CpG-island No: 29698
cctaaacgttaaaactacaaaaacaccccgaaaccaacgacgacaaataatatccaaaaccccgcgccaactaaaaactttactaccgctacgaccttatataaatttaaaaaaacaaaaccgaaacgcgaactaaatctactatcatatacgaaatcaatacaccatctccaaaacctcgaaaacctcaatttccacgtatacaaaacgatccataataccctcgtaccctaatcgctactacaccatcgaaatcaacgcgcgacaaatcccaaataaaccacgtcgactacaaacctcgacgacgaacgataacgacgcgtatccacgcgaaaacgctacgcaccgcgcttcaacccgacctcgccttctacaaaaacgatctcctaacgccaaaaaacgtacgaaaaccgaaaaaaacgcaaaaataaacccgcgaataccgaaacgcgcgccccgccgtatactaaatccaaaacgcgcgaccgacctatccgaacctccttcgcaaacgaaacgactaaaacgtctcgaaaacgcgccaaaccgaaaacgcatacctacacacgtatacgaaactcacctaatactacgaccgactcgaacgttacctacacgcaccgtactctacctacgaaaacgaaataaaatccgcgatacctacgtaac

SEQ ID NO: 29699 - DNA, 669 bp, Artificial Sequence
  chemically treated genomic DNA (Homo sapiens) CpG-island No: 29699
tttggacgttggggttgtagggatatttcggggttagcgacggtaggtgatgtttagggtttcgcgttaattgggagttttgttgtcgttgcggttttgtgtgaatttggagggataaggtcggggcgcgaattgaatttattgttatatgcggagttaatgtattatttttaggatttcgaaagttttagtttttacgtatgtaaaacggtttatggtgttttcgtattttggtcgttgttgtattatcgaggttagcgcgcggtaagttttaggtaggttacgtcggttgtagatttcggcggcgggcggtggcggcgcgtgtttacgcgagggcgttgcgtatcgcgttttagttcgatttcgttttttgtaggggcggttttttggcgttagggggcgtgcgaggatcgaggagagcgtaagagtaagttcgcgggtgtcggagcgcgcgtttcgtcgtgtgttgggtttagggcgcgcggtcggtttgttcgggtttttttcgtagacgaagcggttggaacgtttcgggggcgcgttaagtcgggggcgtatgtttgtatacgtgtgcggggtttatttggtgttgcggtcggttcgggcgttgtttgtacgtatcgtgttttatttgcgggagcggagtggagttcgcggtgtttgcgtggt

SEQ ID NO: 29700 - DNA, 669 bp, Artificial Sequence
  chemically treated genomic DNA (Homo sapiens) CpG-island No: 29700
accacgcaaacaccgcgaactccactccgctcccgcaaataaaacacgatacgtacaaacaacgcccgaaccgaccgcaacaccaaataaaccccgcacacgtatacaaacatacgcccccgacttaacgcgcccccgaaacgttccaaccgcttcgtctacgaaaaaaacccgaacaaaccgaccgcgcgccctaaacccaacacacgacgaaacgcgcgctccgacacccgcgaacttactcttacgctctcctcgatcctcgcacgccccctaacgccaaaaaaccgcccctacaaaaaacgaaatcgaactaaaacgcgatacgcaacgccctcgcgtaaacacgcgccgccaccgcccgccgccgaaatctacaaccgacgtaacctacctaaaacttaccgcgcgctaacctcgataatacaacaacgaccaaaatacgaaaacaccataaaccgttttacatacgtaaaaactaaaactttcgaaatcctaaaaataatacattaactccgcatataacaataaattcaattcgcgccccgaccttatccctccaaattcacacaaaaccgcaacgacaacaaaactcccaattaacgcgaaaccctaaacatcacctaccgtcgctaaccccgaaatatccctacaaccccaacgtccaaa

SEQ ID NO: 29701 - DNA, 986 bp, Artificial Sequence
  chemically treated genomic DNA (Homo sapiens) CpG-island No: 29701
tatcgtttcgcgggagtttaggaattgttttataatagtcgaaattcgggtcgtttattttaacggatttttttttcgttggatacgggggtcgtgagaggttaaataattttcgcgaggttattttcgtagcgatcgttcggcgggcgttttatttttttatcggattgtatatttcgttttttggggtttgaggcgggaattcgggtcgcgttgtttcgaggtttcggcggatcgcgaaaggatggtttattattcggttagggttagtttttgtaataagtttagtttcgttcgttttcgcgtttaggagcggtcggcggggcggggtggttgggtcggtttcgggggcgggggttcgggggcgggggtttaggggcggggttacgtggtttttttttgcgggcggaggtaggcggtgtcgcggcgtcgggattcgatttattcggtgtttgcgtgtggtggtgagcgtagcgtcgaggatgaggaggtgtaatagcggtttcgggtcgtcgtcgtcgttgttgttgttgttgttgtggttgttcgcggttttcggcgttaacgcggtttcgcggtcggcgttttattcgtttttcgattcgttgacgttgttgtaggcggatacggtgcgcggcgcggtgttgggttttcgtagcgtttgggtcgtggagtttttcgttttttggtgcggttattgtatcgttttcgtttcgacgtggaaggcgttggtcgaagacgttaaaggtgagaagcgggggcggttcgttttttcgtgtttcgtcgttcggatttttttatttgttcggtgggtagttttttatttcgggagcgcgttttttttttagttattttcgtttattttttttttttcgcgtattttacgtttattatttttatgttttttagttttatttttgtttttcgtttttttgttttttttttttggtttttatttcgagttttttttttttttcgcggtttgg

SEQ ID NO: 29702 - DNA, 986 bp, Artificial Sequence
  chemically treated genomic DNA (Homo sapiens) CpG-island No: 29702
ccaaaccgcgaaaaaaaaaaaaaactcgaaataaaaaccaaaaaaaaaaaacaaaaaaacgaaaaacaaaaataaaactaaaaaacataaaaataataaacgtaaaatacgcgaaaaaaaaaaaataaacgaaaataactaaaaaaaaaacgcgctcccgaaataaaaaactacccaccgaacaaataaaaaaatccgaacgacgaaacacgaaaaaacgaaccgcccccgcttctcacctttaacgtcttcgaccaacgccttccacgtcgaaacgaaaacgatacaataaccgcaccaaaaaacgaaaaactccacgacccaaacgctacgaaaacccaacaccgcgccgcgcaccgtatccgcctacaacaacgtcaacgaatcgaaaaacgaataaaacgccgaccgcgaaaccgcgttaacgccgaaaaccgcgaacaaccacaacaacaacaacaacaacgacgacgacgacccgaaaccgctattacacctcctcatcctcgacgctacgctcaccaccacacgcaaacaccgaataaatcgaatcccgacgccgcgacaccgcctacctccgcccgcaaaaaaaaaccacgtaaccccgcccctaaacccccgcccccgaacccccgcccccgaaaccgacccaaccaccccgccccgccgaccgctcctaaacgcgaaaacgaacgaaactaaacttattacaaaaactaaccctaaccgaataataaaccatcctttcgcgatccgccgaaacctcgaaacaacgcgacccgaattcccgcctcaaaccccaaaaaacgaaatatacaatccgataaaaaaataaaacgcccgccgaacgatcgctacgaaaataacctcgcgaaaattatttaacctctcacgacccccgtatccaacgaaaaaaaaatccgttaaaataaacgacccgaatttcgactattataaaacaattcctaaactcccgcgaaacgata

SEQ ID NO: 29703 - DNA, 986 bp, Artificial Sequence
  chemically treated genomic DNA (Homo sapiens) CpG-island No: 29703
ttaggtcgcggagagggaaagaagttcgggatgagggttaagaggaaaaggtaagggagcgggaggtaaaaatggagttgagaaatatgaaggtggtgggcgtgggatgcgcggagaggaagaggtgggcggaggtgattggaagagggacgcgttttcggagtaggaggttgtttatcgggtaggtggaggggttcgggcggcggggtacgggggagcgggtcgttttcgttttttatttttgacgttttcggttagcgttttttacgtcggggcgaaggcgatgtagtggtcgtattaggaggcgaagaattttacggtttaggcgttgcgggagtttagtatcgcgtcgcgtatcgtgttcgtttgtagtagcgttagcgggtcggaaggcgaatagagcgtcgatcgcggggtcgcgttagcgtcgggaatcgcgagtagttatagtagtagtagtagtagcgacggcggcggttcggagtcgttgttgtatttttttattttcggcgttgcgtttattattatacgtaagtatcggatgagtcgggtttcggcgtcgcggtatcgtttgttttcgttcgtaaggaggagttacgtggtttcgtttttgagttttcgttttcgagttttcgttttcgaggtcggtttagttatttcgtttcgtcggtcgtttttgggcgcgggagcgggcggggttgagtttgttgtaggggttggttttggtcgggtggtgagttattttttcgcggttcgtcgaggtttcggagtagcgcgattcgggttttcgttttaggttttaggaggcgaggtgtatagttcggtaaaggaatggagcgttcgtcgagcggtcgttgcgggggtagtttcgcggaggttgtttggttttttacggttttcgtatttaacggaagaggagttcgttggaatagacgattcggatttcggttgttgtagggtagtttttgggttttcgcggagcgatg

SEQ ID NO: 29704 - DNA, 986 bp, Artificial Sequence
  chemically treated genomic DNA (Homo sapiens) CpG-island No: 29704
catcgctccgcgaaaacccaaaaactaccctacaacaaccgaaatccgaatcgtctattccaacgaactcctcttccgttaaatacgaaaaccgtaaaaaaccaaacaacctccgcgaaactacccccgcaacgaccgctcgacgaacgctccattcctttaccgaactatacacctcgcctcctaaaacctaaaacgaaaacccgaatcgcgctactccgaaacctcgacgaaccgcgaaaaaataactcaccacccgaccaaaaccaacccctacaacaaactcaaccccgcccgctcccgcgcccaaaaacgaccgacgaaacgaaataactaaaccgacctcgaaaacgaaaactcgaaaacgaaaactcaaaaacgaaaccacgtaactcctccttacgaacgaaaacaaacgataccgcgacgccgaaacccgactcatccgatacttacgtataataataaacgcaacgccgaaaataaaaaaatacaacaacgactccgaaccgccgccgtcgctactactactactactataactactcgcgattcccgacgctaacgcgaccccgcgatcgacgctctattcgccttccgacccgctaacgctactacaaacgaacacgatacgcgacgcgatactaaactcccgcaacgcctaaaccgtaaaattcttcgcctcctaatacgaccactacatcgccttcgccccgacgtaaaaaacgctaaccgaaaacgtcaaaaataaaaaacgaaaacgacccgctcccccgtaccccgccgcccgaacccctccacctacccgataaacaacctcctactccgaaaacgcgtccctcttccaatcacctccgcccacctcttcctctccgcgcatcccacgcccaccaccttcatatttctcaactccatttttacctcccgctcccttaccttttcctcttaaccctcatcccgaacttctttccctctccgcgacctaa

SEQ ID NO: 29705 - DNA, 706 bp, Artificial Sequence
  chemically treated genomic DNA (Homo sapiens) CpG-island No: 29705
gcgtgacggttagcgtttgtaggatcgttagtgtaattttattttagttggcgggaagttggagagcgcgtttttcgtttttggggttggcggcggagaagtttcggttatatttttagtttttgcggttcgcgtttcgggcgtgcgtgtcgggtgagtttttagtcgttattgttcgcggcgttcgtcgcgtgcgtcgcgggaaattgattgttttttgtgagggaatttgttcgcgtattttagttagtttaggaatgtaggggagggagaagcgatcgtaagttgtgaatttcgggtttagtttttgcgtacgcgagggtaggtgtttagggtggttcgggtttggaggggtagagacgcgggtgtgtgggagttttgttagtttgttcgttcgtttttttttcgcgttcgaaattagcgagatagtcggagttcgcggcgtgtttatttttaagtttttttttgtgtgtatgggtgtgcgcgcgtagagattttttcgaagggaattcgtttttgtgttttatttttgagcgagagttttcgagagggaatttgtgtagaggttagaataggtgtttagtcgtcgcgcgcgcgcgcgcgcgcgcgataagcgtcgggagagttttgtttttgtggtttgtacgtttagtagggcgtttcgggtattttggagagattaaggagtttttcgtttcgtttgtta

SEQ ID NO: 29706 - DNA, 706 bp, Artificial Sequence
  chemically treated genomic DNA (Homo sapiens) CpG-island No: 29706
taacaaacgaaacgaaaaactccttaatctctccaaaatacccgaaacgccctactaaacgtacaaaccacaaaaacaaaactctcccgacgcttatcgcgcgcgcgcgcgcgcgcgcgacgactaaacacctattctaacctctacacaaattccctctcgaaaactctcgctcaaaaataaaacacaaaaacgaattcccttcgaaaaaatctctacgcgcgcacacccatacacacaaaaaaaaacttaaaaataaacacgccgcgaactccgactatctcgctaatttcgaacgcgaaaaaaaaacgaacgaacaaactaacaaaactcccacacacccgcgtctctacccctccaaacccgaaccaccctaaacacctaccctcgcgtacgcaaaaactaaacccgaaattcacaacttacgatcgcttctccctcccctacattcctaaactaactaaaatacgcgaacaaattccctcacaaaaaacaatcaatttcccgcgacgcacgcgacgaacgccgcgaacaataacgactaaaaactcacccgacacgcacgcccgaaacgcgaaccgcaaaaactaaaaatataaccgaaacttctccgccgccaaccccaaaaacgaaaaacgcgctctccaacttcccgccaactaaaataaaattacactaacgatcctacaaacgctaaccgtcacgc

SEQ ID NO: 29707 - DNA, 706 bp, Artificial Sequence
  chemically treated genomic DNA (Homo sapiens) CpG-island No: 29707
tggtaagcggagcgaggaattttttggtttttttagggtgttcggggcgttttgttgagcgtgtaagttataggggtaggattttttcggcgtttgtcgcgcgcgcgcgcgcgcgcgcgacgattgggtatttgttttggtttttgtatagattttttttcggggattttcgtttaggagtgaagtatagagacggatttttttcgggaaaatttttgcgcgcgtatatttatatatatagagagagatttggggataaatacgtcgcgagtttcggttgtttcgttaatttcgggcgcgggaagaaagcgggcgggtaggttagtaaagtttttatatattcgcgtttttatttttttaaattcgagttattttgagtatttgttttcgcgtgcgtaaaggttgaattcggaatttataatttgcggtcgttttttttttttttgtatttttaggttagttggaatgcgcgagtagatttttttataaggagtagttagtttttcgcggcgtacgcggcgggcgtcgcgggtagtagcggttggggatttattcggtacgtacgttcggggcgcgggtcgtagggattaagagtgtggtcggggttttttcgtcgttagttttaggggcgagagacgcgttttttaatttttcgttagttggggtgaagttgtattagcggttttgtaagcgttgatcgttacgt

SEQ ID NO: 29708 - DNA, 706 bp, Artificial Sequence
  chemically treated genomic DNA (Homo sapiens) CpG-island No: 29708
acgtaacgatcaacgcttacaaaaccgctaatacaacttcaccccaactaacgaaaaattaaaaaacgcgtctctcgcccctaaaactaacgacgaaaaaaccccgaccacactcttaatccctacgacccgcgccccgaacgtacgtaccgaataaatccccaaccgctactacccgcgacgcccgccgcgtacgccgcgaaaaactaactactccttataaaaaaatctactcgcgcattccaactaacctaaaaatacaaaaaaaaaaaaaacgaccgcaaattataaattccgaattcaacctttacgcacgcgaaaacaaatactcaaaataactcgaatttaaaaaaataaaaacgcgaatatataaaaactttactaacctacccgcccgctttcttcccgcgcccgaaattaacgaaacaaccgaaactcgcgacgtatttatccccaaatctctctctatatatataaatatacgcgcgcaaaaattttcccgaaaaaaatccgtctctatacttcactcctaaacgaaaatccccgaaaaaaaatctatacaaaaaccaaaacaaatacccaatcgtcgcgcgcgcgcgcgcgcgcgcgacaaacgccgaaaaaatcctacccctataacttacacgctcaacaaaacgccccgaacaccctaaaaaaaccaaaaaattcctcgctccgcttacca

SEQ ID NO: 29709 - DNA, 549 bp, Artificial Sequence
  chemically treated genomic DNA (Homo sapiens) CpG-island No: 29709
tcgttttcgtaggttttcgtgcggatttagtagttcgcgtcgtagtttttttggatttttatcgcgttttggtcgcgcggttttcggtgcgggtttcgtcgtttcgatagttttatagttgtttttacggttcgtatcgatagttcgttttcgttattttttttcgggttgtagggacgtcgagattcgaatttttatagcgtttgattcggggtcgtgttgggtacgggtacggcgagagtttttcgagtcgtttttaaaatttttttcgcggattttagtagtttttttacgcgtcggggttttgttggtcggttatgttttttgaggagacgcggaaaagcgcgaggtatataggaaggtggggcgttttattcgtttcggttttgatttatttgttatgtagtttttttaggtatcgagggaaaggacgacggaagttcgtcgttcggatcgttggcgggagagagggtagttcgtacgggagaaggaggagtttcgcggggttttcgttgggggtggtaattggaatgtaggtttgggggtttt

SEQ ID NO: 29710 - DNA, 549 bp, Artificial Sequence
  chemically treated genomic DNA (Homo sapiens) CpG-island No: 29710
aaaacccccaaacctacattccaattaccacccccaacgaaaaccccgcgaaactcctccttctcccgtacgaactaccctctctcccgccaacgatccgaacgacgaacttccgtcgtcctttccctcgatacctaaaaaaactacataacaaataaatcaaaaccgaaacgaataaaacgccccaccttcctatatacctcgcgcttttccgcgtctcctcaaaaaacataaccgaccaacaaaaccccgacgcgtaaaaaaactactaaaatccgcgaaaaaaattttaaaaacgactcgaaaaactctcgccgtacccgtacccaacacgaccccgaatcaaacgctataaaaattcgaatctcgacgtccctacaacccgaaaaaaaataacgaaaacgaactatcgatacgaaccgtaaaaacaactataaaactatcgaaacgacgaaacccgcaccgaaaaccgcgcgaccaaaacgcgataaaaatccaaaaaaactacgacgcgaactactaaatccgcacgaaaacctacgaaaacga

SEQ ID NO: 29711 - DNA, 549 bp, Artificial Sequence
  chemically treated genomic DNA (Homo sapiens) CpG-island No: 29711
gagatttttaggtttgtattttaattattatttttagcggagatttcgcggggtttttttttttttcgtgcgggttgttttttttttcgttagcgattcgggcggcgggttttcgtcgttttttttttcggtgtttggggagattatatggtagatgggttaaaatcgaggcggataaaacgttttatttttttatatgtttcgcgttttttcgcgtttttttagagggtatggtcggttagtagggtttcgacgcgtggagggattgttgaggttcgcggggagagttttggaggcggttcggaaggttttcgtcgtattcgtatttaatacggtttcgggttaggcgttgtgaggattcggatttcgacgtttttatagttcggagggaggtggcggggacgagttgtcggtgcgggtcgtagggatagttgtagggttgtcggagcgacgaggttcgtatcgggggtcgcgcgattaaggcgcggtaaaaatttaggagggttacggcgcgaattgttaagttcgtacgggagtttgcgggggcgg

SEQ ID NO: 29712 - DNA, 549 bp, Artificial Sequence
  chemically treated genomic DNA (Homo sapiens) CpG-island No: 29712
ccgcccccgcaaactcccgtacgaacttaacaattcgcgccgtaaccctcctaaatttttaccgcgccttaatcgcgcgacccccgatacgaacctcgtcgctccgacaaccctacaactatccctacgacccgcaccgacaactcgtccccgccacctccctccgaactataaaaacgtcgaaatccgaatcctcacaacgcctaacccgaaaccgtattaaatacgaatacgacgaaaaccttccgaaccgcctccaaaactctccccgcgaacctcaacaatccctccacgcgtcgaaaccctactaaccgaccataccctctaaaaaaacgcgaaaaaacgcgaaacatataaaaaaataaaacgttttatccgcctcgattttaacccatctaccatataatctccccaaacaccgaaaaaaaaaacgacgaaaacccgccgcccgaatcgctaacgaaaaaaaaaacaacccgcacgaaaaaaaaaaaaaccccgcgaaatctccgctaaaaataataattaaaatacaaacctaaaaatctc

SEQ ID NO: 29713 - DNA, 520 bp, Artificial Sequence
  chemically treated genomic DNA (Homo sapiens) CpG-island No: 29713
aacgtaaagggtttgcgcgcgatgatttttagggttttttttaggtttagtgtggaattttttaatattttcgttcgttttttttttgcggagaattttttcgtatcgttgcggtcgggttcggttagagtttttcggtttttagagtattttgaggggaggagttttcgcgataggaaacgcgttaaaggggagggttggcggtaggaatcggttgaagaggggttgggttgtcggtagtgcgcgtcgtagagatttggagtttttcggttacggagttcgaagcgcgggaagttcggcggcgggacgggatgttcggtcggaatttatttcggtcgagtttcgaggtcgcgggagtcggcgcggcgaacgtcgggagtcgtagttttttcgttcgggcgtttcgggttagcggggtttatttcggttttatttaatttttcggtgttcggttttttaagttttcgtggggggcgtgtgtataaatttattttagaatttatttcgtttgttatgattt

SEQ ID NO: 29714 - DNA, 520 bp, Artificial Sequence
  chemically treated genomic DNA (Homo sapiens) CpG-island No: 29714
aaatcataacaaacgaaataaattctaaaataaatttatacacacgccccccacgaaaacttaaaaaaccgaacaccgaaaaattaaataaaaccgaaataaaccccgctaacccgaaacgcccgaacgaaaaaactacgactcccgacgttcgccgcgccgactcccgcgacctcgaaactcgaccgaaataaattccgaccgaacatcccgtcccgccgccgaacttcccgcgcttcgaactccgtaaccgaaaaactccaaatctctacgacgcgcactaccgacaacccaacccctcttcaaccgattcctaccgccaaccctcccctttaacgcgtttcctatcgcgaaaactcctcccctcaaaatactctaaaaaccgaaaaactctaaccgaacccgaccgcaacgatacgaaaaaattctccgcaaaaaaaaaacgaacgaaaatattaaaaaattccacactaaacctaaaaaaaaccctaaaaatcatcgcgcgcaaaccctttacgtt

SEQ ID NO: 29715 - DNA, 520 bp, Artificial Sequence
  chemically treated genomic DNA (Homo sapiens) CpG-island No: 29715
aagttatgataggcgaggtgggttttgaggtgagtttatgtatacgttttttacgggggtttagaaggtcgggtatcgagaggttaggtggggtcggggtagatttcgttgattcgaggcgttcgggcgggaggattgcggttttcggcgttcgtcgcgtcggttttcgcggtttcgagattcggtcgggatgggtttcgatcgggtatttcgtttcgtcgtcgggtttttcgcgtttcgggtttcgtggtcggagagttttaggtttttgcggcgcgtattgtcggtagtttagtttttttttagtcggtttttgtcgttagtttttttttttggcgcgttttttgtcgcggaagtttttttttttagggtgttttgaaagtcgggaggttttagtcgaattcggtcgtagcggtgcggggggatttttcgtagagagagggcgagcgagggtgttagggagttttatattgggtttgggaggggttttggaggttatcgcgcgtaggttttttgcgtt

SEQ ID NO: 29716 - DNA, 520 bp, Artificial Sequence
  chemically treated genomic DNA (Homo sapiens) CpG-island No: 29716
aacgcaaaaaacctacgcgcgataacctccaaaacccctcccaaacccaatataaaactccctaacaccctcgctcgccctctctctacgaaaaatccccccgcaccgctacgaccgaattcgactaaaacctcccgactttcaaaacaccctaaaaaaaaaaacttccgcgacaaaaaacgcgccaaaaaaaaaaactaacgacaaaaaccgactaaaaaaaaactaaactaccgacaatacgcgccgcaaaaacctaaaactctccgaccacgaaacccgaaacgcgaaaaacccgacgacgaaacgaaatacccgatcgaaacccatcccgaccgaatctcgaaaccgcgaaaaccgacgcgacgaacgccgaaaaccgcaatcctcccgcccgaacgcctcgaatcaacgaaatctaccccgaccccacctaacctctcgatacccgaccttctaaacccccgtaaaaaacgtatacataaactcacctcaaaacccacctcgcctatcataactt

SEQ ID NO: 29717 - DNA, 958 bp, Artificial Sequence
  chemically treated genomic DNA (Homo sapiens) CpG-island No: 29717
ggacggttttttcgggtggacggggtagagcgggttagcgggcgcgtgttcgatacgtttatcgggttttgtatttttcgggcgcgcgttcgtttttcgattcgtttcgtcgtttgtcgggttttgtggatttcgcgttcggggtcgcgtacgtttttttcgttcgtcgggattttgggttcgcgtatttcgcgtttttttttttttcggcgggcgcgcgcgttggttttcgttttcgttttcgttggcggcggcggcggcggcggcggcggggattgtttttgttgtcgttgaggtcggaagagtcggagtcgggtttttgttttcgggtcgggcgtcgtcgtcgttttttgtttagcgttcgcgttttcgcggcgttattttagcgttaatatttcggagattaagcgttacgcggcggcggcggcggcggcggcggggttcggagcgggaggcgtcggggatcggggcgaggcggttttcgtcgtcgttatggaggcgttgggattcggtgaggagcgagttcgggtcggggcgggattcgggattcgggattcggggcgggcggtcgggattttcgttgtttcgtcgtttcgtcgggttcgggtcgttaggtttcggggaaggggattcgagtttcgtagtacgaagcggagggagttgattcgggtttggggggcggtgatcgcgttttagtcggtcgttgggtggatttcgaggtttaggggggaggttcgggaaggtgatcggcgttgtcgggcggaggttatttttggttttatttcggggagacgatatgtgttcggggtcgcgacgagggtagtttgggttttagaagggggcgattcgttatttagtgcgcgcggaggtttggtttagatcgggaaaagggtttcgttgtttattattagtcggtagttttggtttggggtcgcgtttttatttttttttgtattgg

SEQ ID NO: 29718 - DNA, 958 bp, Artificial Sequence
  chemically treated genomic DNA (Homo sapiens) CpG-island No: 29718
ccaatacaaaaaaaaataaaaacgcgaccccaaaccaaaactaccgactaataataaacaacgaaacccttttcccgatctaaaccaaacctccgcgcgcactaaataacgaatcgcccccttctaaaacccaaactaccctcgtcgcgaccccgaacacatatcgtctccccgaaataaaaccaaaaataacctccgcccgacaacgccgatcaccttcccgaacctcccccctaaacctcgaaatccacccaacgaccgactaaaacgcgatcaccgccccccaaacccgaatcaactccctccgcttcgtactacgaaactcgaatccccttccccgaaacctaacgacccgaacccgacgaaacgacgaaacaacgaaaatcccgaccgcccgccccgaatcccgaatcccgaatcccgccccgacccgaactcgctcctcaccgaatcccaacgcctccataacgacgacgaaaaccgcctcgccccgatccccgacgcctcccgctccgaaccccgccgccgccgccgccgccgccgcgtaacgcttaatctccgaaatattaacgctaaaataacgccgcgaaaacgcgaacgctaaacaaaaaacgacgacgacgcccgacccgaaaacaaaaacccgactccgactcttccgacctcaacgacaacaaaaacaatccccgccgccgccgccgccgccgccgccaacgaaaacgaaaacgaaaaccaacgcgcgcgcccgccgaaaaaaaaaaaaacgcgaaatacgcgaacccaaaatcccgacgaacgaaaaaaacgtacgcgaccccgaacgcgaaatccacaaaacccgacaaacgacgaaacgaatcgaaaaacgaacgcgcgcccgaaaaatacaaaacccgataaacgtatcgaacacgcgcccgctaacccgctctaccccgtccacccgaaaaaaccgtcc

SEQ ID NO: 29719 - DNA, 958 bp, Artificial Sequence
  chemically treated genomic DNA (Homo sapiens) CpG-island No: 29719
ttagtgtaaagaaaaataggggcgcggttttaaattaggattatcggttggtagtaggtagcggggtttttttttcggtttgggttaggttttcgcgcgtattgggtagcggatcgtttttttttgaggtttaaattattttcgtcgcgatttcgggtatatatcgttttttcgaggtggggttaagagtggttttcgttcggtagcgtcggttattttttcgaattttttttttggatttcgggatttatttaacggtcggttggggcgcggttatcgttttttaggttcgggttagtttttttcgtttcgtgttgcggggttcgggttttttttttcgaggtttggcggttcgaattcggcgaggcgacggggtagcgaaagtttcggtcgttcgtttcgggtttcgggtttcgggtttcgtttcgattcgagttcgttttttatcgggttttagcgtttttatggcggcggcgggggtcgtttcgtttcggttttcggcgtttttcgtttcgggtttcgtcgtcgtcgtcgtcgtcgtcgcgtaacgtttgattttcggaatattggcgttggggtggcgtcgcggagacgcgggcgttgggtagggggcggcggcggcgttcggttcggggatagggattcggtttcggttttttcggttttagcgataataaaaataattttcgtcgtcgtcgtcgtcgtcgtcgttaacgggagcgggagcgggagttagcgcgcgcgttcgtcgggagggaagggggcgcggggtgcgcggatttagggtttcggcgggcggagggggcgtgcgcggtttcgggcgcggggtttatagagttcggtaggcggcgaggcgggtcggggaacgagcgcgcgttcggagggtgtagagttcggtggacgtgtcgggtacgcgttcgttggttcgttttgtttcgtttattcgaggaggtcgttt

SEQ ID NO: 29720 - DNA, 958 bp, Artificial Sequence
  chemically treated genomic DNA (Homo sapiens) CpG-island No: 29720
aaacgacctcctcgaataaacgaaacaaaacgaaccaacgaacgcgtacccgacacgtccaccgaactctacaccctccgaacgcgcgctcgttccccgacccgcctcgccgcctaccgaactctataaaccccgcgcccgaaaccgcgcacgccccctccgcccgccgaaaccctaaatccgcgcaccccgcgcccccttccctcccgacgaacgcgcgcgctaactcccgctcccgctcccgttaacgacgacgacgacgacgacgacgaaaattatttttattatcgctaaaaccgaaaaaaccgaaaccgaatccctatccccgaaccgaacgccgccgccgccccctacccaacgcccgcgtctccgcgacgccaccccaacgccaatattccgaaaatcaaacgttacgcgacgacgacgacgacgacgacgaaacccgaaacgaaaaacgccgaaaaccgaaacgaaacgacccccgccgccgccataaaaacgctaaaacccgataaaaaacgaactcgaatcgaaacgaaacccgaaacccgaaacccgaaacgaacgaccgaaactttcgctaccccgtcgcctcgccgaattcgaaccgccaaacctcgaaaaaaaaaacccgaaccccgcaacacgaaacgaaaaaaactaacccgaacctaaaaaacgataaccgcgccccaaccgaccgttaaataaatcccgaaatccaaaaaaaaaattcgaaaaaataaccgacgctaccgaacgaaaaccactcttaaccccacctcgaaaaaacgatatatacccgaaatcgcgacgaaaataatttaaacctcaaaaaaaaacgatccgctacccaatacgcgcgaaaacctaacccaaaccgaaaaaaaaaccccgctacctactaccaaccgataatcctaatttaaaaccgcgcccctatttttctttacactaa

SEQ ID NO: 29721 - DNA, 628 bp, Artificial Sequence
  chemically treated genomic DNA (Homo sapiens) CpG-island No: 29721
tgcgtttcggtttttttacgacgtacgttttggtgattgcggttcggggtattttttttgcgttcggatttttatttatcgtttacgtttattcgcgtcgtcgagttcgggagcgggggtttttgcggttgtcgtatgttttcggggtcgagcgcgacggggcgatcgggcgtcgggttttagtcgggcgcggagaagtagcggaggacgcggcgggcgggcggagcgttttttttttagcgatttttgcgacgcgtttagagttaaaggaaagtttggcggtgcgagggagggatttagggatagcggttttttttttgtttcgtttcgtttcgtcgggtgcgttcgacgtttttattggagagcgtttttaatttgtaaggtcgcgagttgcgtttaaaggggttcgtgcgagtcgcgggagggtagcgtttttgtagacgcgtttttgtttgggatcgtttttaggtgggtggtcggtcggtttcgagagggaaaagcgtttattaaaggatcgttagtatttataagttttacggagttatatttcggagtttcgtattagaacgtagtttttttgtttttttgtttttagagatttgtttgaagtggttgcgggaagtgtagt

SEQ ID NO: 29722 - DNA, 628 bp, Artificial Sequence
  chemically treated genomic DNA (Homo sapiens) CpG-island No: 29722
actacacttcccgcaaccacttcaaacaaatctctaaaaacaaaaaaacaaaaaaactacgttctaatacgaaactccgaaatataactccgtaaaacttataaatactaacgatcctttaataaacgcttttccctctcgaaaccgaccgaccacccacctaaaaacgatcccaaacaaaaacgcgtctacaaaaacgctaccctcccgcgactcgcacgaacccctttaaacgcaactcgcgaccttacaaattaaaaacgctctccaataaaaacgtcgaacgcacccgacgaaacgaaacgaaacaaaaaaaaaaccgctatccctaaatccctccctcgcaccgccaaactttcctttaactctaaacgcgtcgcaaaaatcgctaaaaaaaaaacgctccgcccgcccgccgcgtcctccgctacttctccgcgcccgactaaaacccgacgcccgatcgccccgtcgcgctcgaccccgaaaacatacgacaaccgcaaaaacccccgctcccgaactcgacgacgcgaataaacgtaaacgataaataaaaatccgaacgcaaaaaaaataccccgaaccgcaatcaccaaaacgtacgtcgtaaaaaaaccgaaacgca

SEQ ID NO: 29723 - DNA, 628 bp, Artificial Sequence
  chemically treated genomic DNA (Homo sapiens) CpG-island No: 29723
gttgtatttttcgtagttattttaaataaatttttgaggatagaggggtagagggattgcgttttaatacggagtttcgaggtatggtttcgtgaggtttgtgggtattagcggttttttagtgggcgtttttttttttcggggtcggtcgattatttatttggggacgattttaggtaggaacgcgtttgtaagagcgttgttttttcgcggttcgtacgggtttttttgagcgtagttcgcggttttgtaggttggggacgttttttagtgggaacgtcgaacgtattcggcggggcggggcggggtagggaaggggtcgttgtttttaggtttttttttcgtatcgttaaatttttttttggttttggacgcgtcgtaggggtcgttggagaggaggcgtttcgttcgttcgtcgcgtttttcgttgttttttcgcgttcggttggagttcggcgttcggtcgtttcgtcgcgttcgatttcgagggtatgcggtagtcgtaggggttttcgttttcgggttcggcggcgcgggtgaacgtgagcggtgagtgagggttcgggcgtagggagggtatttcgagtcgtagttattagggcgtgcgtcgtggggaggtcggggcgta

SEQ ID NO: 29724 - DNA, 628 bp, Artificial Sequence
  chemically treated genomic DNA (Homo sapiens) CpG-island No: 29724
tacgccccgacctccccacgacgcacgccctaataactacgactcgaaataccctccctacgcccgaaccctcactcaccgctcacgttcacccgcgccgccgaacccgaaaacgaaaacccctacgactaccgcataccctcgaaatcgaacgcgacgaaacgaccgaacgccgaactccaaccgaacgcgaaaaaacaacgaaaaacgcgacgaacgaacgaaacgcctcctctccaacgacccctacgacgcgtccaaaaccaaaaaaaaatttaacgatacgaaaaaaaaacctaaaaacaacgaccccttccctaccccgccccgccccgccgaatacgttcgacgttcccactaaaaaacgtccccaacctacaaaaccgcgaactacgctcaaaaaaacccgtacgaaccgcgaaaaaacaacgctcttacaaacgcgttcctacctaaaatcgtccccaaataaataatcgaccgaccccgaaaaaaaaaaacgcccactaaaaaaccgctaatacccacaaacctcacgaaaccatacctcgaaactccgtattaaaacgcaatccctctacccctctatcctcaaaaatttatttaaaataactacgaaaaatacaac

SEQ ID NO: 29725 - DNA, 665 bp, Artificial Sequence
  chemically treated genomic DNA (Homo sapiens) CpG-island No: 29725
cgtcgttttcgtttttatttgatttttttttttttttcgcgcgttttttttcgtttatttgttttcgcgtagttttttgagtttttttttaattgttttcggatttcgacgtttcgtgtcgttttttatcgggttttagtcgttagttttagtttcggtttttcggtgtttacgtcgttttttcgcgtttttttcggtcggtattaatttttatggtcgcgttttagttttaggttgagtcgaaggcggcggtcgagtttatttatggtttttggagtgttcggttttcgtttttagtttcgcgttggtttcgtttttttatttttgattttcgcgggttcgatatttttatttttacgcggggggaggtttaggggataggttcggggcggcgcggcgtatttttcggatttcggtttaattttcgggcgtatttgggcgggttcgttttgttttcgttttgggtagggtagcgtggggtggaagagggcgttcgacgcgcgttcgggattgggcggcgttatttcgtttttatttttcgtggggttttcggggaggtttgatttagcgaatattttgtagttcgtaaaagcgtatgttttggttgaaattatcgttttttaggtggttttaaacgaattttaaaaggggtagagtttttagtt

SEQ ID NO: 29726 - DNA, 665 bp, Artificial Sequence
  chemically treated genomic DNA (Homo sapiens) CpG-island No: 29726
aactaaaaactctaccccttttaaaattcgtttaaaaccacctaaaaaacgataatttcaaccaaaacatacgcttttacgaactacaaaatattcgctaaatcaaacctccccgaaaaccccacgaaaaataaaaacgaaataacgccgcccaatcccgaacgcgcgtcgaacgccctcttccaccccacgctaccctacccaaaacgaaaacaaaacgaacccgcccaaatacgcccgaaaattaaaccgaaatccgaaaaatacgccgcgccgccccgaacctatcccctaaacctccccccgcgtaaaaataaaaatatcgaacccgcgaaaatcaaaaataaaaaaacgaaaccaacgcgaaactaaaaacgaaaaccgaacactccaaaaaccataaataaactcgaccgccgccttcgactcaacctaaaactaaaacgcgaccataaaaattaataccgaccgaaaaaaacgcgaaaaaacgacgtaaacaccgaaaaaccgaaactaaaactaacgactaaaacccgataaaaaacgacacgaaacgtcgaaatccgaaaacaattaaaaaaaaactcaaaaaactacgcgaaaacaaataaacgaaaaaaaacgcgcgaaaaaaaaaaaaaaatcaaataaaaacgaaaacgacg

SEQ ID NO: 29727 - DNA, 665 bp, Artificial Sequence
  chemically treated genomic DNA (Homo sapiens) CpG-island No: 29727
gattgaaaattttgttttttttgggattcgtttggggttatttggaagacggtgattttagttaggatatgcgtttttgcggattgtagggtgttcgttaagttaagttttttcgggagttttacggagggtgggaacgaggtggcgtcgtttagtttcggacgcgcgtcgagcgtttttttttattttacgttgttttgtttagggcgagggtagagcgggttcgtttaggtgcgttcgggggttgggtcggagttcggaaggtgcgtcgcgtcgtttcgaatttgttttttaggttttttttcgcgtgaaagtgaaagtgtcggattcgcggaggttaaggataggggggcggggttagcgcggagttgggagcgggagtcgggtattttaggggttatggatgggttcggtcgtcgttttcgatttagtttgagattgaagcgcggttatgggggttagtgtcggtcggggagagcgcggggggacggcgtgggtatcggggagtcggggttagggttggcggttggggttcggtggagggcggtacggggcgtcgagattcgggagtagttggaaggggatttaggaggttgcgcgggggtaggtgagcgggaaggagcgcgcggagaggggaagagggttaggtgggggcggggacggcg

SEQ ID NO: 29728 - DNA, 665 bp, Artificial Sequence
  chemically treated genomic DNA (Homo sapiens) CpG-island No: 29728
cgccgtccccgcccccacctaaccctcttcccctctccgcgcgctccttcccgctcacctacccccgcgcaacctcctaaatccccttccaactactcccgaatctcgacgccccgtaccgccctccaccgaaccccaaccgccaaccctaaccccgactccccgatacccacgccgtccccccgcgctctccccgaccgacactaacccccataaccgcgcttcaatctcaaactaaatcgaaaacgacgaccgaacccatccataacccctaaaatacccgactcccgctcccaactccgcgctaaccccgcccccctatccttaacctccgcgaatccgacactttcactttcacgcgaaaaaaaacctaaaaaacaaattcgaaacgacgcgacgcaccttccgaactccgacccaacccccgaacgcacctaaacgaacccgctctaccctcgccctaaacaaaacaacgtaaaataaaaaaaaacgctcgacgcgcgtccgaaactaaacgacgccacctcgttcccaccctccgtaaaactcccgaaaaaacttaacttaacgaacaccctacaatccgcaaaaacgcatatcctaactaaaatcaccgtcttccaaataaccccaaacgaatcccaaaaaaaacaaaattttcaatc

SEQ ID NO: 29729 - DNA, 831 bp, Artificial Sequence
  chemically treated genomic DNA (Homo sapiens) CpG-island No: 29729
ttcgtttgcgttttttagggtagtttcgcgttcggtggcgcggttgaattattggggtgagttattttttgtagggtttcggagttttttatcgggaggaggcggggtaggggtgtggattcgtcgggggtcgtttatcgcgacggtaagtgattcgggtcgggggcggggagtcgggaggagcggcgggggcgggcgtcgggggcgggtagaggcgcgggagagcgcgtcgtcggttttttatagcgcgcggggtatcggttttttaagattgcgagtttttcgtattttttcgtattttttttggtcggtttagggcgtttttagtttaatttttttagttttacgggcgttacggaattcgttcgatttcgtcgttaattggtagatatggagatttttgtttggtttcgggtttcgcgtttcgagatcgtcgtcgttcggacgtttttgttcggttgggttttcgtttaggtggtcggcgttttaggtgagtggtattagtttttggaagttcggggcgcgttatacgtaggagggaggcgatagttttggttggtagcgggttcgttttggtttttcggggcgtttatgttgtttttcgcgtttacgggattcggttgcgtttatttagttcggtttgaatgaatcgagttcgtcgggcgtcggcgggagttgtagggagggagttggcgttttagatttcgttgtttttttcgttggagagttttgttcggggtgttcgagtaattggattgttgttgtataagcggatttttagttttcgttttaattttggggaaagggttttttagtgagttgcgattttta

SEQ ID NO: 29730 - DNA, 831 bp, Artificial Sequence
  chemically treated genomic DNA (Homo sapiens) CpG-island No: 29730
taaaaatcgcaactcactaaaaaaccctttccccaaaattaaaacgaaaactaaaaatccgcttatacaacaacaatccaattactcgaacaccccgaacaaaactctccaacgaaaaaaacaacgaaatctaaaacgccaactccctccctacaactcccgccgacgcccgacgaactcgattcattcaaaccgaactaaataaacgcaaccgaatcccgtaaacgcgaaaaacaacataaacgccccgaaaaaccaaaacgaacccgctaccaaccaaaactatcgcctccctcctacgtataacgcgccccgaacttccaaaaactaataccactcacctaaaacgccgaccacctaaacgaaaacccaaccgaacaaaaacgtccgaacgacgacgatctcgaaacgcgaaacccgaaaccaaacaaaaatctccatatctaccaattaacgacgaaatcgaacgaattccgtaacgcccgtaaaactaaaaaaattaaactaaaaacgccctaaaccgaccaaaaaaaatacgaaaaaatacgaaaaactcgcaatcttaaaaaaccgataccccgcgcgctataaaaaaccgacgacgcgctctcccgcgcctctacccgcccccgacgcccgcccccgccgctcctcccgactccccgcccccgacccgaatcacttaccgtcgcgataaacgacccccgacgaatccacacccctaccccgcctcctcccgataaaaaactccgaaaccctacaaaaaataactcaccccaataattcaaccgcgccaccgaacgcgaaactaccctaaaaaacgcaaacgaa

SEQ ID NO: 29731 - DNA, 831 bp, Artificial Sequence
  chemically treated genomic DNA (Homo sapiens) CpG-island No: 29731
tgaaggtcgtaatttattgggaagttttttttttagagttaaagcgggagttaaaagttcgtttatgtaataatagtttaattattcggatatttcgagtaaaattttttagcggaaggggtagcggggtttggggcgttaattttttttttgtaattttcgtcggcgttcgacggattcggtttatttaagtcgggttgggtgagcgtagtcgagtttcgtaggcgcgggggataatatgggcgtttcggggaattagggcgagttcgttgttagttaggattgtcgttttttttttgcgtgtggcgcgtttcgggtttttaggggttggtgttatttatttgaagcgtcggttatttgggcgaagatttagtcgagtaggagcgttcgagcgacggcggtttcggggcgcgggattcggggttaggtaggggtttttatgtttattagttggcggcgagatcgagcgggtttcgtggcgttcgtggggttggggaggttgggttgaaggcgttttgggtcggttagagggagtgcgagggggtgcggggagttcgtagttttggggagtcggtgtttcgcgcgttataaagggtcggcggcgcgttttttcgcgtttttgttcgttttcggcgttcgttttcgtcgtttttttcgatttttcgttttcggttcgggttatttgtcgtcgcggtgggcggttttcggcgagtttatatttttgtttcgttttttttcggtaggaaatttcgggattttgtaagggatgatttattttagtgatttaatcgcgttatcgagcgcggagttgttttggaggacgtaggcggg

SEQ ID NO: 29732 - DNA, 831 bp, Artificial Sequence
  chemically treated genomic DNA (Homo sapiens) CpG-island No: 29732
cccgcctacgtcctccaaaacaactccgcgctcgataacgcgattaaatcactaaaataaatcatcccttacaaaatcccgaaatttcctaccgaaaaaaaacgaaacaaaaatataaactcgccgaaaaccgcccaccgcgacgacaaataacccgaaccgaaaacgaaaaatcgaaaaaaacgacgaaaacgaacgccgaaaacgaacaaaaacgcgaaaaaacgcgccgccgaccctttataacgcgcgaaacaccgactccccaaaactacgaactccccgcaccccctcgcactccctctaaccgacccaaaacgccttcaacccaacctccccaaccccacgaacgccacgaaacccgctcgatctcgccgccaactaataaacataaaaacccctacctaaccccgaatcccgcgccccgaaaccgccgtcgctcgaacgctcctactcgactaaatcttcgcccaaataaccgacgcttcaaataaataacaccaacccctaaaaacccgaaacgcgccacacgcaaaaaaaaaacgacaatcctaactaacaacgaactcgccctaattccccgaaacgcccatattatcccccgcgcctacgaaactcgactacgctcacccaacccgacttaaataaaccgaatccgtcgaacgccgacgaaaattacaaaaaaaaaattaacgccccaaaccccgctaccccttccgctaaaaaattttactcgaaatatccgaataattaaactattattacataaacgaacttttaactcccgctttaactctaaaaaaaaaacttcccaataaattacgaccttca

SEQ ID NO: 29733 - DNA, 862 bp, Artificial Sequence
  chemically treated genomic DNA (Homo sapiens) CpG-island No: 29733
gcgtgattttattacgattatagtcgatgagtcgtttaagttgggagaaggagcgagaaggttgtagcggcgtaggttagatatttttgggtttaacgtttatttttaattagcgtttttgttagtagcgtttttttcggagttatagtttttatttcgagattttttttttttggaatttcggagcgcggtcgggtattaggggttcgcgtaggattgtagaatcgttgtcgttcgtcgttttagttttagttgttcgcgcggtatttatttgggttttagtgttcgggagaaggtgtgttcgcgcgaggcgtgaagttagagttcgttcgatttcgttcgtatcggacgcgtttttagggtagaggaggtcggcggagttgtgacgttgggattagaggaaggagaaggaaagtcgagacgggtcgggtagacgcgtcgaggagcgtttagtgtacgttggtagtcgcgggaggcgaggcgggcgcggtgagtagtcgcgtcggaatcgagtcgcgaattcgcgtcgtttcgcgttcgtagtcgttaggattcgcgggaattttggttcgtcggtagcggtattgaggagggaggggcgcggggttgagtcgtttttcggagttcgagcgtttttcggagtcggtaatttttgttgttcgggcgggatgcgggcgggaatttagttcgcgtggaatgtgggatcggtcgggttcggagtttttagcgttgggggaaagcggggtttatatagttaggacgagagggggtgcggttttagggttattttcgcgttattttttacgtggcggtcgcgttttcggggcgtgagtgtgtacgcggacggtaggggggtcgtgaa

SEQ ID NO: 29734 - DNA, 862 bp, Artificial Sequence
  chemically treated genomic DNA (Homo sapiens) CpG-island No: 29734
ttcacgacccccctaccgtccgcgtacacactcacgccccgaaaacgcgaccgccacgtaaaaaataacgcgaaaataaccctaaaaccgcaccccctctcgtcctaactatataaaccccgctttcccccaacgctaaaaactccgaacccgaccgatcccacattccacgcgaactaaattcccgcccgcatcccgcccgaacaacaaaaattaccgactccgaaaaacgctcgaactccgaaaaacgactcaaccccgcgcccctccctcctcaataccgctaccgacgaaccaaaattcccgcgaatcctaacgactacgaacgcgaaacgacgcgaattcgcgactcgattccgacgcgactactcaccgcgcccgcctcgcctcccgcgactaccaacgtacactaaacgctcctcgacgcgtctacccgacccgtctcgactttccttctccttcctctaatcccaacgtcacaactccgccgacctcctctaccctaaaaacgcgtccgatacgaacgaaatcgaacgaactctaacttcacgcctcgcgcgaacacaccttctcccgaacactaaaacccaaataaataccgcgcgaacaactaaaactaaaacgacgaacgacaacgattctacaatcctacgcgaacccctaatacccgaccgcgctccgaaattccaaaaaaaaaaaatctcgaaataaaaactataactccgaaaaaaacgctactaacaaaaacgctaattaaaaataaacgttaaacccaaaaatatctaacctacgccgctacaaccttctcgctccttctcccaacttaaacgactcatcgactataatcgtaataaaatcacgc

SEQ ID NO: 29735 - DNA, 862 bp, Artificial Sequence
  chemically treated genomic DNA (Homo sapiens) CpG-island No: 29735
tttacggtttttttatcgttcgcgtatatatttacgtttcgggggcgcggtcgttacgtggggagtggcgcgggggtggttttgggatcgtattttttttcgttttggttgtgtgggtttcgtttttttttagcgttggagatttcgagttcggtcggttttatattttacgcgagttgaattttcgttcgtatttcgttcgggtagtagggattgtcggtttcgggaggcgttcgggtttcgagaagcggtttagtttcgcgtttttttttttttagtatcgttgtcggcggattaggattttcgcgggttttggcggttgcgagcgcgaggcggcgcggattcgcggttcggtttcggcgcgattgtttatcgcgttcgtttcgtttttcgcggttgttagcgtgtattgggcgtttttcggcgcgtttgttcggttcgtttcggtttttttttttttttttttagttttagcgttataatttcgtcgattttttttgttttgagagcgcgttcggtgcgggcggagtcggacggattttggttttacgtttcgcgcgggtatattttttttcgggtattgaggtttaggtgagtatcgcgcgggtagttggggttgggacggcgggcggtagcggttttatagttttacgcgagtttttggtattcggtcgcgtttcggggttttagaaggagaagatttcgaggtggagattgtggtttcggggaaaacgttgttggtaagggcgttagttgggggtggacgttgggtttaggggtatttgatttgcgtcgttgtagttttttcgtttttttttttagtttgaacggtttatcggttgtggtcgtggtgggattacgt

SEQ ID NO: 29736 - DNA, 862 bp, Artificial Sequence
  chemically treated genomic DNA (Homo sapiens) CpG-island No: 29736
acgtaatcccaccacgaccacaaccgataaaccgttcaaactaaaaaaaaaaacgaaaaaactacaacgacgcaaatcaaatacccctaaacccaacgtccacccccaactaacgcccttaccaacaacgttttccccgaaaccacaatctccacctcgaaatcttctccttctaaaaccccgaaacgcgaccgaataccaaaaactcgcgtaaaactataaaaccgctaccgcccgccgtcccaaccccaactacccgcgcgatactcacctaaacctcaatacccgaaaaaaaatatacccgcgcgaaacgtaaaaccaaaatccgtccgactccgcccgcaccgaacgcgctctcaaaacaaaaaaaatcgacgaaattataacgctaaaactaaaaaaaaaaaaaaaaaaaccgaaacgaaccgaacaaacgcgccgaaaaacgcccaatacacgctaacaaccgcgaaaaacgaaacgaacgcgataaacaatcgcgccgaaaccgaaccgcgaatccgcgccgcctcgcgctcgcaaccgccaaaacccgcgaaaatcctaatccgccgacaacgatactaaaaaaaaaaaaacgcgaaactaaaccgcttctcgaaacccgaacgcctcccgaaaccgacaatccctactacccgaacgaaatacgaacgaaaattcaactcgcgtaaaatataaaaccgaccgaactcgaaatctccaacgctaaaaaaaaacgaaacccacacaaccaaaacgaaaaaaaatacgatcccaaaaccacccccgcgccactccccacgtaacgaccgcgcccccgaaacgtaaatatatacgcgaacgataaaaaaaccgtaaa

SEQ ID NO: 29737 - DNA, 693 bp, Artificial Sequence
  chemically treated genomic DNA (Homo sapiens) CpG-island No: 29737
ttattacgacgtttatgcgggggtgtttttttacgtgttttttttcggcgttttcggggtttacgaatattttttcgagttagtttttatttagaagcgtaacgagcgcgagaggtagcgagttaagtgcgttaacgagggttacgttcgttttcgcggttattttttcggcgttttggttgagaagcgatttagtaaggtggagacgttgcgcgtcgttattcgttatataaagtatttgtaagagttgttgagttcggttttcgacggttcgacgtttttcgtttttcgcggtttttcgggtatcgggttttgtttcgcgtcgttcgttatttttcgtttcgatcgttttggcgacggcgaggttcgggcgtttttttttttggtgtcggagttattcgagtttttttgttttttttcgtcgttttttttggagtcggaggaattttggtattgatcgggtttgtggtcgttttcggtttggaggatgattcgtcggtttcgttttattttcgggagtagcgggaggttgttgggttattcgcgatgcgtcgtaggacggtgattgtaggaggttcgcggcgttttcgtgtttgcgatatttttttttttttattagtttggggcggaagtgtagggtagcgggtacgatgggtacgatagagatttaggagtttcgtgggtgaagcgagg

SEQ ID NO: 29738 - DNA, 693 bp, Artificial Sequence
  chemically treated genomic DNA (Homo sapiens) CpG-island No: 29738
cctcgcttcacccacgaaactcctaaatctctatcgtacccatcgtacccgctaccctacacttccgccccaaactaataaaaaaaaaaaaatatcgcaaacacgaaaacgccgcgaacctcctacaatcaccgtcctacgacgcatcgcgaataacccaacaacctcccgctactcccgaaaataaaacgaaaccgacgaatcatcctccaaaccgaaaacgaccacaaacccgatcaataccaaaattcctccgactccaaaaaaaacgacgaaaaaaaacaaaaaaactcgaataactccgacaccaaaaaaaaaaacgcccgaacctcgccgtcgccaaaacgatcgaaacgaaaaataacgaacgacgcgaaacaaaacccgatacccgaaaaaccgcgaaaaacgaaaaacgtcgaaccgtcgaaaaccgaactcaacaactcttacaaatactttatataacgaataacgacgcgcaacgtctccaccttactaaatcgcttctcaaccaaaacgccgaaaaaataaccgcgaaaacgaacgtaaccctcgttaacgcacttaactcgctacctctcgcgctcgttacgcttctaaataaaaactaactcgaaaaaatattcgtaaaccccgaaaacgccgaaaaaaaacacgtaaaaaaacacccccgcataaacgtcgtaataa

SEQ ID NO: 29739 - DNA, 693 bp, Artificial Sequence
  chemically treated genomic DNA (Homo sapiens) CpG-island No: 29739
tttcgttttatttacggagtttttaggtttttatcgtgtttatcgtattcgttgttttgtattttcgttttaagttggtggaggagggagggtgtcgtagatacgggagcgtcgcggattttttatagttatcgttttgcggcgtatcgcgggtgatttaatagtttttcgttgttttcgaaagtgggacggggtcggcggattattttttaagtcgggggcggttataggttcgattaatgttaggattttttcgattttaagaaaggcgacggggagaagtaggaggattcggatgatttcggtattagggaggagggcgttcgggtttcgtcgtcgttagggcggtcgggacggggggtggcgggcggcgcggggtagggttcggtgttcgggaggtcgcgggaagcggggggcgtcgagtcgtcgggggtcgagtttagtagtttttgtaggtattttatgtagcggatggcggcgcgtagcgtttttattttgttgagtcgttttttagttagggcgtcggggaggtggtcgcggaggcgagcgtagttttcgttgacgtatttgattcgttgtttttcgcgttcgttgcgtttttggatgaaggttggttcgaaggggtattcgtagatttcgaaggcgtcggggaagggtacgtaggggaatattttcgtataggcgtcgtagtag

SEQ ID NO: 29740 - DNA, 693 bp, Artificial Sequence
  chemically treated genomic DNA (Homo sapiens) CpG-island No: 29740
ctactacgacgcctatacgaaaatattcccctacgtacccttccccgacgccttcgaaatctacgaataccccttcgaaccaaccttcatccaaaaacgcaacgaacgcgaaaaacaacgaatcaaatacgtcaacgaaaactacgctcgcctccgcgaccacctccccgacgccctaactaaaaaacgactcaacaaaataaaaacgctacgcgccgccatccgctacataaaatacctacaaaaactactaaactcgacccccgacgactcgacgccccccgcttcccgcgacctcccgaacaccgaaccctaccccgcgccgcccgccaccccccgtcccgaccgccctaacgacgacgaaacccgaacgccctcctccctaataccgaaatcatccgaatcctcctacttctccccgtcgcctttcttaaaatcgaaaaaatcctaacattaatcgaacctataaccgcccccgacttaaaaaataatccgccgaccccgtcccactttcgaaaacaacgaaaaactattaaatcacccgcgatacgccgcaaaacgataactataaaaaatccgcgacgctcccgtatctacgacaccctccctcctccaccaacttaaaacgaaaatacaaaacaacgaatacgataaacacgataaaaacctaaaaactccgtaaataaaacgaaa

SEQ ID NO: 29741 - DNA, 575 bp, Artificial Sequence
  chemically treated genomic DNA (Homo sapiens) CpG-island No: 29741
gaattttaattttcgttgagggtaggcggcgtcgtgagttttgagttcgtggcggcggcggcggcgcgggtgtggggtcgcgcggtcgggagcgggcggaagagagcgcgaatttgaattttaaaggtatttggaatttaagtgtttttgcgttgttcgattgtgtgtgtggcgtttttgtgtgttcgcgaatgcgcgcgtgcgtgtgtggcgtgtgtttgggtgttttatgattgtttttcgtgaggtcgtgtgtgagtttttgcgtgggtcgtgagtgcggtagggagcgcggtgttcgggggtcgtttgtcggtgtgtttgtgcgtgtttgtgcgttagtttttgtttttgcgagtgcgtatttttaggatcgagtttgtttatatgagtttgtgtttgtgtgtgtgcgttttcggttttgcgtgtgtttgtgagcgtttgtcggggcgcgtgtgtgttcggaatttcgcggtggtgtgcgggtgtgttcgtgtgtttgtgtacgtgtaggcgagcgtttttatttgtgtgtgtgtatttgagtttgggttatgtgtgatttagggattagt

SEQ ID NO: 29742 - DNA, 575 bp, Artificial Sequence
  chemically treated genomic DNA (Homo sapiens) CpG-island No: 29742
actaatccctaaatcacacataacccaaactcaaatacacacacacaaataaaaacgctcgcctacacgtacacaaacacacgaacacacccgcacaccaccgcgaaattccgaacacacacgcgccccgacaaacgctcacaaacacacgcaaaaccgaaaacgcacacacacaaacacaaactcatataaacaaactcgatcctaaaaatacgcactcgcaaaaacaaaaactaacgcacaaacacgcacaaacacaccgacaaacgacccccgaacaccgcgctccctaccgcactcacgacccacgcaaaaactcacacacgacctcacgaaaaacaatcataaaacacccaaacacacgccacacacgcacgcgcgcattcgcgaacacacaaaaacgccacacacacaatcgaacaacgcaaaaacacttaaattccaaatacctttaaaattcaaattcgcgctctcttccgcccgctcccgaccgcgcgaccccacacccgcgccgccgccgccgccacgaactcaaaactcacgacgccgcctaccctcaacgaaaattaaaattc

SEQ ID NO: 29743 - DNA, 575 bp, Artificial Sequence
  chemically treated genomic DNA (Homo sapiens) CpG-island No: 29743
attggtttttgagttatatatagtttagatttagatgtatatatatagatgggaacgttcgtttgtacgtgtatagatatacggatatattcgtatattatcgcggggtttcgagtatatacgcgtttcggtagacgtttatagatatacgtagggtcgggagcgtatatatatagatataggtttatatagatagattcggttttaaaaatacgtattcgtagaggtaaaggttagcgtataagtacgtatagatatatcgataggcggttttcggatatcgcgttttttgtcgtatttacggtttacgtaagggtttatatacggttttacggaggatagttataaaatatttagatatacgttatatacgtacgcgcgtattcgcggatatataaaagcgttatatatataatcgggtaacgtagaagtatttgggttttagatgtttttgaaatttaaattcgcgttttttttcgttcgttttcggtcgcgcggttttatattcgcgtcgtcgtcgtcgttacgggtttaggatttacgacgtcgtttgtttttagcggaaattaaaattt

SEQ ID NO: 29744 - DNA, 575 bp, Artificial Sequence
  chemically treated genomic DNA (Homo sapiens) CpG-island No: 29744
aaattttaatttccgctaaaaacaaacgacgtcgtaaatcctaaacccgtaacgacgacgacgacgcgaatataaaaccgcgcgaccgaaaacgaacgaaaaaaaacgcgaatttaaatttcaaaaacatctaaaacccaaatacttctacgttacccgattatatatataacgcttttatatatccgcgaatacgcgcgtacgtatataacgtatatctaaatattttataactatcctccgtaaaaccgtatataaacccttacgtaaaccgtaaatacgacaaaaaacgcgatatccgaaaaccgcctatcgatatatctatacgtacttatacgctaacctttacctctacgaatacgtatttttaaaaccgaatctatctatataaacctatatctatatatatacgctcccgaccctacgtatatctataaacgtctaccgaaacgcgtatatactcgaaaccccgcgataatatacgaatatatccgtatatctatacacgtacaaacgaacgttcccatctatatatatacatctaaatctaaactatatataactcaaaaaccaat

SEQ ID NO: 29745 - DNA, 621 bp, Artificial Sequence
  chemically treated genomic DNA (Homo sapiens) CpG-island No: 29745
  misc_feature (95)..(95): n is either a, c, g or t
  misc_feature (108)..(109): n is either a, c, g or t
agtttggcgtttgcgaggattttaggagcgatagtagggatcgacgtagagaggtttttagtttggttttcggagaagaggtcgtttcgtttttntcgttcgtatttnncggtgttttggaggttcgcgtggtttcgttttattggtcgtcgcggagttcgaggtttcggggaggcggggcggttttcgtagttgtagttttcgagttttttcgtttagcggtttcgtttttttgtcgcggcgtttaggcgatcgtttaggattataatttttataaggtttcgcgtttgggggcgtggtcgaggagttaagcgagtcgggggcggggtcgtttgggggatgaagtgggggcgttcgttttttttgttttattcgtagttgtcgggtgttggggaaagagtcgtttgttttcggatcggagtgtagatttttgattttggagtcgttcggtcgttgggaatcgtttttttgggtcgtcgtttgggtcgttcgtcgtttttcggtttcgaggggttcggttggtcgcggtgtgggtagaggttagtatgagttaaggggttcgtcgggtaggcgttgggtagggggtagcggtcgcggtgtagttgttggttattttgagtt

SEQ ID NO: 29746 - DNA, 621 bp, Artificial Sequence
  chemically treated genomic DNA (Homo sapiens) CpG-island No: 29746
  misc_feature (513)..(514): n is either a, c, g or t
  misc_feature (527)..(527): n is either a, c, g or t
aactcaaaataaccaacaactacaccgcgaccgctaccccctacccaacgcctacccgacgaaccccttaactcatactaacctctacccacaccgcgaccaaccgaacccctcgaaaccgaaaaacgacgaacgacccaaacgacgacccaaaaaaacgattcccaacgaccgaacgactccaaaatcaaaaatctacactccgatccgaaaacaaacgactctttccccaacacccgacaactacgaataaaacaaaaaaaacgaacgcccccacttcatcccccaaacgaccccgcccccgactcgcttaactcctcgaccacgcccccaaacgcgaaaccttataaaaattataatcctaaacgatcgcctaaacgccgcgacaaaaaaacgaaaccgctaaacgaaaaaactcgaaaactacaactacgaaaaccgccccgcctccccgaaacctcgaactccgcgacgaccaataaaacgaaaccacgcgaacctccaaaacaccgnnaaatacgaacganaaaaacgaaacgacctcttctccgaaaaccaaactaaaaacctctctacgtcgatccctactatcgctcctaaaatcctcgcaaacgccaaact

SEQ ID NO: 29747 - DNA, 621 bp, Artificial Sequence
  chemically treated genomic DNA (Homo sapiens) CpG-island No: 29747
  misc_feature (513)..(514): n is either a, c, g or t
  misc_feature (527)..(527): n is either a, c, g or t
agtttagggtgattagtagttgtatcgcggtcgttattttttgtttagcgtttgttcggcggattttttggtttatgttgatttttatttatatcgcggttagtcggatttttcggggtcggggaacgacgggcggtttaggcgacgatttaaggggacggtttttagcggtcgagcgattttagggttagaggtttgtatttcggttcggaggtaggcgattttttttttaatattcggtagttgcgagtgaggtaggaaaggcgagcgtttttattttattttttaggcggtttcgttttcggttcgtttggtttttcggttacgtttttaagcgcggggttttgtgggagttgtggttttgggcggtcgtttaggcgtcgcggtaggaaggcggagtcgttgaacgagaggattcgggaattataattgcgaaggtcgtttcgttttttcgaggtttcgggtttcgcggcggttaatgaggcgggattacgcgggtttttaaaatatcgnngggtgcgggcggnggaagcggggcgatttttttttcgggaattaggttgaggatttttttgcgtcggtttttgttgtcgtttttggagttttcgtagacgttaggtt

SEQ ID NO: 29748 - DNA, 621 bp, Artificial Sequence
  chemically treated genomic DNA (Homo sapiens) CpG-island No: 29748
  misc_feature (95)..(95): n is either a, c, g or t
  misc_feature (108)..(109): n is either a, c, g or t
aacctaacgtctacgaaaactccaaaaacgacaacaaaaaccgacgcaaaaaaatcctcaacctaattcccgaaaaaaaaatcgccccgcttccnccgcccgcacccnncgatattttaaaaacccgcgtaatcccgcctcattaaccgccgcgaaacccgaaacctcgaaaaaacgaaacgaccttcgcaattataattcccgaatcctctcgttcaacgactccgccttcctaccgcgacgcctaaacgaccgcccaaaaccacaactcccacaaaaccccgcgcttaaaaacgtaaccgaaaaaccaaacgaaccgaaaacgaaaccgcctaaaaaataaaataaaaacgctcgcctttcctacctcactcgcaactaccgaatattaaaaaaaaaatcgcctacctccgaaccgaaatacaaacctctaaccctaaaatcgctcgaccgctaaaaaccgtccccttaaatcgtcgcctaaaccgcccgtcgttccccgaccccgaaaaatccgactaaccgcgatataaataaaaatcaacataaaccaaaaaatccgccgaacaaacgctaaacaaaaaataacgaccgcgatacaactactaatcaccctaaact

SEQ ID NO: 29749 - DNA, 780 bp, Artificial Sequence
  chemically treated genomic DNA (Homo sapiens) CpG-island No: 29749
agattcgggtgtttattatttagcggaaaaagcgatttattgagaaggtgaggtcgtagcgcgcggatttgtttcggcgtagttcgtcgtcggcgtttatgttgtatagggatagcgttttgacggttgttagcgcgtagttttcggttagcgtttagttgtgtattaggcgtacggcgttttgtattttaaagcgggtgtatttggcgtgtagtacgtttaggcgttgcgtttcgcgggttacgcggattagtgttttgcggagtagttcggttaggcgttttatcgtttcggcggagaattggggtagtcgtcggtcgttagcgtttttgcggagtattcgggttacgtttttttcggtttaggggaatttttttagttcggggagtcgcggatagcgcgagaagaggtcggttatttcggggttttcgggtagtatcgtgtttatcgtgttttagttgttgtggcggttgtttatggagtcggagtagtattattaggtcgtttcgcggtgttgttgcgtcgaagagttgagcgtttgcgagttggatttggaggacgagaggttgagcgagcggtacgagttttcggttttatattcggagtttaaggttaagttttttagcgtttttagagtcgagttgtacgtttcggttatggggagtttgtcgagggcggcgtcgtcgagcgaggggtatttataattttatgtttttttttttaagtgggtagaaataagttttaggtttttcgggttatttttttttttttttgcgtcgt

SEQ ID NO: 29750 - DNA, 780 bp, Artificial Sequence
  chemically treated genomic DNA (Homo sapiens) CpG-island No: 29750
acgacgcaaaaaaaaaaaaaaataacccgaaaaacctaaaacttatttctacccacttaaaaaaaaaaacataaaattataaatacccctcgctcgacgacgccgccctcgacaaactccccataaccgaaacgtacaactcgactctaaaaacgctaaaaaacttaaccttaaactccgaatataaaaccgaaaactcgtaccgctcgctcaacctctcgtcctccaaatccaactcgcaaacgctcaactcttcgacgcaacaacaccgcgaaacgacctaataatactactccgactccataaacaaccgccacaacaactaaaacacgataaacacgatactacccgaaaaccccgaaataaccgacctcttctcgcgctatccgcgactccccgaactaaaaaaattcccctaaaccgaaaaaaacgtaacccgaatactccgcaaaaacgctaacgaccgacgactaccccaattctccgccgaaacgataaaacgcctaaccgaactactccgcaaaacactaatccgcgtaacccgcgaaacgcaacgcctaaacgtactacacgccaaatacacccgctttaaaatacaaaacgccgtacgcctaatacacaactaaacgctaaccgaaaactacgcgctaacaaccgtcaaaacgctatccctatacaacataaacgccgacgacgaactacgccgaaacaaatccgcgcgctacgacctcaccttctcaataaatcgctttttccgctaaataataaacacccgaatct

SEQ ID NO: 29751 - DNA, 780 bp, Artificial Sequence
  chemically treated genomic DNA (Homo sapiens) CpG-island No: 29751
gcgacgtagagaggaaggagggtggttcggagggtttagagtttgtttttgtttatttgggaaagagggtatggagttgtgagtgtttttcgttcggcgacgtcgttttcggtaggttttttatggtcgggacgtatagttcgattttgaagacgttggaggatttgattttggatttcgggtatggggtcggggattcgtgtcgttcgtttagtttttcgttttttaagtttaattcgtaggcgtttaatttttcggcgtagtagtatcgcggggcggtttggtggtgttatttcggttttatgaatagtcgttataatagttgggatacggtgaatacggtgttgttcgaggatttcgaagtggtcgattttttttcgcgttgttcgcggtttttcgagttggaggagtttttttggatcgaaggagacgtggttcgggtgtttcgtaaaggcgttggcggtcggcggttgttttagtttttcgtcgaggcggtgaggcgtttggtcgggttgtttcgtagggtattgattcgcgtggttcgcgaggcgtagcgtttgagcgtgttgtacgttaagtgtattcgttttgaggtgtagagcgtcgtgcgtttggtgtatagttgggcgttggtcgagagttgcgcgttggtagtcgttaaggcgttgtttttgtatagtatgagcgtcggcgacgggttgcgtcggggtaagttcgcgcgttgcggttttatttttttagtgggtcgtttttttcgttggatggtggatattcgaattt

SEQ ID NO: 29752 - DNA, 780 bp, Artificial Sequence
  chemically treated genomic DNA (Homo sapiens) CpG-island No: 29752
aaattcgaatatccaccatccaacgaaaaaaacgacccactaaaaaaataaaaccgcaacgcgcgaacttaccccgacgcaacccgtcgccgacgctcatactatacaaaaacaacgccttaacgactaccaacgcgcaactctcgaccaacgcccaactatacaccaaacgcacgacgctctacacctcaaaacgaatacacttaacgtacaacacgctcaaacgctacgcctcgcgaaccacgcgaatcaataccctacgaaacaacccgaccaaacgcctcaccgcctcgacgaaaaactaaaacaaccgccgaccgccaacgcctttacgaaacacccgaaccacgtctccttcgatccaaaaaaactcctccaactcgaaaaaccgcgaacaacgcgaaaaaaaatcgaccacttcgaaatcctcgaacaacaccgtattcaccgtatcccaactattataacgactattcataaaaccgaaataacaccaccaaaccgccccgcgatactactacgccgaaaaattaaacgcctacgaattaaacttaaaaaacgaaaaactaaacgaacgacacgaatccccgaccccatacccgaaatccaaaatcaaatcctccaacgtcttcaaaatcgaactatacgtcccgaccataaaaaacctaccgaaaacgacgtcgccgaacgaaaaacactcacaactccataccctctttcccaaataaacaaaaacaaactctaaaccctccgaaccaccctccttcctctctacgtcgc

SEQ ID NO: 29753 - DNA, 598 bp, Artificial Sequence
  chemically treated genomic DNA (Homo sapiens) CpG-island No: 29753
agtttcgggtaatcggttatttttttttatcgaagaaaatttgttggttgttttcgtatttgtttcggggttatcgtatttttttattttttttgtatacgtattcgtttatacgcggatatacgtatatatgcgcgaatatatagattttttttttcggttggtttttttttcgggtttcggagtttaagttttcggagtttatttttcgggatggattcggttttttagtttcgcgggttatttttttttcgattttaaagtgtttttttcgggtgttggttcgttttttcgttttttttagcggggtttttattcggagcgcgttttttcgtttttcgagttttgcggagtaggttacgattttttttcgttttcgggatatcgttcggcgttatagattagttttgtcggtgtcgggaggttggtcgtggaatttaggttttggggagcgtacgaacgcggatagtagcgttgagaggggtttttaggcgttcgcgcgttcggggtagggggttgtggttttagtaaaggcgtcgtttttttttttttcgtttttttcgtttcgaggttcggtttttttatattttatagtagt

SEQ ID NO: 29754 - DNA, 598 bp, Artificial Sequence
  chemically treated genomic DNA (Homo sapiens) CpG-island No: 29754
actactataaaatataaaaaaaccgaacctcgaaacgaaaaaaacgaaaaaaaaaaaaacgacgcctttactaaaaccacaaccccctaccccgaacgcgcgaacgcctaaaaacccctctcaacgctactatccgcgttcgtacgctccccaaaacctaaattccacgaccaacctcccgacaccgacaaaactaatctataacgccgaacgatatcccgaaaacgaaaaaaaatcgtaacctactccgcaaaactcgaaaaacgaaaaaacgcgctccgaataaaaaccccgctaaaaaaaacgaaaaaacgaaccaacacccgaaaaaaacactttaaaatcgaaaaaaaaataacccgcgaaactaaaaaaccgaatccatcccgaaaaataaactccgaaaacttaaactccgaaacccgaaaaaaaaaccaaccgaaaaaaaaaatctatatattcgcgcatatatacgtatatccgcgtataaacgaatacgtatacaaaaaaaataaaaaaatacgataaccccgaaacaaatacgaaaacaaccaacaaattttcttcgataaaaaaaaataaccgattacccgaaact

SEQ ID NO: 29755 - DNA, 598 bp, Artificial Sequence
  chemically treated genomic DNA (Homo sapiens) CpG-island No: 29755
gttgttgtgggatgtgggaaagtcgagtttcggggcggaggggacgagagggaggaggacggcgtttttgttggagttatagttttttgtttcgggcgcgcgggcgtttggagattttttttagcgttgttgttcgcgttcgtgcgttttttaggatttgggttttacggttagtttttcggtatcgatagggttgatttgtggcgtcgagcggtgtttcgggggcggggggaggtcgtgatttgtttcgtagggttcggggagcggggagacgcgtttcgggtgagggtttcgttgggaaaggcgagggagcggattagtattcgaggagggtattttgaggtcgggagggaaatgattcgcgaagttgagagatcgggtttatttcgggggatgggtttcggggatttgagtttcgaagttcggaggggaagttagtcgaggggaggggtttgtgtgttcgcgtatgtgtgcgtgtgttcgcgtgtgagcgagtgcgtgtgtaaaggaaataaaggggtacggtggtttcggggtagatgcgagggtaattagtaggtttttttcggtagggggaggtgatcgattgttcgagatt

SEQ ID NO: 29756 - DNA, 598 bp, Artificial Sequence
  chemically treated genomic DNA (Homo sapiens) CpG-island No: 29756
aatctcgaacaatcgatcacctccccctaccgaaaaaaacctactaattaccctcgcatctaccccgaaaccaccgtacccctttatttcctttacacacgcactcgctcacacgcgaacacacgcacacatacgcgaacacacaaacccctcccctcgactaacttcccctccgaacttcgaaactcaaatccccgaaacccatcccccgaaataaacccgatctctcaacttcgcgaatcatttccctcccgacctcaaaataccctcctcgaatactaatccgctccctcgcctttcccaacgaaaccctcacccgaaacgcgtctccccgctccccgaaccctacgaaacaaatcacgacctccccccgcccccgaaacaccgctcgacgccacaaatcaaccctatcgataccgaaaaactaaccgtaaaacccaaatcctaaaaaacgcacgaacgcgaacaacaacgctaaaaaaaatctccaaacgcccgcgcgcccgaaacaaaaaactataactccaacaaaaacgccgtcctcctccctctcgtcccctccgccccgaaactcgactttcccacatcccacaacaac

SEQ ID NO: 29757 - DNA, 580 bp, Artificial Sequence
  chemically treated genomic DNA (Homo sapiens) CpG-island No: 29757
gcgcggggattcggtttcggtggaaagatttgttttcggcgtataagataggcgggcggtcgggcgtgggcgagcgcgtagtcggcgtgttttttcgtgcgtttaggcggcgcgggcgcggtcggcgattttgtagagggagttgtgcgtcggttttagcgtacgttcggtgtcgttcgtttttttttgtcgtcgtcgtcgtcgttgggttcgttcgtcggggaggggttttcggtttcgtagatagcggttttttgttttttgtacgttttcgtcgtcgcgtcgttagttcgtttgtgttagttttggtcgtgagtcggtcgttcgttgtcgtcggtcgtttcgtagttgtttgcgttttagtcgcgtttcgcggttagttcggttagtttaggttcgttttcggagttcgcgtttttttacgttgttttttgtttgttttcggttatgttgtttttttagtatttcgacgtgtatcgcgacgagatcgtcgtaagtatttttgttttcgtttagagggttttcgggtaaaggtgtttagtttgtttgattcgtggtattcgtagtttttttttttgta

SEQ ID NO: 29758 - DNA, 580 bp, Artificial Sequence
  chemically treated genomic DNA (Homo sapiens) CpG-island No: 29758
tacaaaaaaaaaaactacgaataccacgaatcaaacaaactaaacacctttacccgaaaaccctctaaacgaaaacaaaaatacttacgacgatctcgtcgcgatacacgtcgaaatactaaaaaaacaacataaccgaaaacaaacaaaaaacaacgtaaaaaaacgcgaactccgaaaacgaacctaaactaaccgaactaaccgcgaaacgcgactaaaacgcaaacaactacgaaacgaccgacgacaacgaacgaccgactcacgaccaaaactaacacaaacgaactaacgacgcgacgacgaaaacgtacaaaaaacaaaaaaccgctatctacgaaaccgaaaacccctccccgacgaacgaacccaacgacgacgacgacgacaaaaaaaaacgaacgacaccgaacgtacgctaaaaccgacgcacaactccctctacaaaatcgccgaccgcgcccgcgccgcctaaacgcacgaaaaaacacgccgactacgcgctcgcccacgcccgaccgcccgcctatcttatacgccgaaaacaaatctttccaccgaaaccgaatccccgcgc

SEQ ID NO: 29759 - DNA, 580 bp, Artificial Sequence
  chemically treated genomic DNA (Homo sapiens) CpG-island No: 29759
tataggaagaggagttgcgggtgttacgggttaggtaggttgggtatttttgttcgggagttttttgggcggaggtagagatatttacggcggtttcgtcgcggtatacgtcggggtattgaagggatagtatggtcggggataggtagggggtagcgtggaggggcgcgggtttcgggagcggatttgagttagtcgggttggtcgcgaggcgcggttggggcgtaggtagttgcggggcggtcggcggtagcgggcggtcggtttacggttagagttagtataaacggattggcggcgcggcggcgaggacgtgtagaaagtaggaagtcgttgtttgcgaggtcgggagttttttttcggcgggcgggtttagcggcggcggcggcggtaagagggagcgggcggtatcgagcgtgcgttaaggtcggcgtatagttttttttgtaggatcgtcggtcgcgttcgcgtcgtttgggcgtacggaggagtacgtcggttacgcgttcgtttacgttcggtcgttcgtttgttttatgcgtcggggataagtttttttatcgaggtcgggttttcgcgt

SEQ ID NO: 29760 - DNA, 580 bp, Artificial Sequence
  chemically treated genomic DNA (Homo sapiens) CpG-island No: 29760
acgcgaaaacccgacctcgataaaaaaacttatccccgacgcataaaacaaacgaacgaccgaacgtaaacgaacgcgtaaccgacgtactcctccgtacgcccaaacgacgcgaacgcgaccgacgatcctacaaaaaaaactatacgccgaccttaacgcacgctcgataccgcccgctccctcttaccgccgccgccgccgctaaacccgcccgccgaaaaaaaactcccgacctcgcaaacaacgacttcctactttctacacgtcctcgccgccgcgccgccaatccgtttatactaactctaaccgtaaaccgaccgcccgctaccgccgaccgccccgcaactacctacgccccaaccgcgcctcgcgaccaacccgactaactcaaatccgctcccgaaacccgcgcccctccacgctaccccctacctatccccgaccatactatcccttcaataccccgacgtataccgcgacgaaaccgccgtaaatatctctacctccgcccaaaaaactcccgaacaaaaatacccaacctacctaacccgtaacacccgcaactcctcttcctata

SEQ ID NO: 29761 - DNA, 623 bp, Artificial Sequence
  chemically treated genomic DNA (Homo sapiens) CpG-island No: 29761
taattcggtgtatagcgagtgtaaaaatcgagaagcgaatgtagttgcgtttggagaaggcggttgagaagcgatattttagtagggttttgaagaatgggagttttagagtcgggtggcgggtgggattgggttttcggatagattacgtgtaaattcgttaggatatagggagcgaggggcgggggggcggtagagcgcggcgttttatttttttagtttgggattgcggttattggatacgagggtcgggaagttttttttcggcgtcgattggagtttagcgtgttggcggtagtaagaagttgaggtaagcgggtttcgggttttaacgacgcgttttagtttttttttgggtttcgggtttttttcgggtaataagaggtcgttgttcgaacgggatttttttaggcgttttagacgggcgggttttcgggtttcggacggttaattcgagtattttttatttgtttttgaggttttattttattacgttcggttttcgtagacgttcggttagttgtttcgcgattgagttgcggtagtcgttgttaaggttttgcgggggacgggggcggagtttatttcgaggtagagggttaggtttcgtttttttaaatttt

SEQ ID NO: 29762 - DNA, 623 bp, Artificial Sequence
  chemically treated genomic DNA (Homo sapiens) CpG-island No: 29762
aaaatttaaaaaaacgaaacctaaccctctacctcgaaataaactccgcccccgtcccccgcaaaaccttaacaacgactaccgcaactcaatcgcgaaacaactaaccgaacgtctacgaaaaccgaacgtaataaaataaaacctcaaaaacaaataaaaaatactcgaattaaccgtccgaaacccgaaaacccgcccgtctaaaacgcctaaaaaaatcccgttcgaacaacgacctcttattacccgaaaaaaacccgaaacccaaaaaaaaactaaaacgcgtcgttaaaacccgaaacccgcttacctcaacttcttactaccgccaacacgctaaactccaatcgacgccgaaaaaaaacttcccgaccctcgtatccaataaccgcaatcccaaactaaaaaaataaaacgccgcgctctaccgcccccccgcccctcgctccctatatcctaacgaatttacacgtaatctatccgaaaacccaatcccacccgccacccgactctaaaactcccattcttcaaaaccctactaaaatatcgcttctcaaccgccttctccaaacgcaactacattcgcttctcgatttttacactcgctatacaccgaatta

SEQ ID NO: 29763 - DNA, 623 bp, Artificial Sequence
  chemically treated genomic DNA (Homo sapiens) CpG-island No: 29763
ggagtttgggggggcggggtttggttttttgtttcggggtgggtttcgttttcgtttttcgtagggttttagtagcggttgtcgtagtttaatcgcggagtaattagtcgggcgtttgcgggagtcgagcgtggtgaggtggggttttaggggtaggtgggaggtgttcgggttaatcgttcgaggttcggagattcgttcgtttagggcgtttgagggaatttcgttcgggtagcggttttttgttattcgggaggaattcgaggtttagagaggggttgggacgcgtcgttagggttcggggttcgtttgttttagttttttgttgtcgttagtacgttaagttttagtcggcgtcgaaggagagtttttcgattttcgtgtttagtagtcgtaattttaggttgggagggtgaggcgtcgcgttttgtcgttttttcgtttttcgttttttgtgttttggcggatttgtacgtaatttattcgaaagtttagttttattcgttattcgattttggagtttttattttttaggattttgttgaagtatcgttttttagtcgttttttttaggcgtagttgtattcgtttttcggtttttgtattcgttgtgtatcgagtta

SEQ ID NO: 29764 - DNA, 623 bp, Artificial Sequence
  chemically treated genomic DNA (Homo sapiens) CpG-island No: 29764
taactcgatacacaacgaatacaaaaaccgaaaaacgaatacaactacgcctaaaaaaaacgactaaaaaacgatacttcaacaaaatcctaaaaaataaaaactccaaaatcgaataacgaataaaactaaactttcgaataaattacgtacaaatccgccaaaacacaaaaaacgaaaaacgaaaaaacgacaaaacgcgacgcctcaccctcccaacctaaaattacgactactaaacacgaaaatcgaaaaactctccttcgacgccgactaaaacttaacgtactaacgacaacaaaaaactaaaacaaacgaaccccgaaccctaacgacgcgtcccaacccctctctaaacctcgaattcctcccgaataacaaaaaaccgctacccgaacgaaattccctcaaacgccctaaacgaacgaatctccgaacctcgaacgattaacccgaacacctcccacctacccctaaaaccccacctcaccacgctcgactcccgcaaacgcccgactaattactccgcgattaaactacgacaaccgctactaaaaccctacgaaaaacgaaaacgaaacccaccccgaaacaaaaaaccaaaccccgcccccccaaactcc

SEQ ID NO: 29765 - DNA, 892 bp, Artificial Sequence
  chemically treated genomic DNA (Homo sapiens) CpG-island No: 29765
  misc_feature (760)..(760): n is either a, c, g or t
tgacgtaattagttaaatcggttaaggatttgattgcgattgagaattagtgaggatttttaggaatttaattttttgcgtttatatacgcgttcgcgcgtatacgtacgtatatatatatatatatatatatatatacggtaagtaagttattttcggttatattttagatatcgtcgttttttcgggacgggcgtttttttacgcgtgttttttggacgcgttagttttttttttatttcgggatcgttgttttttttttttcgggtttttgttgtagtcggtcggtcgttttcgtcgttcgtttagttttcgaacgtttttttttttatttttaaggtttagggaaggggttagtcggcgtttgagcgcgttacgtggagcgcgcgcgtttgtagttaaattttagtcggtttttaaagtggggttttcgtttttttcgttttgtttttcgattttttaaggtcgagttcgttttcgcgttttcgagtttttgttttgtttggttggggtttgtggcgcggaaaacgtggtaggttatttgcgattcggggtcgtcgggttgcgttttgattaggtaggtaaagtaggtgaggtcgtggttgttgtggatgaagcgcgagatatgttgcgttttgtgttcgaagatgaatatcgtcgggttgggttgcgtggtcgatagattagtgtttttcgaggttttagcgttcggcgcggggacgtaacgtatgaagggcgcgttgagtattaggattatttntcgggtcgacggcgtttcgtagacgttcgtttcgggtttttggttgcgtttgcggatttcggttatgagttagggtagtataggtagcgtggttttgtggtttaggtacgaattttaacgtattatagaagg

SEQ ID NO: 29766 - DNA, 892 bp, Artificial Sequence
  chemically treated genomic DNA (Homo sapiens) CpG-island No: 29766
  misc_feature (133)..(133): n is either a, c, g or t
ccttctataatacgttaaaattcgtacctaaaccacaaaaccacgctacctatactaccctaactcataaccgaaatccgcaaacgcaaccaaaaacccgaaacgaacgtctacgaaacgccgtcgacccganaaataatcctaatactcaacgcgcccttcatacgttacgtccccgcgccgaacgctaaaacctcgaaaaacactaatctatcgaccacgcaacccaacccgacgatattcatcttcgaacacaaaacgcaacatatctcgcgcttcatccacaacaaccacgacctcacctactttacctacctaatcaaaacgcaacccgacgaccccgaatcgcaaataacctaccacgttttccgcgccacaaaccccaaccaaacaaaacaaaaactcgaaaacgcgaaaacgaactcgaccttaaaaaatcgaaaaacaaaacgaaaaaaacgaaaaccccactttaaaaaccgactaaaatttaactacaaacgcgcgcgctccacgtaacgcgctcaaacgccgactaaccccttccctaaaccttaaaaataaaaaaaaaaacgttcgaaaactaaacgaacgacgaaaacgaccgaccgactacaacaaaaacccgaaaaaaaaaaaacaacgatcccgaaataaaaaaaaaactaacgcgtccaaaaaacacgcgtaaaaaaacgcccgtcccgaaaaaacgacgatatctaaaatataaccgaaaataacttacttaccgtatatatatatatatatatatatatatacgtacgtatacgcgcgaacgcgtatataaacgcaaaaaattaaattcctaaaaatcctcactaattctcaatcgcaatcaaatccttaaccgatttaactaattacgtca

SEQ ID NO: 29767 - DNA, 892 bp, Artificial Sequence
  chemically treated genomic DNA (Homo sapiens) CpG-island No: 29767
  misc_feature (133)..(133): n is either a, c, g or t
ttttttgtggtacgttggggttcgtgtttggattataggattacgttgtttatgttgttttggtttatggtcgagattcgtaggcgtagttagaagttcgaggcgggcgtttgcggggcgtcgtcggttcganaggtgattttggtgtttagcgcgttttttatgcgttgcgttttcgcgtcggacgttggggtttcggggggtattagtttgtcggttacgtagtttaattcggcggtatttattttcgagtataaggcgtagtatatttcgcgttttatttataatagttacgattttatttattttgtttatttgattaaggcgtagttcgacgatttcgagtcgtagatggtttgttacgtttttcgcgttatagattttagttaggtaagataggggttcggaggcgcgggggcgggttcggttttgggggatcggggagtagggcgggaggggcggggattttattttaaggatcgattgaggtttggttgtaggcgcgcgcgttttacgtggcgcgtttaagcgtcggttggttttttttttggattttgggagtgggagagaaggcgttcgggggttgggcgagcggcgggagcggtcggtcggttatagtagggattcggagggaaaaggataacggtttcgggatggagggggagttggcgcgtttaaggagtacgcgtggaggagcgttcgtttcgggaggacggcggtgtttggggtgtgatcggagatggtttgtttgtcgtgtgtgtgtgtgtgtgtgtgtgtgtgtgcgtgcgtgtgcgcgcgagcgcgtgtatgaacgtagaaggttgggtttttagaggtttttattagtttttaatcgtagttaaatttttaatcggtttggttggttgcgtta

SEQ ID NO: 29768 - DNA, 892 bp, Artificial Sequence
  chemically treated genomic DNA (Homo sapiens) CpG-island No: 29768
  misc_feature (760)..(760): n is either a, c, g or t
taacgcaaccaaccaaaccgattaaaaatttaactacgattaaaaactaataaaaacctctaaaaacccaaccttctacgttcatacacgcgctcgcgcgcacacgcacgcacacacacacacacacacacacacacacgacaaacaaaccatctccgatcacaccccaaacaccgccgtcctcccgaaacgaacgctcctccacgcgtactccttaaacgcgccaactccccctccatcccgaaaccgttatccttttccctccgaatccctactataaccgaccgaccgctcccgccgctcgcccaacccccgaacgccttctctcccactcccaaaatccaaaaaaaaaaccaaccgacgcttaaacgcgccacgtaaaacgcgcgcgcctacaaccaaacctcaatcgatccttaaaataaaatccccgcccctcccgccctactccccgatcccccaaaaccgaacccgcccccgcgcctccgaacccctatcttacctaactaaaatctataacgcgaaaaacgtaacaaaccatctacgactcgaaatcgtcgaactacgccttaatcaaataaacaaaataaataaaatcgtaactattataaataaaacgcgaaatatactacgccttatactcgaaaataaataccgccgaattaaactacgtaaccgacaaactaataccccccgaaaccccaacgtccgacgcgaaaacgcaacgcataaaaaacgcgctaaacaccaaaatcacctntcgaaccgacgacgccccgcaaacgcccgcctcgaacttctaactacgcctacgaatctcgaccataaaccaaaacaacataaacaacgtaatcctataatccaaacacgaaccccaacgtaccacaaaaaa

SEQ ID NO: 29769 - DNA, 799 bp, Artificial Sequence
  chemically treated genomic DNA (Homo sapiens) CpG-island No: 29769
tcgaggcgggcgggggttcgttatttttgcgttttatcgtggtcgtcgtttcggcgggaatcgagcggaggagtcgggtggatttttgtttggagggcgtttgtttcgggcgatttttatttcgcgggggtagttagggaaacggaagatggcggcggcggtcgggtacggggtttcgggtttcgttcgggtagagtttattcgttgattaacgtcgtcgttttcgtcgggcggtgttgtgttttcgtaggagtcggagaggatggtaggggtcggaggttagtattatttttcgggcgtcgttggaggagcggtcgtcggagtcggcgtcgcggttattttcgtcgttgtttcggcggtgtcgggagaggattcgtttgatagcgaagcggagtaagagggattttagaatttgattcgtaaagtgtttatttcggggtagattcggattaaggtagggcggaggaggcgggtttgagggtcgcgtggaaagcgggaggtggagagggcgcggtggcgtttggacgcgtcgggcgatttcgggaaggcggtgaaggcggtgttggcggtgtatgttgggaatgcggggatagcggtgaaggttgggtaggcggggaaggttgggatggtgaaacgttaagttgggcggggtttgtgtcgcggtcggttcggtaggagtgggtcgtttttcgtggcgttggatttgggtgtttgcgggatcgattttcggttgttgttcggaaagttgcgattttggtttttaggagtttgatgttaaagacggagtagggaattcggt

SEQ ID NO: 29770 - DNA, 799 bp, Artificial Sequence
  chemically treated genomic DNA (Homo sapiens) CpG-island No: 29770
accgaattccctactccgtctttaacatcaaactcctaaaaaccaaaatcgcaactttccgaacaacaaccgaaaatcgatcccgcaaacacccaaatccaacgccacgaaaaacgacccactcctaccgaaccgaccgcgacacaaaccccgcccaacttaacgtttcaccatcccaaccttccccgcctacccaaccttcaccgctatccccgcattcccaacatacaccgccaacaccgccttcaccgccttcccgaaatcgcccgacgcgtccaaacgccaccgcgccctctccacctcccgctttccacgcgaccctcaaacccgcctcctccgccctaccttaatccgaatctaccccgaaataaacactttacgaatcaaattctaaaatccctcttactccgcttcgctatcaaacgaatcctctcccgacaccgccgaaacaacgacgaaaataaccgcgacgccgactccgacgaccgctcctccaacgacgcccgaaaaataatactaacctccgacccctaccatcctctccgactcctacgaaaacacaacaccgcccgacgaaaacgacgacgttaatcaacgaataaactctacccgaacgaaacccgaaaccccgtacccgaccgccgccgccatcttccgtttccctaactacccccgcgaaataaaaatcgcccgaaacaaacgccctccaaacaaaaatccacccgactcctccgctcgattcccgccgaaacgacgaccacgataaaacgcaaaaataacgaacccccgcccgcctcga

SEQ ID NO: 29771 - DNA, 799 bp, Artificial Sequence
  chemically treated genomic DNA (Homo sapiens) CpG-island No: 29771
atcgggttttttgtttcgtttttgatattaaatttttgggaattaagatcgtagtttttcgaataataatcgggaatcggtttcgtaagtatttaggtttagcgttacggggaacggtttatttttatcggatcggtcgcggtataggtttcgtttagtttaacgttttattattttagtttttttcgtttatttagtttttatcgttattttcgtatttttagtatatatcgttaatatcgtttttatcgttttttcgggatcgttcggcgcgtttaagcgttatcgcgttttttttatttttcgttttttacgcggtttttaggttcgtttttttcgttttattttggttcggatttgtttcgaggtagatattttgcggattagattttggggttttttttgtttcgtttcgttgttagacgaattttttttcggtatcgtcgaggtagcggcggaggtgatcgcggcgtcggtttcggcggtcgtttttttagcggcgttcggagggtggtgttggttttcggtttttgttatttttttcgatttttgcggggatatagtatcgttcggcgggggcggcggcgttggttagcgggtgggttttgttcgagcggagttcggaatttcgtgttcggtcgtcgtcgttatttttcgtttttttagttattttcgcgaggtaagggtcgttcgggataggcgttttttaggtaggggtttattcggttttttcgttcggttttcgtcggagcggcggttacggtgggacgtagaggtaacggattttcgttcgtttcgg

SEQ ID NO: 29772 - DNA, 799 bp, Artificial Sequence
  chemically treated genomic DNA (Homo sapiens) CpG-island No: 29772
ccgaaacgaacgaaaatccgttacctctacgtcccaccgtaaccgccgctccgacgaaaaccgaacgaaaaaaccgaataaacccctacctaaaaaacgcctatcccgaacgacccttacctcgcgaaaataactaaaaaaacgaaaaataacgacgacgaccgaacacgaaattccgaactccgctcgaacaaaacccacccgctaaccaacgccgccgcccccgccgaacgatactatatccccgcaaaaatcgaaaaaaataacaaaaaccgaaaaccaacaccaccctccgaacgccgctaaaaaaacgaccgccgaaaccgacgccgcgatcacctccgccgctacctcgacgataccgaaaaaaaattcgtctaacaacgaaacgaaacaaaaaaaaccccaaaatctaatccgcaaaatatctacctcgaaacaaatccgaaccaaaataaaacgaaaaaaacgaacctaaaaaccgcgtaaaaaacgaaaaataaaaaaaacgcgataacgcttaaacgcgccgaacgatcccgaaaaaacgataaaaacgatattaacgatatatactaaaaatacgaaaataacgataaaaactaaataaacgaaaaaaactaaaataataaaacgttaaactaaacgaaacctataccgcgaccgatccgataaaaataaaccgttccccgtaacgctaaacctaaatacttacgaaaccgattcccgattattattcgaaaaactacgatcttaattcccaaaaatttaatatcaaaaacgaaacaaaaaacccgat

SEQ ID NO: 29773 - DNA, 515 bp, Artificial Sequence
  chemically treated genomic DNA (Homo sapiens) CpG-island No: 29773
  misc_feature (342)..(342): n is either a, c, g or t
  misc_feature (345)..(345): n is either a, c, g or t
  misc_feature (348)..(353): n is either a, c, g or t
  misc_feature (356)..(356): n is either a, c, g or t
  misc_feature (359)..(359): n is either a, c, g or t
  misc_feature (361)..(362): n is either a, c, g or t
  misc_feature (365)..(367): n is either a, c, g or t
  misc_feature (369)..(369): n is either a, c, g or t
  misc_feature (371)..(371): n is either a, c, g or t
  misc_feature (397)..(397): n is either a, c, g or t
gttattttcgcggttaagtttggggttgatattatgtagtatacggcgttatttataatgtatcggtttttttttgttatatataggtacgtatatttattttcgcgttcggagggagtttagggttcggttcgtgggcgtttaggcgtcgattttttcgatttcgtatttatttagaagttgtatcggtcgcgatttcgttttggcgttttcgggggtttggggttcggtcggcggcggtcgcggcgagcgatttcgggtaggatttagttagcgtcgaataaaggttgcgcgtaggtagcgggcgtcgtttgtattttcgtttcgcgtttcggcggcggnggnggnnnnnnggnttngnnggnnntngngttcgttcgtttcgcgttgttcgttntcggggcgtttcggttttcgcgttttcgttcgttgttgttcgtgttcgttgttttcgttttgtttttgttttttttttttttgtttttttgtttgtttttttttttttcgtttttttt

SEQ ID NO: 29774 - DNA, 515 bp, Artificial Sequence
  chemically treated genomic DNA (Homo sapiens) CpG-island No: 29774
  misc_feature (119)..(119): n is either a, c, g or t
  misc_feature (145)..(145): n is either a, c, g or t
  misc_feature (147)..(147): n is either a, c, g or t
  misc_feature (149)..(151): n is either a, c, g or t
  misc_feature (154)..(155): n is either a, c, g or t
  misc_feature (157)..(157): n is either a, c, g or t
  misc_feature (160)..(160): n is either a, c, g or t
  misc_feature (163)..(168): n is either a, c, g or t
  misc_feature (171)..(171): n is either a, c, g or t
  misc_feature (174)..(174): n is either a, c, g or t
aaaaaaaacgaaaaaaaaaaaaacaaacaaaaaaacaaaaaaaaaaaaaacaaaaacaaaacgaaaacaacgaacacgaacaacaacgaacgaaaacgcgaaaaccgaaacgccccganaacgaacaacgcgaaacgaacgaacncnannnccnncnaanccnnnnnnccnccnccgccgccgaaacgcgaaacgaaaatacaaacgacgcccgctacctacgcgcaacctttattcgacgctaactaaatcctacccgaaatcgctcgccgcgaccgccgccgaccgaaccccaaacccccgaaaacgccaaaacgaaatcgcgaccgatacaacttctaaataaatacgaaatcgaaaaaatcgacgcctaaacgcccacgaaccgaaccctaaactccctccgaacgcgaaaataaatatacgtacctatatataacaaaaaaaaaccgatacattataaataacgccgtatactacataatatcaaccccaaacttaaccgcgaaaataac

SEQ ID NO: 29775 - DNA, 515 bp, Artificial Sequence
  chemically treated genomic DNA (Homo sapiens) CpG-island No: 29775
  misc_feature (119)..(119): n is either a, c, g or t
  misc_feature (145)..(145): n is either a, c, g or t
  misc_feature (147)..(147): n is either a, c, g or t
  misc_feature (149)..(151): n is either a, c, g or t
  misc_feature (154)..(155): n is either a, c, g or t
  misc_feature (157)..(157): n is either a, c, g or t
  misc_feature (160)..(160): n is either a, c, g or t
  misc_feature (163)..(168): n is either a, c, g or t
  misc_feature (171)..(171): n is either a, c, g or t
  misc_feature (174)..(174): n is either a, c, g or t
agagagagcgagaaaaggagagataggtaagagaataaggaaagagggaataaagatagaacggagatagcgaatacggataatagcgagcgggagcgcgggagtcggagcgtttcggnagcgggtagcgcggaacgaacgggtntngnnnttnntnggnttnnnnnnttnttntcgtcgtcggggcgcggagcggggatgtaggcggcgttcgttgtttgcgcgtagtttttgttcggcgttggttgaattttattcggagtcgttcgtcgcggtcgtcgtcggtcgggttttaagttttcgagggcgttagggcgggatcgcgatcggtgtaatttttaggtaagtgcggggtcggaggggtcggcgtttgggcgtttacgggtcgggttttgggtttttttcgggcgcgggggtgagtgtgcgtgtttgtgtgtgatagaggagggtcggtgtattgtgggtagcgtcgtgtgttgtatggtgttagttttaggtttggtcgcgagagtggt

SEQ ID NO: 29776 - DNA, 515 bp, Artificial Sequence
  chemically treated genomic DNA (Homo sapiens) CpG-island No: 29776
  misc_feature (342)..(342): n is either a, c, g or t
  misc_feature (345)..(345): n is either a, c, g or t
  misc_feature (348)..(353): n is either a, c, g or t
  misc_feature (356)..(356): n is either a, c, g or t
  misc_feature (359)..(359): n is either a, c, g or t
  misc_feature (361)..(362): n is either a, c, g or t
  misc_feature (365)..(367): n is either a, c, g or t
  misc_feature (369)..(369): n is either a, c, g or t
  misc_feature (371)..(371): n is either a, c, g or t
  misc_feature (397)..(397): n is either a, c, g or t
accactctcgcgaccaaacctaaaactaacaccatacaacacacgacgctacccacaatacaccgaccctcctctatcacacacaaacacgcacactcacccccgcgcccgaaaaaaacccaaaacccgacccgtaaacgcccaaacgccgacccctccgaccccgcacttacctaaaaattacaccgatcgcgatcccgccctaacgccctcgaaaacttaaaacccgaccgacgacgaccgcgacgaacgactccgaataaaattcaaccaacgccgaacaaaaactacgcgcaaacaacgaacgccgcctacatccccgctccgcgccccgacgacganaanaannnnnnaanccnannaannncnanacccgttcgttccgcgctacccgctnccgaaacgctccgactcccgcgctcccgctcgctattatccgtattcgctatctccgttctatctttattccctctttccttattctcttacctatctctccttttctcgctctctct

SEQ ID NO: 29777 - DNA, 1126 bp, Artificial Sequence
  chemically treated genomic DNA (Homo sapiens) CpG-island No: 29777
tacgtattcgaagcgtcgtagttcggttattacgtacgcgtgttttcgttataggtttcgtagttttacggtttgtcgggcggttgggttatgggcgcgtttcgttgtttttagtttcgtttaggtttcgcggtttttattattttatcgttgttaggacgttcgggtaaggagttagggacgcgtttatcgttttgcgtttattcggttttattttttcggttatcgtatgttttaggatgtacgcgtttacgcgagtaaggtttatcgtgtttatggcggtcgttgttagttttggttttcggtttttcgattttttgtttttcgttttcggtttttcgtttttggattttcgttttcggtttatagatttagttttaagtttcgtttcgagatgtttcggtttcgttttttttgttgtcgtcgaggtttcgttttttcgggttcgttttcgtttcgggttcgtttttaagatggtcgtagcgcgtttcggttacgttttcgatcgtatttcgagttttgtttcgttttttcggattcgtttttagtttcgttttgtttttttttttattttaggttaagtttcgagatcgcggcgttaaattttgggttcgtttgtttcggtttttttcgtttttttaattcgggttttgcgggatagttgttgtttcgcgttttggtttcgtttttagtttcgttttttcgttgggtcgtcgatttggatttcgtcggttattggcgtagtaggcggagttgggcggtgcggttttcggtgcgcggtgcgtttgtgcggaatgcggcgggaggcgggtagtcggttcggggtcgtttcggggggcgtcggggagcggttgggtacggtgggtttaggggtggtttagggagcggcgggggtttttttgcggtttcgcgcgagattgggttggatttagggttgaggggagagggtgagcgtaggggtcgcgggtataggggatcgcgggtcggggtttttcgcggggcgggggttttagtagtggggggcgggggggtgcgagggtttagtttttttacgtggtttggttttcgtttgaaaattttcgtaaatgcggtagtattttaattatatatggacgcgatgttttta

SEQ ID NO: 29778 - DNA, 1126 bp, Artificial Sequence
  chemically treated genomic DNA (Homo sapiens) CpG-island No: 29778
taaaaacatcgcgtccatatataattaaaatactaccgcatttacgaaaattttcaaacgaaaaccaaaccacgtaaaaaaactaaaccctcgcacccccccgccccccactactaaaacccccgccccgcgaaaaaccccgacccgcgatcccctatacccgcgacccctacgctcaccctctcccctcaaccctaaatccaacccaatctcgcgcgaaaccgcaaaaaaacccccgccgctccctaaaccacccctaaacccaccgtacccaaccgctccccgacgccccccgaaacgaccccgaaccgactacccgcctcccgccgcattccgcacaaacgcaccgcgcaccgaaaaccgcaccgcccaactccgcctactacgccaataaccgacgaaatccaaatcgacgacccaacgaaaaaacgaaactaaaaacgaaaccaaaacgcgaaacaacaactatcccgcaaaacccgaattaaaaaaacgaaaaaaaccgaaacaaacgaacccaaaatttaacgccgcgatctcgaaacttaacctaaaataaaaaaaaaaacaaaacgaaactaaaaacgaatccgaaaaaacgaaacaaaactcgaaatacgatcgaaaacgtaaccgaaacgcgctacgaccatcttaaaaacgaacccgaaacgaaaacgaacccgaaaaaacgaaacctcgacgacaacaaaaaaaacgaaaccgaaacatctcgaaacgaaacttaaaactaaatctataaaccgaaaacgaaaatccaaaaacgaaaaaccgaaaacgaaaaacaaaaaatcgaaaaaccgaaaaccaaaactaacaacgaccgccataaacacgataaaccttactcgcgtaaacgcgtacatcctaaaacatacgataaccgaaaaaataaaaccgaataaacgcaaaacgataaacgcgtccctaactccttacccgaacgtcctaacaacgataaaataataaaaaccgcgaaacctaaacgaaactaaaaacaacgaaacgcgcccataacccaaccgcccgacaaaccgtaaaactacgaaacctataacgaaaacacgcgtacgtaataaccgaactacgacgcttcgaatacgta

SEQ ID NO: 29779 - DNA, 1126 bp, Artificial Sequence
  chemically treated genomic DNA (Homo sapiens) CpG-island No: 29779
taaagatatcgcgtttatgtataattgagatgttgtcgtatttgcggggatttttaagcgaaaattaggttacgtggaaaggttaagttttcgtattttttcgttttttattgttgggattttcgtttcgcgggagatttcggttcgcggttttttatgttcgcgatttttgcgtttattttttttttttaattttgagtttagtttagtttcgcgcgaggtcgtagggagattttcgtcgttttttggattatttttgggtttatcgtatttagtcgtttttcggcgtttttcgggacgatttcgagtcggttgttcgtttttcgtcgtatttcgtataggcgtatcgcgtatcgagggtcgtatcgtttagtttcgtttgttgcgttaatggtcgacggggtttaagtcggcggtttaacggagaggcggggttaggggcgggattaggacgcgggatagtaattgtttcgtaaggttcggattgaggaggcgggagggatcgaagtaggcggatttaggatttggcgtcgcgatttcgaggtttggtttggagtaggaggggaaataaggcgggattaggggcgaattcgagggggcggagtagggttcggggtgcggtcgggggcgtggtcggggcgcgttgcggttattttgggggcgggttcggggcggagacgagttcgaaggggcggggtttcggcggtagtaagaaaggcgggatcggggtatttcggggcggggtttggggttggatttatgagtcgggagcggggatttaggagcgaggagtcgggagcggggaatagggagtcggggagtcgggaattagggttggtagcggtcgttatgagtacggtggattttgttcgcgtgggcgcgtgtattttgaagtatgcggtgatcggggaggtgaggtcgggtggacgtagggcggtgggcgcgtttttggttttttgttcgggcgttttggtagcgatggggtggtgggggtcgcggggtttgggcggggttgggggtaacggggcgcgtttatgatttagtcgttcggtaggtcgtggagttgcggagtttgtggcgggagtacgcgtgcgtggtggtcgggttgcggcgtttcgggtgcgtg

SEQ ID NO: 29780 - DNA, 1126 bp, Artificial Sequence
  chemically treated genomic DNA (Homo sapiens) CpG-island No: 29780
cacgcacccgaaacgccgcaacccgaccaccacgcacgcgtactcccgccacaaactccgcaactccacgacctaccgaacgactaaatcataaacgcgccccgttacccccaaccccgcccaaaccccgcgacccccaccaccccatcgctaccaaaacgcccgaacaaaaaaccaaaaacgcgcccaccgccctacgtccacccgacctcacctccccgatcaccgcatacttcaaaatacacgcgcccacgcgaacaaaatccaccgtactcataacgaccgctaccaaccctaattcccgactccccgactccctattccccgctcccgactcctcgctcctaaatccccgctcccgactcataaatccaaccccaaaccccgccccgaaataccccgatcccgcctttcttactaccgccgaaaccccgccccttcgaactcgtctccgccccgaacccgcccccaaaataaccgcaacgcgccccgaccacgcccccgaccgcaccccgaaccctactccgccccctcgaattcgcccctaatcccgccttatttcccctcctactccaaaccaaacctcgaaatcgcgacgccaaatcctaaatccgcctacttcgatccctcccgcctcctcaatccgaaccttacgaaacaattactatcccgcgtcctaatcccgcccctaaccccgcctctccgttaaaccgccgacttaaaccccgtcgaccattaacgcaacaaacgaaactaaacgatacgaccctcgatacgcgatacgcctatacgaaatacgacgaaaaacgaacaaccgactcgaaatcgtcccgaaaaacgccgaaaaacgactaaatacgataaacccaaaaataatccaaaaaacgacgaaaatctccctacgacctcgcgcgaaactaaactaaactcaaaattaaaaaaaaaaaataaacgcaaaaatcgcgaacataaaaaaccgcgaaccgaaatctcccgcgaaacgaaaatcccaacaataaaaaacgaaaaaatacgaaaacttaacctttccacgtaacctaattttcgcttaaaaatccccgcaaatacgacaacatctcaattatacataaacgcgatatcttta

SEQ ID NO: 29781 - DNA, 652 bp, Artificial Sequence
  chemically treated genomic DNA (Homo sapiens) CpG-island No: 29781
tggagcgagcggtagcgggagtagcggggatagtttggataagagtattacgttgtttttcgacgagatttttcgtaatttggagaacgttaagcgtttcgttatcgatataggtagtcgtaggtcgggcgtcgggcgcgggttgcgggggcgggcggggcgtcggcggtgggtcggcgagcgggggcggcgggaaggacgaagggcgggggcgcgggtttcgcgtatagttttacgggttttgtagttcgcgggttcgcgtatagttttacgggttttgtagttcgtagggtcgttgatgcgcgggttcggggcgacggtcggattatagttatcggtaggcgtcgtagggattagagcggggtttgtcgggtttggtagttcgcgcggtcgttttgggtggttgggggtcggggtttagcgttattcgtcgcgaggtgggagggtcggcggaattttatgttttcggttatatcggtatttgggcgtttcggtttcgtcgtttggttggtggttggtttgagatttggggtttttagttttggtcgagacgaggacgagttcggcgggaagtttttggtagagtggtttcgaaaaggtcgcgcgttttcgcggcgtggttagttgtggttcgcgggtcggatagttcgtg

SEQ ID NO: 29782 - DNA, 652 bp, Artificial Sequence
  chemically treated genomic DNA (Homo sapiens) CpG-island No: 29782
cacgaactatccgacccgcgaaccacaactaaccacgccgcgaaaacgcgcgaccttttcgaaaccactctaccaaaaacttcccgccgaactcgtcctcgtctcgaccaaaactaaaaaccccaaatctcaaaccaaccaccaaccaaacgacgaaaccgaaacgcccaaataccgatataaccgaaaacataaaattccgccgaccctcccacctcgcgacgaataacgctaaaccccgacccccaaccacccaaaacgaccgcgcgaactaccaaacccgacaaaccccgctctaatccctacgacgcctaccgataactataatccgaccgtcgccccgaacccgcgcatcaacgaccctacgaactacaaaacccgtaaaactatacgcgaacccgcgaactacaaaacccgtaaaactatacgcgaaacccgcgcccccgcccttcgtccttcccgccgcccccgctcgccgacccaccgccgacgccccgcccgcccccgcaacccgcgcccgacgcccgacctacgactacctatatcgataacgaaacgcttaacgttctccaaattacgaaaaatctcgtcgaaaaacaacgtaatactcttatccaaactatccccgctactcccgctaccgctcgctcca

SEQ ID NO: 29783 - DNA, 652 bp, Artificial Sequence
  chemically treated genomic DNA (Homo sapiens) CpG-island No: 29783
tacggattgttcggttcgcgggttatagttggttacgtcgcgggaacgcgcggttttttcggggttattttgttaagggtttttcgtcgagttcgttttcgtttcgattagaattaaggattttaaattttaggttagttattagttaagcggcggagtcggggcgtttagatgtcgatgtggtcgaagatataaaatttcgtcgatttttttatttcgcggcgggtaacgttggatttcggtttttagttatttaggacggtcgcgcgaattattaggttcggtaggtttcgttttggtttttgcggcgtttgtcggtagttgtagttcggtcgtcgtttcgagttcgcgtattagcgattttgcggattataaggttcgtgaggttgtgcgcgggttcgcggattataaggttcgtgaggttgtgcgcgaggttcgcgttttcgtttttcgtttttttcgtcgttttcgttcgtcggtttatcgtcggcgtttcgttcgttttcgtagttcgcgttcggcgttcggtttgcggttatttatgtcgatggcgaagcgtttggcgttttttaggttgcggaagatttcgtcggggggtagcgtgatgtttttgtttagattgttttcgttgttttcgttgtcgttcgtttta

SEQ ID NO: 29784 - DNA, 652 bp, Artificial Sequence
  chemically treated genomic DNA (Homo sapiens) CpG-island No: 29784
taaaacgaacgacaacgaaaacaacgaaaacaatctaaacaaaaacatcacgctaccccccgacgaaatcttccgcaacctaaaaaacgccaaacgcttcgccatcgacataaataaccgcaaaccgaacgccgaacgcgaactacgaaaacgaacgaaacgccgacgataaaccgacgaacgaaaacgacgaaaaaaacgaaaaacgaaaacgcgaacctcgcgcacaacctcacgaaccttataatccgcgaacccgcgcacaacctcacgaaccttataatccgcaaaatcgctaatacgcgaactcgaaacgacgaccgaactacaactaccgacaaacgccgcaaaaaccaaaacgaaacctaccgaacctaataattcgcgcgaccgtcctaaataactaaaaaccgaaatccaacgttacccgccgcgaaataaaaaaatcgacgaaattttatatcttcgaccacatcgacatctaaacgccccgactccgccgcttaactaataactaacctaaaatttaaaatccttaattctaatcgaaacgaaaacgaactcgacgaaaaacccttaacaaaataaccccgaaaaaaccgcgcgttcccgcgacgtaaccaactataacccgcgaaccgaacaatccgta

SEQ ID NO: 29785 - DNA, 512 bp, Artificial Sequence
  chemically treated genomic DNA (Homo sapiens) CpG-island No: 29785
gttttcgttcgggcggtttttttaagaagcgcgcgttagtttttagttcgttttgtatgtaaatgtagcggcgcggcgggagcgcgcggttgatattcgggattgggttgcggcggttagttttttttcggtcgtcgtcgttttcgatatattgttcgtaggagttgcggcggcgaagcggagagtatcggggggaggagatgggtgagtagagcggtttaggttcggtttggtaacgagcgggcgtacgggttaggatggttaggttgttaattgttgttttacgcggataggagttcggtgacgggagggggaggggatgcgagcgtagacgggattcgtttttttttgtcgttttgcggggtggggtttttgttgtgggggcgggatattggacggtgggcggtgtttttaagacgaagttttgtgggggtttgggttttcgtgaggattagttcgtcggggttagaaagggggggcgggatttattagtgggttgtggttttagcgtt

SEQ ID NO: 29786 - DNA, 512 bp, Artificial Sequence
  chemically treated genomic DNA (Homo sapiens) CpG-island No: 29786
aacgctaaaaccacaacccactaataaatcccgccccccctttctaaccccgacgaactaatcctcacgaaaacccaaacccccacaaaacttcgtcttaaaaacaccgcccaccgtccaatatcccgcccccacaacaaaaaccccaccccgcaaaacgacaaaaaaaaacgaatcccgtctacgctcgcatcccctccccctcccgtcaccgaactcctatccgcgtaaaacaacaattaacaacctaaccatcctaacccgtacgcccgctcgttaccaaaccgaacctaaaccgctctactcacccatctcctccccccgatactctccgcttcgccgccgcaactcctacgaacaatatatcgaaaacgacgacgaccgaaaaaaaactaaccgccgcaacccaatcccgaatatcaaccgcgcgctcccgccgcgccgctacatttacatacaaaacgaactaaaaactaacgcgcgcttcttaaaaaaaccgcccgaacgaaaac

SEQ ID NO: 29787 - DNA, 512 bp, Artificial Sequence
  chemically treated genomic DNA (Homo sapiens) CpG-island No: 29787
agcgttgaagttatagtttattggtaagtttcgttttttttttttagtttcgacgagttggtttttacgaaagtttaagtttttatagggtttcgttttagaagtatcgtttatcgtttaatgtttcgtttttataatagaggttttatttcgtaaaacgataggagggggcggatttcgtttgcgttcgtattttttttttttttcgttatcgggtttttgttcgcgtggagtagtaattagtagtttggttattttaattcgtgcgttcgttcgttgttaggtcgagtttgagtcgttttgtttatttatttttttttttcggtgtttttcgtttcgtcgtcgtagtttttgcgggtaatatgtcggaggcgacggcggtcgggagaggattaatcgtcgtagtttagtttcgggtattagtcgcgcgttttcgtcgcgtcgttatatttgtatataaggcgggttggaagttggcgcgcgttttttaaaggggtcgttcggacggaggt

SEQ ID NO: 29788 - DNA, 512 bp, Artificial Sequence
  chemically treated genomic DNA (Homo sapiens) CpG-island No: 29788
acctccgtccgaacgacccctttaaaaaacgcgcgccaacttccaacccgccttatatacaaatataacgacgcgacgaaaacgcgcgactaatacccgaaactaaactacgacgattaatcctctcccgaccgccgtcgcctccgacatattacccgcaaaaactacgacgacgaaacgaaaaacaccgaaaaaaaaaaataaataaacaaaacgactcaaactcgacctaacaacgaacgaacgcacgaattaaaataaccaaactactaattactactccacgcgaacaaaaacccgataacgaaaaaaaaaaaaaatacgaacgcaaacgaaatccgccccctcctatcgttttacgaaataaaacctctattataaaaacgaaacattaaacgataaacgatacttctaaaacgaaaccctataaaaacttaaactttcgtaaaaaccaactcgtcgaaactaaaaaaaaaaaacgaaacttaccaataaactataacttcaacgct

SEQ ID NO: 29789 - DNA, 638 bp, Artificial Sequence
  chemically treated genomic DNA (Homo sapiens) CpG-island No: 29789
gtatgcggttagcgattttagggtatatcgtggtgtttttcgatatgacgttgttggtatataggttttttttgatgtcgatgttatattttatgatgttgttgtaggtggtttcgtgaatgttcgtcgattttatatttggggatcgcggcggggagcgtgagtagaagttcggggcgtcgggggtcggcggggtttgggggtcggggcgagggcgagcggggtttatcgatgaaggagggttggaagagcgttttcgggtagcggaagcgttcgttgtcgatggtgatgatttgttcgtttggtagttcgtagtttttttttagggaggaggaggaggcggtcgtcgttatttcgttttcgaagtttagggttacgtagtatagtttttttttgatgtcgcgtacgatttcgcgtttagttgcggagggtagaagtaggagaggagtttttatttaggggtcgtcgtcggttttttcgttcggggtgtaggggcgtcgcgtatttgtggttacgaaggagtagttacgtttagtgaggatttttattaggtagtcggtgagatcgcggttcgttaggtttaggcgtatgatggcgtgcggtagcgcgtagtttttataaatgggtacgttgtgggt

SEQ ID NO: 29790 - DNA, 638 bp, Artificial Sequence
  chemically treated genomic DNA (Homo sapiens) CpG-island No: 29790
acccacaacgtacccatttataaaaactacgcgctaccgcacgccatcatacgcctaaacctaacgaaccgcgatctcaccgactacctaataaaaatcctcactaaacgtaactactccttcgtaaccacaaatacgcgacgcccctacaccccgaacgaaaaaaccgacgacgacccctaaataaaaactcctctcctacttctaccctccgcaactaaacgcgaaatcgtacgcgacatcaaaaaaaaactatactacgtaaccctaaacttcgaaaacgaaataacgacgaccgcctcctcctcctccctaaaaaaaaactacgaactaccaaacgaacaaatcatcaccatcgacaacgaacgcttccgctacccgaaaacgctcttccaaccctccttcatcgataaaccccgctcgccctcgccccgacccccaaaccccgccgacccccgacgccccgaacttctactcacgctccccgccgcgatccccaaatataaaatcgacgaacattcacgaaaccacctacaacaacatcataaaatataacatcgacatcaaaaaaaacctatataccaacaacgtcatatcgaaaaacaccacgatataccctaaaatcgctaaccgcatac

SEQ ID NO: 29791 - DNA, 638 bp, Artificial Sequence
  chemically treated genomic DNA (Homo sapiens) CpG-island No: 29791
atttataacgtgtttatttatgagggttacgcgttgtcgtacgttattatgcgtttggatttggcgggtcgcgattttatcgattatttgatgaagatttttattgagcgtggttattttttcgtgattataggtgcgcggcgtttttgtatttcgggcgggagggtcggcggcggtttttgagtgagggttttttttttgtttttgtttttcgtagttgagcgcgagatcgtgcgcgatattaaggagaagttgtgttacgtggttttggatttcgagaacgagatggcgacggtcgttttttttttttttttggaaaagagttacgagttgttagacgggtaggttattattatcggtaacgagcgttttcgttgttcggagacgtttttttagtttttttttatcggtgagtttcgttcgttttcgtttcggtttttaggtttcgtcggttttcggcgtttcgagtttttgtttacgtttttcgtcgcggtttttaggtatggagtcggcgggtatttacgagattatttataatagtattatgaagtgtgatatcgatattaggaaggatttgtatgttaataacgttatgtcggggggtattacgatgtattttgggatcgttgatcgtatgt

SEQ ID NO: 29792 - DNA, 638 bp, Artificial Sequence
  chemically treated genomic DNA (Homo sapiens) CpG-island No: 29792
acatacgatcaacgatcccaaaatacatcgtaataccccccgacataacgttattaacatacaaatccttcctaatatcgatatcacacttcataatactattataaataatctcgtaaatacccgccgactccatacctaaaaaccgcgacgaaaaacgtaaacaaaaactcgaaacgccgaaaaccgacgaaacctaaaaaccgaaacgaaaacgaacgaaactcaccgataaaaaaaaactaaaaaaacgtctccgaacaacgaaaacgctcgttaccgataataataacctacccgtctaacaactcgtaactcttttccaaaaaaaaaaaaaaaacgaccgtcgccatctcgttctcgaaatccaaaaccacgtaacacaacttctccttaatatcgcgcacgatctcgcgctcaactacgaaaaacaaaaacaaaaaaaaaaccctcactcaaaaaccgccgccgaccctcccgcccgaaatacaaaaacgccgcgcacctataatcacgaaaaaataaccacgctcaataaaaatcttcatcaaataatcgataaaatcgcgacccgccaaatccaaacgcataataacgtacgacaacgcgtaaccctcataaataaacacgttataaat

SEQ ID NO: 29793 - DNA, 674 bp, Artificial Sequence
  chemically treated genomic DNA (Homo sapiens) CpG-island No: 29793
tgagcggaattaggaggggacgttaaaatcggtttttacgacgcgtagcgggtgggggttagggtttggtttgggcgggcgtttttttttgcgcgtttttttttagtcgttggtcgattgattcggtcgtttcgcgtttttcgttgtcgtagaggttagagttttttttcgttgtttgttagggatatatgtcgtaatttcggttttttttatcgtttcgatttagtttcgttttttttagtttttttatcgtttttcggcgcgacggtcggtagtcgatcgaggtttttgtttttttttgtttaaggtgtcggtcgtttttattgtttcggcggtttttgcgttttttttaaacgcgcgttttcggttttgtttttttcgttttagtttttttttcgggagttttgtttcggtttttgttattttcggtttttagcgtatttttttttttttatttttgcgttttagtttttttttgtagtcgtcggttttttttattgttttcgcgtttttggagtttttttcggagtttttttgcgttttcgtttttttggggtttttttagttttcgcgcggatcgtttaggtttggtaaatttttttttaagttaagtaataatgaaaagttcgtgcgattcgaatattttagtttttttcgtaggaatgggatttttt

SEQ ID NO: 29794 - DNA, 674 bp, Artificial Sequence
  chemically treated genomic DNA (Homo sapiens) CpG-island No: 29794
aaaaaatcccattcctacgaaaaaaactaaaatattcgaatcgcacgaacttttcattattacttaacttaaaaaaaaatttaccaaacctaaacgatccgcgcgaaaactaaaaaaaccccaaaaaaacgaaaacgcaaaaaaactccgaaaaaaactccaaaaacgcgaaaacaataaaaaaaaccgacgactacaaaaaaaaactaaaacgcaaaaataaaaaaaaaaaaatacgctaaaaaccgaaaataacaaaaaccgaaacaaaactcccgaaaaaaaaactaaaacgaaaaaaacaaaaccgaaaacgcgcgtttaaaaaaaacgcaaaaaccgccgaaacaataaaaacgaccgacaccttaaacaaaaaaaaacaaaaacctcgatcgactaccgaccgtcgcgccgaaaaacgataaaaaaactaaaaaaaacgaaactaaatcgaaacgataaaaaaaaccgaaattacgacatatatccctaacaaacaacgaaaaaaaactctaacctctacgacaacgaaaaacgcgaaacgaccgaatcaatcgaccaacgactaaaaaaaaacgcgcaaaaaaaaacgcccgcccaaaccaaaccctaacccccacccgctacgcgtcgtaaaaaccgattttaacgtcccctcctaattccgctca

SEQ ID NO: 29795 - DNA, 674 bp, Artificial Sequence
  chemically treated genomic DNA (Homo sapiens) CpG-island No: 29795
ggaggattttatttttgcggggaaggttagggtgttcgggtcgtacgggttttttattgttatttggtttgggagggggtttgttaggtttgggcgattcgcgcgagagttggaaaagttttagagaggcggagacgtagagaggtttcgagaggagttttagagacgcggggataatgagggggatcgacggttgtagagagagattgagacgtagggatggaggggagggggtacgttggagatcgagggtggtagagatcgagataaagttttcgagaggggagttgaagcgggagagatagagtcgaggacgcgcgtttggggaggacgtagaagtcgtcgaaataataagggcgatcgatattttagatagggagagatagagatttcgatcggttgtcggtcgtcgcgtcgagggacgatggagggattgagaaaggcgaggttaagtcgagacggtaagagaggtcgaggttacggtatgtgtttttggtaggtagcgaagggaggttttgatttttgcggtagcggggagcgcggggcggtcgagttagtcggttagcggttgggagagggcgcgtaggagggggcgttcgtttaggttaggttttaatttttattcgttgcgcgtcgtgggaatcggttttggcgtttttttttggtttcgttta

SEQ ID NO: 29796 - DNA, 674 bp, Artificial Sequence
  chemically treated genomic DNA (Homo sapiens) CpG-island No: 29796
taaacgaaaccaaaaaaaaacgccaaaaccgattcccacgacgcgcaacgaataaaaattaaaacctaacctaaacgaacgccccctcctacgcgccctctcccaaccgctaaccgactaactcgaccgccccgcgctccccgctaccgcaaaaatcaaaacctcccttcgctacctaccaaaaacacataccgtaacctcgacctctcttaccgtctcgacttaacctcgcctttctcaatccctccatcgtccctcgacgcgacgaccgacaaccgatcgaaatctctatctctccctatctaaaatatcgatcgcccttattatttcgacgacttctacgtcctccccaaacgcgcgtcctcgactctatctctcccgcttcaactcccctctcgaaaactttatctcgatctctaccaccctcgatctccaacgtaccccctcccctccatccctacgtctcaatctctctctacaaccgtcgatccccctcattatccccgcgtctctaaaactcctctcgaaacctctctacgtctccgcctctctaaaacttttccaactctcgcgcgaatcgcccaaacctaacaaaccccctcccaaaccaaataacaataaaaaacccgtacgacccgaacaccctaaccttccccgcaaaaataaaatcctcc

SEQ ID NO: 29797 - DNA, 869 bp, Artificial Sequence
  chemically treated genomic DNA (Homo sapiens) CpG-island No: 29797
tcgcgcgggtggagatttttagttgttgttagaagtcgttacgtttttagggtgatttagtcggggattcggtttagggggacgcgtttttgcgattcgttttagtcggattcgtagtgcgggattttttaattttgtaagaagggatttcgttaggtttgaacgggttttagcgggtgggagattttcgtaatttttgtttaggtcgcggcgcgggaaaaagggggtgttagataagggggtcgcgaatttatttcgtttgtttcggtcgatttggtttagtttgggcggtcgtttgttttgttcggcgtcgaagaagttgttggtgttttgtaggcggtaggagaagatttggtttacgtcgtcgtcgtcgtcgtaggggtttagtttttcgtcgtcgtagggtagtattttcgatatggtcgcgttcgggggtttcgtcgcggcgtttttttcgatcgcgttttcgttcgcggcggatagggttagcggcgttggggtcgggggcggtcggtcggggacggttcgcgggttgttgcggcggtggcgtcggcgagaggtcgggggacgtcgttagggtaagagcgcggtattcgcgcgagcggttcggagagcgttcgcggttgcgttgcgttgcgtttcggtttcgcgcgcgagtggttgttgtttcgttagaggcgagtaggatttatattttcggcgcgttggggttttgggcgggggtcgggtcgggcggggtcgcgagtcgggagggaggagacgtttttgcgagttcggagggcgcgggatcgaggagggcgtatttcgggagtcgggcgggtcggttttgcggcgagtgcgggcggcggcgtcggttcggggaggtagat

SEQ ID NO: 29798 - DNA, 869 bp, Artificial Sequence
  chemically treated genomic DNA (Homo sapiens) CpG-island No: 29798
atctacctccccgaaccgacgccgccgcccgcactcgccgcaaaaccgacccgcccgactcccgaaatacgccctcctcgatcccgcgccctccgaactcgcaaaaacgtctcctccctcccgactcgcgaccccgcccgacccgacccccgcccaaaaccccaacgcgccgaaaatataaatcctactcgcctctaacgaaacaacaaccactcgcgcgcgaaaccgaaacgcaacgcaacgcaaccgcgaacgctctccgaaccgctcgcgcgaataccgcgctcttaccctaacgacgtcccccgacctctcgccgacgccaccgccgcaacaacccgcgaaccgtccccgaccgaccgcccccgaccccaacgccgctaaccctatccgccgcgaacgaaaacgcgatcgaaaaaaacgccgcgacgaaacccccgaacgcgaccatatcgaaaatactaccctacgacgacgaaaaactaaacccctacgacgacgacgacgacgtaaaccaaatcttctcctaccgcctacaaaacaccaacaacttcttcgacgccgaacaaaacaaacgaccgcccaaactaaaccaaatcgaccgaaacaaacgaaataaattcgcgacccccttatctaacaccccctttttcccgcgccgcgacctaaacaaaaattacgaaaatctcccacccgctaaaacccgttcaaacctaacgaaatcccttcttacaaaattaaaaaatcccgcactacgaatccgactaaaacgaatcgcaaaaacgcgtccccctaaaccgaatccccgactaaatcaccctaaaaacgtaacgacttctaacaacaactaaaaatctccacccgcgcga

SEQ ID NO: 29799 - DNA, 869 bp, Artificial Sequence
  chemically treated genomic DNA (Homo sapiens) CpG-island No: 29799
gtttgttttttcgaatcggcgtcgtcgttcgtattcgtcgtaggatcggttcgttcggttttcggggtgcgtttttttcggtttcgcgtttttcgggttcgtagggacgttttttttttttcggttcgcggtttcgttcggttcggttttcgtttagagttttagcgcgtcgaggatgtgagttttgttcgtttttggcggagtagtagttattcgcgcgcggagtcggagcgtagcgtagcgtagtcgcgggcgtttttcgggtcgttcgcgcgagtgtcgcgtttttgttttagcggcgtttttcggtttttcgtcggcgttatcgtcgtagtagttcgcgggtcgttttcggtcggtcgttttcggttttagcgtcgttgattttgttcgtcgcgggcggggacgcggtcggaggaggcgtcgcggcggagttttcggacgcgattatgtcggaggtgttgttttacggcgacgagaagttgagtttttacggcgacggcggcgacgtgggttagatttttttttgtcgtttgtaggatattaataattttttcggcgtcgggtagaataagcggtcgtttaagttgggttagatcggtcggagtaagcggggtgagttcgcggtttttttgtttgatattttttttttttcgcgtcgcggtttgaataagggttgcggaggttttttattcgttggagttcgtttagatttgacggaatttttttttgtagaattgggggatttcgtattgcgggttcggttgaagcgggtcgtaggaacgcgtttttttaagtcggattttcggttgggttattttgggggcgtggcggtttttagtagtagttgggggtttttattcgcgcgg

SEQ ID NO: 29800 - DNA, 869 bp, Artificial Sequence
  chemically treated genomic DNA (Homo sapiens) CpG-island No: 29800
ccgcgcgaataaaaacccccaactactactaaaaaccgccacgcccccaaaataacccaaccgaaaatccgacttaaaaaaacgcgttcctacgacccgcttcaaccgaacccgcaatacgaaatcccccaattctacaaaaaaaaattccgtcaaatctaaacgaactccaacgaataaaaaacctccgcaacccttattcaaaccgcgacgcgaaaaaaaaaaaatatcaaacaaaaaaaccgcgaactcaccccgcttactccgaccgatctaacccaacttaaacgaccgcttattctacccgacgccgaaaaaattattaatatcctacaaacgacaaaaaaaaatctaacccacgtcgccgccgtcgccgtaaaaactcaacttctcgtcgccgtaaaacaacacctccgacataatcgcgtccgaaaactccgccgcgacgcctcctccgaccgcgtccccgcccgcgacgaacaaaatcaacgacgctaaaaccgaaaacgaccgaccgaaaacgacccgcgaactactacgacgataacgccgacgaaaaaccgaaaaacgccgctaaaacaaaaacgcgacactcgcgcgaacgacccgaaaaacgcccgcgactacgctacgctacgctccgactccgcgcgcgaataactactactccgccaaaaacgaacaaaactcacatcctcgacgcgctaaaactctaaacgaaaaccgaaccgaacgaaaccgcgaaccgaaaaaaaaaaaacgtccctacgaacccgaaaaacgcgaaaccgaaaaaaacgcaccccgaaaaccgaacgaaccgatcctacgacgaatacgaacgacgacgccgattcgaaaaaacaaac

SEQ ID NO: 29801 - DNA, 700 bp, Artificial Sequence
  chemically treated genomic DNA (Homo sapiens) CpG-island No: 29801
ttcgtcgcgttgttttagggcgtaagttttacgcgtttcgtcgggcgtagaaaagtatttttcgtttcgcggggtttaggtcgtttttttcgataacgtattttcgtagcgacgtttgcgtttggaaggggttcggtatttagatcgtagtttcgcgcgggttatattttttagtaagtgtttcggtagcgttttaggagattcgtcgcgttcgtcggagttggacgtggcgtcgaggttcgcgtcgtcgttcgtatttcggtgtttatttgtattacgtagtagtttagggtatttttttgagcgttaggagggacgatgtttcggggcgtgtggttcgggtgtaagaaatgaattatggtaatttcggcggcggggcgttaaaaagagagtcggcgtcgagtcggagttcggatttcgcgagaattaagcgggcggttgttaggacgcgtttattacgtttgcgaggtatacggagttagcgtcgcgttttgtcggcgagtttttgaaatgttcggcgaggcgacgcgtacgcgggggtcggttcgtcgtagattttatttttcgggcggttttttagttttattcgtttttcgatacgtcgttgtcggggttaatcgtttttttttcgtttttttagtttttttagtttttttagattaatttgttacgatttagtcgtttatttatttttttttag

SEQ ID NO: 29802 - DNA, 700 bp, Artificial Sequence
  chemically treated genomic DNA (Homo sapiens) CpG-island No: 29802
ctaaaaaaaaataaataaacgactaaatcgtaacaaattaatctaaaaaaactaaaaaaactaaaaaaacgaaaaaaaaacgattaaccccgacaacgacgtatcgaaaaacgaataaaactaaaaaaccgcccgaaaaataaaatctacgacgaaccgacccccgcgtacgcgtcgcctcgccgaacatttcaaaaactcgccgacaaaacgcgacgctaactccgtatacctcgcaaacgtaataaacgcgtcctaacaaccgcccgcttaattctcgcgaaatccgaactccgactcgacgccgactctctttttaacgccccgccgccgaaattaccataattcatttcttacacccgaaccacacgccccgaaacatcgtccctcctaacgctcaaaaaaataccctaaactactacgtaatacaaataaacaccgaaatacgaacgacgacgcgaacctcgacgccacgtccaactccgacgaacgcgacgaatctcctaaaacgctaccgaaacacttactaaaaaatataacccgcgcgaaactacgatctaaataccgaaccccttccaaacgcaaacgtcgctacgaaaatacgttatcgaaaaaaacgacctaaaccccgcgaaacgaaaaatacttttctacgcccgacgaaacgcgtaaaacttacgccctaaaacaacgcgacgaa

SEQ ID NO: 29803 - DNA, 700 bp, Artificial Sequence
  chemically treated genomic DNA (Homo sapiens) CpG-island No: 29803
ttgggaaggagtgggtgagcggttgggtcgtggtaggttggtttggggaggttggggaggttggggaggcgggaggagaacggttggtttcggtagcggcgtgtcggagggcggatggggttaggaggtcgttcggggggtggggtttgcggcgggtcggttttcgcgtgcgcgtcgtttcgtcgggtattttaaaagttcgtcggtagggcgcggcgttagtttcgtgtgtttcgtaggcgtggtgggcgcgttttggtagtcgttcgtttggttttcgcgggattcgggtttcggttcgacgtcggttttttttttgacgtttcgtcgtcggggttgttatggtttattttttgtattcgggttatacgtttcggaatatcgttttttttgacgtttagaaggatgttttgggttgttgcgtggtataggtgagtatcggggtgcgggcggcgacgcggatttcggcgttacgtttagtttcggcgagcgcggcgagttttttgggacgttgtcgaggtatttgttggggagtgtggttcgcgcggggttgcggtttagatgtcgagttttttttaggcgtaggcgtcgttgcggaggtgcgttgtcgggggaggcggtttgggtttcgcggagcggggggtgtttttttgcgttcggcgaagcgcgtggaatttgcgttttgaggtagcgcggcgag

SEQ ID NO: 29804 - DNA, 700 bp, Artificial Sequence
  chemically treated genomic DNA (Homo sapiens) CpG-island No: 29804
ctcgccgcgctacctcaaaacgcaaattccacgcgcttcgccgaacgcaaaaaaacaccccccgctccgcgaaacccaaaccgcctcccccgacaacgcacctccgcaacgacgcctacgcctaaaaaaaactcgacatctaaaccgcaaccccgcgcgaaccacactccccaacaaatacctcgacaacgtcccaaaaaactcgccgcgctcgccgaaactaaacgtaacgccgaaatccgcgtcgccgcccgcaccccgatactcacctataccacgcaacaacccaaaacatccttctaaacgtcaaaaaaaacgatattccgaaacgtataacccgaatacaaaaaataaaccataacaaccccgacgacgaaacgtcaaaaaaaaaaccgacgtcgaaccgaaacccgaatcccgcgaaaaccaaacgaacgactaccaaaacgcgcccaccacgcctacgaaacacacgaaactaacgccgcgccctaccgacgaacttttaaaatacccgacgaaacgacgcgcacgcgaaaaccgacccgccgcaaaccccaccccccgaacgacctcctaaccccatccgccctccgacacgccgctaccgaaaccaaccgttctcctcccgcctccccaacctccccaacctccccaaaccaacctaccacgacccaaccgctcacccactccttcccaa

SEQ ID NO: 29805 - DNA, 560 bp, Artificial Sequence
  chemically treated genomic DNA (Homo sapiens) CpG-island No: 29805
tttcgtagttgtagttttagtttttggagtcgttcgtttaggcgttgtagtttcgcgacgtagtcgttttcgtcgtaatttaattttttttgttcggttttttcgttcgttatttttatatttcgtttcgtcgcgtacgtatttgggttacgtgataatataatgttacgttcggcggggttacgtgtcgggcgcgtttgtacggcgtcgagtacgtataaagggttcgatggggaagatatgggggtggggagagtggcgcgagagagttcgagggaggtgaaggtaaggggaaaggagaagggcggggttggggcggtgcggaaaacggcggtttatttatttcgagcgggaagtgggtagtagcggtcgaaaggggcgggttggtgaaggtttgttttcggttacgtgggcgtcgcgacgggaaaaagtttagggaggggcgatttttttcggcgtttcgatttcggcgtggttttttttagtttacgaagttttttacggatatatttttttgttttttaagaggatggtatagggagagttttgagtggtttcgg

SEQ ID NO: 29806 - DNA, 560 bp, Artificial Sequence
  chemically treated genomic DNA (Homo sapiens) CpG-island No: 29806
ccgaaaccactcaaaactctccctataccatcctcttaaaaaacaaaaaaatatatccgtaaaaaacttcgtaaactaaaaaaaaccacgccgaaatcgaaacgccgaaaaaaatcgcccctccctaaactttttcccgtcgcgacgcccacgtaaccgaaaacaaaccttcaccaacccgcccctttcgaccgctactacccacttcccgctcgaaataaataaaccgccgttttccgcaccgccccaaccccgcccttctcctttccccttaccttcacctccctcgaactctctcgcgccactctccccacccccatatcttccccatcgaaccctttatacgtactcgacgccgtacaaacgcgcccgacacgtaaccccgccgaacgtaacattatattatcacgtaacccaaatacgtacgcgacgaaacgaaatataaaaataacgaacgaaaaaaccgaacaaaaaaaattaaattacgacgaaaacgactacgtcgcgaaactacaacgcctaaacgaacgactccaaaaactaaaactacaactacgaaa

SEQ ID NO: 29807 - DNA, 560 bp, Artificial Sequence
  chemically treated genomic DNA (Homo sapiens) CpG-island No: 29807
tcgagattatttagaattttttttgtgttatttttttggggaataggaggatatgttcgtagaagatttcgtggattggggaaagttacgtcgggatcgggacgtcggagagggtcgtttttttttaggttttttttcgtcgcggcgtttacgtgatcgagagtaggtttttattagttcgtttttttcggtcgttgttgtttatttttcgttcggggtaagtaaatcgtcgtttttcgtatcgttttaatttcgttttttttttttttttttgtttttatttttttcgggttttttcgcgttattttttttatttttatattttttttatcgggttttttgtacgtgttcggcgtcgtgtaagcgcgttcggtacgtgatttcgtcgaacgtggtattgtgttattacgtgatttaggtgcgtacgcgacggagcggggtgtgaagatggcggacgaagaggtcgagtaggagaggttgagttgcggcgaaggcggttgcgtcgcggagttgtagcgtttgggcgagcggttttaggagttggagttatagttgcggga

SEQ ID NO: 29808 - DNA, 560 bp, Artificial Sequence
  chemically treated genomic DNA (Homo sapiens) CpG-island No: 29808
tcccgcaactataactccaactcctaaaaccgctcgcccaaacgctacaactccgcgacgcaaccgccttcgccgcaactcaacctctcctactcgacctcttcgtccgccatcttcacaccccgctccgtcgcgtacgcacctaaatcacgtaataacacaataccacgttcgacgaaatcacgtaccgaacgcgcttacacgacgccgaacacgtacaaaaaacccgataaaaaaaatataaaaataaaaaaaataacgcgaaaaaacccgaaaaaaataaaaacaaaaaaaaaaaaaaaaaacgaaattaaaacgatacgaaaaacgacgatttacttaccccgaacgaaaaataaacaacaacgaccgaaaaaaacgaactaataaaaacctactctcgatcacgtaaacgccgcgacgaaaaaaaacctaaaaaaaaacgaccctctccgacgtcccgatcccgacgtaactttccccaatccacgaaatcttctacgaacatatcctcctattccccaaaaaaataacacaaaaaaaattctaaataatctcga

SEQ ID NO: 29809 - DNA, 857 bp, Artificial Sequence
  chemically treated genomic DNA (Homo sapiens) CpG-island No: 29809
gatgttggagtttaggtcgtttcgtagcgtcgtcgttatcggcgacggattcggttttgtttcgtcgtcgtcgtcgttttcgttagggtagttttcgtcgtcgtcgttcggcgggtagtcgaaggttaaggttattttttcgaatagtagcgagtttattatgcgtcggttgcgcggtttagggtttcgggttcgcggttttaggtgcggttttagtttcgggtagggttttcggcgcggtcgggttagggtgggcgcgggttttagcgcggtcggtcgggcggttttagatgcgcgttagatgcggttttcgtagagacggtaggacggatggtttcggatgcgggcgtcgaggcgagagagggtattcggtcgtttttcgggacgcggtggaggtcgcggtatttgcgcggggttagaagggtcgcgggttttatcgttcgggttgttagagacgttgtggaggggtcgcggtagtcgtacgtagaggattttcggtcggtattgttttttttgcggcgggtttcgtttattgtagatattggtttcgttttcgtcgcggtttcgtttattttttttttttttgcggcgtttttcgagttcgaggtttcgttttacgaggttcgtagcgtcgggttttatttatagattttcggtttcgtttattttcgggttttttcgtttttttcgtagtatagatttcgtttagtttttcggcggggttacgtttttttttgcgtttggttttgttttttcgtcgggtgtcgattttttgttgggggattcggatcgtagagttgtattagggatcgggttagttggaatcgtcgtagagttagtcgggttttttaaagggg

SEQ ID NO: 29810 - DNA, 857 bp, Artificial Sequence
  chemically treated genomic DNA (Homo sapiens) CpG-island No: 29810
cccctttaaaaaacccgactaactctacgacgattccaactaacccgatccctaatacaactctacgatccgaatcccccaacaaaaaatcgacacccgacgaaaaaacaaaaccaaacgcaaaaaaaaacgtaaccccgccgaaaaactaaacgaaatctatactacgaaaaaaacgaaaaaacccgaaaataaacgaaaccgaaaatctataaataaaacccgacgctacgaacctcgtaaaacgaaacctcgaactcgaaaaacgccgcaaaaaaaaaaaaaataaacgaaaccgcgacgaaaacgaaaccaatatctacaataaacgaaacccgccgcaaaaaaaacaataccgaccgaaaatcctctacgtacgactaccgcgacccctccacaacgtctctaacaacccgaacgataaaacccgcgacccttctaaccccgcgcaaataccgcgacctccaccgcgtcccgaaaaacgaccgaataccctctctcgcctcgacgcccgcatccgaaaccatccgtcctaccgtctctacgaaaaccgcatctaacgcgcatctaaaaccgcccgaccgaccgcgctaaaacccgcgcccaccctaacccgaccgcgccgaaaaccctacccgaaactaaaaccgcacctaaaaccgcgaacccgaaaccctaaaccgcgcaaccgacgcataataaactcgctactattcgaaaaaataaccttaaccttcgactacccgccgaacgacgacgacgaaaactaccctaacgaaaacgacgacgacgacgaaacaaaaccgaatccgtcgccgataacgacgacgctacgaaacgacctaaactccaacatc

SEQ ID NO: 29811 - DNA, 857 bp, Artificial Sequence
  chemically treated genomic DNA (Homo sapiens) CpG-island No: 29811
tttttttaagaggttcggttggttttgcggcggttttagttaattcggtttttggtgtagttttgcggttcgggttttttagtagagaatcggtattcggcggggaggtaggattagacgtaggagagggcgtggtttcgtcggggagttgggcggagtttatgttgcggagaaagcgggagaattcggaggtgggcggagtcgagggtttgtgggtggggttcggcgttgcgggtttcgtggggcggagtttcgggttcggggaacgtcgtagaaggaggaggggtgggcggggtcgcggcgggggcggggttagtgtttgtagtgggcggggttcgtcgtagaaggggtagtgtcggtcgagagttttttgcgtgcggttgtcgcggtttttttatagcgtttttgatagttcgggcggtgagattcgcgatttttttggtttcgcgtagatatcgcggtttttatcgcgtttcgaggagcggtcgagtgttttttttcgtttcggcgttcgtattcggggttattcgttttgtcgtttttgcggaggtcgtatttggcgcgtatttggaatcgttcggtcggtcgcgttggagttcgcgtttattttggttcggtcgcgtcgggagttttgttcggagttggagtcgtatttggagtcgcgggttcggggttttgagtcgcgtagtcggcgtatggtgaattcgttgttgttcggggagatggttttggttttcggttgttcgtcgggcggcggcggcgggggttgttttggcgggggcggcggcggcggcggggtagggtcgggttcgtcgtcggtgacggcggcgttgcgggacgatttgggttttaatatt

SEQ ID NO: 29812 - DNA, 857 bp, Artificial Sequence
  chemically treated genomic DNA (Homo sapiens) CpG-island No: 29812
aatattaaaacccaaatcgtcccgcaacgccgccgtcaccgacgacgaacccgaccctaccccgccgccgccgccgcccccgccaaaacaacccccgccgccgccgcccgacgaacaaccgaaaaccaaaaccatctccccgaacaacaacgaattcaccatacgccgactacgcgactcaaaaccccgaacccgcgactccaaatacgactccaactccgaacaaaactcccgacgcgaccgaaccaaaataaacgcgaactccaacgcgaccgaccgaacgattccaaatacgcgccaaatacgacctccgcaaaaacgacaaaacgaataaccccgaatacgaacgccgaaacgaaaaaaaacactcgaccgctcctcgaaacgcgataaaaaccgcgatatctacgcgaaaccaaaaaaatcgcgaatctcaccgcccgaactatcaaaaacgctataaaaaaaccgcgacaaccgcacgcaaaaaactctcgaccgacactaccccttctacgacgaaccccgcccactacaaacactaaccccgcccccgccgcgaccccgcccacccctcctccttctacgacgttccccgaacccgaaactccgccccacgaaacccgcaacgccgaaccccacccacaaaccctcgactccgcccacctccgaattctcccgctttctccgcaacataaactccgcccaactccccgacgaaaccacgccctctcctacgtctaatcctacctccccgccgaataccgattctctactaaaaaacccgaaccgcaaaactacaccaaaaaccgaattaactaaaaccgccgcaaaaccaaccgaacctcttaaaaaaa

SEQ ID NO: 29813 - DNA, 526 bp, Artificial Sequence
  chemically treated genomic DNA (Homo sapiens) CpG-island No: 29813
gtgagcgttttagtatttgtcgttttgggcgttttttttatttgcgcgttttacgttcgttttcggtcggtttttaggttttagaggcgatttcgaggaatcgtttcgtttttaaggggcggagtttttttatcgtcgcgttcggtattcggtttatgttgtttcgtttcggcggtcgtttagcgggaggcggagcgagtttaaaatggcggtttttaggttggcgcgtttcgtgttgttggggttttgaggtggtcgtcgggggttcgggggatttttttttcgtcgcggaagttttagaggatgaatcggggattttgttaaggtttggcggcggggttggagagtagtggtagtaagggttgcggtggcgtttacgtagcgggatgtgcgagagttattttaggtcgttgttgagggtttcggtggcgtagatttgttaggcgttgggttgggattcggtgtagtttagcgtttgttatttttttacggacgtgttgtagcgttatttgtagtagttgggtcg

SEQ ID NO: 29814 - DNA, 526 bp, Artificial Sequence
  chemically treated genomic DNA (Homo sapiens) CpG-island No: 29814
cgacccaactactacaaataacgctacaacacgtccgtaaaaaaataacaaacgctaaactacaccgaatcccaacccaacgcctaacaaatctacgccaccgaaaccctcaacaacgacctaaaataactctcgcacatcccgctacgtaaacgccaccgcaacccttactaccactactctccaaccccgccgccaaaccttaacaaaatccccgattcatcctctaaaacttccgcgacgaaaaaaaaatcccccgaacccccgacgaccacctcaaaaccccaacaacacgaaacgcgccaacctaaaaaccgccattttaaactcgctccgcctcccgctaaacgaccgccgaaacgaaacaacataaaccgaataccgaacgcgacgataaaaaaactccgccccttaaaaacgaaacgattcctcgaaatcgcctctaaaacctaaaaaccgaccgaaaacgaacgtaaaacgcgcaaataaaaaaaacgcccaaaacgacaaatactaaaacgctcac

SEQ ID NO: 29815 - DNA, 526 bp, Artificial Sequence
  chemically treated genomic DNA (Homo sapiens) CpG-island No: 29815
cggtttagttgttgtagatagcgttgtagtacgttcgtgaggaggtggtaggcgttgagttgtatcgagttttagtttagcgtttggtagatttgcgttatcgagatttttaataacgatttggagtaattttcgtatatttcgttgcgtggacgttatcgtagtttttgttgttattgttttttagtttcgtcgttagattttagtagggttttcgatttattttttagggttttcgcggcggggaaagggtttttcggattttcggcgattattttaaagttttagtagtacggagcgcgttagtttgagagtcgttattttggattcgtttcgtttttcgttggacggtcgtcggggcgaggtagtataagtcgaatgtcgagcgcggcgatgagaaagtttcgttttttgggagcggaacgatttttcgggatcgtttttgaggtttggaagtcggtcggaagcgggcgtggggcgcgtaggtggaggaggcgtttagggcggtaggtgttggggcgtttat

SEQ ID NO: 29816 - DNA, 526 bp, Artificial Sequence
  chemically treated genomic DNA (Homo sapiens) CpG-island No: 29816
ataaacgccccaacacctaccgccctaaacgcctcctccacctacgcgccccacgcccgcttccgaccgacttccaaacctcaaaaacgatcccgaaaaatcgttccgctcccaaaaaacgaaactttctcatcgccgcgctcgacattcgacttatactacctcgccccgacgaccgtccaacgaaaaacgaaacgaatccaaaataacgactctcaaactaacgcgctccgtactactaaaactttaaaataatcgccgaaaatccgaaaaaccctttccccgccgcgaaaaccctaaaaaataaatcgaaaaccctactaaaatctaacgacgaaactaaaaaacaataacaacaaaaactacgataacgtccacgcaacgaaatatacgaaaattactccaaatcgttattaaaaatctcgataacgcaaatctaccaaacgctaaactaaaactcgatacaactcaacgcctaccacctcctcacgaacgtactacaacgctatctacaacaactaaaccg

SEQ ID NO: 29817 - DNA, 536 bp, Artificial Sequence
  chemically treated genomic DNA (Homo sapiens) CpG-island No: 29817
aagattatttattatatggacgaggaggagacgtcgtatttggttaagttgttcgtggttttcgagcgcgttacgttggtcgattttaagaacgtgtttagtaatcggttcgtgtacgtttataaatttttttttaagtttatggattaggatttcgggttagtcggtcgcgaggtttgcgcgagtttggcgcgggttcgggggtcgtatttgttcgcgcggggacggggcgggggttttgagtcgttcgcgttttcggggatttgcgatcgcgacgcgttttcgttagatgcggcgcgggtggcggtttcggttcgtgtgcggcgcgcgtttatttgttcgtggagcggggcgatggtaggcggggttttcggcgtttttggttttagtttttcggtttcgagttttgttttggttcgtgttagattcggtcggtcgtatcgtttttatcggggttggtcgggagcgtttgtcgttggtgcgggttggggttaggggcgtgttagtgggaaggaagtagggtggggttttttagt

SEQ ID NO: 29818 - DNA, 536 bp, Artificial Sequence
  chemically treated genomic DNA (Homo sapiens) CpG-island No: 29818
actaaaaaaccccaccctacttccttcccactaacacgcccctaaccccaacccgcaccaacgacaaacgctcccgaccaaccccgataaaaacgatacgaccgaccgaatctaacacgaaccaaaacaaaactcgaaaccgaaaaactaaaaccaaaaacgccgaaaaccccgcctaccatcgccccgctccacgaacaaataaacgcgcgccgcacacgaaccgaaaccgccacccgcgccgcatctaacgaaaacgcgtcgcgatcgcaaatccccgaaaacgcgaacgactcaaaacccccgccccgtccccgcgcgaacaaatacgacccccgaacccgcgccaaactcgcgcaaacctcgcgaccgactaacccgaaatcctaatccataaacttaaaaaaaaatttataaacgtacacgaaccgattactaaacacgttcttaaaatcgaccaacgtaacgcgctcgaaaaccacgaacaacttaaccaaatacgacgtctcctcctcgtccatataataaataatctt

SEQ ID NO: 29819 - DNA, 536 bp, Artificial Sequence
  chemically treated genomic DNA (Homo sapiens) CpG-island No: 29819
gttagggaattttattttgttttttttttattgatacgtttttgattttagttcgtattaacggtaggcgttttcggttagtttcggtggaagcgatgcggtcgatcgagtttgatacgggttaaggtaggattcggggtcgggaagttggggttagggacgtcgggaatttcgtttgttatcgtttcgttttacggataggtgggcgcgcgtcgtatacgggtcgaggtcgttattcgcgtcgtatttagcggaggcgcgtcgcggtcgtaggttttcgggggcgcgaacggtttaggattttcgtttcgttttcgcgcgggtaggtgcgattttcgagttcgcgttaggttcgcgtaggtttcgcggtcgattgattcgaagttttggtttatggatttaaagaagaatttgtaggcgtgtacgggtcggttgttgagtacgtttttgaagtcggttagcgtgacgcgttcgggggttacgggtagtttgattaggtacggcgtttttttttcgtttatgtggtagataatttt

SEQ ID NO: 29820 - DNA, 536 bp, Artificial Sequence
  chemically treated genomic DNA (Homo sapiens) CpG-island No: 29820
aaaattatctaccacataaacgaaaaaaaaacgccgtacctaatcaaactacccgtaacccccgaacgcgtcacgctaaccgacttcaaaaacgtactcaacaaccgacccgtacacgcctacaaattcttctttaaatccataaaccaaaacttcgaatcaatcgaccgcgaaacctacgcgaacctaacgcgaactcgaaaatcgcacctacccgcgcgaaaacgaaacgaaaatcctaaaccgttcgcgcccccgaaaacctacgaccgcgacgcgcctccgctaaatacgacgcgaataacgacctcgacccgtatacgacgcgcgcccacctatccgtaaaacgaaacgataacaaacgaaattcccgacgtccctaaccccaacttcccgaccccgaatcctaccttaacccgtatcaaactcgatcgaccgcatcgcttccaccgaaactaaccgaaaacgcctaccgttaatacgaactaaaatcaaaaacgtatcaataaaaaaaaaacaaaataaaattccctaac

SEQ ID NO: 29821 - DNA, 808 bp, Artificial Sequence
  chemically treated genomic DNA (Homo sapiens) CpG-island No: 29821
gtgcgcgagttgtattcggggtttttggcgtatcgcgtagcgcgtgttcgcgatttttttgcgttggcggcggcgttggtttacggggtcgaggttaattgggcggacgcggaggatgagggtaagacgtcgttggtgtaggtcgtgttaggggtgagcgagttacgggggttgcgcgtaggatataggtgtatagtcgcgtttgtattttttgtggcgtttatataagggtcgtttgttcgcggtggggattaagttcggtttcggttgggggcgtttaaggtcggggttagggtgtagaggcgcggagaggggtcggtgtcgtggtttcgtttgagttgtttcggttttttagggttttttgatcgtttgtgagtttttgttgtaaaacggagcggacgtgaattaaagagatagtcggggtcgggcgtttttgtattacgttacgttgttgggtcgtatcgggtgagacgcgtaatttacgtttcgttttgtgtttcgattacgtttatttcggttcggttacgttttgttcgttatgttttattcggttacgttttcgcgattatattcgtttcgtttcgtttcgtttcgatacgttttttcgatttcgttttttagttaggtttgtttgtttttgaagcggggcgcggattagtacgttttggattaagagtagcgggattcgttggttatcgtagtgtaggcggttaacgttgatatcgtgatattgtgagcgcggtcgggttttcggggttgggcggggtttttagggtaggggcggggttttaagggtaggggcggggtt

SEQ ID NO: 29822 - DNA, 808 bp, Artificial Sequence
  chemically treated genomic DNA (Homo sapiens) CpG-island No: 29822
aaccccgcccctacccttaaaaccccgcccctaccctaaaaaccccgcccaaccccgaaaacccgaccgcgctcacaatatcacgatatcaacgttaaccgcctacactacgataaccaacgaatcccgctactcttaatccaaaacgtactaatccgcgccccgcttcaaaaacaaacaaacctaactaaaaaacgaaatcgaaaaaacgtatcgaaacgaaacgaaacgaaacgaatataatcgcgaaaacgtaaccgaataaaacataacgaacaaaacgtaaccgaaccgaaataaacgtaatcgaaacacaaaacgaaacgtaaattacgcgtctcacccgatacgacccaacaacgtaacgtaatacaaaaacgcccgaccccgactatctctttaattcacgtccgctccgttttacaacaaaaactcacaaacgatcaaaaaaccctaaaaaaccgaaacaactcaaacgaaaccacgacaccgacccctctccgcgcctctacaccctaaccccgaccttaaacgcccccaaccgaaaccgaacttaatccccaccgcgaacaaacgacccttatataaacgccacaaaaaatacaaacgcgactatacacctatatcctacgcgcaacccccgtaactcgctcacccctaacacgacctacaccaacgacgtcttaccctcatcctccgcgtccgcccaattaacctcgaccccgtaaaccaacgccgccgccaacgcaaaaaaatcgcgaacacgcgctacgcgatacgccaaaaaccccgaatacaactcgcgcac

SEQ ID NO: 29823 - DNA, 808 bp, Artificial Sequence
  chemically treated genomic DNA (Homo sapiens) CpG-island No: 29823
ggtttcgtttttgtttttgaggtttcgtttttgttttggaggtttcgtttagtttcgagggttcggtcgcgtttatagtgttacgatgttagcgttggtcgtttgtattgcgatggttaacgggtttcgttgtttttggtttagggcgtgttggttcgcgtttcgttttaggaataggtaaatttggttgaggggcgaggtcggaggggcgtgtcggggcggggcggggcggggcgagtgtggtcgcgggggcgtggtcggatagggtatggcggatagggcgtagtcgggtcggggtaggcgtggtcggggtatagggcggggcgtgggttgcgcgttttattcggtgcggtttagtagcgtggcgtggtgtaggggcgttcggtttcggttgtttttttggtttacgttcgtttcgttttgtagtaggaatttatagacgattaaggagttttggggagtcggggtaatttagacggagttacggtatcggttttttttcgcgtttttgtattttgatttcggttttgggcgtttttagtcgggatcgaatttggtttttatcgcggataggcgatttttgtgtgggcgttatagaagatgtaaacgcgattgtgtatttgtgttttgcgcgtagttttcgtggttcgtttatttttagtacggtttgtattagcggcgttttgtttttatttttcgcgttcgtttagttgatttcggtttcgtgggttagcgtcgtcgttagcgtaggaaggtcgcgggtacgcgttgcgcggtgcgttaagagtttcgggtgtagttcgcgtat

SEQ ID NO: 29824 - DNA, 808 bp, Artificial Sequence
  chemically treated genomic DNA (Homo sapiens) CpG-island No: 29824
atacgcgaactacacccgaaactcttaacgcaccgcgcaacgcgtacccgcgaccttcctacgctaacgacgacgctaacccacgaaaccgaaatcaactaaacgaacgcgaaaaataaaaacaaaacgccgctaatacaaaccgtactaaaaataaacgaaccacgaaaactacgcgcaaaacacaaatacacaatcgcgtttacatcttctataacgcccacacaaaaatcgcctatccgcgataaaaaccaaattcgatcccgactaaaaacgcccaaaaccgaaatcaaaatacaaaaacgcgaaaaaaaaccgataccgtaactccgtctaaattaccccgactccccaaaactccttaatcgtctataaattcctactacaaaacgaaacgaacgtaaaccaaaaaaacaaccgaaaccgaacgcccctacaccacgccacgctactaaaccgcaccgaataaaacgcgcaacccacgccccgccctataccccgaccacgcctaccccgacccgactacgccctatccgccataccctatccgaccacgcccccgcgaccacactcgccccgccccgccccgccccgacacgcccctccgacctcgcccctcaaccaaatttacctattcctaaaacgaaacgcgaaccaacacgccctaaaccaaaaacaacgaaacccgttaaccatcgcaatacaaacgaccaacgctaacatcgtaacactataaacgcgaccgaaccctcgaaactaaacgaaacctccaaaacaaaaacgaaacctcaaaaacaaaaacgaaacc

SEQ ID NO: 29825 - DNA, 859 bp, Artificial Sequence
  chemically treated genomic DNA (Homo sapiens) CpG-island No: 29825
aaaaacgggggaaatagttttagacgttttcgttttttacgtaattttattttcgttgttagatacgttattttcgtagttttgagttcgtattttcgtcggttcgttgggaattcggtttttgggtggttcggaaacgattttggatttgcgggtatatttagggttcgtattttttgggattgtgggaaatgtagttttttgttttcgtaagggattaggcggagttgaggaatcgcgcgaggattgggatcgtgattttattaatcggaaatcgtcgtttttcgggttcggcggggtttgagttaatgtagaatcgggggtcgcgaggacgttagcgggcgttgtgcgtaggaatcgtcgggtggtcgttgtcgatcggggtcgatttggggacggatcggaagtgttcgagggcggtcgtagaacggttaatttgagtcgcgtcgaggtcgggtttgggaagggttagcgggaggtttgagggcgtcgggcgttgcggtaggcgggttcggggtttagtcgagagggttcgggcgttaggtaacgcgattcgcgcgggggtgaattcggggagggggtcggttttttcgttttgggatttttcggtgcgttcgagcgcgatatcgttcgcgtcgggggtttgggagtttcggggcgcgagttgtgttggaagtaaagttttttttgtgggttggggtggcggagggagaagggaagcgagggtcgcggcgggattagacgttttagtttcggttcgttcgcgattattgaaggcgttgtcgtttgatttgaacgggtatttgtgttttagtttttttgggatttgtggtcgtcgtttatagattatgtttttggg

SEQ ID NO: 29826 - DNA, 859 bp, Artificial Sequence
  chemically treated genomic DNA (Homo sapiens) CpG-island No: 29826
cccaaaaacataatctataaacgacgaccacaaatcccaaaaaaactaaaacacaaatacccgttcaaatcaaacgacaacgccttcaataatcgcgaacgaaccgaaactaaaacgtctaatcccgccgcgaccctcgcttcccttctccctccgccaccccaacccacaaaaaaaactttacttccaacacaactcgcgccccgaaactcccaaacccccgacgcgaacgatatcgcgctcgaacgcaccgaaaaatcccaaaacgaaaaaaccgaccccctccccgaattcacccccgcgcgaatcgcgttacctaacgcccgaaccctctcgactaaaccccgaacccgcctaccgcaacgcccgacgccctcaaacctcccgctaacccttcccaaacccgacctcgacgcgactcaaattaaccgttctacgaccgccctcgaacacttccgatccgtccccaaatcgaccccgatcgacaacgaccacccgacgattcctacgcacaacgcccgctaacgtcctcgcgacccccgattctacattaactcaaaccccgccgaacccgaaaaacgacgatttccgattaataaaatcacgatcccaatcctcgcgcgattcctcaactccgcctaatcccttacgaaaacaaaaaactacatttcccacaatcccaaaaaatacgaaccctaaatatacccgcaaatccaaaatcgtttccgaaccacccaaaaaccgaattcccaacgaaccgacgaaaatacgaactcaaaactacgaaaataacgtatctaacaacgaaaataaaattacgtaaaaaacgaaaacgtctaaaactatttcccccgttttt

SEQ ID NO: 29827 - DNA, 859 bp, Artificial Sequence
  chemically treated genomic DNA (Homo sapiens) CpG-island No: 29827
tttaggagtatggtttgtgggcggcggttataggttttaggggagttggaatataagtgttcgtttaggttaggcggtagcgtttttagtagtcgcgggcgggtcgggattggggcgtttggtttcgtcgcgattttcgtttttttttttttttcgttattttaatttataaggaggattttgtttttaatatagttcgcgtttcgaggtttttaagttttcgacgcgggcggtgtcgcgttcggacgtatcgaaaggttttagaacggggaggtcggtttttttttcgggtttattttcgcgcgaatcgcgttgtttggcgttcggattttttcggttggatttcgggttcgtttgtcgtagcgttcggcgtttttaggtttttcgttgattttttttaagttcgatttcgacgcggtttaaattgatcgttttgcggtcgttttcgggtattttcggttcgtttttaagtcggtttcgatcggtagcggttattcggcggtttttacgtatagcgttcgttggcgttttcgcggttttcgattttgtattggtttaggtttcgtcgggttcgaaaggcgacggttttcggttagtggaattacggttttagttttcgcgcggttttttagtttcgtttggttttttacggaggtaaaaaattatattttttataattttagggggtgcgggttttggatatattcgtaggtttagaatcgttttcggattatttaggggtcggatttttaacgggtcgacggaagtgcgggtttaagattacggaagtgacgtatttggtaacggaagtggagttacgtggaaggcggaagcgtttagagttatttttttcgttttt

SEQ ID NO: 29828 - DNA, 859 bp, Artificial Sequence
  chemically treated genomic DNA (Homo sapiens) CpG-island No: 29828
aaaaacgaaaaaaataactctaaacgcttccgccttccacgtaactccacttccgttaccaaatacgtcacttccgtaatcttaaacccgcacttccgtcgacccgttaaaaatccgacccctaaataatccgaaaacgattctaaacctacgaatatatccaaaacccgcaccccctaaaattataaaaaatataattttttacctccgtaaaaaaccaaacgaaactaaaaaaccgcgcgaaaactaaaaccgtaattccactaaccgaaaaccgtcgcctttcgaacccgacgaaacctaaaccaatacaaaatcgaaaaccgcgaaaacgccaacgaacgctatacgtaaaaaccgccgaataaccgctaccgatcgaaaccgacttaaaaacgaaccgaaaatacccgaaaacgaccgcaaaacgatcaatttaaaccgcgtcgaaatcgaacttaaaaaaaatcaacgaaaaacctaaaaacgccgaacgctacgacaaacgaacccgaaatccaaccgaaaaaatccgaacgccaaacaacgcgattcgcgcgaaaataaacccgaaaaaaaaaccgacctccccgttctaaaacctttcgatacgtccgaacgcgacaccgcccgcgtcgaaaacttaaaaacctcgaaacgcgaactatattaaaaacaaaatcctccttataaattaaaataacgaaaaaaaaaaaaaaacgaaaatcgcgacgaaaccaaacgccccaatcccgacccgcccgcgactactaaaaacgctaccgcctaacctaaacgaacacttatattccaactcccctaaaacctataaccgccgcccacaaaccatactcctaaa

SEQ ID NO: 29829 - DNA, 651 bp, Artificial Sequence
  chemically treated genomic DNA (Homo sapiens) CpG-island No: 29829
tatgtacgtatgtgttgcgtgttggtcgtgtacgtgtgttacgtgtatgtgtgttatttgtgtatgtcgtgtgtgttgtgagcgtatgttgtgcgtatgtgcgtgttatgtgttttgcgtgtattatgtgtgtgttgtttgtatgtgttatttgtgttatgtacgtgttatttgcgtgcgatgcgcgtgtgttatacgtcgtttgtttgcgtgttatgtatgtgtggtatttgtgtatgtgtcgttttcgtgtgtattgtgtgtgtcgtgtgtgtgttatttgtatgtgtcgttttgtgtgtgttatgcgcgtgtgttatgtatttgtcgtgcgtgtgttatttgtgtgtattatgcgtatgtgttattcgtgtgtatcgtatacgtgtgttatttgtatgtatgttgtgtacgtgtggtatgtatgtgtgtcgtttgtatgttatgtatgtgttttttgcgtgtgtcgtgcgtgttttatgtacgtgtgtcgtgtatgtgttattcgcgtgtattatgcgtatgtgtcgtttgtgtgtgtgtcgtatttttgtgttcgtgtgttaggttcgtatgtgcgttatatttacgtgtgtttagtatgtgttatatgtatgtgcggtggtagtgtgtgttttttataggtttttt

SEQ ID NO: 29830 - DNA, 651 bp, Artificial Sequence
  chemically treated genomic DNA (Homo sapiens) CpG-island No: 29830
aaaaaacctataaaaaacacacactaccaccgcacatacatataacacatactaaacacacgtaaatataacgcacatacgaacctaacacacgaacacaaaaatacgacacacacacaaacgacacatacgcataatacacgcgaataacacatacacgacacacgtacataaaacacgcacgacacacgcaaaaaacacatacataacatacaaacgacacacatacataccacacgtacacaacatacatacaaataacacacgtatacgatacacacgaataacacatacgcataatacacacaaataacacacgcacgacaaatacataacacacgcgcataacacacacaaaacgacacatacaaataacacacacacgacacacacaatacacacgaaaacgacacatacacaaataccacacatacataacacgcaaacaaacgacgtataacacacgcgcatcgcacgcaaataacacgtacataacacaaataacacatacaaacaacacacacataatacacgcaaaacacataacacgcacatacgcacaacatacgctcacaacacacacgacatacacaaataacacacatacacgtaacacacgtacacgaccaacacgcaacacatacgtacata

SEQ ID NO: 29831 - DNA, 651 bp, Artificial Sequence
  chemically treated genomic DNA (Homo sapiens) CpG-island No: 29831
ggaggatttgtgagggatatatattattatcgtatatgtatatggtatatgttgagtatacgtgaatatggcgtatatgcgaatttggtatacgagtataggaatgcggtatatatataaacggtatatgcgtatggtatacgcgaatggtatatgtacggtatacgtgtatgggatacgtacggtatacgtaaggaatatatgtatggtatgtaaacggtatatatgtatgttatacgtgtatagtatatatgtaaatggtatacgtgtacggtgtatacgaatggtatatgcgtatggtatatataaatggtatacgtacggtaagtgtatggtatacgcgtatggtatatataaaacggtatatgtaaatggtatatatacggtatatataatatatacggaaacggtatatatataaatgttatatatgtatggtacgtaagtaaacgacgtgtggtatacgcgtatcgtacgtaaatggtacgtgtatgatataaatggtatatgtaaatagtatatatatggtatacgtaaagtatatggtacgtatatgcgtatagtatacgtttatagtatatacggtatatataaatggtatatatgtacgtggtatacgtgtacggttaatacgtagtatatacgtgtatg

SEQ ID NO: 29832 - DNA, 651 bp, Artificial Sequence
  chemically treated genomic DNA (Homo sapiens) CpG-island No: 29832
catacacgtatatactacgtattaaccgtacacgtataccacgtacatatataccatttatatataccgtatatactataaacgtatactatacgcatatacgtaccatatactttacgtataccatatatatactatttacatataccatttatatcatacacgtaccatttacgtacgatacgcgtataccacacgtcgtttacttacgtaccatacatatataacatttatatatataccgtttccgtatatattatatataccgtatatataccatttacatataccgttttatatataccatacgcgtataccatacacttaccgtacgtataccatttatatataccatacgcatataccattcgtatacaccgtacacgtataccatttacatatatactatacacgtataacatacatatataccgtttacataccatacatatattccttacgtataccgtacgtatcccatacacgtataccgtacatataccattcgcgtataccatacgcatataccgtttatatatataccgcattcctatactcgtataccaaattcgcatatacgccatattcacgtatactcaacatataccatatacatatacgataataatatatatccctcacaaatcctcc

SEQ ID NO: 29833 - DNA, 1349 bp, Artificial Sequence
  chemically treated genomic DNA (Homo sapiens) CpG-island No: 29833
tcgtttcgtgtttttgtttcgtttcgtgtttgtttcgtttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgtttttcgtgtttttgtttcgtttcgtgtttttgtttcgtttcgtgtttttgtttcgtttttcgtgtttttgtttcgtttcgtgtttttgtttcgtttttcgtgtttttgtttcgtttttcgagtttttgtttcgtttttcgtgtttttgtttcgttttagtgtttttgtttcgtttcgtgtttttgtttcgtatcgtgtttttgtttcgtttcgtgtttttgtttcgtttcgtgtttttgtttcgtttttcgtgtttttgtttcgtttcgtgtttttgtttcgtttttcgtgtttttgtttcgtttcgtgtttttgtttcgtttcgtgtttttgtttcgtttcgagtttttgtttcgtttcgagtttttgtttcgtttcgagtttttgtttcgtttcgtgtttttgtttcgttttatgtttatgtttcgtttcgtagtttttgtttcgtttcgtgttttagtttcgtttcgtgtttttgtttcgtttcgtgtttttgtttcgtttcgtgtttttgtttcgtttttcgtgtttttgtttcgtttcgtgtttttgtttcgtttttcgtgtttttgtttcgtttcgtgtttttgtttcgtttcgtgtttttgtttcgtttcgagtttttgtttcgtttagagtttttgtttcgtttcgtgtttttgtttcgtttttcgtgtttttgtttcgtttttcgagtttttgtttcgtttttcgtgtttttgtttcgtttcgtgtttttgtttcgtttcgtgtttttgtttcgtttcgtgtttttgtttcgtttttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgttttatttcgtgtttttgtttcgtttcgtgtttttgtttcgtttcgtgtttttgtttcgtttcgtgtttttgtttcgtttcgtgtttttgtttcgttttttatgtttttattttattttatgtttttgtttattttttatgtttttagg

SEQ ID NO: 29834 - DNA, 1349 bp, Artificial Sequence
  chemically treated genomic DNA (Homo sapiens) CpG-island No: 29834
cctaaaaacataaaaaataaacaaaaacataaaataaaataaaaacataaaaaacgaaacaaaaacacgaaacgaaacaaaaacacgaaacgaaacaaaaacacgaaacgaaacaaaaacacgaaacgaaacaaaaacacgaaataaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaaaacgaaacaaaaacacgaaacgaaacaaaaacacgaaacgaaacaaaaacacgaaacgaaacaaaaacacgaaaaacgaaacaaaaactcgaaaaacgaaacaaaaacacgaaaaacgaaacaaaaacacgaaacgaaacaaaaactctaaacgaaacaaaaactcgaaacgaaacaaaaacacgaaacgaaacaaaaacacgaaacgaaacaaaaacacgaaaaacgaaacaaaaacacgaaacgaaacaaaaacacgaaaaacgaaacaaaaacacgaaacgaaacaaaaacacgaaacgaaacaaaaacacgaaacgaaactaaaacacgaaacgaaacaaaaactacgaaacgaaacataaacataaaacgaaacaaaaacacgaaacgaaacaaaaactcgaaacgaaacaaaaactcgaaacgaaacaaaaactcgaaacgaaacaaaaacacgaaacgaaacaaaaacacgaaacgaaacaaaaacacgaaaaacgaaacaaaaacacgaaacgaaacaaaaacacgaaaaacgaaacaaaaacacgaaacgaaacaaaaacacgaaacgaaacaaaaacacgatacgaaacaaaaacacgaaacgaaacaaaaacactaaaacgaaacaaaaacacgaaaaacgaaacaaaaactcgaaaaacgaaacaaaaacacgaaaaacgaaacaaaaacacgaaacgaaacaaaaacacgaaaaacgaaacaaaaacacgaaacgaaacaaaaacacgaaacgaaacaaaaacacgaaaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaacgaaacaaacacgaaacgaaacaaaaacacgaaacga

SEQ ID NO: 29835 - DNA, 1349 bp, Artificial Sequence
  chemically treated genomic DNA (Homo sapiens) CpG-island No: 29835
tttggggatatgggggatgagtagggatatgggatggagtggagatatgggggacggggtagagatacgggacggggtagagatacgggacggagtagagatacgggacggagtagagatacgggacggagtagagatacgggatggagtagagatacgggacggagtagggatacgggacggagtagagatacgggacggagtagagatacgggacggagtagagatacgggacggagtagagatacgggacggagtagagatacgggggacggggtagagatacgggacggagtagagatacgggggacggagtagagatacgggacggagtagagatacgggacggagtagagatacgggacggagtagagatacgggggacggagtagagattcgggggacggggtagagatacgggggacggggtagagatacgggacggggtagagattttggacggagtagagattcgggacggagtagggatacgggacggggtagagatacgggacggggtagagatacgggggacggggtagagatacgggacggagtagagatacgggggacggggtagagatacgggacggagtagggatacgggacggagtagagatacgggacggggttgagatacgggacggagtagagattacgggacggagtatagatatgggacggagtagggatacgggacggggtagagattcgggacggagtagagattcgggacggagtagagattcgggacggagtagggatacgggacggggtagagatacgggacggggtagagatacgggggacggggtagagatacgggacggagtagagatacgggggacggggtagagatacgggacggagtagggatacgggacggggtagagatacggtacggggtagagatacgggacggagtagagatattgggacggagtagagatacgggggacggagtagagattcgggggacggggtagagatacgggggacggggtagagatacgggacggggtagagatacgggggacggggtagagatacgggacggagtagggatacgggacggagtagagatacgggggacggagtagagatacgggggacggggtagagatacgggacggggtagagatacgggacggggtagagatacgggacggagtagagatacgggacggagtagagatacgggacggggtagagatacgggacggagtagagatacgggacggggtagagatacgggacggagtagagatacgggggacggagtagagatacgggacggagtagagatacgggacggagtagatacgggacggagtagggatacgggacgg

SEQ ID NO: 29836 - DNA, 1349 bp, Artificial Sequence
  chemically treated genomic DNA (Homo sapiens) CpG-island No: 29836
ccgtcccgtatccctactccgtcccgtatctactccgtcccgtatctctactccgtcccgtatctctactccgtcccccgtatctctactccgtcccgtatctctaccccgtcccgtatctctactccgtcccgtatctctaccccgtcccgtatctctactccgtcccgtatctctactccgtcccgtatctctaccccgtcccgtatctctaccccgtcccgtatctctaccccgtcccccgtatctctactccgtcccccgtatctctactccgtcccgtatccctactccgtcccgtatctctaccccgtcccccgtatctctaccccgtcccgtatctctaccccgtcccccgtatctctaccccgtcccccgaatctctactccgtcccccgtatctctactccgtcccaatatctctactccgtcccgtatctctaccccgtaccgtatctctaccccgtcccgtatccctactccgtcccgtatctctaccccgtcccccgtatctctactccgtcccgtatctctaccccgtcccccgtatctctaccccgtcccgtatctctaccccgtcccgtatccctactccgtcccgaatctctactccgtcccgaatctctactccgtcccgaatctctaccccgtcccgtatccctactccgtcccatatctatactccgtcccgtaatctctactccgtcccgtatctcaaccccgtcccgtatctctactccgtcccgtatccctactccgtcccgtatctctaccccgtcccccgtatctctactccgtcccgtatctctaccccgtcccccgtatctctaccccgtcccgtatctctaccccgtcccgtatccctactccgtcccgaatctctactccgtccaaaatctctaccccgtcccgtatctctaccccgtcccccgtatctctaccccgtcccccgaatctctactccgtcccccgtatctctactccgtcccgtatctctactccgtcccgtatctctactccgtcccgtatctctactccgtcccccgtatctctactccgtcccgtatctctaccccgtcccccgtatctctactccgtcccgtatctctactccgtcccgtatctctactccgtcccgtatctctactccgtcccgtatctctactccgtcccgtatccctactccgtcccgtatctctactccatcccgtatctctactccgtcccgtatctctactccgtcccgtatctctactccgtcccgtatctctaccccgtcccgtatctctaccccgtcccccatatctccactccatcccatatccctactcatcccccatatccccaaa

SEQ ID NO: 29837 - DNA, 1424 bp, Artificial Sequence
  chemically treated genomic DNA (Homo sapiens) CpG-island No: 29837
ttcgttcgcgtcgtttcggcgttcgttcgtttcggaatgaggtcgtcgcgtcgcgtttcgtttcgtttgttatcgtcggggagcgtcgttaaagttagtcgttcgcgcgtatcgttcgttgttattgtcggggagcgtcgttaaggttcgtcgttcgcgcgcgtcgttcgttgttatcgtcggggagcgtcgttaaacgtttttcgtagcgtttagggattatttcggttcggaagtgaggcggggtttgttacggtcgttttcggggatagtcggtggaaatgtggggcgcggggagggcgcggggagggcgcgggttcgttcgttttaattatttcggtcgttgcgtaatttagggcgtttgtaaaaattacgtttgggaggatttggtcgtaacgcggcgaacgggcgcgttcggggagtgtgggcggcggcgaatgaatgagcgagtgaacgaatgtacgttcgcgagagcgcggggtgatcgcgtggttggtgcgcgtttttcggggcgtcgcgatagaggtagagcgtttgcgttcggcggcgggtcggtattttgtagtcgttttttaagttcggtttcgttttcgtttttcgattttggtcgtcgtggcgcggtgttatcgcgtaggcgtaagagcggtcggggtcgggggggagggggggggggcgtgattaggtcgcgttcgcgcgcgcgtaggatttttgcgttggaggtcgtttttgacgttatcggttgggtttcgttatgagttcggcgtcggttttaggtttcgtgcgcgcgcgttattttgtgtatttttagtacgtgggtatcgattttaagtaggttttttaggcgtagcggcgggcgttacgtgggttcgggcggaggcgggaaggagggcgcgggcgggtaggcggatgtttttggacgcgggttttaaacgttcggggaaggaagcggttttggttttagacggcggcggagattttagggtagggcgttttcggtaattttcgttcgtttttgttcgtagcggggtcgcggtcgttaggggtatttagcgcgtcgtcggggtttagaattatttggaggtgcgtttagtcggttacgggacgttcggtgaggggtaagggggaggttttcgttcgcgcgttttcggggttcggtttcgtttattcgttcgtttcgcggttcggttttgtaggaggtcgtcgagcggttgaatttcgtggagtcggttaggtttattatttttagtcgtacggacgtcggggtttacgttttgagtaacgcggcgtatttggacgtttagcgtcgtttaggtcggtcgtttttttcgttcgaggttttggtcgaggtttttaatatatatttgcggtattcggttattaggtgagttcgcgatttaagtagttttggggttgtgttttttcga

SEQ ID NO: 29838 - DNA, 1424 bp, Artificial Sequence
  chemically treated genomic DNA (Homo sapiens) CpG-island No: 29838
tcgaaaaaacacaaccccaaaactacttaaatcgcgaactcacctaataaccgaataccgcaaatatatattaaaaacctcgaccaaaacctcgaacgaaaaaaacgaccgacctaaacgacgctaaacgtccaaatacgccgcgttactcaaaacgtaaaccccgacgtccgtacgactaaaaataataaacctaaccgactccacgaaattcaaccgctcgacgacctcctacaaaaccgaaccgcgaaacgaacgaataaacgaaaccgaaccccgaaaacgcgcgaacgaaaacctcccccttacccctcaccgaacgtcccgtaaccgactaaacgcacctccaaataattctaaaccccgacgacgcgctaaatacccctaacgaccgcgaccccgctacgaacaaaaacgaacgaaaattaccgaaaacgccctaccctaaaatctccgccgccgtctaaaaccaaaaccgcttccttccccgaacgtttaaaacccgcgtccaaaaacatccgcctacccgcccgcgccctccttcccgcctccgcccgaacccacgtaacgcccgccgctacgcctaaaaaacctacttaaaatcgatacccacgtactaaaaatacacaaaataacgcgcgcgcacgaaacctaaaaccgacgccgaactcataacgaaacccaaccgataacgtcaaaaacgacctccaacgcaaaaatcctacgcgcgcgcgaacgcgacctaatcacgccccccccccctcccccccgaccccgaccgctcttacgcctacgcgataacaccgcgccacgacgaccaaaatcgaaaaacgaaaacgaaaccgaacttaaaaaacgactacaaaataccgacccgccgccgaacgcaaacgctctacctctatcgcgacgccccgaaaaacgcgcaccaaccacgcgatcaccccgcgctctcgcgaacgtacattcgttcactcgctcattcattcgccgccgcccacactccccgaacgcgcccgttcgccgcgttacgaccaaatcctcccaaacgtaatttttacaaacgccctaaattacgcaacgaccgaaataattaaaacgaacgaacccgcgccctccccgcgccctccccgcgccccacatttccaccgactatccccgaaaacgaccgtaacaaaccccgcctcacttccgaaccgaaataatccctaaacgctacgaaaaacgtttaacgacgctccccgacgataacaacgaacgacgcgcgcgaacgacgaaccttaacgacgctccccgacaataacaacgaacgatacgcgcgaacgactaactttaacgacgctccccgacgataacaaacgaaacgaaacgcgacgcgacgacctcattccgaaacgaacgaacgccgaaacgacgcgaacgaa

SEQ ID NO: 29839 - DNA, 1424 bp, Artificial Sequence
  chemically treated genomic DNA (Homo sapiens) CpG-island No: 29839
tcgggaaggtatagttttagggttgtttaggtcgcgggtttatttgatggtcgggtgtcgtaggtgtgtgttgagggtttcggttaggatttcgggcgggaagggcggtcggtttgagcggcgttggacgtttaggtgcgtcgcgttgtttagggcgtggatttcggcgttcgtgcggttggagatggtgaatttgatcggttttacggaatttagtcgttcggcggttttttgtaggatcgagtcgcggggcgggcgggtgagcgaggtcggatttcggggacgcgcgggcgggagttttttttttattttttatcgggcgtttcgtgatcggttgagcgtatttttaggtagttttggatttcgacggcgcgttgagtgtttttgacggtcgcgatttcgttgcgggtagaagcgggcggaggttatcgggggcgttttgttttggggttttcgtcgtcgtttgaggttagggtcgttttttttttcgaacgtttggaattcgcgtttagagatattcgtttgttcgttcgcgttttttttttcgttttcgttcgggtttacgtggcgttcgtcgttgcgtttgggaaatttatttaaagtcggtgtttacgtattggaagtatataagatagcgcgcgcgtacggagtttgaggtcggcgtcgaatttatggcggagtttagtcggtggcgttagaggcggtttttagcgtaggaattttgcgcgcgcgcggacgcggtttggttacgttttttttttttttttttcggtttcggtcgtttttgcgtttgcgcggtggtatcgcgttacggcggttagagtcggggagcggaggcggggtcgggtttagggagcggttgtaaagtgtcggttcgtcgtcgagcgtaggcgttttatttttatcgcggcgtttcgggaggcgcgtattaattacgcggttatttcgcgttttcgcgggcgtgtattcgtttattcgtttatttattcgtcgtcgtttatatttttcgagcgcgttcgttcgtcgcgttgcggttaagtttttttagacgtggtttttgtaaacgttttgagttgcgtaacggtcgggatggttggagcgggcgggttcgcgtttttttcgcgtttttttcgcgttttatatttttatcgattgttttcggagacggtcgtggtaggtttcgttttattttcggatcggggtggtttttggacgttgcgagaggcgtttggcgacgtttttcggcggtgatagcgggcggcgcgcgcgggcggcggattttggcgacgtttttcggtagtgatagcgggcggtgcgcgcgggcggttgattttggcgacgtttttcggcggtgataggcggggcggggcgcggcgcggcggttttatttcggggcgggcgggcgtcgaggcggcgcgggcggg

SEQ ID NO: 29840 - DNA, 1424 bp, Artificial Sequence
  chemically treated genomic DNA (Homo sapiens) CpG-island No: 29840
cccgcccgcgccgcctcgacgcccgcccgccccgaaataaaaccgccgcgccgcgccccgccccgcctatcaccgccgaaaaacgtcgccaaaatcaaccgcccgcgcgcaccgcccgctatcactaccgaaaaacgtcgccaaaatccgccgcccgcgcgcgccgcccgctatcaccgccgaaaaacgtcgccaaacgcctctcgcaacgtccaaaaaccaccccgatccgaaaataaaacgaaacctaccacgaccgtctccgaaaacaatcgataaaaatataaaacgcgaaaaaaacgcgaaaaaaacgcgaacccgcccgctccaaccatcccgaccgttacgcaactcaaaacgtttacaaaaaccacgtctaaaaaaacttaaccgcaacgcgacgaacgaacgcgctcgaaaaatataaacgacgacgaataaataaacgaataaacgaatacacgcccgcgaaaacgcgaaataaccgcgtaattaatacgcgcctcccgaaacgccgcgataaaaataaaacgcctacgctcgacgacgaaccgacactttacaaccgctccctaaacccgaccccgcctccgctccccgactctaaccgccgtaacgcgataccaccgcgcaaacgcaaaaacgaccgaaaccgaaaaaaaaaaaaaaaaaacgtaaccaaaccgcgtccgcgcgcgcgcaaaattcctacgctaaaaaccgcctctaacgccaccgactaaactccgccataaattcgacgccgacctcaaactccgtacgcgcgcgctatcttatatacttccaatacgtaaacaccgactttaaataaatttcccaaacgcaacgacgaacgccacgtaaacccgaacgaaaacgaaaaaaaaaacgcgaacgaacaaacgaatatctctaaacgcgaattccaaacgttcgaaaaaaaaaacgaccctaacctcaaacgacgacgaaaaccccaaaacaaaacgcccccgataacctccgcccgcttctacccgcaacgaaatcgcgaccgtcaaaaacactcaacgcgccgtcgaaatccaaaactacctaaaaatacgctcaaccgatcacgaaacgcccgataaaaaataaaaaaaaaactcccgcccgcgcgtccccgaaatccgacctcgctcacccgcccgccccgcgactcgatcctacaaaaaaccgccgaacgactaaattccgtaaaaccgatcaaattcaccatctccaaccgcacgaacgccgaaatccacgccctaaacaacgcgacgcacctaaacgtccaacgccgctcaaaccgaccgcccttcccgcccgaaatcctaaccgaaaccctcaacacacacctacgacacccgaccatcaaataaacccgcgacctaaacaaccctaaaactataccttcccga

SEQ ID NO: 29841 - DNA, 899 bp, Artificial Sequence
  chemically treated genomic DNA (Homo sapiens) CpG-island No: 29841
gcgtggggttcggcgatcgttaggtggaagacgcggcgttcgtgtaggttatagtaatggtggtgtaggtggtaggagtaggtgttttcgtcggcgatttttagcggttcgatacgtagtgagaagttatcgcgtttaaaggtattcgcgtttatagttacgcggtcgcgtagaaaaaggggttcgtaggcgcggcgttcgttcgacgcgtagaggtttagtaggcggttcgcgcggtcgtgcgggatttcgggcggttgtcggttttagtgtattatttgttgagttttttttacgtgtcggtcggtttatacgtgttcgcggtttacgtaggttagaagcgcgggtgcgtcgcgcgttatcgttagtatttttttttcgtcgttttagtaggcgggggtggtcggggttgcggagggggcgcggttagcggcgcgcgggtcggggcggcggtcgagggtcgaggggcgggagttggggggcgggggggaagtatttacggtcgtcggtgatttttaggcggacggttaggttttcgtagaggtggtagtagtgatggtgtaggttgtaggtgtatagtttcgcgttcgttttttttatcgttgcgtatttaggaggaagtcgcgcgtgagttttgcggtgttttcgatttcgcggtttcggatttttgtttcgatttcgcggtttcggttttcggttttcgtatcgcggatgagtagcgagaagttgtcgtcgtcgaaggtcgaggtcgagagttttaggcggtcgcggtttcgcgtttcgtatacgcgttgttcgttcgtcgagtataagtttagtaggcgtcgcgcggggttattttcggggtcgcgtaggttttagtggagtacgcgttggcggtcgtgtagtcggttttgggt

SEQ ID NO: 29842 - DNA, 899 bp, Artificial Sequence
  chemically treated genomic DNA (Homo sapiens) CpG-island No: 29842
acccaaaaccgactacacgaccgccaacgcgtactccactaaaacctacgcgaccccgaaaataaccccgcgcgacgcctactaaacttatactcgacgaacgaacaacgcgtatacgaaacgcgaaaccgcgaccgcctaaaactctcgacctcgaccttcgacgacgacaacttctcgctactcatccgcgatacgaaaaccgaaaaccgaaaccgcgaaatcgaaacaaaaatccgaaaccgcgaaatcgaaaacaccgcaaaactcacgcgcgacttcctcctaaatacgcaacgataaaaaaaacgaacgcgaaactatacacctacaacctacaccatcactactaccacctctacgaaaacctaaccgtccgcctaaaaatcaccgacgaccgtaaatacttcccccccgccccccaactcccgcccctcgaccctcgaccgccgccccgacccgcgcgccgctaaccgcgccccctccgcaaccccgaccacccccgcctactaaaacgacgaaaaaaaaatactaacgataacgcgcgacgcacccgcgcttctaacctacgtaaaccgcgaacacgtataaaccgaccgacacgtaaaaaaaactcaacaaataatacactaaaaccgacaaccgcccgaaatcccgcacgaccgcgcgaaccgcctactaaacctctacgcgtcgaacgaacgccgcgcctacgaacccctttttctacgcgaccgcgtaactataaacgcgaatacctttaaacgcgataacttctcactacgtatcgaaccgctaaaaatcgccgacgaaaacacctactcctaccacctacaccaccattactataacctacacgaacgccgcgtcttccacctaacgatcgccgaaccccacgc

SEQ ID NO: 29843 - DNA, 899 bp, Artificial Sequence
  chemically treated genomic DNA (Homo sapiens) CpG-island No: 29843
atttaggatcggttgtacgatcgttagcgcgtgttttattgggatttgcgcggtttcgggggtggtttcgcgcggcgtttgttggatttgtattcggcgggcgagtagcgcgtgtacgaggcgcgggatcgcggtcgtttggagttttcggtttcggttttcgacgacggtaatttttcgttgtttattcgcggtgcggggatcggggatcggggtcgcggggtcggggtaggggttcggggtcgcggggtcgggggtatcgtaaggtttacgcgcggtttttttttgggtgcgtagcggtggaggagacggacgcggggttgtatatttgtaatttgtattattattattgttatttttacgagagtttggtcgttcgtttggaggttatcgacggtcgtgagtgtttttttttcgttttttagttttcgtttttcgattttcgatcgtcgtttcggttcgcgcgtcgttgatcgcgtttttttcgtagtttcggttattttcgtttattgggacggcgagaagaaggtgttggcggtggcgcgcggcgtattcgcgtttttgatttgcgtgaatcgcgggtacgtgtggatcgatcggtacgtggaggaggtttaataggtggtgtattgggatcggtagtcgttcggggtttcgtacgatcgcgcggatcgtttgttggatttttacgcgtcgggcgagcgtcgcgtttacgggtttttttttttgcgcgatcgcgtggttgtgggcgcggatgtttttgagcgcggtgattttttattgcgtatcgagtcgttggaggtcgtcgacgagggtatttatttttgttatttgtattattattattgtggtttgtacgaacgtcgcgttttttatttgacggtcgtcgaattttacgt

SEQ ID NO: 29844 - DNA, 899 bp, Artificial Sequence
  chemically treated genomic DNA (Homo sapiens) CpG-island No: 29844
acgtaaaattcgacgaccgtcaaataaaaaacgcgacgttcgtacaaaccacaataataataatacaaataacaaaaataaataccctcgtcgacgacctccaacgactcgatacgcaataaaaaatcaccgcgctcaaaaacatccgcgcccacaaccacgcgatcgcgcaaaaaaaaaaacccgtaaacgcgacgctcgcccgacgcgtaaaaatccaacaaacgatccgcgcgatcgtacgaaaccccgaacgactaccgatcccaatacaccacctattaaacctcctccacgtaccgatcgatccacacgtacccgcgattcacgcaaatcaaaaacgcgaatacgccgcgcgccaccgccaacaccttcttctcgccgtcccaataaacgaaaataaccgaaactacgaaaaaaacgcgatcaacgacgcgcgaaccgaaacgacgatcgaaaatcgaaaaacgaaaactaaaaaacgaaaaaaaaacactcacgaccgtcgataacctccaaacgaacgaccaaactctcgtaaaaataacaataataataatacaaattacaaatatacaaccccgcgtccgtctcctccaccgctacgcacccaaaaaaaaaccgcgcgtaaaccttacgatacccccgaccccgcgaccccgaacccctaccccgaccccgcgaccccgatccccgatccccgcaccgcgaataaacaacgaaaaattaccgtcgtcgaaaaccgaaaccgaaaactccaaacgaccgcgatcccgcgcctcgtacacgcgctactcgcccgccgaatacaaatccaacaaacgccgcgcgaaaccacccccgaaaccgcgcaaatcccaataaaacacgcgctaacgatcgtacaaccgatcctaaat

SEQ ID NO: 29845 - DNA, 1009 bp, Artificial Sequence
  chemically treated genomic DNA (Homo sapiens) CpG-island No: 29845
  misc_feature (984)..(984): n is either a, c, g or t
agcgacggggggagtgaggagggggtttggacggggtaggagcgacggggggagtgaggagggggtttggacggggtaggagcgacggggggagtgaggagggggtttggacggggtaggagcgacggggggagtgaggagggggtttggacggggtaggagcgacggggggagtgaggagggggtttggacggggtaggagcgacggggggagtgaggagggggtttggacggggtaggagcgacggggggagtgaggagggggtttggacggggtaggagcgacggggggagtgaggagggggtttggatcgggtaggagcgacggggggagtgaggagggggtttggatcgggtaggagcgacggggggagtgaggagggggtttggatcgggtaggagcgacggggggagtgaggagggggtcgtaggagcgacggggggagtgagggggtttggatcgggtaggagcgacggggggagtgaggagggggtttggatcgggtaggagcgacggggggagtgaggagggggtttggatcgggtaggagcgacggggggagtgaggagggggtttggatcgggtaggagcgacggggggagtgaggagggggtttggacggggtaggagcgacggggggagtgaggagggggtttggacggggtaggagcgacggggggagtgaggagggggtttggacggggttggagcgacggggggagtgaggagggggtttggatcgggtaggagcgacggggggagtgaggagggggtttggatcgggtaggagcgacggggggagtgaggagggggtttggacggggtaggagcgacggggggagtgaggagggggtttggacggggtaggagcgacggggggagtgaggagggggtttggacggggtaggagcgacggggggagtgaggagggggtttggacggggtaggagcgacggggggagtgaggagggggtttggacggngtaggagcgacggggggagtgagga

SEQ ID NO: 29846 - DNA, 1009 bp, Artificial Sequence
  chemically treated genomic DNA (Homo sapiens) CpG-island No: 29846
  misc_feature (26)..(26): n is either a, c, g or t
tcctcactccccccgtcgctcctacnccgtccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgctcctacccgatccaaaccccctcctcactccccccgtcgctcctacccgatccaaaccccctcctcactccccccgtcgctccaaccccgtccaaaccccctcctcactccccccgtcgctcctaccccgtccaaaccccctcctcactccccccgtcgctcctaccccgtccaaaccccctcctcactccccccgtcgctcctacccgatccaaaccccctcctcactccccccgtcgctcctacccgatccaaaccccctcctcactccccccgtcgctcctacccgatccaaaccccctcctcactccccccgtcgctcctacccgatccaaaccccctcactccccccgtcgctcctacgaccccctcctcactccccccgtcgctcctacccgatccaaaccccctcctcactccccccgtcgctcctacccgatccaaaccccctcctcactccccccgtcgctcctacccgatccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgctcctaccccgtccaaaccccctcctcactccccccgtcgct

SEQ ID NO: 29847 - DNA, 1009 bp, Artificial Sequence
  chemically treated genomic DNA (Homo sapiens) CpG-island No: 29847
  misc_feature (26)..(26): n is either a, c, g or t
tttttatttttttcgtcgtttttgtntcgtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtttttgttcggtttaggttttttttttatttttttcgtcgtttttgttcggtttaggttttttttttatttttttcgtcgttttagtttcgtttaggttttttttttatttttttcgtcgtttttgtttcgtttaggttttttttttatttttttcgtcgtttttgtttcgtttaggttttttttttatttttttcgtcgtttttgttcggtttaggttttttttttatttttttcgtcgtttttgttcggtttaggttttttttttatttttttcgtcgtttttgttcggtttaggttttttttttatttttttcgtcgtttttgttcggtttaggtttttttatttttttcgtcgtttttgcggttttttttttatttttttcgtcgtttttgttcggtttaggttttttttttatttttttcgtcgtttttgttcggtttaggttttttttttatttttttcgtcgtttttgttcggtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtttttgtttcgtttaggttttttttttatttttttcgtcgtt

SEQ ID NO: 29848 - DNA, 1009 bp, Artificial Sequence
  chemically treated genomic DNA (Homo sapiens) CpG-island No: 29848
  misc_feature (984)..(984): n is either a, c, g or t
aacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaaccgaacaaaaacgacgaaaaaaataaaaaaaaaacctaaaccgaacaaaaacgacgaaaaaaataaaaaaaaaacctaaaccgaacaaaaacgacgaaaaaaataaaaaaaaaaccgcaaaaacgacgaaaaaaataaaaaaacctaaaccgaacaaaaacgacgaaaaaaataaaaaaaaaacctaaaccgaacaaaaacgacgaaaaaaataaaaaaaaaacctaaaccgaacaaaaacgacgaaaaaaataaaaaaaaaacctaaaccgaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaactaaaacgacgaaaaaaataaaaaaaaaacctaaaccgaacaaaaacgacgaaaaaaataaaaaaaaaacctaaaccgaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacgaaacaaaaacgacgaaaaaaataaaaaaaaaacctaaacganacaaaaacgacgaaaaaaataaaaa

SEQ ID NO: 29849 - DNA, 596 bp, Artificial Sequence
  chemically treated genomic DNA (Homo sapiens) CpG-island No: 29849
tttcgttagggagaggttttcggttagggcgttttattttgttgttgggaagcgtgttttttgtcggtggggttttttgtgggaattttcgatcgtttggggattcggagttgtaggatttgggttaaatagacgttgggttatcgaagtttcgacgtcgggttatcgtacgtttttttgtttaggtgttggagtcgtttttcggggttcgaggagggattttggagttgcgttcgcgatttcgttatcgtttatagttgcgcgttaggtttaacggttttatttattaaggtttttggagttcgtggtcggatttaattagggtggagatcgttatcgagatcggtgaggtaagtttcggtcgtattaaagtcgtatagcgtttgcgttagggattgggcgtcgggtgcgagtggggcggggttcggagaggggcgaggcgcggggcgcggagaggggcggggttttgattttgcgggtcgacggttgcgtaggtgttcgtagtgtttaggggcggcgaggggcggggttagagtaggggttggttggatgagggcggggtttcggttcgggtgggtcgaagtttgatttttttt

SEQ ID NO: 29850 - DNA, 596 bp, Artificial Sequence
  chemically treated genomic DNA (Homo sapiens) CpG-island No: 29850
aaaaaaaatcaaacttcgacccacccgaaccgaaaccccgccctcatccaaccaacccctactctaaccccgcccctcgccgcccctaaacactacgaacacctacgcaaccgtcgacccgcaaaatcaaaaccccgcccctctccgcgccccgcgcctcgcccctctccgaaccccgccccactcgcacccgacgcccaatccctaacgcaaacgctatacgactttaatacgaccgaaacttacctcaccgatctcgataacgatctccaccctaattaaatccgaccacgaactccaaaaaccttaataaataaaaccgttaaacctaacgcgcaactataaacgataacgaaatcgcgaacgcaactccaaaatccctcctcgaaccccgaaaaacgactccaacacctaaacaaaaaaacgtacgataacccgacgtcgaaacttcgataacccaacgtctatttaacccaaatcctacaactccgaatccccaaacgatcgaaaattcccacaaaaaaccccaccgacaaaaaacacgcttcccaacaacaaaataaaacgccctaaccgaaaacctctccctaacgaaa

SEQ ID NO: 29851 - DNA, 596 bp, Artificial Sequence
  chemically treated genomic DNA (Homo sapiens) CpG-island No: 29851
aaaaagggttagatttcggtttattcgggtcggagtttcgtttttatttagttagtttttattttggtttcgtttttcgtcgtttttgggtattgcgggtatttgcgtagtcgtcggttcgtaaggttagggtttcgttttttttcgcgtttcgcgtttcgttttttttcgagtttcgttttattcgtattcggcgtttagtttttggcgtaggcgttgtgcggttttggtgcggtcggggtttgttttatcggtttcggtggcggtttttattttagttgggttcgattacgagttttagggattttggtaggtggggtcgttgagtttggcgcgtagttgtaaacggtagcgagatcgcgggcgtagttttagggttttttttcgggtttcgagaggcggttttagtatttgagtaaagaagcgtgcggtggttcggcgtcggggtttcgatagtttagcgtttgtttgatttaaattttgtagtttcgaatttttaggcggtcggagatttttataaagagttttatcggtagaaaatacgttttttagtaataggatagagcgttttaatcgagagtttttttttaacggga

SEQ ID NO: 29852 - DNA, 596 bp, Artificial Sequence
  chemically treated genomic DNA (Homo sapiens) CpG-island No: 29852
tcccgttaaaaaaaaactctcgattaaaacgctctatcctattactaaaaaacgtattttctaccgataaaactctttataaaaatctccgaccgcctaaaaattcgaaactacaaaatttaaatcaaacaaacgctaaactatcgaaaccccgacgccgaaccaccgcacgcttctttactcaaatactaaaaccgcctctcgaaacccgaaaaaaaaccctaaaactacgcccgcgatctcgctaccgtttacaactacgcgccaaactcaacgaccccacctaccaaaatccctaaaactcgtaatcgaacccaactaaaataaaaaccgccaccgaaaccgataaaacaaaccccgaccgcaccaaaaccgcacaacgcctacgccaaaaactaaacgccgaatacgaataaaacgaaactcgaaaaaaaacgaaacgcgaaacgcgaaaaaaaacgaaaccctaaccttacgaaccgacgactacgcaaatacccgcaatacccaaaaacgacgaaaaacgaaaccaaaataaaaactaactaaataaaaacgaaactccgacccgaataaaccgaaatctaacccttttt

SEQ ID NO: 29853 - DNA, 599 bp, Artificial Sequence
  chemically treated genomic DNA (Homo sapiens) CpG-island No: 29853
gtcgttcgcggttttttttttttttttaggaacggtttaagcgttttgggtattttatcgggttttgtatcgagttttgtattataaatacgattttcgtgtaggatttaagtgtgaatttttgtaggttttcggattttgaagtattcggggttagatatttcgagttcgcggcggtggaaggtacgtaaaagggcgaatcgagacgattttaggacgttgaggtagcgtaggttttattcggtttcgttttgtttcgttttgtttcggtcggttttttagtattagttttttggcgtcggtttttagtttttttcgtattttttaaatcgcgtttcgtcgttagattttcgtgatagttgagatttttttcggaaggttcgtttttttcgtcggagaggttaatgggttagggtaacggttgcgacggttggattttgaaggagttaataggcgttcggagcggagagtttaagaggcgtaagttaggcgtgttaaagtcggtcggaattgtttcggagggtacggtgagaggtggtggggttgagtcgaggtggggtcgtggttagggggagggggtgttaggtcggaaggggttg

SEQ ID NO: 29854 - DNA, 599 bp, Artificial Sequence
  chemically treated genomic DNA (Homo sapiens) CpG-island No: 29854
caaccccttccgacctaacaccccctccccctaaccacgaccccacctcgactcaaccccaccacctctcaccgtaccctccgaaacaattccgaccgactttaacacgcctaacttacgcctcttaaactctccgctccgaacgcctattaactccttcaaaatccaaccgtcgcaaccgttaccctaacccattaacctctccgacgaaaaaaacgaaccttccgaaaaaaatctcaactatcacgaaaatctaacgacgaaacgcgatttaaaaaatacgaaaaaaactaaaaaccgacgccaaaaaactaatactaaaaaaccgaccgaaacaaaacgaaacaaaacgaaaccgaataaaacctacgctacctcaacgtcctaaaatcgtctcgattcgcccttttacgtaccttccaccgccgcgaactcgaaatatctaaccccgaatacttcaaaatccgaaaacctacaaaaattcacacttaaatcctacacgaaaatcgtatttataatacaaaactcgatacaaaacccgataaaatacccaaaacgcttaaaccgttcctaaaaaaaaaaaaaaaaccgcgaacgac

SEQ ID NO: 29855 - DNA, 599 bp, Artificial Sequence
  chemically treated genomic DNA (Homo sapiens) CpG-island No: 29855
tagtttttttcggtttagtattttttttttttggttacggttttatttcggtttagttttattattttttatcgtgtttttcggagtagtttcgatcggttttaatacgtttggtttacgttttttaaatttttcgtttcgagcgtttattggtttttttaaaatttaatcgtcgtaatcgttgttttagtttattggttttttcggcgaagggggcgggtttttcggggaaagttttagttattacgagagtttagcggcggagcgcgatttgaagggtacgagaggggttgggagtcggcgttagaggattagtattggaaagtcggtcgggatagggcggggtagggcggggtcgggtggggtttgcgttgttttagcgttttggagtcgtttcggttcgtttttttgcgtgttttttatcgtcgcgagttcggaatgtttggtttcgggtgttttagggttcgagaatttgtagaagtttatatttaaattttatacgagagtcgtatttatgatgtagaattcggtgtagaattcgatggagtgtttaaggcgtttgagtcgtttttagaaggggaaggagagtcgcgggcggt

SEQ ID NO: 29856 - DNA, 599 bp, Artificial Sequence
  chemically treated genomic DNA (Homo sapiens) CpG-island No: 29856
accgcccgcgactctccttccccttctaaaaacgactcaaacgccttaaacactccatcgaattctacaccgaattctacatcataaatacgactctcgtataaaatttaaatataaacttctacaaattctcgaaccctaaaacacccgaaaccaaacattccgaactcgcgacgataaaaaacacgcaaaaaaacgaaccgaaacgactccaaaacgctaaaacaacgcaaaccccacccgaccccgccctaccccgccctatcccgaccgactttccaatactaatcctctaacgccgactcccaacccctctcgtacccttcaaatcgcgctccgccgctaaactctcgtaataactaaaactttccccgaaaaacccgcccccttcgccgaaaaaaccaataaactaaaacaacgattacgacgattaaattttaaaaaaaccaataaacgctcgaaacgaaaaatttaaaaaacgtaaaccaaacgtattaaaaccgatcgaaactactccgaaaaacacgataaaaaataataaaactaaaccgaaataaaaccgtaaccaaaaaaaaaaaatactaaaccgaaaaaaacta

SEQ ID NO: 29857 - DNA, 528 bp, Artificial Sequence
  chemically treated genomic DNA (Homo sapiens) CpG-island No: 29857
aggttatacgtgtttttcgatttcgtttttagggggagttttttttttttattgcgttggtcgtgtttttggttcgcgtgtttaggaagggcgtagcggagtcgcgtgttcgttcgggcggaggacgtcgttttcgcgcggcggtgtcgggtttttgttttcggaacgttaattttagggttcgtcggtttttttttttttttattcgtttttcgtgcgagtcgttgcgtagtagtttgcgtttcgagtgcgttgtgttttaaggaggtttcggcgtttgttttttgggttcgggggtttgggtgcgtaggtgggggttggtacgtagttcgttgggtaggtttcgcgtagcgattttttttacgtcggagttaagttttttgggtgagacgtgtaataacgtaggttttaaagttttttgcgcgtagcgtcgcggggtttggttttttttagttttcgggagttagttatcgtttttggtttgttataggatttttatttcgtggtgggtaatgatatatatatatt

SEQ ID NO: 29858 - DNA, 528 bp, Artificial Sequence
  chemically treated genomic DNA (Homo sapiens) CpG-island No: 29858
aatatatatatatcattacccaccacgaaataaaaatcctataacaaaccaaaaacgataactaactcccgaaaactaaaaaaaaccaaaccccgcgacgctacgcgcaaaaaactttaaaacctacgttattacacgtctcacccaaaaaacttaactccgacgtaaaaaaaatcgctacgcgaaacctacccaacgaactacgtaccaacccccacctacgcacccaaacccccgaacccaaaaaacaaacgccgaaacctccttaaaacacaacgcactcgaaacgcaaactactacgcaacgactcgcacgaaaaacgaataaaaaaaaaaaaaaaccgacgaaccctaaaattaacgttccgaaaacaaaaacccgacaccgccgcgcgaaaacgacgtcctccgcccgaacgaacacgcgactccgctacgcccttcctaaacacgcgaaccaaaaacacgaccaacgcaataaaaaaaaaaaactccccctaaaaacgaaatcgaaaaacacgtataacct

SEQ ID NO: 29859 - DNA, 528 bp, Artificial Sequence
  chemically treated genomic DNA (Homo sapiens) CpG-island No: 29859
aatatgtatatattattgtttattacgaggtgggaattttataataagttagagacggtggttgattttcgaggattggagaaggttaagtttcgcggcgttgcgcgtagagagttttggggtttgcgttgttgtacgttttatttaaagaatttagtttcggcgtggggagggtcgttgcgcgaaatttgtttaacgggttgcgtgttagtttttatttgcgtatttaagttttcgagtttaaggggtaagcgtcggggtttttttaaaatatagcgtattcgaagcgtagattgttgcgtagcggttcgtacggaaagcgggtgaaaagaaaggggggtcggcgaattttaaaattagcgtttcggaagtaggggttcggtatcgtcgcgcggagacggcgtttttcgttcggacgggtacgcgatttcgttgcgttttttttgggtacgcgggttaggagtacgattagcgtaataggaaggaagggttttttttggaaacgggatcggggaatacgtgtagttt

SEQ ID NO: 29860 - DNA, 528 bp, Artificial Sequence
  chemically treated genomic DNA (Homo sapiens) CpG-island No: 29860
aaactacacgtattccccgatcccgtttccaaaaaaaacccttccttcctattacgctaatcgtactcctaacccgcgtacccaaaaaaaacgcaacgaaatcgcgtacccgtccgaacgaaaaacgccgtctccgcgcgacgataccgaacccctacttccgaaacgctaattttaaaattcgccgacccccctttcttttcacccgctttccgtacgaaccgctacgcaacaatctacgcttcgaatacgctatattttaaaaaaaccccgacgcttaccccttaaactcgaaaacttaaatacgcaaataaaaactaacacgcaacccgttaaacaaatttcgcgcaacgaccctccccacgccgaaactaaattctttaaataaaacgtacaacaacgcaaaccccaaaactctctacgcgcaacgccgcgaaacttaaccttctccaatcctcgaaaatcaaccaccgtctctaacttattataaaattcccacctcgtaataaacaataatatatacatatt

SEQ ID NO: 29861 - DNA, 552 bp, Artificial Sequence
  chemically treated genomic DNA (Homo sapiens) CpG-island No: 29861
tgagcggcgcgggttcgcgcgtattcgtacgtttcgggcgttaggcgtcgtcgtgtgggcggagtcgggtagttttttttgtcggcgttagttacggttttcggttttaagtttcgttttcggcgcgtattttttagtagcggttcggtatttggtagacgcgcggcggcggcggcgagcggtggcgttcggttcgggcgatcgcggcgggggagggcgcggcgtatcgatgggcgttattgagaagggaggttagaagagtcggaagttgttttttttgcggcggtcgtggaaggcgattcggcggttgtggaggttacgtttagttcgttaggcggcgtagggtgagtgtgggcgcggtcggtcgggatttgttattttgaggtaggggcgtagcggcggcggggtcgttttcggcggtttttcgggtcgcgttttcggttttgggagtttggatgtttaggcgacgttcgaattcgattttcggtcgcgggtatcgggatcgttggggaagcgtaggggttgatgtcggtatagtttttttttttttag

SEQ ID NO: 29862 - DNA, 552 bp, Artificial Sequence
  chemically treated genomic DNA (Homo sapiens) CpG-island No: 29862
ctaaaaaaaaaaaaactataccgacatcaacccctacgcttccccaacgatcccgatacccgcgaccgaaaatcgaattcgaacgtcgcctaaacatccaaactcccaaaaccgaaaacgcgacccgaaaaaccgccgaaaacgaccccgccgccgctacgcccctacctcaaaataacaaatcccgaccgaccgcgcccacactcaccctacgccgcctaacgaactaaacgtaacctccacaaccgccgaatcgccttccacgaccgccgcaaaaaaaacaacttccgactcttctaacctcccttctcaataacgcccatcgatacgccgcgccctcccccgccgcgatcgcccgaaccgaacgccaccgctcgccgccgccgccgcgcgtctaccaaataccgaaccgctactaaaaaatacgcgccgaaaacgaaacttaaaaccgaaaaccgtaactaacgccgacaaaaaaaactacccgactccgcccacacgacgacgcctaacgcccgaaacgtacgaatacgcgcgaacccgcgccgctca

SEQ ID NO: 29863 - DNA, 552 bp, Artificial Sequence
  chemically treated genomic DNA (Homo sapiens) CpG-island No: 29863
ttagaggaaaggagattgtgtcgatattagtttttgcgtttttttagcggtttcggtattcgcgatcgagggtcgggttcgggcgtcgtttaggtatttaggtttttagggtcgggaacgcgattcgagagatcgtcggggacggtttcgtcgtcgttgcgtttttgttttagggtaataggtttcgatcggtcgcgtttatatttattttgcgtcgtttggcgagttgagcgtggtttttatagtcgtcgggtcgttttttacggtcgtcgtaaggaaaatagttttcggtttttttggtttttttttttagtggcgtttatcggtgcgtcgcgttttttttcgtcgcggtcgttcgagtcgagcgttatcgttcgtcgtcgtcgtcgcgcgtttgttaggtgtcgggtcgttgttgggagatgcgcgtcgggggcggagtttggggtcgggagtcgtggttggcgtcgataggggaggttgttcggtttcgtttatacggcggcgtttggcgttcgaggcgtgcgggtgcgcgcgggttcgcgtcgttta

SEQ ID NO: 29864 - DNA, 552 bp, Artificial Sequence
  chemically treated genomic DNA (Homo sapiens) CpG-island No: 29864
taaacgacgcgaacccgcgcgcacccgcacgcctcgaacgccaaacgccgccgtataaacgaaaccgaacaacctcccctatcgacgccaaccacgactcccgaccccaaactccgcccccgacgcgcatctcccaacaacgacccgacacctaacaaacgcgcgacgacgacgacgaacgataacgctcgactcgaacgaccgcgacgaaaaaaaacgcgacgcaccgataaacgccactaaaaaaaaaaaccaaaaaaaccgaaaactattttccttacgacgaccgtaaaaaacgacccgacgactataaaaaccacgctcaactcgccaaacgacgcaaaataaatataaacgcgaccgatcgaaacctattaccctaaaacaaaaacgcaacgacgacgaaaccgtccccgacgatctctcgaatcgcgttcccgaccctaaaaacctaaatacctaaacgacgcccgaacccgaccctcgatcgcgaataccgaaaccgctaaaaaaacgcaaaaactaatatcgacacaatctcctttcctctaa

SEQ ID NO: 29865 - DNA, 827 bp, Artificial Sequence
  chemically treated genomic DNA (Homo sapiens) CpG-island No: 29865
tggttgtacgtacgtttttcggattgtataaacgatcgggaattcggtataattagttaatcgttttttttttaggttttttaagttttcgatttcgcgttaggtatcgtttttagtatacgtatttttttataaaggagttgcggatttataggaaacgggagcgtcgggttttttcggggatttgttttcgcggcgcgagtttcgcgttcgttatttcggggcgtattgtcgatgtagttcgcgtagtttttttcgggcgggtttagtattcgttttttagatttttacgggttcggattttgtatgatatcgcgacggcgtcgggggggatgatgagcgttttttcgtcgtttttgggttcgttttttttggtttttttttgggttagagcggagttgaacgttatttttattatggcgcggtttggggcgttttcgaagggcggcggcgggttcggggcgcgggttgcgggttttcggttgcgattgtagtttttacggtcgggtttcgggagcggtttcgggcggttgaagaggttcgggaagtttcgcggcggtagaggcggttattgcggtagggatttcgtagttttttagttttcgcgcgagggcggagattgttcgtatattttttgggaggcggggcgggggcgggggcggagttagcggtcgggggtggggtgttgcgcgggattttgttttcgtttcgtagttgggcgtcggatttcggcgcgtttcggagagggatgggtgtttttttgggtcgtttggaatttttagttttgaattcgtttttaattaggttatttttaggtcgagtgttgt

SEQ ID NO: 29866 - DNA, 827 bp, Artificial Sequence
  chemically treated genomic DNA (Homo sapiens) CpG-island No: 29866
acaacactcgacctaaaaataacctaattaaaaacgaattcaaaactaaaaattccaaacgacccaaaaaaacacccatccctctccgaaacgcgccgaaatccgacgcccaactacgaaacgaaaacaaaatcccgcgcaacaccccacccccgaccgctaactccgcccccgcccccgccccgcctcccaaaaaatatacgaacaatctccgccctcgcgcgaaaactaaaaaactacgaaatccctaccgcaataaccgcctctaccgccgcgaaacttcccgaacctcttcaaccgcccgaaaccgctcccgaaacccgaccgtaaaaactacaatcgcaaccgaaaacccgcaacccgcgccccgaacccgccgccgcccttcgaaaacgccccaaaccgcgccataataaaaataacgttcaactccgctctaacccaaaaaaaaaccaaaaaaaacgaacccaaaaacgacgaaaaaacgctcatcatcccccccgacgccgtcgcgatatcatacaaaatccgaacccgtaaaaatctaaaaaacgaatactaaacccgcccgaaaaaaactacgcgaactacatcgacaatacgccccgaaataacgaacgcgaaactcgcgccgcgaaaacaaatccccgaaaaaacccgacgctcccgtttcctataaatccgcaactcctttataaaaaaatacgtatactaaaaacgatacctaacgcgaaatcgaaaacttaaaaaacctaaaaaaaaaacgattaactaattataccgaattcccgatcgtttatacaatccgaaaaacgtacgtacaacca

SEQ ID NO: 29867 - DNA, 827 bp, Artificial Sequence
  chemically treated genomic DNA (Homo sapiens) CpG-island No: 29867
gtagtattcggtttggaggtaatttggttgggagcgaatttagaattggaaattttaggcggtttagagggatatttattttttttcgaggcgcgtcgggattcggcgtttagttgcggggcgagggtagggtttcgcgtagtattttattttcggtcgttggtttcgttttcgttttcgtttcgttttttaggggatgtgcgagtagttttcgttttcgcgcgggagttgggaggttgcgagatttttatcgtagtagtcgtttttgtcgtcgcggagtttttcgaatttttttagtcgttcggagtcgttttcggagttcggtcgtagaggttgtaatcgtagtcgggagttcgtagttcgcgtttcgagttcgtcgtcgtttttcgagggcgttttaggtcgcgttatggtgaaggtgacgtttaatttcgttttggtttagaaggaggttaagaaggacgagtttaagagcggcgaggaggcgtttattatttttttcgacgtcgtcgcggtgttatgtaaggttcgagttcgtggaggtttaggaaacgggtgttgggttcgttcggggagggttgcgcggattgtatcggtagtgcgtttcgaggtggcgggcgcggggttcgcgtcgcggggataagttttcgagagagttcggcgttttcgttttttgtgggttcgtagtttttttgtaaggaagtgcgtgtgttggaagcggtgtttgacgcggggtcgggggtttgggaggtttggagagggaacgattggttaattgtgtcgaattttcggtcgtttgtgtagttcggggagcgtgcgtgtagtta

SEQ ID NO: 29868 - DNA, 827 bp, Artificial Sequence
  chemically treated genomic DNA (Homo sapiens) CpG-island No: 29868
taactacacgcacgctccccgaactacacaaacgaccgaaaattcgacacaattaaccaatcgttccctctccaaacctcccaaacccccgaccccgcgtcaaacaccgcttccaacacacgcacttccttacaaaaaaactacgaacccacaaaaaacgaaaacgccgaactctctcgaaaacttatccccgcgacgcgaaccccgcgcccgccacctcgaaacgcactaccgatacaatccgcgcaaccctccccgaacgaacccaacacccgtttcctaaacctccacgaactcgaaccttacataacaccgcgacgacgtcgaaaaaaataataaacgcctcctcgccgctcttaaactcgtccttcttaacctccttctaaaccaaaacgaaattaaacgtcaccttcaccataacgcgacctaaaacgccctcgaaaaacgacgacgaactcgaaacgcgaactacgaactcccgactacgattacaacctctacgaccgaactccgaaaacgactccgaacgactaaaaaaattcgaaaaactccgcgacgacaaaaacgactactacgataaaaatctcgcaacctcccaactcccgcgcgaaaacgaaaactactcgcacatcccctaaaaaacgaaacgaaaacgaaaacgaaaccaacgaccgaaaataaaatactacgcgaaaccctaccctcgccccgcaactaaacgccgaatcccgacgcgcctcgaaaaaaaataaatatccctctaaaccgcctaaaatttccaattctaaattcgctcccaaccaaattacctccaaaccgaatactac

SEQ ID NO: 29869 - DNA, 512 bp, Artificial Sequence
  chemically treated genomic DNA (Homo sapiens) CpG-island No: 29869
taacgtcgcgattgttttgagtaaaacgagggagattttgcggggaaagtgtttttagtttatttttttaatagagaatgagttttttcgtttatcgcggatagcgaggaaaagtagcggagatgggttttcgggttgtatttcgtttttcggtttatttagattttttggtagtttcgggcgttcgtttatttcgtttttttttcgtttttgtcgtcgtcgtcgtaggtgcgtattttatcgcgtttttgtttttttttcgaatttttttcgaaggtggttttcgtttttttttttatttatcgttttttgagtgttagaattggagttatagcgtttttaagacgaaatttatgttgggtttcgcgattatggtgttggtttacgcgtttggtaggtaaggacgggtagcgatttacgtttttgggttttcgtttttaagagttgggaattttatttttttatttttttatttgtatttaaatttttcgagacgtattgatttttttgtt

SEQ ID NO: 29870 - DNA, 512 bp, Artificial Sequence
  chemically treated genomic DNA (Homo sapiens) CpG-island No: 29870
aacaaaaaaatcaatacgtctcgaaaaatttaaatacaaataaaaaaataaaaaaataaaattcccaactcttaaaaacgaaaacccaaaaacgtaaatcgctacccgtccttacctaccaaacgcgtaaaccaacaccataatcgcgaaacccaacataaatttcgtcttaaaaacgctataactccaattctaacactcaaaaaacgataaataaaaaaaaaaacgaaaaccaccttcgaaaaaaattcgaaaaaaaaacaaaaacgcgataaaatacgcacctacgacgacgacgacaaaaacgaaaaaaaaacgaaataaacgaacgcccgaaactaccaaaaaatctaaataaaccgaaaaacgaaatacaacccgaaaacccatctccgctacttttcctcgctatccgcgataaacgaaaaaactcattctctattaaaaaaataaactaaaaacactttccccgcaaaatctccctcgttttactcaaaacaatcgcgacgtta

SEQ ID NO: 29871 - DNA, 512 bp, Artificial Sequence
  chemically treated genomic DNA (Homo sapiens) CpG-island No: 29871
aatagaagggttagtacgtttcgggggatttaggtgtaggtgaggaggtaaaaaagtggaatttttagtttttagaaacgaagatttaggagcgtgggtcgttgttcgtttttatttgttaggcgcgtgggttagtattatggtcgcgaaatttagtatggatttcgttttggggacgttatggttttagttttgatatttaagaaacgatggatggagaggagaacgaggattattttcgaaaagagttcgagagggaagtagggacgcggtggggtgcgtatttgcggcggcggcggtaaaggcggaggagaagcgaagtgggcgagcgttcgaggttgttagaggatttgggtgggtcggaaggcggagtgtagttcggaagtttattttcgttgttttttttcgttgttcgcgataagcgagagggtttattttttgttggagaagtgagttgaaaatatttttttcgtaagatttttttcgttttgtttaaggtagtcgcggcgttg

SEQ ID NO: 29872 - DNA, 512 bp, Artificial Sequence
  chemically treated genomic DNA (Homo sapiens) CpG-island No: 29872
caacgccgcgactaccttaaacaaaacgaaaaaaatcttacgaaaaaaatattttcaactcacttctccaacaaaaaataaaccctctcgcttatcgcgaacaacgaaaaaaaacaacgaaaataaacttccgaactacactccgccttccgacccacccaaatcctctaacaacctcgaacgctcgcccacttcgcttctcctccgcctttaccgccgccgccgcaaatacgcaccccaccgcgtccctacttccctctcgaactcttttcgaaaataatcctcgttctcctctccatccatcgtttcttaaatatcaaaactaaaaccataacgtccccaaaacgaaatccatactaaatttcgcgaccataatactaacccacgcgcctaacaaataaaaacgaacaacgacccacgctcctaaatcttcgtttctaaaaactaaaaattccacttttttacctcctcacctacacctaaatcccccgaaacgtactaacccttctatt

SEQ ID NO: 29873 - DNA, 504 bp, Artificial Sequence
  chemically treated genomic DNA (Homo sapiens) CpG-island No: 29873
tgttgcgcgtgtttcgttcgttgttggggtacggtagagattaacgtgtcgtgttcgtagtgtcgggagattttttcgtagaggtatatgcggtttaatcggtatttggttaacgtgatttaattggtaaagtagttgcgtatcgagcggtcgtcggggttcggcggcgagatgggcgtgtgcgagaagtatcgcgagtttttgaagttgtattgcgaggaggattagatgtttatttgcgtggtgtgcgatcgttttcgcgagtatcgcggttatagcgtgttgtcgttcgaggaggcggtggagggttttaaggtgagggcgcggattcgggagggcgggagcgcgagtcggataaagggaggagagagttaaaggggttttttttttttcgtttagaaaatggttgagtcggacgtgtggtttatagtcgttattttttttttgttcgttttagagttttagtatttagatttggaggaaaatttgtagttggcgaggaag

SEQ ID NO: 29874 - DNA, 504 bp, Artificial Sequence
  chemically treated genomic DNA (Homo sapiens) CpG-island No: 29874
cttcctcgccaactacaaattttcctccaaatctaaatactaaaactctaaaacgaacaaaaaaaaaataacgactataaaccacacgtccgactcaaccattttctaaacgaaaaaaaaaaaacccctttaactctctcctccctttatccgactcgcgctcccgccctcccgaatccgcgccctcaccttaaaaccctccaccgcctcctcgaacgacaacacgctataaccgcgatactcgcgaaaacgatcgcacaccacgcaaataaacatctaatcctcctcgcaatacaacttcaaaaactcgcgatacttctcgcacacgcccatctcgccgccgaaccccgacgaccgctcgatacgcaactactttaccaattaaatcacgttaaccaaataccgattaaaccgcatatacctctacgaaaaaatctcccgacactacgaacacgacacgttaatctctaccgtaccccaacaacgaacgaaacacgcgcaaca

SEQ ID NO: 29875 - DNA, 504 bp, Artificial Sequence
  chemically treated genomic DNA (Homo sapiens) CpG-island No: 29875
ttttttcgttagttataggtttttttttaaatttgagtgttgaggttttggagcggatagagaggaaatgacggttgtgaattatacgttcggtttagttattttttaggcggaaaaaaggaagtttttttggtttttttttttttttgttcgattcgcgttttcgttttttcggattcgcgtttttattttgaagttttttatcgttttttcgagcggtagtacgttgtggtcgcggtgttcgcgggagcggtcgtatattacgtagatgggtatttggtttttttcgtagtatagttttaggggttcgcggtgtttttcgtatacgtttatttcgtcgtcgggtttcgacggtcgttcggtgcgtagttgttttattagttgggttacgttggttaggtgtcggttgggtcgtatgtgtttttgcgggaaggtttttcggtattgcgggtacgatacgttagtttttgtcgtgttttagtagcgggcgaggtacgcgtaata

SEQ ID NO: 29876 - DNA, 504 bp, Artificial Sequence
  chemically treated genomic DNA (Homo sapiens) CpG-island No: 29876
tattacgcgtacctcgcccgctactaaaacacgacaaaaactaacgtatcgtacccgcaataccgaaaaaccttcccgcaaaaacacatacgacccaaccgacacctaaccaacgtaacccaactaataaaacaactacgcaccgaacgaccgtcgaaacccgacgacgaaataaacgtatacgaaaaacaccgcgaacccctaaaactatactacgaaaaaaaccaaatacccatctacgtaatatacgaccgctcccgcgaacaccgcgaccacaacgtactaccgctcgaaaaaacgataaaaaacttcaaaataaaaacgcgaatccgaaaaaacgaaaacgcgaatcgaacaaaaaaaaaaaaaaaccaaaaaaacttccttttttccgcctaaaaaataactaaaccgaacgtataattcacaaccgtcatttcctctctatccgctccaaaacctcaacactcaaatttaaaaaaaaacctataactaacgaaaaaa

SEQ ID NO: 29877 - DNA, 709 bp, Artificial Sequence
  chemically treated genomic DNA (Homo sapiens) CpG-island No: 29877
  misc_feature (381)..(381): n is either a, c, g or t
gcggtcgtagtgttttgagggttcgcgattttcggttttaattttcgggttatcgcgggggttttattttttttggttatttaatggtaatagttttagatttcgttcggaatcgtagtcgtagttttttaggcgttagttgcgcgcgatttgcggcgaggcgggggcggggttggcggggttggcggatagttttttgtcgtgattggttagggggcgtggcgacgagtcggaagttacgtagggttacgtttgcgttttgaggattgggtttgggtgtagacgttgttgtttgggcgttttttcgttgcgtgtaggtgaagggggttttttgatcgaggtaagtcgggtttcgaggttcggagttgagaaggtaaattntcggtcggtaagggttcggtgggagcggaataggttagattttcggttcgacggaggggttagtggtttggcgggcgattgatcgagcggcggagcgcgcgggatatatatataggtttttgcgtttcgcgggcgggttggtcgggacgggtcgcgggttttttttcggggttttggtacgtggatttaggcggggattttagggtggagtgtcgggaattatttttgtgcggtgattcgagggtaggcgggagagaggtattaaggagatttgaagattgaatggagagtagggggatatttttaattttttgcgtggacgttggat

SEQ ID NO: 29878 - DNA, 709 bp, Artificial Sequence
  chemically treated genomic DNA (Homo sapiens) CpG-island No: 29878
  misc_feature (329)..(329): n is either a, c, g or t
atccaacgtccacgcaaaaaattaaaaatatccccctactctccattcaatcttcaaatctccttaatacctctctcccgcctaccctcgaatcaccgcacaaaaataattcccgacactccaccctaaaatccccgcctaaatccacgtaccaaaaccccgaaaaaaaacccgcgacccgtcccgaccaacccgcccgcgaaacgcaaaaacctatatatatatcccgcgcgctccgccgctcgatcaatcgcccgccaaaccactaacccctccgtcgaaccgaaaatctaacctattccgctcccaccgaacccttaccgaccganaatttaccttctcaactccgaacctcgaaacccgacttacctcgatcaaaaaacccccttcacctacacgcaacgaaaaaacgcccaaacaacaacgtctacacccaaacccaatcctcaaaacgcaaacgtaaccctacgtaacttccgactcgtcgccacgccccctaaccaatcacgacaaaaaactatccgccaaccccgccaaccccgcccccgcctcgccgcaaatcgcgcgcaactaacgcctaaaaaactacgactacgattccgaacgaaatctaaaactattaccattaaataaccaaaaaaaataaaacccccgcgataacccgaaaattaaaaccgaaaatcgcgaaccctcaaaacactacgaccgc

SEQ ID NO: 29879 - DNA, 709 bp, Artificial Sequence
  chemically treated genomic DNA (Homo sapiens) CpG-island No: 29879
  misc_feature (329)..(329): n is either a, c, g or t
atttagcgtttacgtaaaaagttaagagtatttttttattttttatttaatttttaaatttttttggtgtttttttttcgtttattttcgaattatcgtataagggtgattttcggtattttattttgaggttttcgtttaggtttacgtattagagtttcgggaggagattcgcggttcgtttcgattagttcgttcgcggggcgtaggggtttgtatgtgtgtttcgcgcgtttcgtcgttcggttagtcgttcgttagattattagttttttcgtcgggtcgagaatttgatttgtttcgtttttatcgagtttttgtcgatcggnagtttatttttttaatttcgagtttcggggttcggtttatttcggttaggaagttttttttatttatacgtagcggagaagcgtttaagtaataacgtttgtatttaaatttagtttttagaacgtaaacgtggttttgcgtggttttcggttcgtcgttacgttttttggttaattacggtagaggattattcgttagtttcgttagtttcgttttcgtttcgtcgtaggtcgcgcgtagttggcgtttgaggaattgcggttgcggtttcgagcggggtttggggttgttattattgagtgattagaaagggtgaggttttcgcggtggttcgggggttggggtcgagggtcgcgggtttttagagtattgcggtcgt

SEQ ID NO: 29880 - DNA, 709 bp, Artificial Sequence
  chemically treated genomic DNA (Homo sapiens) CpG-island No: 29880
  misc_feature (381)..(381): n is either a, c, g or t
acgaccgcaatactctaaaaacccgcgaccctcgaccccaacccccgaaccaccgcgaaaacctcaccctttctaatcactcaataataacaaccccaaaccccgctcgaaaccgcaaccgcaattcctcaaacgccaactacgcgcgacctacgacgaaacgaaaacgaaactaacgaaactaacgaataatcctctaccgtaattaaccaaaaaacgtaacgacgaaccgaaaaccacgcaaaaccacgtttacgttctaaaaactaaatttaaatacaaacgttattacttaaacgcttctccgctacgtataaataaaaaaaacttcctaaccgaaataaaccgaaccccgaaactcgaaattaaaaaaataaactnccgatcgacaaaaactcgataaaaacgaaacaaatcaaattctcgacccgacgaaaaaactaataatctaacgaacgactaaccgaacgacgaaacgcgcgaaacacacatacaaacccctacgccccgcgaacgaactaatcgaaacgaaccgcgaatctcctcccgaaactctaatacgtaaacctaaacgaaaacctcaaaataaaataccgaaaatcacccttatacgataattcgaaaataaacgaaaaaaaaacaccaaaaaaatttaaaaattaaataaaaaataaaaaaatactcttaactttttacgtaaacgctaaat

SEQ ID NO: 29881 - DNA, 540 bp, Artificial Sequence
  chemically treated genomic DNA (Homo sapiens) CpG-island No: 29881
gttagcgtcgggaggtaggaagtcgatcgggggcggggatcgaaggttttagacgtcgacgtcggcgtgggcgcgagtacggtgtattttgggagttgttattaggtttttcggttttcggtttcggtgtagttgtcgtggttgttaggagagttgcgtcggcgagaagcggtcgagttagtagtaggtaaaagcgtttttgtttttagtgcggtcgttaggttggtagtcggtttcgagtatttttttcggttcggttaggttttgagtcgcggggacgttttgcgagtttgattgttgtggcgtcgggggtgttgtcgtttcggtttcgttaggagttgcgaagttggtcggtcgttttttggtttacggggagtcgggagttgcgcggggattggagggttagggttggggtcggggtttgggtcgggtagaggcgcgagggcggttttaggtgagggaggtcggaggcggggtcggggagtcggggataggtttcgagttttttttgttggggcggagcggtgcgtaaggttgggg

SEQ ID NO: 29882 - DNA, 540 bp, Artificial Sequence
  chemically treated genomic DNA (Homo sapiens) CpG-island No: 29882
ccccaaccttacgcaccgctccgccccaacaaaaaaaactcgaaacctatccccgactccccgaccccgcctccgacctccctcacctaaaaccgccctcgcgcctctacccgacccaaaccccgaccccaaccctaaccctccaatccccgcgcaactcccgactccccgtaaaccaaaaaacgaccgaccaacttcgcaactcctaacgaaaccgaaacgacaacacccccgacgccacaacaatcaaactcgcaaaacgtccccgcgactcaaaacctaaccgaaccgaaaaaaatactcgaaaccgactaccaacctaacgaccgcactaaaaacaaaaacgcttttacctactactaactcgaccgcttctcgccgacgcaactctcctaacaaccacgacaactacaccgaaaccgaaaaccgaaaaacctaataacaactcccaaaatacaccgtactcgcgcccacgccgacgtcgacgtctaaaaccttcgatccccgcccccgatcgacttcctacctcccgacgctaac

SEQ ID NO: 29883 - DNA, 540 bp, Artificial Sequence
  chemically treated genomic DNA (Homo sapiens) CpG-island No: 29883
ttttagttttgcgtatcgtttcgttttagtaggggaggttcgggatttgttttcggtttttcggtttcgttttcggttttttttatttggggtcgttttcgcgtttttgttcggtttaggtttcggttttagttttggttttttagttttcgcgtagttttcgatttttcgtaaattagagggcggtcgattagtttcgtagtttttggcggggtcggagcggtaatattttcgacgttatagtagttagattcgtaaggcgttttcgcggtttaggatttagtcgggtcgagaaggatgttcggagtcggttattagtttagcggtcgtattgggggtagggacgtttttatttgttgttggttcggtcgtttttcgtcggcgtagtttttttggtaattacggtagttatatcgagatcgggagtcgaagggtttagtgatagtttttagagtgtatcgtgttcgcgtttacgtcggcgtcgacgtttgaggttttcgattttcgttttcgatcggttttttgtttttcggcgttagt

SEQ ID NO: 29884 - DNA, 540 bp, Artificial Sequence
  chemically treated genomic DNA (Homo sapiens) CpG-island No: 29884
actaacgccgaaaaacaaaaaaccgatcgaaaacgaaaatcgaaaacctcaaacgtcgacgccgacgtaaacgcgaacacgatacactctaaaaactatcactaaacccttcgactcccgatctcgatataactaccgtaattaccaaaaaaactacgccgacgaaaaacgaccgaaccaacaacaaataaaaacgtccctacccccaatacgaccgctaaactaataaccgactccgaacatccttctcgacccgactaaatcctaaaccgcgaaaacgccttacgaatctaactactataacgtcgaaaatattaccgctccgaccccgccaaaaactacgaaactaatcgaccgccctctaatttacgaaaaatcgaaaactacgcgaaaactaaaaaaccaaaactaaaaccgaaacctaaaccgaacaaaaacgcgaaaacgaccccaaataaaaaaaaccgaaaacgaaaccgaaaaaccgaaaacaaatcccgaacctcccctactaaaacgaaacgatacgcaaaactaaaa

SEQ ID NO: 29885 - DNA, 541 bp, Artificial Sequence
  chemically treated genomic DNA (Homo sapiens) CpG-island No: 29885
cgttagggtttcggttgggggtgggcggcgcggcggtttcggcgcgttttttcggggttatagagttagggtcgttggcgtgggcgttcggcggtttcgaggtaggttcggttatcgtttcgcggagacggtcgcggcggcgatgtgcgtggttttttttcgttcgcgggtttgcgtggagcggggttcggcggagcgcggggcgttttgggcgtttcgacgtagttggtgtttttcgatcgtcgcggtttcgttcgcgtcgggttttttttgcgatcgtcgttttcgtttttcgtttcggtagtttttaggattttttcgtttcggttgttatggtgatagttgcgtcggtgaatgagcgttttagtgatacgcgcgcgttcgttaggttagatgtggtttcggggcgcgtcgcgttttcgtagtcgtaagttttcggcggcgcgggtcggggtaagatattaggcgagtatggtggtattcggggttggttttatttttagtacggaaatatggaatttgtatttgaaaataaggggag

SEQ ID NO: 29886 - DNA, 541 bp, Artificial Sequence
  chemically treated genomic DNA (Homo sapiens) CpG-island No: 29886
ctccccttattttcaaatacaaattccatatttccgtactaaaaataaaaccaaccccgaataccaccatactcgcctaatatcttaccccgacccgcgccgccgaaaacttacgactacgaaaacgcgacgcgccccgaaaccacatctaacctaacgaacgcgcgcgtatcactaaaacgctcattcaccgacgcaactatcaccataacaaccgaaacgaaaaaatcctaaaaactaccgaaacgaaaaacgaaaacgacgatcgcaaaaaaaacccgacgcgaacgaaaccgcgacgatcgaaaaacaccaactacgtcgaaacgcccaaaacgccccgcgctccgccgaaccccgctccacgcaaacccgcgaacgaaaaaaaaccacgcacatcgccgccgcgaccgtctccgcgaaacgataaccgaacctacctcgaaaccgccgaacgcccacgccaacgaccctaactctataaccccgaaaaaacgcgccgaaaccgccgcgccgcccacccccaaccgaaaccctaacg

SEQ ID NO: 29887 - DNA, 541 bp, Artificial Sequence
  chemically treated genomic DNA (Homo sapiens) CpG-island No: 29887
ttttttttgtttttaagtgtaagttttatgttttcgtgttgggaataaggttagtttcgggtgttattatattcgtttgatgttttatttcgattcgcgtcgtcgagagtttgcggttacgggaacgcggcgcgtttcggggttatatttggtttagcgggcgcgcgcgtgttattaagacgtttatttatcggcgtagttgttattataataatcggagcgagggaattttggagattgtcggggcggggggcgggggcggcggtcgtaggagggattcggcgcgggcgggatcgcggcggtcgggggatattagttgcgtcggagcgtttagaacgtttcgcgtttcgtcgagtttcgttttacgtagattcgcgggcgggagggagttacgtatatcgtcgtcgcggtcgttttcgcggggcggtaatcgagtttgtttcggagtcgtcgaacgtttacgttagcgattttgattttatggtttcgggggagcgcgtcggagtcgtcgcgtcgtttatttttagtcggaattttagcg

SEQ ID NO: 29888 - DNA, 541 bp, Artificial Sequence
  chemically treated genomic DNA (Homo sapiens) CpG-island No: 29888
cgctaaaattccgactaaaaataaacgacgcgacgactccgacgcgctcccccgaaaccataaaatcaaaatcgctaacgtaaacgttcgacgactccgaaacaaactcgattaccgccccgcgaaaacgaccgcgacgacgatatacgtaactccctcccgcccgcgaatctacgtaaaacgaaactcgacgaaacgcgaaacgttctaaacgctccgacgcaactaatatcccccgaccgccgcgatcccgcccgcgccgaatccctcctacgaccgccgcccccgccccccgccccgacaatctccaaaattccctcgctccgattattataataacaactacgccgataaataaacgtcttaataacacgcgcgcgcccgctaaaccaaatataaccccgaaacgcgccgcgttcccgtaaccgcaaactctcgacgacgcgaatcgaaataaaacatcaaacgaatataataacacccgaaactaaccttattcccaacacgaaaacataaaacttacacttaaaaacaaaaaaaa

SEQ ID NO: 29889 - DNA, 631 bp, Artificial Sequence
  chemically treated genomic DNA (Homo sapiens) CpG-island No: 29889
gcgtagggatcggatagcggggcgcgtcggggtcgtttttcgagagttttgcgtgatattgtttcgtgtttttcgcgtagatagcgagttggtgttttcggattgtttgcggtcgcgtttttttatcgttttgcggcggtcgtcgttgcggcgcgaggcggacgacgcgcgtttttcggtgagtttatgcgattttaacgtgtcgggcgcggacggcgacgaggtcgcgtcggtcgtcggttgttttatttcgtagaatttatttaattcgtagtatagtcgcgcgttgtcggcgtagttcgacggcgatttgcgtttttacgttttgcgcgtcggcgcgtacgttcgtattttcgacgagtagacggtggcgcgcgtggagtacgggcgcgacgagcgcgcgttcgtttttattagtcggttcgtgcgcgtggtcgagattattttcgttaaggttacgcgttcgggtggcgcgcggttcggcgcgttgtcgttcggcgttattacgtgcgatttcggtacgttgcggtcggtcgatttgttttttagttttgaggttttggtggatcgtaaggaattttgggtcgtgtgtcgcgtgttcgggtttttgtatagcggcgatattttgggt

SEQ ID NO: 29890 - DNA, 631 bp, Artificial Sequence
  chemically treated genomic DNA (Homo sapiens) CpG-island No: 29890
acccaaaatatcgccgctatacaaaaacccgaacacgcgacacacgacccaaaattccttacgatccaccaaaacctcaaaactaaaaaacaaatcgaccgaccgcaacgtaccgaaatcgcacgtaataacgccgaacgacaacgcgccgaaccgcgcgccacccgaacgcgtaaccttaacgaaaataatctcgaccacgcgcacgaaccgactaataaaaacgaacgcgcgctcgtcgcgcccgtactccacgcgcgccaccgtctactcgtcgaaaatacgaacgtacgcgccgacgcgcaaaacgtaaaaacgcaaatcgccgtcgaactacgccgacaacgcgcgactatactacgaattaaataaattctacgaaataaaacaaccgacgaccgacgcgacctcgtcgccgtccgcgcccgacacgttaaaatcgcataaactcaccgaaaaacgcgcgtcgtccgcctcgcgccgcaacgacgaccgccgcaaaacgataaaaaaacgcgaccgcaaacaatccgaaaacaccaactcgctatctacgcgaaaaacacgaaacaatatcacgcaaaactctcgaaaaacgaccccgacgcgccccgctatccgatccctacgc

SEQ ID NO: 29891 - DNA, 631 bp, Artificial Sequence
  chemically treated genomic DNA (Homo sapiens) CpG-island No: 29891
gtttaggatgtcgtcgttgtgtaggggttcgggtacgcggtatacggtttagaattttttgcggtttattagggttttagggttgaaaggtaggtcggtcggtcgtagcgtgtcggggtcgtacgtggtgacgtcgaacgatagcgcgtcgggtcgcgcgttattcgagcgcgtgattttgacgaagatggtttcggttacgcgtacgggtcggttggtgaagacgagcgcgcgttcgtcgcgttcgtgttttacgcgcgttatcgtttgttcgtcgaggatgcggacgtgcgcgtcggcgcgtagggcgtggaaacgtaggtcgtcgtcgagttgcgtcggtagcgcgcggttgtgttgcgagttgagtgagttttgcgggatggggtagtcggcggtcggcgcggtttcgtcgtcgttcgcgttcggtacgttgaggtcgtataggtttatcgagaggcgcgcgtcgttcgtttcgcgtcgtagcgacggtcgtcgtagggcggtgaaggagcgcggtcgtagatagttcgggagtattagttcgttatttgcgcgggagatacggggtagtgttacgtagggttttcgggaggcggtttcggcgcgtttcgttgttcggtttttacgt

SEQ ID NO: 29892 - DNA, 631 bp, Artificial Sequence
  chemically treated genomic DNA (Homo sapiens) CpG-island No: 29892
acgtaaaaaccgaacaacgaaacgcgccgaaaccgcctcccgaaaaccctacgtaacactaccccgtatctcccgcgcaaataacgaactaatactcccgaactatctacgaccgcgctccttcaccgccctacgacgaccgtcgctacgacgcgaaacgaacgacgcgcgcctctcgataaacctatacgacctcaacgtaccgaacgcgaacgacgacgaaaccgcgccgaccgccgactaccccatcccgcaaaactcactcaactcgcaacacaaccgcgcgctaccgacgcaactcgacgacgacctacgtttccacgccctacgcgccgacgcgcacgtccgcatcctcgacgaacaaacgataacgcgcgtaaaacacgaacgcgacgaacgcgcgctcgtcttcaccaaccgacccgtacgcgtaaccgaaaccatcttcgtcaaaatcacgcgctcgaataacgcgcgacccgacgcgctatcgttcgacgtcaccacgtacgaccccgacacgctacgaccgaccgacctacctttcaaccctaaaaccctaataaaccgcaaaaaattctaaaccgtataccgcgtacccgaacccctacacaacgacgacatcctaaac

SEQ ID NO: 29893 - DNA, 600 bp, Artificial Sequence
  chemically treated genomic DNA (Homo sapiens) CpG-island No: 29893
gcgtcgcgttaggagtttttttttttttttttagcgaaggcggggattcgggcgttgttggtagttggcgacgcggggcgaagtcgcggttggcggcgtttggttagtttcgtattcgtcgcggtgggtgtgttcgtaggggtgcgtcggggttagggtcgagatcgtcggttagagggcgtttggagggtgtgcgcgtcgcggacgattagggtgcgttagtttcggggtgcgcgtttgggacgcggatagtgtattcggaggttgcgtgcgtttcgaagtcggggtgtgcgtttagttgtttcggtttcgtgtatcgcgggtcgtttcgcgtaggattttcgtagttcgttaaggtaagggattttgcgattttagtttttcgtagtgcgtttgttggggtgtttaatattcgttttgcgcgattcgagtgttggtttcggcgttcgattattttttttttgtttttgttattcgtttcgtttagtttttagcgtcgcgttttcggttttttttaaagtagtggttgcggtagtttgggtcgatttggcgttttcgttttttagtttggggtttgcgatagaaaaggagcggggttgt

SEQ ID NO: 29894 - DNA, 600 bp, Artificial Sequence
  chemically treated genomic DNA (Homo sapiens) CpG-island No: 29894
acaaccccgctccttttctatcgcaaaccccaaactaaaaaacgaaaacgccaaatcgacccaaactaccgcaaccactactttaaaaaaaaccgaaaacgcgacgctaaaaactaaacgaaacgaataacaaaaacaaaaaaaaaataatcgaacgccgaaaccaacactcgaatcgcgcaaaacgaatattaaacaccccaacaaacgcactacgaaaaactaaaatcgcaaaatcccttaccttaacgaactacgaaaatcctacgcgaaacgacccgcgatacacgaaaccgaaacaactaaacgcacaccccgacttcgaaacgcacgcaacctccgaatacactatccgcgtcccaaacgcgcaccccgaaactaacgcaccctaatcgtccgcgacgcgcacaccctccaaacgccctctaaccgacgatctcgaccctaaccccgacgcacccctacgaacacacccaccgcgacgaatacgaaactaaccaaacgccgccaaccgcgacttcgccccgcgtcgccaactaccaacaacgcccgaatccccgccttcgctaaaaaaaaaaaaaaaaactcctaacgcgacgc

SEQ ID NO: 29895 - DNA, 600 bp, Artificial Sequence
  chemically treated genomic DNA (Homo sapiens) CpG-island No: 29895
gtagtttcgttttttttttgtcgtagattttaggttgggaggcgggggcgttaggtcggtttaagttgtcgtagttattgttttaaagggagtcggggacgcggcgttggggattgggcgaggcgggtggtagaggtaagaggagagtggtcgagcgtcggggttaatattcgggtcgcgtagggcgggtgttgaatattttagtagacgtattgcgggggattggggtcgtagagttttttattttggcgagttgcggaagttttgcgcgaggcggttcgcggtgtacggggtcggggtagttaggcgtatatttcggtttcggagcgtacgtaattttcgggtgtattgttcgcgttttaggcgcgtatttcggggttggcgtattttggtcgttcgcggcgcgtatattttttaggcgttttttggtcgacggtttcggttttggtttcggcgtatttttgcgggtatatttatcgcggcggatgcgggattggttaggcgtcgttagtcgcggtttcgtttcgcgtcgttagttgttaatagcgttcgagttttcgttttcgttaggggagaaaaaaaagatttttgacgcggcgt

SEQ ID NO: 29896 - DNA, 600 bp, Artificial Sequence
  chemically treated genomic DNA (Homo sapiens) CpG-island No: 29896
acgccgcgtcaaaaatcttttttttctcccctaacgaaaacgaaaactcgaacgctattaacaactaacgacgcgaaacgaaaccgcgactaacgacgcctaaccaatcccgcatccgccgcgataaatatacccgcaaaaatacgccgaaaccaaaaccgaaaccgtcgaccaaaaaacgcctaaaaaatatacgcgccgcgaacgaccaaaatacgccaaccccgaaatacgcgcctaaaacgcgaacaatacacccgaaaattacgtacgctccgaaaccgaaatatacgcctaactaccccgaccccgtacaccgcgaaccgcctcgcgcaaaacttccgcaactcgccaaaataaaaaactctacgaccccaatcccccgcaatacgtctactaaaatattcaacacccgccctacgcgacccgaatattaaccccgacgctcgaccactctcctcttacctctaccacccgcctcgcccaatccccaacgccgcgtccccgactccctttaaaacaataactacgacaacttaaaccgacctaacgcccccgcctcccaacctaaaatctacgacaaaaaaaaaacgaaactac

SEQ ID NO: 29897 - DNA, 942 bp, Artificial Sequence
  chemically treated genomic DNA (Homo sapiens) CpG-island No: 29897
tcgtggggcggtatttggcgagttggcgggtgggcggcgagtcgaggtttttcggtttggcggtaattcgtttttttgtttttagttttttcggtttcgttttttttttttacgtcgttttgttttttttttacgttttttttttttttttttttttttttttagttcgtttgtttttattttagcggcgttcgtcgggtttttcgtttaatggtcgcggggttcgggatcgtattagttgatcggttcgggtttttggtcgttgggagttaattagggtatcgggggcggtttcgggtcgcggataaagggtgcggggttgttggcggttttgtagagtcgagagtgggagaagagcggagcgtgtgagtagtattgcggttttttttttttttttaatttcgttttcgcggtttagttttattcgttcgtttgttcggcgattaggtaagttttcggacggttcggtgttacgtaagcgaggcgcgtcgtttttgttatttcgcgaggcgcgtcgtttagtttttttttcggttgtttgtttttttagttttagttttacgttgcggttttttcggtttatgtttgagattcggtatgagtgtttttttcgcgtgttttcgtcgttggtggtttggattcgtcggggttggcgttggtggggcgcgtttttggttaggttttgggaagggcggggtgagttgttttgattttttttttattatttgcggtcgaagcgtcgtttttggaggtcgttgggtcggtttgcgttttggggttcgtagtggtttgtttgcgttgtggatggagtggcggtgcggttttttgtggagcgtaaataaggcgtttggttggcgcgggcgtttggttgtttttttcgtggtggggttttcggagtaatcgttttggttttggcgatggttgagacgtttcgattgcggt

SEQ ID NO: 29898 - DNA, 942 bp, Artificial Sequence
  chemically treated genomic DNA (Homo sapiens) CpG-island No: 29898
accgcaatcgaaacgtctcaaccatcgccaaaaccaaaacgattactccgaaaaccccaccacgaaaaaaacaaccaaacgcccgcgccaaccaaacgccttatttacgctccacaaaaaaccgcaccgccactccatccacaacgcaaacaaaccactacgaaccccaaaacgcaaaccgacccaacgacctccaaaaacgacgcttcgaccgcaaataataaaaaaaaaatcaaaacaactcaccccgcccttcccaaaacctaaccaaaaacgcgccccaccaacgccaaccccgacgaatccaaaccaccaacgacgaaaacacgcgaaaaaaacactcataccgaatctcaaacataaaccgaaaaaaccgcaacgtaaaactaaaactaaaaaaacaaacaaccgaaaaaaaaactaaacgacgcgcctcgcgaaataacaaaaacgacgcgcctcgcttacgtaacaccgaaccgtccgaaaacttacctaatcgccgaacaaacgaacgaataaaactaaaccgcgaaaacgaaattaaaaaaaaaaaaaaaaccgcaatactactcacacgctccgctcttctcccactctcgactctacaaaaccgccaacaaccccgcaccctttatccgcgacccgaaaccgcccccgataccctaattaactcccaacgaccaaaaacccgaaccgatcaactaatacgatcccgaaccccgcgaccattaaacgaaaaacccgacgaacgccgctaaaataaaaacaaacgaactaaaaaaaaaaaaaaaaaaaaaaaaaaaacgtaaaaaaaaaacaaaacgacgtaaaaaaaaaaaacgaaaccgaaaaaactaaaaacaaaaaaacgaattaccgccaaaccgaaaaacctcgactcgccgcccacccgccaactcgccaaataccgccccacga

SEQ ID NO: 29899 - DNA, 942 bp, Artificial Sequence
  chemically treated genomic DNA (Homo sapiens) CpG-island No: 29899
gtcgtaatcgaggcgttttaattatcgttagaattaggacgattgtttcgaaggttttattacgaggaaggtagttaggcgttcgcgttaattaagcgttttgtttgcgttttataggggatcgtatcgttattttatttatagcgtaaataaattattgcgagttttagggcgtaggtcggtttaacggtttttaggggcggcgtttcggtcgtaagtagtgaaaagaagattaaaataatttatttcgttttttttagagtttggttaagggcgcgttttattagcgttagtttcgacgggtttaagttattagcggcggaagtacgcgggaggagtatttatgtcggattttaggtatgggtcggagaggtcgtagcgtagggttgggattggaggggtaggtagtcgaaaaaagagttgggcggcgcgtttcgcggggtagtaggggcggcgcgtttcgtttgcgtgatatcgggtcgttcgggggtttatttggtcgtcgagtaggcgggcgggtaaagttaggtcgcgagagcgaggttaggagaggagaggaggtcgtagtattgtttatacgtttcgttttttttttattttcgattttgtagagtcgttagtagtttcgtattttttattcgcggttcggggtcgttttcggtgttttgattggtttttagcggttaggagttcgggtcgattagttgatgcggtttcgggtttcgcggttattgggcgaggagttcggcgggcgtcgttggggtgggggtaagcgaattgggaaagaaagaaagaaagagaaaggggcgtgggggaggggtagggcggcgtgggggaagggagcggagtcgggagggttgagggtagaggggcgagttgtcgttaggtcgggaagtttcggttcgtcgtttattcgttagttcgttaggtgtcgttttacgg

SEQ ID NO: 29900 - DNA, 942 bp, Artificial Sequence
  chemically treated genomic DNA (Homo sapiens) CpG-island No: 29900
ccgtaaaacgacacctaacgaactaacgaataaacgacgaaccgaaacttcccgacctaacgacaactcgcccctctaccctcaaccctcccgactccgctcccttcccccacgccgccctacccctcccccacgcccctttctctttctttctttctttcccaattcgcttacccccaccccaacgacgcccgccgaactcctcgcccaataaccgcgaaacccgaaaccgcatcaactaatcgacccgaactcctaaccgctaaaaaccaatcaaaacaccgaaaacgaccccgaaccgcgaataaaaaatacgaaactactaacgactctacaaaatcgaaaataaaaaaaaaacgaaacgtataaacaatactacgacctcctctcctctcctaacctcgctctcgcgacctaactttacccgcccgcctactcgacgaccaaataaacccccgaacgacccgatatcacgcaaacgaaacgcgccgcccctactaccccgcgaaacgcgccgcccaactcttttttcgactacctacccctccaatcccaaccctacgctacgacctctccgacccatacctaaaatccgacataaatactcctcccgcgtacttccgccgctaataacttaaacccgtcgaaactaacgctaataaaacgcgcccttaaccaaactctaaaaaaaacgaaataaattattttaatcttcttttcactacttacgaccgaaacgccgcccctaaaaaccgttaaaccgacctacgccctaaaactcgcaataatttatttacgctataaataaaataacgatacgatcccctataaaacgcaaacaaaacgcttaattaacgcgaacgcctaactaccttcctcgtaataaaaccttcgaaacaatcgtcctaattctaacgataattaaaacgcctcgattacgac

SEQ ID NO: 29901 - DNA, 697 bp, Artificial Sequence
  chemically treated genomic DNA (Homo sapiens) CpG-island No: 29901
gattttcgcgttttttcgtgtttcgggtcgggttttttacggttggtcgggtttagggcgttttaagtatttcgatttgtcgtttcgggttaggtcggcggggttcgtgtaggggtttcgtggggtcgcgtcgggtaggggtcgttcgggttcgagtacggtatttataaataggttggcgtttcgcgacggagattcgggttcggttcggagtcgttcgggaggtttgaggttaagggtttggtttagcgcgcggtcggagcgggtcgggggcgtagagttgtgcggcggcgtttttcgggtttcgggtttgtgtagggtcggtttttttttgcggggcgaggttgcgggtcgggttgcggtgcggggttttaataaaggatcgaggttttagaagcggtttttacgcgttttttgtttttgcgtggaataaattttatatacgtgtgtgtttttcgagggtttttcgtgtgttgagcgtttgtaaagcggagtcgcgttcggggagacgcgaagtcggtgttcgcggtttatttagggattttagttagatagcggtattcgcggggcgcgtgcgggatttttaggcgatcgggggaagtatcggtaatcgttttttattcgtgtttttttttttacggagaatgttttcgcgcgttcgttgtgtaattaaaaattaatgtgaaatatttattga

SEQ ID NO: 29902 - DNA, 697 bp, Artificial Sequence
  chemically treated genomic DNA (Homo sapiens) CpG-island No: 29902
tcaataaatatttcacattaatttttaattacacaacgaacgcgcgaaaacattctccgtaaaaaaaaaaacacgaataaaaaacgattaccgatacttcccccgatcgcctaaaaatcccgcacgcgccccgcgaataccgctatctaactaaaatccctaaataaaccgcgaacaccgacttcgcgtctccccgaacgcgactccgctttacaaacgctcaacacacgaaaaaccctcgaaaaacacacacgtatataaaatttattccacgcaaaaacaaaaaacgcgtaaaaaccgcttctaaaacctcgatcctttattaaaaccccgcaccgcaacccgacccgcaacctcgccccgcaaaaaaaaaccgaccctacacaaacccgaaacccgaaaaacgccgccgcacaactctacgcccccgacccgctccgaccgcgcgctaaaccaaacccttaacctcaaacctcccgaacgactccgaaccgaacccgaatctccgtcgcgaaacgccaacctatttataaataccgtactcgaacccgaacgacccctacccgacgcgaccccacgaaacccctacacgaaccccgccgacctaacccgaaacgacaaatcgaaatacttaaaacgccctaaacccgaccaaccgtaaaaaacccgacccgaaacacgaaaaaacgcgaaaatc

SEQ ID NO: 29903 - DNA, 697 bp, Artificial Sequence
  chemically treated genomic DNA (Homo sapiens) CpG-island No: 29903
ttaatggatgttttatattaatttttagttgtataacgaacgcgcgggaatatttttcgtgagagaaaaagtacgggtggggggcggttatcggtgtttttttcggtcgtttgggggtttcgtacgcgtttcgcgggtgtcgttgtttggttggggtttttgggtgagtcgcgggtatcggtttcgcgttttttcgggcgcgatttcgttttgtaagcgtttagtatacgggaaattttcggaaaatatatacgtgtgtaaagtttgttttacgtagaaataaaggacgcgtgggggtcgtttttggggtttcggttttttgttggaatttcgtatcgtagttcggttcgtagtttcgtttcgtaaggggaagtcggttttgtataggttcggggttcggaaggcgtcgtcgtatagttttgcgttttcgattcgtttcggtcgcgcgttgggttaggtttttggttttaagtttttcgggcggtttcgggtcggattcgggttttcgtcgcgggacgttagtttgtttgtgggtgtcgtgttcgggttcgggcggtttttgttcgacgcggttttacggagtttttgtacgaatttcgtcgatttggttcggggcggtaagtcgaggtgtttagggcgttttgggttcggttaatcgtggaaaattcggttcggggtacgggggggcgcgggggtt

SEQ ID NO: 29904 - DNA, 697 bp, Artificial Sequence
  chemically treated genomic DNA (Homo sapiens) CpG-island No: 29904
aacccccgcgcccccccgtaccccgaaccgaattttccacgattaaccgaacccaaaacgccctaaacacctcgacttaccgccccgaaccaaatcgacgaaattcgtacaaaaactccgtaaaaccgcgtcgaacaaaaaccgcccgaacccgaacacgacacccacaaacaaactaacgtcccgcgacgaaaacccgaatccgacccgaaaccgcccgaaaaacttaaaaccaaaaacctaacccaacgcgcgaccgaaacgaatcgaaaacgcaaaactatacgacgacgccttccgaaccccgaacctatacaaaaccgacttccccttacgaaacgaaactacgaaccgaactacgatacgaaattccaacaaaaaaccgaaaccccaaaaacgacccccacgcgtcctttatttctacgtaaaacaaactttacacacgtatatattttccgaaaatttcccgtatactaaacgcttacaaaacgaaatcgcgcccgaaaaaacgcgaaaccgatacccgcgactcacccaaaaaccccaaccaaacaacgacacccgcgaaacgcgtacgaaacccccaaacgaccgaaaaaaacaccgataaccgccccccacccgtactttttctctcacgaaaaatattcccgcgcgttcgttatacaactaaaaattaatataaaacatccattaa

SEQ ID NO: 29905 - DNA, 550 bp, Artificial Sequence
  chemically treated genomic DNA (Homo sapiens) CpG-island No: 29905
tttcgttcgtttttagggtttggacgtttcgggttgggtttcgttaagtttttcgggtcgtttaggcgtcggattttcgttttcggagttttcgcgcgcgtttattttgggtttgtcgaaggcgggcgtttgggttatggtgttttcgtgcgtttcggcgttgtttttttcgtcgtcgttcggtgggtttttgtcggttcggtggtcgttcggttttttttggggttagcggtggtcgcggtcggttacgttttttttaacgggtcgggtttcgtttttcgtttcgttcgtcgtcgttttcggggttcgttttttcgtcggagttttcgtttcgttcgtcggtttggatcgcgtattttttggaattttggattcggcgttttcgttcgtcgattcgaaaattacggtttcgcggcgttcgatcggatttatttgtgggcgcgcgttttagtcgtttcgttgggcgttgtttttttttcggtttttttagtaatttttaagcgtttttttgtagtttgggcgttgttgtgcgttaggtttaagttagaag

SEQ ID NO: 29906 - DNA, 550 bp, Artificial Sequence
  chemically treated genomic DNA (Homo sapiens) CpG-island No: 29906
cttctaacttaaacctaacgcacaacaacgcccaaactacaaaaaaacgcttaaaaattactaaaaaaaccgaaaaaaaaacaacgcccaacgaaacgactaaaacgcgcgcccacaaataaatccgatcgaacgccgcgaaaccgtaattttcgaatcgacgaacgaaaacgccgaatccaaaattccaaaaaatacgcgatccaaaccgacgaacgaaacgaaaactccgacgaaaaaacgaaccccgaaaacgacgacgaacgaaacgaaaaacgaaacccgacccgttaaaaaaaacgtaaccgaccgcgaccaccgctaaccccaaaaaaaaccgaacgaccaccgaaccgacaaaaacccaccgaacgacgacgaaaaaaacaacgccgaaacgcacgaaaacaccataacccaaacgcccgccttcgacaaacccaaaataaacgcgcgcgaaaactccgaaaacgaaaatccgacgcctaaacgacccgaaaaacttaacgaaacccaacccgaaacgtccaaaccctaaaaacgaacgaaa

SEQ ID NO: 29907 - DNA, 550 bp, Artificial Sequence
  chemically treated genomic DNA (Homo sapiens) CpG-island No: 29907
tttttagtttgggtttggcgtatagtagcgtttagattgtagggggacgtttgaaagttgttggaggagtcggggggaaggtagcgtttagcgaggcggttggagcgcgcgtttataggtgggttcggtcgggcgtcgcggggtcgtagttttcgggtcggcgggcgaggacgtcgggtttagaattttaggaaatgcgcgatttaggtcggcgggcggggcgggggtttcggcgagagggcgggtttcgggaacggcggcgggcggggcgggaggcggggttcggttcgttaagaagagcgtggtcggtcgcggttatcgttggttttagggaaagtcgagcggttatcgagtcggtagagatttatcgagcggcggcggagggagtagcgtcggggcgtacgagggtattatggtttagacgttcgttttcgataagtttaaagtgagcgcgcgcgggggtttcggggacgggggttcggcgtttgggcggttcgaggggtttagcggggtttagttcggggcgtttaaattttgggaacgaacgggg

SEQ ID NO: 29908 - DNA, 550 bp, Artificial Sequence
  chemically treated genomic DNA (Homo sapiens) CpG-island No: 29908
ccccgttcgttcccaaaatttaaacgccccgaactaaaccccgctaaacccctcgaaccgcccaaacgccgaacccccgtccccgaaacccccgcgcgcgctcactttaaacttatcgaaaacgaacgtctaaaccataataccctcgtacgccccgacgctactccctccgccgccgctcgataaatctctaccgactcgataaccgctcgactttccctaaaaccaacgataaccgcgaccgaccacgctcttcttaacgaaccgaaccccgcctcccgccccgcccgccgccgttcccgaaacccgccctctcgccgaaacccccgccccgcccgccgacctaaatcgcgcatttcctaaaattctaaacccgacgtcctcgcccgccgacccgaaaactacgaccccgcgacgcccgaccgaacccacctataaacgcgcgctccaaccgcctcgctaaacgctaccttccccccgactcctccaacaactttcaaacgtccccctacaatctaaacgctactatacgccaaacccaaactaaaaa

SEQ ID NO: 29909 - DNA, 738 bp, Artificial Sequence
  chemically treated genomic DNA (Homo sapiens) CpG-island No: 29909
gtgtgtgttggggggcgtcgcgtttcgcgttcgtcgttattggggattcgggcgtaggtaggttgtttcgggcgtagagcgcgtcgtttttagtttttttggcgggttcggttcggtagggtttttggcggttttcggaggcgggtttttttgtttttgattttcgttgggcgcgaaggtcgtcggcggttaatagaaattcgagttcgcgtaacggagtttaggtttttacgtgcggtttcgtagggtagagtaggaaggagcggttgtagtttcggggcgtttcgtaagtatttagtgttcggtttttttagtttcgcggcgggtttcggacggtggagtgagatattagaattcgtttttcgttttttcgagtcgatgtacggtttgggatggcgtcgttcgttttaagtagcgtggtttgagggcgagaagacgtttattggagcgtttttttttatttagattttcgaagacgcgcgttcgagtcgaagtcggggatagagaaggttttttggcgtttttttgtcgattgttttgcggtcgtcgggattcgagtagcggggcgggatttaaatatagttttaatttaaagatgtttagtagaacgttttaaataaaatagaaacggtggtcgtatttgcgtgtgtgtgtgtgtgtgtgtgtgtgacgggggagaggagttgattttatttgaaatatagtttgcgtttttgtgtgtgtggtcgaagaatggaa

SEQ ID NO: 29910 - DNA, 738 bp, Artificial Sequence
  chemically treated genomic DNA (Homo sapiens) CpG-island No: 29910
ttccattcttcgaccacacacacaaaaacgcaaactatatttcaaataaaatcaactcctctcccccgtcacacacacacacacacacacacacgcaaatacgaccaccgtttctattttatttaaaacgttctactaaacatctttaaattaaaactatatttaaatcccgccccgctactcgaatcccgacgaccgcaaaacaatcgacaaaaaaacgccaaaaaaccttctctatccccgacttcgactcgaacgcgcgtcttcgaaaatctaaataaaaaaaaacgctccaataaacgtcttctcgccctcaaaccacgctacttaaaacgaacgacgccatcccaaaccgtacatcgactcgaaaaaacgaaaaacgaattctaatatctcactccaccgtccgaaacccgccgcgaaactaaaaaaaccgaacactaaatacttacgaaacgccccgaaactacaaccgctccttcctactctaccctacgaaaccgcacgtaaaaacctaaactccgttacgcgaactcgaatttctattaaccgccgacgaccttcgcgcccaacgaaaatcaaaaacaaaaaaacccgcctccgaaaaccgccaaaaaccctaccgaaccgaacccgccaaaaaaactaaaaacgacgcgctctacgcccgaaacaacctacctacgcccgaatccccaataacgacgaacgcgaaacgcgacgccccccaacacacac

SEQ ID NO: 29911 - DNA, 738 bp, Artificial Sequence
  chemically treated genomic DNA (Homo sapiens) CpG-island No: 29911
ttttatttttcggttatatatatagaagcgtaaattatgttttaggtaagattaatttttttttttcgttatatatatatatatatatatatacgtagatgcggttatcgtttttgttttgtttggagcgttttgttgggtatttttgggttggggttatgtttaggtttcgtttcgttgttcgggtttcggcggtcgtaaagtagtcggtaggggggcgttagagaattttttttgttttcgatttcgattcgggcgcgcgttttcgggagtttgggtggaggggagcgttttagtaggcgttttttcgtttttaaattacgttgtttaggacgagcggcgttattttaagtcgtgtatcggttcggggaagcgaaaggcgagttttggtgttttattttatcgttcgaagttcgtcgcggagttgggagggtcgggtattggatgtttgcggggcgtttcggggttgtagtcgtttttttttgttttgttttgcggggtcgtacgtggaagtttgagtttcgttgcgcgggttcgggtttttgttagtcgtcggcggttttcgcgtttagcgggagttagggataaagaaattcgttttcgggggtcgttaggggttttgtcgggtcgggttcgttagagagattggaggcggcgcgttttgcgttcgggatagtttgtttgcgttcggatttttagtggcggcgggcgcggagcgcggcgttttttaatatatat

SEQ ID NO: 29912 - DNA, 738 bp, Artificial Sequence
  chemically treated genomic DNA (Homo sapiens) CpG-island No: 29912
atatatattaaaaaacgccgcgctccgcgcccgccgccactaaaaatccgaacgcaaacaaactatcccgaacgcaaaacgcgccgcctccaatctctctaacgaacccgacccgacaaaacccctaacgacccccgaaaacgaatttctttatccctaactcccgctaaacgcgaaaaccgccgacgactaacaaaaacccgaacccgcgcaacgaaactcaaacttccacgtacgaccccgcaaaacaaaacaaaaaaaaacgactacaaccccgaaacgccccgcaaacatccaatacccgaccctcccaactccgcgacgaacttcgaacgataaaataaaacaccaaaactcgcctttcgcttccccgaaccgatacacgacttaaaataacgccgctcgtcctaaacaacgtaatttaaaaacgaaaaaacgcctactaaaacgctcccctccacccaaactcccgaaaacgcgcgcccgaatcgaaatcgaaaacaaaaaaaattctctaacgcccccctaccgactactttacgaccgccgaaacccgaacaacgaaacgaaacctaaacataaccccaacccaaaaatacccaacaaaacgctccaaacaaaacaaaaacgataaccgcatctacgtatatatatatatatatatatataacgaaaaaaaaaaattaatcttacctaaaacataatttacgcttctatatatataaccgaaaaataaaa

SEQ ID NO: 29913 - DNA, 751 bp, Artificial Sequence
  chemically treated genomic DNA (Homo sapiens) CpG-island No: 29913
gacggattcgattagcgtattacggcgttttagggtttttttatcgttttcggttttcggtttttcgtttttcggttatcgcgcgggtttcgtcgtttttgggacgcgtattggtttcggttcggcgttattttttgtttttttgttatttcgtacggaggtttttattatttaagtcgcgtttagtcgtcgtcgcgtcgttttaggaggttttcgttttttttttatttcgtttcgtaggttatacggcgtttcggtttcgcgcgcgggttgtttttcggcggcgtttttttttcgcgagttagtagaggcggttagcggtcgggtatttgcgtttagtggcggttcgtatagcgcgagtgcggtcgagagtaatgcgataacgatcgcgtcggcgacggtagtttcggttttcgcgcgtgtgattattttcgggttaaatggaatcgattttatttcgtttgtaagttcggattgttttatagcgaggatttagggttatcgggtagtatttcggatttttagttgttttcgcgtcgtcgtcggaaatatagttattggaagcgtttttcggtttttcgatcgttttcgcgcggttgtcggtagtgggattttaattcgtttaattatattcggttttagatgattgataagcgcgacgtttaattcggtttggttttagttttggtttaagaggttcggttggaaggtaggttgaagagttaataacgatttggtttagggtttggtt

SEQ ID NO: 29914 - DNA, 751 bp, Artificial Sequence
  chemically treated genomic DNA (Homo sapiens) CpG-island No: 29914
aaccaaaccctaaaccaaatcgttattaactcttcaacctaccttccaaccgaacctcttaaaccaaaactaaaaccaaaccgaattaaacgtcgcgcttatcaatcatctaaaaccgaatataattaaacgaattaaaatcccactaccgacaaccgcgcgaaaacgatcgaaaaaccgaaaaacgcttccaataactatatttccgacgacgacgcgaaaacaactaaaaatccgaaatactacccgataaccctaaatcctcgctataaaacaatccgaacttacaaacgaaataaaatcgattccatttaacccgaaaataatcacacgcgcgaaaaccgaaactaccgtcgccgacgcgatcgttatcgcattactctcgaccgcactcgcgctatacgaaccgccactaaacgcaaatacccgaccgctaaccgcctctactaactcgcgaaaaaaaaacgccgccgaaaaacaacccgcgcgcgaaaccgaaacgccgtataacctacgaaacgaaataaaaaaaaaacgaaaacctcctaaaacgacgcgacgacgactaaacgcgacttaaataataaaaacctccgtacgaaataacaaaaaaacaaaaaataacgccgaaccgaaaccaatacgcgtcccaaaaacgacgaaacccgcgcgataaccgaaaaacgaaaaaccgaaaaccgaaaacgataaaaaaaccctaaaacgccgtaatacgctaatcgaatccgtc

SEQ ID NO: 29915 - DNA, 751 bp, Artificial Sequence
  chemically treated genomic DNA (Homo sapiens) CpG-island No: 29915
aattagattttgaattagatcgttgttaattttttaatttgttttttagtcgaattttttaggttagagttgggattaggtcgggttgggcgtcgcgtttgttaattatttagaatcgggtgtgattgagcgagttgggattttattgtcgatagtcgcgcggaggcggtcgggaaatcggaaaacgtttttaatggttgtgttttcggcgacggcgcgggggtagttgggaattcggaatgttgttcgatggttttgggttttcgttgtggggtaattcgggtttgtagacgaggtaaggtcgattttatttggttcggggatggttatacgcgcgggggtcggaattgtcgtcgtcggcgcggtcgttgtcgtattgttttcggtcgtattcgcgttgtacgggtcgttattggacgtaggtattcgatcgttgatcgtttttgttggttcgcgggggggaagcgtcgtcgaggggtagttcgcgcgcggggtcggggcgtcgtgtggtttgcggggcggagtagggagaggacggaggttttttggaacggcgcggcgacggttgggcgcggtttgggtgatgggagttttcgtgcggggtgatagaggggtagagggtggcgtcgggtcggagttagtgcgcgttttaggagcggcggagttcgcgcggtggtcggggaacggggggtcgagggtcgaggacggtaggagggttttggggcgtcgtggtgcgttggtcggattcgtt

SEQ ID NO: 29916 - DNA, 751 bp, Artificial Sequence
  chemically treated genomic DNA (Homo sapiens) CpG-island No: 29916
aacgaatccgaccaacgcaccacgacgccccaaaaccctcctaccgtcctcgaccctcgaccccccgttccccgaccaccgcgcgaactccgccgctcctaaaacgcgcactaactccgacccgacgccaccctctacccctctatcaccccgcacgaaaactcccatcacccaaaccgcgcccaaccgtcgccgcgccgttccaaaaaacctccgtcctctccctactccgccccgcaaaccacacgacgccccgaccccgcgcgcgaactacccctcgacgacgcttcccccccgcgaaccaacaaaaacgatcaacgatcgaatacctacgtccaataacgacccgtacaacgcgaatacgaccgaaaacaatacgacaacgaccgcgccgacgacgacaattccgacccccgcgcgtataaccatccccgaaccaaataaaatcgaccttacctcgtctacaaacccgaattaccccacaacgaaaacccaaaaccatcgaacaacattccgaattcccaactacccccgcgccgtcgccgaaaacacaaccattaaaaacgttttccgatttcccgaccgcctccgcgcgactatcgacaataaaatcccaactcgctcaatcacacccgattctaaataattaacaaacgcgacgcccaacccgacctaatcccaactctaacctaaaaaattcgactaaaaaacaaattaaaaaattaacaacgatctaattcaaaatctaatt

SEQ ID NO: 29917 - DNA, 674 bp, Artificial Sequence
  chemically treated genomic DNA (Homo sapiens) CpG-island No: 29917
  misc_feature (13)..(13): n is either a, c, g or t
atttttagcgttntcgcgtttttttttcgaggttggtcggttcgtgcgttttgggcgtagttggaggagcggatttcggattcgtcgggattcggattttcgtgaacgtttcgggattttcgttttcggacgttcgggagtttaagagaggaagcgcgtgtgcgcgttcgggaaggagttgggtgtagagtacggagtttacgtcgggggttcggatcgcggcggtttcgtttcgtttcgttttcgttttcgttttcgggtttttttatcgtcgcggtttcgttttattttttttcgtttatcgttttcgtttcgtttttgttggatttcgtcgtttcgtaagtattcgagttttttagtcgaggttcgggattgttgtagggtggaaaatgaaagttttgagagtatttttcgttttttcgtttttgtatagtcggggttgcggtgcgaggagtttggtcgcggggttcgaacgaggcgaaggggtcggggtttttggggaattttttttttttttttatttttttttaggtaaaattcgtgttttttttacgttcgatttagcgtttttttagttgcggtcgatttgttttttcgcgtgtaagtatagttatttttaaggttattgaaaaagtttgttttaaatgagcgtttgcggaattcgttttgaggtt

SEQ ID NO: 29918 - DNA, 674 bp, Artificial Sequence
  chemically treated genomic DNA (Homo sapiens) CpG-island No: 29918
  misc_feature (662)..(662): n is either a, c, g or t
aacctcaaaacgaattccgcaaacgctcatttaaaacaaactttttcaataaccttaaaaataactatacttacacgcgaaaaaacaaatcgaccgcaactaaaaaaacgctaaatcgaacgtaaaaaaaacacgaattttacctaaaaaaaaataaaaaaaaaaaaaaaattccccaaaaaccccgaccccttcgcctcgttcgaaccccgcgaccaaactcctcgcaccgcaaccccgactatacaaaaacgaaaaaacgaaaaatactctcaaaactttcattttccaccctacaacaatcccgaacctcgactaaaaaactcgaatacttacgaaacgacgaaatccaacaaaaacgaaacgaaaacgataaacgaaaaaaaataaaacgaaaccgcgacgataaaaaaacccgaaaacgaaaacgaaaacgaaacgaaacgaaaccgccgcgatccgaacccccgacgtaaactccgtactctacacccaactccttcccgaacgcgcacacgcgcttcctctcttaaactcccgaacgtccgaaaacgaaaatcccgaaacgttcacgaaaatccgaatcccgacgaatccgaaatccgctcctccaactacgcccaaaacgcacgaaccgaccaacctcgaaaaaaaaacgcganaacgctaaaaat

SEQ ID NO: 29919 - DNA, 674 bp, Artificial Sequence
  chemically treated genomic DNA (Homo sapiens) CpG-island No: 29919
  misc_feature (662)..(662): n is either a, c, g or t
agttttaggacgagtttcgtagacgtttatttaaagtaaatttttttaatgattttgagggtggttgtatttatacgcggagaagtaaatcgatcgtagttggaaaggcgttgggtcgagcgtgagaggaatacgggttttatttaagggagagtggaagagagaagggggttttttaagggtttcggttttttcgtttcgttcgggtttcgcggttaagtttttcgtatcgtagtttcggttgtgtagaagcggaggggcggaaggtgtttttagaatttttattttttattttgtagtagtttcgagtttcggttggagaattcggatgtttgcgaaacggcgaggtttagtaggggcgggacgggggcggtgggcggaggaggatagggcggggtcgcggcggtgaaagggttcgggggcgggggcgggggcggggcgaggcgaggtcgtcgcggttcgggttttcgacgtgggtttcgtgttttgtatttagttttttttcgggcgcgtatacgcgtttttttttttgagttttcgggcgttcggaggcgaaggtttcggagcgtttacgagaattcgggtttcggcgagttcggggttcgtttttttagttgcgtttagggcgtacgagtcggttagtttcggggagagggcgcggnggcgttgggggt

SEQ ID NO: 29920 - DNA, 674 bp, Artificial Sequence
  chemically treated genomic DNA (Homo sapiens) CpG-island No: 29920
  misc_feature (13)..(13): n is either a, c, g or t
acccccaacgccnccgcgccctctccccgaaactaaccgactcgtacgccctaaacgcaactaaaaaaacgaaccccgaactcgccgaaacccgaattctcgtaaacgctccgaaaccttcgcctccgaacgcccgaaaactcaaaaaaaaaaacgcgtatacgcgcccgaaaaaaaactaaatacaaaacacgaaacccacgtcgaaaacccgaaccgcgacgacctcgcctcgccccgcccccgcccccgcccccgaaccctttcaccgccgcgaccccgccctatcctcctccgcccaccgcccccgtcccgcccctactaaacctcgccgtttcgcaaacatccgaattctccaaccgaaactcgaaactactacaaaataaaaaataaaaattctaaaaacaccttccgcccctccgcttctacacaaccgaaactacgatacgaaaaacttaaccgcgaaacccgaacgaaacgaaaaaaccgaaacccttaaaaaacccccttctctcttccactctcccttaaataaaacccgtattcctctcacgctcgacccaacgcctttccaactacgatcgatttacttctccgcgtataaatacaaccaccctcaaaatcattaaaaaaatttactttaaataaacgtctacgaaactcgtcctaaaact

SEQ ID NO: 29921 - DNA, 1190 bp, Artificial Sequence
  chemically treated genomic DNA (Homo sapiens) CpG-island No: 29921
atcggtttttaacgtattatgttagggagttaagcgttttgttcggtcgtaagtacgtgtttcggatttcgattcgcggtacgtcggcggtagcgagaagtttggggtatagtcggagcgattttttaaagaattttggggatggggagggtgaagtttgtagagcgcgttgtatttttgaaattcggtgtgtttcggagtcggggattcgtacgttttatttcgcgtagcgtgcgttcgggtcggcggggcggttagggatgagcggggtagtttttttttttcgggttgcgcgtcgggttatttttttttttttttttttttttttttttttttcgtttttttttttttttcgagtttgcggttttgttaattagtttttagcgcgagtcgtcgtagcgtttcgttagtaggatttgatgcgtatttatattagtcgttcgagcgtaggaattcggatcgattcgcgtcgtcgagtttatttttaattagtatcgtcgggattcggatggtgcgcgtatcgtcggttagaaatattttattagcgttgttttttatttttcgatttttttttttcgatatttttttttttatgtgggaggggaaattttttttttatatattttcgagtttttttcgggtcgggaagcgcggagatgacggcgttcgttttttcgtcgtcgttttaaggtattcgggggtgtttgttcggggtgttcgcgcgggggtgtttgttcggggttgttcggtgggagtattcgtcgcgttttgttttgcggattttgaatttttcgggcggacggcgtcggtcgggagggggtcgcgggtagtttcgcgttttcgcgggttttcggttggcggtcgtggttacgtcgattatcgtttcggggggtttggggaggaggggatcgggttttagtcgtgcgggtacgtattgttttttcgttttttcgttggcggggtgagtgttttcgtgggagttttcggtgtggagttagtttgtttcgcgggcggggggggtggggggttcggcgtcgttacgagtataggaaggaggtcgggagtattcgaggcggggtcggtcgtcggggttcgtttcgtcgtttagttgtggagcgcgttcggaaatttttgttcgtcgttcgttggattagttttttacgagttttggggttttttttttttttttt

SEQ ID NO: 29922 - DNA, 1190 bp, Artificial Sequence
  chemically treated genomic DNA (Homo sapiens) CpG-island No: 29922
aaaaaaaaaaaaaaaaaccccaaaactcgtaaaaaactaatccaacgaacgacgaacaaaaatttccgaacgcgctccacaactaaacgacgaaacgaaccccgacgaccgaccccgcctcgaatactcccgacctccttcctatactcgtaacgacgccgaaccccccaccccccccgcccgcgaaacaaactaactccacaccgaaaactcccacgaaaacactcaccccgccaacgaaaaaacgaaaaaacaatacgtacccgcacgactaaaacccgatcccctcctccccaaaccccccgaaacgataatcgacgtaaccacgaccgccaaccgaaaacccgcgaaaacgcgaaactacccgcgaccccctcccgaccgacgccgtccgcccgaaaaattcaaaatccgcaaaacaaaacgcgacgaatactcccaccgaacaaccccgaacaaacacccccgcgcgaacaccccgaacaaacacccccgaataccttaaaacgacgacgaaaaaacgaacgccgtcatctccgcgcttcccgacccgaaaaaaactcgaaaatatataaaaaaaaaatttcccctcccacataaaaaaaaaaatatcgaaaaaaaaaaatcgaaaaataaaaaacaacgctaataaaatatttctaaccgacgatacgcgcaccatccgaatcccgacgatactaattaaaaataaactcgacgacgcgaatcgatccgaattcctacgctcgaacgactaatataaatacgcatcaaatcctactaacgaaacgctacgacgactcgcgctaaaaactaattaacaaaaccgcaaactcgaaaaaaaaaaaaaaacgaaaaaaaaaaaaaaaaaaaaaaaaaaaaaaaaataacccgacgcgcaacccgaaaaaaaaaaactaccccgctcatccctaaccgccccgccgacccgaacgcacgctacgcgaaataaaacgtacgaatccccgactccgaaacacaccgaatttcaaaaatacaacgcgctctacaaacttcaccctccccatccccaaaattctttaaaaaatcgctccgactataccccaaacttctcgctaccgccgacgtaccgcgaatcgaaatccgaaacacgtacttacgaccgaacaaaacgcttaactccctaacataatacgttaaaaaccgat

SEQ ID NO: 29923 - DNA, 1190 bp, Artificial Sequence
  chemically treated genomic DNA (Homo sapiens) CpG-island No: 29923
gggaggaggaagggaagttttagaattcgtgaaaaattggtttagcgggcggcggataaaagttttcgagcgcgttttatagttgggcggcggagcgggtttcggcggtcggtttcgtttcggatgttttcggttttttttttgtgttcgtgacggcgtcgagttttttatttttttcgttcgcgaggtaggttagttttatatcgagggtttttacgaaaatatttatttcgttaacggaagggcgagggaataatacgtgttcgtacggttagggttcggtttttttttttttaggtttttcggggcggtggtcggcgtgattacgatcgttagtcgggaattcgcgagggcgcggggttgttcgcggttttttttcggtcggcgtcgttcgttcgggaggtttaaagttcgtagagtagggcgcggcggatgtttttatcgagtagtttcgagtaggtattttcgcgcgagtatttcgggtaggtattttcggatattttagggcggcggcgggagggcgggcgtcgttattttcgcgtttttcggttcgagaaggattcgaaagtatgtaggagaaaagtttttttttttatatgggagggaggatgtcgagggagagaggtcgaaagatggagagtagcgttggtaagatgtttttggtcggcggtgcgcgtattattcgagtttcggcggtgttggttaaaaataaattcggcggcgcgggtcggttcggatttttgcgttcggacggttaatatggatgcgtattaggttttgttggcggggcgttgcgacggttcgcgttgggagttggttggtagagtcgtaggttcgggaaagggaaaagagcggaggaaggggaggaggaggaggaggaggaggaatggttcggcgcgtagttcgaggggagagggttgtttcgtttatttttggtcgtttcgtcggttcgagcgtacgttgcgcggagtggggcgtgcgggttttcggtttcgggatatatcgagttttaaaagtataacgcgttttgtagattttattttttttatttttaaagttttttaaaaggtcgtttcggttgtgttttagatttttcgttgtcgtcggcgtatcgcgagtcggaattcggggtacgtatttacggtcgggtaggacgtttggttttttggtatgatgcgttggggatcggt

SEQ ID NO: 29924 - DNA, 1190 bp, Artificial Sequence
  chemically treated genomic DNA (Homo sapiens) CpG-island No: 29924
accgatccccaacgcatcataccaaaaaaccaaacgtcctacccgaccgtaaatacgtaccccgaattccgactcgcgatacgccgacgacaacgaaaaatctaaaacacaaccgaaacgaccttttaaaaaactttaaaaataaaaaaaataaaatctacaaaacgcgttatacttttaaaactcgatatatcccgaaaccgaaaacccgcacgccccactccgcgcaacgtacgctcgaaccgacgaaacgaccaaaaataaacgaaacaaccctctcccctcgaactacgcgccgaaccattcctcctcctcctcctcctcctccccttcctccgctcttttccctttcccgaacctacgactctaccaaccaactcccaacgcgaaccgtcgcaacgccccgccaacaaaacctaatacgcatccatattaaccgtccgaacgcaaaaatccgaaccgacccgcgccgccgaatttatttttaaccaacaccgccgaaactcgaataatacgcgcaccgccgaccaaaaacatcttaccaacgctactctccatctttcgacctctctccctcgacatcctccctcccatataaaaaaaaaaacttttctcctacatactttcgaatccttctcgaaccgaaaaacgcgaaaataacgacgcccgccctcccgccgccgccctaaaatatccgaaaatacctacccgaaatactcgcgcgaaaatacctactcgaaactactcgataaaaacatccgccgcgccctactctacgaactttaaacctcccgaacgaacgacgccgaccgaaaaaaaaccgcgaacaaccccgcgccctcgcgaattcccgactaacgatcgtaatcacgccgaccaccgccccgaaaaacctaaaaaaaaaaaaaccgaaccctaaccgtacgaacacgtattattccctcgcccttccgttaacgaaataaatattttcgtaaaaaccctcgatataaaactaacctacctcgcgaacgaaaaaaataaaaaactcgacgccgtcacgaacacaaaaaaaaaaccgaaaacatccgaaacgaaaccgaccgccgaaacccgctccgccgcccaactataaaacgcgctcgaaaacttttatccgccgcccgctaaaccaatttttcacgaattctaaaacttcccttcctcctccc

SEQ ID NO: 29925 - DNA, 705 bp, Artificial Sequence
  chemically treated genomic DNA (Homo sapiens) CpG-island No: 29925
tttcgcgcggttttagttatcgtggtgattcgttttgcgtcgtagagggagtatagttcggcgaggggtaggcgggaggacggcgcgggttatttcggggtcggaggttatagtgaggtttttacgtaggagtcgtggcggtgtagcggtcggtggttgtggtttagatattttttttgtcggtggacgatgaggatcggaaagtagagggcgtcgtggtagggcggcggcggttcggtttttttttcgtcgtcgttttcgtcgttttttatgttggtttggttggatagtcgcgtttgtttcgtggggtagttggtttcgttgacgttttcgttgcggttgcgttataggtagttgcgtcgggagtcgtagagacggtttagcgagaagcggttgttttcgtagttcgcgtttttatcgggtttcgggtcggttcgcgggttggcgtagatgtttagggcgttgcgcgagaagatagacgagttgttgacggcgcgttggtagtgttcgtagttgcgtcggtagggagttacgttcgtcgcgttcgggtcgtttattttatcgtagcggtacgagggcgcgtagtcgtcgtttgtttcgtcgtagcgcgtttcgagtttcgttaggtttatgagtatcgttttagagtagttgggtattagttgttggttggagcggatgtgttattcgagtttcgtgttgttt

SEQ ID NO: 29926 - DNA, 705 bp, Artificial Sequence
  chemically treated genomic DNA (Homo sapiens) CpG-island No: 29926
aaacaacacgaaactcgaataacacatccgctccaaccaacaactaatacccaactactctaaaacgatactcataaacctaacgaaactcgaaacgcgctacgacgaaacaaacgacgactacgcgccctcgtaccgctacgataaaataaacgacccgaacgcgacgaacgtaactccctaccgacgcaactacgaacactaccaacgcgccgtcaacaactcgtctatcttctcgcgcaacgccctaaacatctacgccaacccgcgaaccgacccgaaacccgataaaaacgcgaactacgaaaacaaccgcttctcgctaaaccgtctctacgactcccgacgcaactacctataacgcaaccgcaacgaaaacgtcaacgaaaccaactaccccacgaaacaaacgcgactatccaaccaaaccaacataaaaaacgacgaaaacgacgacgaaaaaaaaaccgaaccgccgccgccctaccacgacgccctctactttccgatcctcatcgtccaccgacaaaaaaaatatctaaaccacaaccaccgaccgctacaccgccacgactcctacgtaaaaacctcactataacctccgaccccgaaataacccgcgccgtcctcccgcctacccctcgccgaactatactccctctacgacgcaaaacgaatcaccacgataactaaaaccgcgcgaaa

SEQ ID NO: 29927 - DNA, 705 bp, Artificial Sequence
  chemically treated genomic DNA (Homo sapiens) CpG-island No: 29927
agatagtacggagttcgagtggtatattcgttttaattagtagttggtgtttagttattttgaggcggtgtttatggatttggcggggttcgggacgcgttgcggcggggtaggcggcggttacgcgttttcgtgtcgttacggtggggtaggcggttcgggcgcggcgggcgtggttttttatcggcgtagttgcgagtattgttagcgcgtcgttagtagttcgtttattttttcgcgtagcgttttaagtatttgcgttagttcgcgggtcggttcggggttcggtgggggcgcgggttgcgggggtagtcgtttttcgttgggtcgtttttacggttttcggcgtagttgtttgtggcgtagtcgtagcgggagcgttaacgaggttagttgttttacggagtagacgcggttgtttagttaggttagtatgggggacgacgaggacgacgacgaggaggaggtcgggtcgtcgtcgttttattacgacgttttttatttttcggtttttatcgtttatcggtaggaggggtgtttgggttatagttatcggtcgttgtatcgttacggtttttgcgtagagattttattgtgattttcggtttcggagtggttcgcgtcgttttttcgtttgtttttcgtcggattgtgttttttttgcgacgtagggcgagttattacggtgattgaggtcgcgcgggg

SEQ ID NO: 29928 - DNA, 705 bp, Artificial Sequence
  chemically treated genomic DNA (Homo sapiens) CpG-island No: 29928
ccccgcgcgacctcaatcaccgtaataactcgccctacgtcgcaaaaaaaacacaatccgacgaaaaacaaacgaaaaaacgacgcgaaccactccgaaaccgaaaatcacaataaaatctctacgcaaaaaccgtaacgatacaacgaccgataactataacccaaacacccctcctaccgataaacgataaaaaccgaaaaataaaaaacgtcgtaataaaacgacgacgacccgacctcctcctcgtcgtcgtcctcgtcgtcccccatactaacctaactaaacaaccgcgtctactccgtaaaacaactaacctcgttaacgctcccgctacgactacgccacaaacaactacgccgaaaaccgtaaaaacgacccaacgaaaaacgactacccccgcaacccgcgcccccaccgaaccccgaaccgacccgcgaactaacgcaaatacttaaaacgctacgcgaaaaaataaacgaactactaacgacgcgctaacaatactcgcaactacgccgataaaaaaccacgcccgccgcgcccgaaccgcctaccccaccgtaacgacacgaaaacgcgtaaccgccgcctaccccgccgcaacgcgtcccgaaccccgccaaatccataaacaccgcctcaaaataactaaacaccaactactaattaaaacgaatataccactcgaactccgtactatct

SEQ ID NO: 29929 - DNA, 525 bp, Artificial Sequence
  chemically treated genomic DNA (Homo sapiens) CpG-island No: 29929
tagtgcgcgtaggtcgtgcggtattcggttagtattcgtagcggttacgatagcgtgagtagcgtcgcggtttagaaggtcgacgagtaggcgtattagggcggtcgggtcgggttcgggaaggttattatgaatttacggaagtttacgtttttgaggtgtatgttttcgcgtgtttttatgtagtcgtttaggttttcgttttttgcgaagaagcgcgcgcgttggtataggtacgcgttttcggtttttacgttggcgaaattgaagtatttggtgaagcgtagtcgcgtggtcggcgcgttttttagttttattagcgttttggatacgtcgcgaacgtcgtagcgcgcgtagtcgaatttagttttcgttacgtgcgtgttgacgcgttcgtggtagatttgcggcgcggggggtaggcggcggggtcgcggggagttcgttattggtgttcgtttttgtttatttattttttttcgttttatttgtgttttggttgtttggtcggattttaagtttgtt

SEQ ID NO: 29930 - DNA, 525 bp, Artificial Sequence
  chemically treated genomic DNA (Homo sapiens) CpG-island No: 29930
aacaaacttaaaatccgaccaaacaaccaaaacacaaataaaacgaaaaaaaataaataaacaaaaacgaacaccaataacgaactccccgcgaccccgccgcctaccccccgcgccgcaaatctaccacgaacgcgtcaacacgcacgtaacgaaaactaaattcgactacgcgcgctacgacgttcgcgacgtatccaaaacgctaataaaactaaaaaacgcgccgaccacgcgactacgcttcaccaaatacttcaatttcgccaacgtaaaaaccgaaaacgcgtacctataccaacgcgcgcgcttcttcgcaaaaaacgaaaacctaaacgactacataaaaacacgcgaaaacatacacctcaaaaacgtaaacttccgtaaattcataataaccttcccgaacccgacccgaccgccctaatacgcctactcgtcgaccttctaaaccgcgacgctactcacgctatcgtaaccgctacgaatactaaccgaataccgcacgacctacgcgcacta

SEQ ID NO: 29931 - DNA, 525 bp, Artificial Sequence
  chemically treated genomic DNA (Homo sapiens) CpG-island No: 29931
gatagatttagggttcgattaggtaattagagtatagatggggcgggaaagggtgagtgggtagaagcgggtattaatgacgggtttttcgcgatttcgtcgtttgtttttcgcgtcgtaggtttattacgaacgcgttaatacgtacgtggcggaggttgagttcgattacgcgcgttgcggcgttcgcgacgtgtttaagacgttggtggggttggagggcgcgtcggttacgcggttgcgttttattaagtgttttagtttcgttagcgtggaggtcgagaacgcgtatttgtgttagcgcgcgcgttttttcgtagagaacgagggtttagacgattatatggaggtacgcgagggtatgtattttaagaacgtggattttcgtgagtttatggtggttttttcggattcggttcggtcgttttggtacgtttgttcgtcggttttttgggtcgcggcgttgtttacgttgtcgtggtcgttgcgagtgttggtcgagtatcgtacggtttacgcgtatta

SEQ ID NO: 29932 - DNA, 525 bp, Artificial Sequence
  chemically treated genomic DNA (Homo sapiens) CpG-island No: 29932
taatacgcgtaaaccgtacgatactcgaccaacactcgcaacgaccacgacaacgtaaacaacgccgcgacccaaaaaaccgacgaacaaacgtaccaaaacgaccgaaccgaatccgaaaaaaccaccataaactcacgaaaatccacgttcttaaaatacataccctcgcgtacctccatataatcgtctaaaccctcgttctctacgaaaaaacgcgcgcgctaacacaaatacgcgttctcgacctccacgctaacgaaactaaaacacttaataaaacgcaaccgcgtaaccgacgcgccctccaaccccaccaacgtcttaaacacgtcgcgaacgccgcaacgcgcgtaatcgaactcaacctccgccacgtacgtattaacgcgttcgtaataaacctacgacgcgaaaaacaaacgacgaaatcgcgaaaaacccgtcattaatacccgcttctacccactcaccctttcccgccccatctatactctaattacctaatcgaaccctaaatctatc

SEQ ID NO: 29933 - DNA, 569 bp, Artificial Sequence
  chemically treated genomic DNA (Homo sapiens) CpG-island No: 29933
gggaagggggatttcggaggggcggggttttttttcggaagcgttcgtcgggggcggggagggggcggggttattcgcgtgaggcgattttgttggttcggaggggcggggcgaggaggaggattcgtttgggcggttcggttgtttatagtaatcgttgggtggatttggttagcgtttcgaattttgttttcgttgcgcgtcggtttttcggagttttatagttcgggaaggaggtcgtcgcgggtcgggcgttcgttttgttaagcggattcgtaattcggaaaggcggcgcggcggagtttggagtcggattttgtttagatcgggtttcggtcggttagagtcgcgggtatgtcggaggcgcggaaggggtcggacgaggcggaggagagttagtacgattttggtattgagtttttgcgttttttgcgttttttattcgagtttatttcggttttagttttcgggttttcggacggtagtttttagttttgtatttatttttcgggattcgttaaggaattataggagaaggaagacgcggatggggagcgggttgattttat

SEQ ID NO: 29934 - DNA, 569 bp, Artificial Sequence
  chemically treated genomic DNA (Homo sapiens) CpG-island No: 29934
ataaaatcaacccgctccccatccgcgtcttccttctcctataattccttaacgaatcccgaaaaataaatacaaaactaaaaactaccgtccgaaaacccgaaaactaaaaccgaaataaactcgaataaaaaacgcaaaaaacgcaaaaactcaataccaaaatcgtactaactctcctccgcctcgtccgaccccttccgcgcctccgacatacccgcgactctaaccgaccgaaacccgatctaaacaaaatccgactccaaactccgccgcgccgcctttccgaattacgaatccgcttaacaaaacgaacgcccgacccgcgacgacctccttcccgaactataaaactccgaaaaaccgacgcgcaacgaaaacaaaattcgaaacgctaaccaaatccacccaacgattactataaacaaccgaaccgcccaaacgaatcctcctcctcgccccgcccctccgaaccaacaaaatcgcctcacgcgaataaccccgccccctccccgcccccgacgaacgcttccgaaaaaaaaccccgcccctccgaaatcccccttccc

SEQ ID NO: 29935 - DNA, 569 bp, Artificial Sequence
  chemically treated genomic DNA (Homo sapiens) CpG-island No: 29935
gtggaattagttcgttttttattcgcgtttttttttttttgtggttttttgacgggtttcggaggatgggtgtagggttgggggttgtcgttcgagggttcggaggttggagtcgaggtggattcgggtagggagcgtagagagcgtagagatttaatgttagagtcgtattggttttttttcgtttcgttcggtttttttcgcgttttcgatatgttcgcggttttggtcggtcggggttcggtttgagtaggattcggttttaggtttcgtcgcgtcgttttttcgggttgcgggttcgtttggtagagcgggcgttcggttcgcggcggtttttttttcgggttgtggggtttcgaggggtcggcgcgtagcgaggataaggttcggagcgttggttaggtttatttagcggttattgtgggtagtcgaatcgtttaagcgggttttttttttcgtttcgttttttcggattaatagggtcgttttacgcggatggtttcgtttttttttcgttttcggcgggcgttttcggaaagaggtttcgttttttcggaattttttttttt

SEQ ID NO: 29936 - DNA, 569 bp, Artificial Sequence
  chemically treated genomic DNA (Homo sapiens) CpG-island No: 29936
aaaaaaaaaaattccgaaaaaacgaaacctctttccgaaaacgcccgccgaaaacgaaaaaaaaacgaaaccatccgcgtaaaacgaccctattaatccgaaaaaacgaaacgaaaaaaaaaacccgcttaaacgattcgactacccacaataaccgctaaataaacctaaccaacgctccgaaccttatcctcgctacgcgccgacccctcgaaaccccacaacccgaaaaaaaaaccgccgcgaaccgaacgcccgctctaccaaacgaacccgcaacccgaaaaaacgacgcgacgaaacctaaaaccgaatcctactcaaaccgaaccccgaccgaccaaaaccgcgaacatatcgaaaacgcgaaaaaaaccgaacgaaacgaaaaaaaaccaatacgactctaacattaaatctctacgctctctacgctccctacccgaatccacctcgactccaacctccgaaccctcgaacgacaacccccaaccctacacccatcctccgaaacccgtcaaaaaaccacaaaaaaaaaaaaacgcgaataaaaaacgaactaattccac

SEQ ID NO: 29937 - DNA, 562 bp, Artificial Sequence
  chemically treated genomic DNA (Homo sapiens) CpG-island No: 29937
gtcgggcgggcgtttttttagggttggggtttttcgcgtttaggggtagtttaggttttcggaatttaagtcgcgtttgttttcgggtcgcgcgggggcgttgtggttcggcggcggttcggggcgttgcgtggtcgcggtaggggcggagggggtcgcggggagggaggcgggaagagcgcggtattttcgttggtcgttggttcgttggtcgtttttggaggcggcggcgggagcgtagggggcgcgcggttcggggattcgtatttttcggttttttttttattttacgcggtttggattatggacgttaggtgggggttagggtagtagcgagtttacgtgatcgagttttcgggttacgtgattgtcgcgttttagtacgggggtcgggtggggtttcggttgttcggtcgtcggttagtatatcgttgttcggagttagcggggatgggagttgcggtttggttttgtgttttttggggagtttcgggcggaggggttggggattttgacgtttcggatcgtggaggggagtgtgggggaaggggcgttttttttg

SEQ ID NO: 29938 - DNA, 562 bp, Artificial Sequence
  chemically treated genomic DNA (Homo sapiens) CpG-island No: 29938
caaaaaaaacgccccttcccccacactcccctccacgatccgaaacgtcaaaatccccaacccctccgcccgaaactccccaaaaaacacaaaaccaaaccgcaactcccatccccgctaactccgaacaacgatatactaaccgacgaccgaacaaccgaaaccccacccgacccccgtactaaaacgcgacaatcacgtaacccgaaaactcgatcacgtaaactcgctactaccctaacccccacctaacgtccataatccaaaccgcgtaaaataaaaaaaaaaccgaaaaatacgaatccccgaaccgcgcgccccctacgctcccgccgccgcctccaaaaacgaccaacgaaccaacgaccaacgaaaataccgcgctcttcccgcctccctccccgcgaccccctccgcccctaccgcgaccacgcaacgccccgaaccgccgccgaaccacaacgcccccgcgcgacccgaaaacaaacgcgacttaaattccgaaaacctaaactacccctaaacgcgaaaaaccccaaccctaaaaaaacgcccgcccgac

SEQ ID NO: 29939 - DNA, 562 bp, Artificial Sequence
  chemically treated genomic DNA (Homo sapiens) CpG-island No: 29939
tagaggaagcgtttttttttttatatttttttttacgattcgggacgttagggtttttagttttttcgttcgaagttttttaaggagtataaaattaagtcgtagtttttattttcgttggtttcgggtagcgatatgttggtcgacggtcgagtagtcgggattttattcggttttcgtgttgaggcgcggtagttacgtggttcgggggttcggttacgtgagttcgttgttgttttagtttttatttggcgtttatggtttaggtcgcgtggggtggagggggaatcggggaatgcgagttttcgggtcgcgcgttttttgcgttttcgtcgtcgtttttaggagcggttagcgagttagcggttagcggaagtgtcgcgtttttttcgttttttttttcgcggtttttttcgtttttgtcgcgattacgtagcgtttcgggtcgtcgtcggattatagcgttttcgcgcggttcggaggtagacgcggtttgggtttcggggatttgggttgtttttgggcgcggggagttttagttttgaagaggcgttcgttcggt

SEQ ID NO: 29940 - DNA, 562 bp, Artificial Sequence
  chemically treated genomic DNA (Homo sapiens) CpG-island No: 29940
accgaacgaacgcctcttcaaaactaaaactccccgcgcccaaaaacaacccaaatccccgaaacccaaaccgcgtctacctccgaaccgcgcgaaaacgctataatccgacgacgacccgaaacgctacgtaatcgcgacaaaaacgaaaaaaaccgcgaaaaaaaaaacgaaaaaaacgcgacacttccgctaaccgctaactcgctaaccgctcctaaaaacgacgacgaaaacgcaaaaaacgcgcgacccgaaaactcgcattccccgattccccctccaccccacgcgacctaaaccataaacgccaaataaaaactaaaacaacaacgaactcacgtaaccgaacccccgaaccacgtaactaccgcgcctcaacacgaaaaccgaataaaatcccgactactcgaccgtcgaccaacatatcgctacccgaaaccaacgaaaataaaaactacgacttaattttatactccttaaaaaacttcgaacgaaaaaactaaaaaccctaacgtcccgaatcgtaaaaaaaaatataaaaaaaaaaacgcttcctcta

SEQ ID NO: 29941 - DNA, 711 bp, Artificial Sequence
  chemically treated genomic DNA (Homo sapiens) CpG-island No: 29941
tttcgtattttcgttcgcgagtttgtattttcgttcgcgagtttttatttttatttttatttttatattttttcgttagcgtagttagcggtacggtttttttttgatatcgattagatcgatggggattattcgtttattcgtttgttttttgcggaggttaacgtgatcgtagtttgttttaggttcgggagttaggtcgtttcgtttagtttgggtttcggttttcgtagggtttttaggttttttggttcgtgcgcgttacgtgttgcgcggtttcgtacgtttcgtattggggttttattcggcgtttttttttcgggttgcggagtcgttaggttcgttttttttgtttttcgtggtaggcgggtagcggcgtttttcgtttcggtagtttttagtttttagttttcggtttcgggtagtatttgtcgtagaagtattgttttcgcgttgagattcgcgcgttttcgttgtagtttttttttttcgtcggggtatatttaaattcgtttttcgttgagttcgtttcgttttgcgtttattgttattttttcgacgttcgcggtttcgttttcggtttatttttgttatttcgcggcgatttcgcgcgtttcgtcgtttttatttcgagtttttgcgtttttagggtcgtttggtcgtgttattgcggtagataggatttttttgggttttgttatattaaggttg

SEQ ID NO: 29942 - DNA, 711 bp, Artificial Sequence
  chemically treated genomic DNA (Homo sapiens) CpG-island No: 29942
caaccttaatataacaaaacccaaaaaaatcctatctaccgcaataacacgaccaaacgaccctaaaaacgcaaaaactcgaaataaaaacgacgaaacgcgcgaaatcgccgcgaaataacaaaaataaaccgaaaacgaaaccgcgaacgtcgaaaaaataacaataaacgcaaaacgaaacgaactcaacgaaaaacgaatttaaatataccccgacgaaaaaaaaaaactacaacgaaaacgcgcgaatctcaacgcgaaaacaatacttctacgacaaatactacccgaaaccgaaaactaaaaactaaaaactaccgaaacgaaaaacgccgctacccgcctaccacgaaaaacaaaaaaaacgaacctaacgactccgcaacccgaaaaaaaaacgccgaataaaaccccaatacgaaacgtacgaaaccgcgcaacacgtaacgcgcacgaaccaaaaaacctaaaaaccctacgaaaaccgaaacccaaactaaacgaaacgacctaactcccgaacctaaaacaaactacgatcacgttaacctccgcaaaaaacaaacgaataaacgaataatccccatcgatctaatcgatatcaaaaaaaaaccgtaccgctaactacgctaacgaaaaaatataaaaataaaaataaaaataaaaactcgcgaacgaaaatacaaactcgcgaacgaaaatacgaaa

SEQ ID NO: 29943 - DNA, 711 bp, Artificial Sequence
  chemically treated genomic DNA (Homo sapiens) CpG-island No: 29943
tagttttggtgtggtagggtttaaagaggttttatttatcgtaataatacgattaggcggttttgggggcgtaggggttcggggtgggagcggcggagcgcgcggagtcgtcgcggggtggtaggggtgggtcgggggcggggtcgcgggcgtcggggaggtggtagtgggcgtagggcggggcgagtttagcggagggcgggtttgaatgtgtttcggcgggagagggaagttgtagcgagagcgcgcggattttagcgcgggagtagtgtttttgcggtaggtgttgttcggggtcggggattggggattggggattgtcggggcggaagacgtcgttgttcgtttgttacggagggtagggagggcgggtttgacggtttcgtagttcggagaagggacgtcgggtggggttttagtgcggagcgtgcggagtcgcgtagtacgtggcgcgtacgggttagggagtttgaggattttgcggggatcgggatttaagttgggcggggcggtttggttttcgggtttaaaataggttgcggttacgttgattttcgtaaggggtaggcgagtggacgggtgatttttatcgatttggtcggtattagggaggggtcgtgtcgttgattgcgttggcggaggggtatggggatggggatggggatggaggttcgcgagcggaggtgtaggttcgcgagcggaggtgcgggg

SEQ ID NO: 29944 - DNA, 711 bp, Artificial Sequence
  chemically treated genomic DNA (Homo sapiens) CpG-island No: 29944
ccccgcacctccgctcgcgaacctacacctccgctcgcgaacctccatccccatccccatccccatacccctccgccaacgcaatcaacgacacgacccctccctaataccgaccaaatcgataaaaatcacccgtccactcgcctaccccttacgaaaatcaacgtaaccgcaacctattttaaacccgaaaaccaaaccgccccgcccaacttaaatcccgatccccgcaaaatcctcaaactccctaacccgtacgcgccacgtactacgcgactccgcacgctccgcactaaaaccccacccgacgtcccttctccgaactacgaaaccgtcaaacccgccctccctaccctccgtaacaaacgaacaacgacgtcttccgccccgacaatccccaatccccaatccccgaccccgaacaacacctaccgcaaaaacactactcccgcgctaaaatccgcgcgctctcgctacaacttccctctcccgccgaaacacattcaaacccgccctccgctaaactcgccccgccctacgcccactaccacctccccgacgcccgcgaccccgcccccgacccacccctaccaccccgcgacgactccgcgcgctccgccgctcccaccccgaacccctacgcccccaaaaccgcctaatcgtattattacgataaataaaacctctttaaaccctaccacaccaaaacta

SEQ ID NO: 29945 - DNA, 833 bp, Artificial Sequence
  chemically treated genomic DNA (Homo sapiens) CpG-island No: 29945
gttttttgcgagcgatcgattgcggtcgttatatttatttcgtcgttaagtagtattcgggttttgattcggtttcgggtttcggtggcggtggtggcggcggcggcggtggcggcggtttttttatggcggcggtaggcgtgacggtaaaggcgggaggagggattagcgcggtagcggttttttttattcgtgtacggagtttcgtatggtcgcggcgggtagtaagttgtagtttggcgcggggtatcggagtttcgaagtgcgggagtgattcgatttcgttttcgtttttatttcgtcgtaggagtcgtgcgcgtcgcggttattttggaaacggcgatcggtcgagcgtcggggttacggtgggcggcgagggataagttttttagatcggcggcggtggcggcggcggcggcgggcgtcggaatgcgatcggacgggggcggagacggcggtagggaggggcggggagcgtcgttaagtgtcggcgcgattcggttttggagtcgggtttcgttagttcgttcggtgtcgtttcggtcggtggtagtgggggattgtggagcggagtcgggttgtgtagcgggttgggagttcgaggttttttaggcggtcgtcggtttgggagggacgttgggtagggtcgatgagcggggcgggcgcgacgttatgagttcggtcggagtcgtcgtttagggatttgttattcggattttattttttaggaggacggacgttatttagacgttcgtaatttcggttttttgatagcgtagttttttataggttcgaatttttaagatttgatataaagttttcggaattttaga

SEQ ID NO: 29946 - DNA, 833 bp, Artificial Sequence
  chemically treated genomic DNA (Homo sapiens) CpG-island No: 29946
tctaaaattccgaaaactttatatcaaatcttaaaaattcgaacctataaaaaactacgctatcaaaaaaccgaaattacgaacgtctaaataacgtccgtcctcctaaaaaataaaatccgaataacaaatccctaaacgacgactccgaccgaactcataacgtcgcgcccgccccgctcatcgaccctacccaacgtccctcccaaaccgacgaccgcctaaaaaacctcgaactcccaacccgctacacaacccgactccgctccacaatcccccactaccaccgaccgaaacgacaccgaacgaactaacgaaacccgactccaaaaccgaatcgcgccgacacttaacgacgctccccgcccctccctaccgccgtctccgcccccgtccgatcgcattccgacgcccgccgccgccgccgccaccgccgccgatctaaaaaacttatccctcgccgcccaccgtaaccccgacgctcgaccgatcgccgtttccaaaataaccgcgacgcgcacgactcctacgacgaaataaaaacgaaaacgaaatcgaatcactcccgcacttcgaaactccgataccccgcgccaaactacaacttactacccgccgcgaccatacgaaactccgtacacgaataaaaaaaaccgctaccgcgctaatccctcctcccgcctttaccgtcacgcctaccgccgccataaaaaaaccgccgccaccgccgccgccgccaccaccgccaccgaaacccgaaaccgaatcaaaacccgaatactacttaacgacgaaataaatataacgaccgcaatcgatcgctcgcaaaaaac

SEQ ID NO: 29947 - DNA, 833 bp, Artificial Sequence
  chemically treated genomic DNA (Homo sapiens) CpG-island No: 29947
tttggaatttcggagattttatgttaagttttaaaaattcgagtttgtggaaggttgcgttgttaagagatcggagttgcgagcgtttgggtgacgttcgtttttttggaaggtgggattcgggtggtaggtttttgggcggcgatttcggtcgggtttatagcgtcgcgttcgtttcgtttatcggttttatttagcgttttttttagatcgacgatcgtttgggaagtttcgagtttttagttcgttgtatagttcggtttcgttttatagttttttattgttatcggtcggggcgatatcgggcgagttggcgagattcggttttaggatcgaatcgcgtcgatatttgacggcgtttttcgtttttttttgtcgtcgttttcgttttcgttcggtcgtatttcggcgttcgtcgtcgtcgtcgttatcgtcgtcgatttgggaggtttgtttttcgtcgtttatcgtagtttcggcgttcggtcggtcgtcgtttttaagatggtcgcggcgcgtacggtttttgcggcggggtagaggcggaggcggagtcgagttattttcgtatttcggggtttcggtgtttcgcgttaggttgtagtttattgttcgtcgcggttatgcggggtttcgtgtacggatgagagaagtcgttgtcgcgttggttttttttttcgtttttgtcgttacgtttgtcgtcgttatggaggagtcgtcgttatcgtcgtcgtcgttattatcgttatcggaattcgagatcgagttagaattcgagtgttgtttggcggcgaggtgagtgtggcggtcgtagtcggtcgttcgtagaaagt

SEQ ID NO: 29948 - DNA, 833 bp, Artificial Sequence
  chemically treated genomic DNA (Homo sapiens) CpG-island No: 29948
actttctacgaacgaccgactacgaccgccacactcacctcgccgccaaacaacactcgaattctaactcgatctcgaattccgataacgataataacgacgacgacgataacgacgactcctccataacgacgacaaacgtaacgacaaaaacgaaaaaaaaaaccaacgcgacaacgacttctctcatccgtacacgaaaccccgcataaccgcgacgaacaataaactacaacctaacgcgaaacaccgaaaccccgaaatacgaaaataactcgactccgcctccgcctctaccccgccgcaaaaaccgtacgcgccgcgaccatcttaaaaacgacgaccgaccgaacgccgaaactacgataaacgacgaaaaacaaacctcccaaatcgacgacgataacgacgacgacgacgaacgccgaaatacgaccgaacgaaaacgaaaacgacgacaaaaaaaaacgaaaaacgccgtcaaatatcgacgcgattcgatcctaaaaccgaatctcgccaactcgcccgatatcgccccgaccgataacaataaaaaactataaaacgaaaccgaactatacaacgaactaaaaactcgaaacttcccaaacgatcgtcgatctaaaaaaaacgctaaataaaaccgataaacgaaacgaacgcgacgctataaacccgaccgaaatcgccgcccaaaaacctaccacccgaatcccaccttccaaaaaaacgaacgtcacccaaacgctcgcaactccgatctcttaacaacgcaaccttccacaaactcgaatttttaaaacttaacataaaatctccgaaattccaaa

SEQ ID NO: 29949 - DNA, 726 bp, Artificial Sequence
  chemically treated genomic DNA (Homo sapiens) CpG-island No: 29949
cggttttagttattttttttttttatttcgagttgtttttcgttttagatttcgtcgttggttattttattgttttatttcgtttcgtcgtcggcgaaaatcggtttcggggtttatcgcgggtgggcggattttgtaaatgttcgatttttttgcgatgggtttgattttcgcgatgtagttaagagggtttcggaattcggtttagttaggttcgaatatcgggtatttcggtggcggtaggaaatcgtcggatttcggttttatggtgggttcgaggtttgggttagggatcgggaggtttggatcgtttttaaggatttatggcgtcgtcgttgtttgaagtcgaggtaatgttcggaggttaggttttaagcggggtagtcgtcgttcgtcgagggtttaagggggcgtgtggtcgtcgtgttttgagagttttaggttgattttattgttatcgttttttcgtttcgtttcgttttttttaaattgtgtggttgtttttttattatcgtagttttcgttattatagttattttttaaacgtcgcggtttttagcgtcgtcgtcgttattttggtttgttagcgttttttttttttatattataataaatcggattttttcgcggggtgttttttcgagtttcgtatacgttgcgttatattaagttttaggaaatttttatatagtggagatcgagttaaataggttggtatgggttttt

SEQ ID NO: 29950 - DNA, 726 bp, Artificial Sequence
  chemically treated genomic DNA (Homo sapiens) CpG-island No: 29950
aaaaacccataccaacctatttaactcgatctccactatataaaaatttcctaaaacttaatataacgcaacgtatacgaaactcgaaaaaacaccccgcgaaaaaatccgatttattataatataaaaaaaaaaaacgctaacaaaccaaaataacgacgacgacgctaaaaaccgcgacgtttaaaaaataactataataacgaaaactacgataataaaaaaacaaccacacaatttaaaaaaaacgaaacgaaacgaaaaaacgataacaataaaatcaacctaaaactctcaaaacacgacgaccacacgcccccttaaaccctcgacgaacgacgactaccccgcttaaaacctaacctccgaacattacctcgacttcaaacaacgacgacgccataaatccttaaaaacgatccaaacctcccgatccctaacccaaacctcgaacccaccataaaaccgaaatccgacgatttcctaccgccaccgaaatacccgatattcgaacctaactaaaccgaattccgaaaccctcttaactacatcgcgaaaatcaaacccatcgcaaaaaaatcgaacatttacaaaatccgcccacccgcgataaaccccgaaaccgattttcgccgacgacgaaacgaaataaaacaataaaataaccaacgacgaaatctaaaacgaaaaacaactcgaaataaaaaaaaaaaataactaaaaccg

SEQ ID NO: 29951 - DNA, 726 bp, Artificial Sequence
  chemically treated genomic DNA (Homo sapiens) CpG-island No: 29951
agaaatttatattagtttatttagttcggtttttattatatgaaggttttttagggtttggtgtgacgtaacgtatacgaggttcggaaggatatttcgcggaaggattcggtttgttgtggtgtggggaggggagacgttgataaattaagatggcggcggcggcgttgaaggtcgcggcgtttgggaggtaattgtggtggcgaaggttgcggtagtggggaggtaattatatagtttggaagaaacggagcgggacgaagaggcggtagtagtagagttagtttgagatttttagagtacgacggttatacgtttttttaggttttcggcgggcggcggttgtttcgtttagggtttagttttcgagtattgtttcggttttaaatagcggcggcgttatgagtttttaagggcggtttaagtttttcgatttttggtttagatttcgggtttattatggagtcggggttcgacgattttttatcgttatcggagtgttcggtgttcgagtttagttgggtcgagtttcgagatttttttggttatatcgcgaaaattaggtttatcgtagagaaatcgggtatttgtaagattcgtttattcgcggtaagtttcggggtcggttttcgtcggcggcgagacggaatgaagtagtaggatagttagcggcgaagtttggggcggagggtagttcgaggtggggagagggggtggttgggatcg

SEQ ID NO: 29952 - DNA, 726 bp, Artificial Sequence
  chemically treated genomic DNA (Homo sapiens) CpG-island No: 29952
cgatcccaaccaccccctctccccacctcgaactaccctccgccccaaacttcgccgctaactatcctactacttcattccgtctcgccgccgacgaaaaccgaccccgaaacttaccgcgaataaacgaatcttacaaatacccgatttctctacgataaacctaattttcgcgatataaccaaaaaaatctcgaaactcgacccaactaaactcgaacaccgaacactccgataacgataaaaaatcgtcgaaccccgactccataataaacccgaaatctaaaccaaaaatcgaaaaacttaaaccgcccttaaaaactcataacgccgccgctatttaaaaccgaaacaatactcgaaaactaaaccctaaacgaaacaaccgccgcccgccgaaaacctaaaaaaacgtataaccgtcgtactctaaaaatctcaaactaactctactactaccgcctcttcgtcccgctccgtttcttccaaactatataattacctccccactaccgcaaccttcgccaccacaattacctcccaaacgccgcgaccttcaacgccgccgccgccatcttaatttatcaacgtctcccctccccacaccacaacaaaccgaatccttccgcgaaatatccttccgaacctcgtatacgttacgtcacaccaaaccctaaaaaaccttcatataataaaaaccgaactaaataaactaatataaatttct

SEQ ID NO: 29953 - DNA, 806 bp, Artificial Sequence
  chemically treated genomic DNA (Homo sapiens) CpG-island No: 29953
gacgggcgcggttggagggtagcgcgtaggcgtaggcggcgtacgtggtttcggatacgtagcgttgcggcggggttagcgttttaatttcggagtggggtcgaggcgcgtagttttttaacgattcgacgttaacggggtttttcggatcgcggcgcgaggtaggaggggcggggtaggagggtcgcggtaggttcgggtcgttaaagttgttagtaaggtcgagggtcggacgtggggttttagagcgacgttgagtgcgtgcgggattcggagtacgtgacggagtttcgagtttttatgttcgttacgtcgtttcgggttatttttcggagtttcggtttcgtatattttagttcggtttatcggttttatttggggttagagtttcgttcgtattattatagggtcgttggggagtcggggttttttagatttgttcgttttaagttcgcgggacgttatttttttttttacgttattgtagtcgtcgtagttttattttttttcgggaggtgagggaatgagtgacggttttttcgacgaatggcgaggcggagttgagggggcgtgtttcggaggcgggaagtgggtggggttcgttttagttaggtaggaagtcggcgcgggcggcgcggatagtatttgtgggtattcggagtacggagatttcgtcggttttacgtttatttcggtgtttgtagtatttttcgtttttttttttaggcgacgagatttagtggttaggtaatgattggggaagggttgagtaacgggtaggcggcgtagggtttttttgggtttgt

SEQ ID NO: 29954 - DNA, 806 bp, Artificial Sequence
  chemically treated genomic DNA (Homo sapiens) CpG-island No: 29954
acaaacccaaaaaaaccctacgccgcctacccgttactcaacccttccccaatcattacctaaccactaaatctcgtcgcctaaaaaaaaaaacgaaaaatactacaaacaccgaaataaacgtaaaaccgacgaaatctccgtactccgaatacccacaaatactatccgcgccgcccgcgccgacttcctacctaactaaaacgaaccccacccacttcccgcctccgaaacacgccccctcaactccgcctcgccattcgtcgaaaaaaccgtcactcattccctcacctcccgaaaaaaaataaaactacgacgactacaataacgtaaaaaaaaaaataacgtcccgcgaacttaaaacgaacaaatctaaaaaaccccgactccccaacgaccctataataatacgaacgaaactctaaccccaaataaaaccgataaaccgaactaaaatatacgaaaccgaaactccgaaaaataacccgaaacgacgtaacgaacataaaaactcgaaactccgtcacgtactccgaatcccgcacgcactcaacgtcgctctaaaaccccacgtccgaccctcgaccttactaacaactttaacgacccgaacctaccgcgaccctcctaccccgcccctcctacctcgcgccgcgatccgaaaaaccccgttaacgtcgaatcgttaaaaaactacgcgcctcgaccccactccgaaattaaaacgctaaccccgccgcaacgctacgtatccgaaaccacgtacgccgcctacgcctacgcgctaccctccaaccgcgcccgtc

SEQ ID NO: 29955 - DNA, 806 bp, Artificial Sequence
  chemically treated genomic DNA (Homo sapiens) CpG-island No: 29955
ataagtttagaaaagttttgcgtcgtttgttcgttgtttagtttttttttaattattatttagttattgggtttcgtcgtttaggagaggaagcggagggtgttgtagatatcgaggtgaacgtaaagtcggcgagattttcgtgtttcgggtatttatagatattgttcgcgtcgttcgcgtcgattttttgtttagttaaggcgagttttatttatttttcgttttcggggtacgtttttttagtttcgtttcgttattcgtcgggagagtcgttatttatttttttatttttcggaaaggggtgggattgcgacggttgtagtagcgtggaaaggggggtgacgtttcgcggatttgaggcgggtagatttggggggtttcgattttttagcggttttgtagtggtgcgggcgaaattttggttttagataggatcggtgagtcgaattggggtgtgcggagtcggggtttcgggggatggttcggggcggcgtggcgggtatgagagttcggggtttcgttacgtatttcgagtttcgtacgtatttagcgtcgttttggggttttacgttcggttttcgattttgttgataattttggcggttcgggtttgtcgcggtttttttgtttcgttttttttgtttcgcgtcgcgattcgagagatttcgttggcgtcgagtcgttgagaggttgcgcgtttcggttttatttcggggttggggcgttggtttcgtcgtagcgttgcgtgttcggggttacgtgcgtcgtttgcgtttgcgcgttgttttttagtcgcgttcgtt

SEQ ID NO: 29956 - DNA, 806 bp, Artificial Sequence
  chemically treated genomic DNA (Homo sapiens) CpG-island No: 29956
aacgaacgcgactaaaaaacaacgcgcaaacgcaaacgacgcacgtaaccccgaacacgcaacgctacgacgaaaccaacgccccaaccccgaaataaaaccgaaacgcgcaacctctcaacgactcgacgccaacgaaatctctcgaatcgcgacgcgaaacaaaaaaaacgaaacaaaaaaaccgcgacaaacccgaaccgccaaaattatcaacaaaatcgaaaaccgaacgtaaaaccccaaaacgacgctaaatacgtacgaaactcgaaatacgtaacgaaaccccgaactctcatacccgccacgccgccccgaaccatcccccgaaaccccgactccgcacaccccaattcgactcaccgatcctatctaaaaccaaaatttcgcccgcaccactacaaaaccgctaaaaaatcgaaaccccccaaatctacccgcctcaaatccgcgaaacgtcacccccctttccacgctactacaaccgtcgcaatcccacccctttccgaaaaataaaaaaataaataacgactctcccgacgaataacgaaacgaaactaaaaaaacgtaccccgaaaacgaaaaataaataaaactcgccttaactaaacaaaaaatcgacgcgaacgacgcgaacaatatctataaatacccgaaacacgaaaatctcgccgactttacgttcacctcgatatctacaacaccctccgcttcctctcctaaacgacgaaacccaataactaaataataattaaaaaaaaactaaacaacgaacaaacgacgcaaaacttttctaaacttat

SEQ ID NO: 29957 - DNA, 821 bp, Artificial Sequence
  chemically treated genomic DNA (Homo sapiens) CpG-island No: 29957
cgtcgggcgggtcggggtcgttcgcgtcgtttagcgttaggtttaggtcggcggtcgtcgattgtttttttagtagcgagttcggttcggcgtttagcgatagggagtcgtttagattgatgggaggttcgggcgcggggttttttgtcgcgggttcgtcgcgtttttgtttttcgtgtttgcgtttgtgcgagtttatttgcgatatgtttattatcgtgtggcggtagttcgggaaggtgtagtggaagtgcgagtatttgagtttgtatttgtagtcgggtacggcgtagtcggcgttggagttgaattggtagaagttcgcggcgttgattacgttttgtttgtcgtggtgtttgcgatgcgtcgtgattttggtgttgtcggtgtagcggaagcggtagcgtaggtagtggaagtgcgtgttggtgttcgagaaggggtagtcggcgaagtggtagttgagtgaggttttgaagcgtttgaagtcgtttagtattaggttgtttacgcggtcgtggtgttgcgcgtgtttgtatatgtgcgtgcgttcgtagaatttgtagtcgtagttttcgcgcgtgtagtggtagtgggtgattttgagcgagaattgataagttgcgtttttgtagttttcgtaaaggtcgaagcgtcggaagttttttagtattatgttttcgtttagtatttttcgggaggacgtcgtttttcgtcgtttgtcgaagggcgatatgttttcgatgatttagaagcgttttttggttttcgaggttgtcggtatagagatggtgttttttggggaggggtagggaggttag

SEQ ID NO: 29958 - DNA, 821 bp, Artificial Sequence
  chemically treated genomic DNA (Homo sapiens) CpG-island No: 29958
ctaacctccctacccctccccaaaaaacaccatctctataccgacaacctcgaaaaccaaaaaacgcttctaaatcatcgaaaacatatcgcccttcgacaaacgacgaaaaacgacgtcctcccgaaaaatactaaacgaaaacataatactaaaaaacttccgacgcttcgacctttacgaaaactacaaaaacgcaacttatcaattctcgctcaaaatcacccactaccactacacgcgcgaaaactacgactacaaattctacgaacgcacgcacatatacaaacacgcgcaacaccacgaccgcgtaaacaacctaatactaaacgacttcaaacgcttcaaaacctcactcaactaccacttcgccgactaccccttctcgaacaccaacacgcacttccactacctacgctaccgcttccgctacaccgacaacaccaaaatcacgacgcatcgcaaacaccacgacaaacaaaacgtaatcaacgccgcgaacttctaccaattcaactccaacgccgactacgccgtacccgactacaaatacaaactcaaatactcgcacttccactacaccttcccgaactaccgccacacgataataaacatatcgcaaataaactcgcacaaacgcaaacacgaaaaacaaaaacgcgacgaacccgcgacaaaaaaccccgcgcccgaacctcccatcaatctaaacgactccctatcgctaaacgccgaaccgaactcgctactaaaaaaacaatcgacgaccgccgacctaaacctaacgctaaacgacgcgaacgaccccgacccgcccgacg

SEQ ID NO: 29959 - DNA, 821 bp, Artificial Sequence
  chemically treated genomic DNA (Homo sapiens) CpG-island No: 29959
ttgatttttttgtttttttttagggaatattatttttatgtcgatagtttcgggggttaaaaagcgtttttggattatcgaggatatgtcgtttttcggtaagcggcggaagacggcgttttttcggaagatgttggacgagggtatgatgttggagggttttcggcgtttcgatttttacgaggattgtaaggacgtagtttgttagttttcgtttaaggttatttattattattgtacgcgcgagaattgcggttataagttttgcgggcgtacgtatatgtataagtacgcgtagtattacgatcgcgtggataatttggtgttggacgattttaagcgttttaaggttttatttagttgttatttcgtcgattgttttttttcgggtattagtacgtatttttattgtttgcgttgtcgttttcgttgtatcgatagtattaaggttacggcgtatcgtaagtattacggtaaataggacgtgattagcgtcgcgggtttttgttagtttagttttagcgtcgattgcgtcgtgttcgattgtaagtataagtttaagtgttcgtatttttattgtattttttcgggttgtcgttatacggtggtgggtatgtcgtagatggattcgtataagcgtaagtacgagaagtaggagcgcggcgagttcgcggtagagggtttcgcgttcgggttttttattagtttggacggttttttgtcgttgggcgtcgagtcgggttcgttgttaaaaaagtagtcggcggtcgtcggtttgggtttggcgttgggcgacgcgggcgatttcggttcgttcgacg

SEQ ID NO: 29960 - DNA, 821 bp, Artificial Sequence
  chemically treated genomic DNA (Homo sapiens) CpG-island No: 29960
cgtcgaacgaaccgaaatcgcccgcgtcgcccaacgccaaacccaaaccgacgaccgccgactacttttttaacaacgaacccgactcgacgcccaacgacaaaaaaccgtccaaactaataaaaaacccgaacgcgaaaccctctaccgcgaactcgccgcgctcctacttctcgtacttacgcttatacgaatccatctacgacatacccaccaccgtataacgacaacccgaaaaaatacaataaaaatacgaacacttaaacttatacttacaatcgaacacgacgcaatcgacgctaaaactaaactaacaaaaacccgcgacgctaatcacgtcctatttaccgtaatacttacgatacgccgtaaccttaatactatcgatacaacgaaaacgacaacgcaaacaataaaaatacgtactaatacccgaaaaaaaacaatcgacgaaataacaactaaataaaaccttaaaacgcttaaaatcgtccaacaccaaattatccacgcgatcgtaatactacgcgtacttatacatatacgtacgcccgcaaaacttataaccgcaattctcgcgcgtacaataataataaataaccttaaacgaaaactaacaaactacgtccttacaatcctcgtaaaaatcgaaacgccgaaaaccctccaacatcataccctcgtccaacatcttccgaaaaaacgccgtcttccgccgcttaccgaaaaacgacatatcctcgataatccaaaaacgctttttaacccccgaaactatcgacataaaaataatattccctaaaaaaaaacaaaaaaatcaa

SEQ ID NO: 29961 - DNA, 761 bp, Artificial Sequence
  chemically treated genomic DNA (Homo sapiens) CpG-island No: 29961
tcgttgaggtcgagtcgggttgtttttggcgagttatttattgggttatggcggcggatagagtagaatcgaagagcggcgacgcgcggaggacgagtgagggaaagattcgtagcggttttttttagaaattgcggtcgtttacgtttcgtttttcggcgtcggttaatcgaatggaagggggtggagttatgaagttatattattggtttttttcgacgtttgttagattattcgaggtaaacgtgttcgtttattttcgggggtcggattagtggagcgtcgagtatttagatgatattgtttcggcgaggtttcgggtttttcgtttacgcgtagagtttttcgttcgttttagttgtatttcggttttgtaggtcgttcgtttggcgtagttgtagttatagtaatttacgtaggatcgcgttttatagtttattaggtattcggacgtttttggcgcgagcgttcgtcgttttttttttaggttattgcggtgtatcgtgcgggttcgcgtcgtgtttttcgtttcggagtagggatcgggcgtgttcgtttagttttgtgcgtattcggaatggggtcggggaaggttgagttttagggcgattttgatgtggagtcgtgcgatcgtttattgcggttgaagagatttaggcgtagatagcgtaggcggggtatgtattggttggagtatgatggggttaggatttgagttttttatttaggttcggagttaacggtattgaatttttttttat

SEQ ID NO: 29962 - DNA, 761 bp, Artificial Sequence
  chemically treated genomic DNA (Homo sapiens) CpG-island No: 29962
ataaaaaaaaattcaataccgttaactccgaacctaaataaaaaactcaaatcctaaccccatcatactccaaccaatacataccccgcctacgctatctacgcctaaatctcttcaaccgcaataaacgatcgcacgactccacatcaaaatcgccctaaaactcaaccttccccgaccccattccgaatacgcacaaaactaaacgaacacgcccgatccctactccgaaacgaaaaacacgacgcgaacccgcacgatacaccgcaataacctaaaaaaaaaacgacgaacgctcgcgccaaaaacgtccgaatacctaataaactataaaacgcgatcctacgtaaattactataactacaactacgccaaacgaacgacctacaaaaccgaaatacaactaaaacgaacgaaaaactctacgcgtaaacgaaaaacccgaaacctcgccgaaacaatatcatctaaatactcgacgctccactaatccgacccccgaaaataaacgaacacgtttacctcgaataatctaacaaacgtcgaaaaaaaccaataatataacttcataactccacccccttccattcgattaaccgacgccgaaaaacgaaacgtaaacgaccgcaatttctaaaaaaaaccgctacgaatctttccctcactcgtcctccgcgcgtcgccgctcttcgattctactctatccgccgccataacccaataaataactcgccaaaaacaacccgactcgacctcaacga

SEQ ID NO: 29963 - DNA, 761 bp, Artificial Sequence
  chemically treated genomic DNA (Homo sapiens) CpG-island No: 29963
atgagaaggggtttaatatcgttaatttcgggtttgggtaaaagatttaagttttgattttattatattttaattaatatatatttcgtttgcgttgtttgcgtttgggtttttttaatcgtagtgagcggtcgtacggttttatattagggtcgttttgaggtttagtttttttcggttttatttcgagtgcgtataggattgaacgagtacgttcggtttttgtttcggagcggaggatacgacgcggattcgtacggtgtatcgtagtgatttgaggaaggagcgacgggcgttcgcgttaaaggcgttcgagtgtttggtaaattgtaaagcgcggttttgcgtgagttgttatggttatagttgcgttaggcggacggtttgtaggatcgaggtgtagttgggacgagcggaaagttttgcgcgtgggcggggagttcggagtttcgtcggggtaatgttatttaggtgttcggcgttttattgattcggttttcgggggtgggcgggtacgtttgtttcggatggtttaataggcgtcggggagagttaatggtgtggttttatggttttatttttttttattcgattggtcggcgtcgaaaagcggggcgtgagcggtcgtagtttttggagggagtcgttgcgggttttttttttattcgtttttcgcgcgtcgtcgtttttcggttttgttttgttcgtcgttatggtttagtgagtgattcgttaggggtagttcggttcggttttagcgg

SEQ ID NO: 29964 - DNA, 761 bp, Artificial Sequence
  chemically treated genomic DNA (Homo sapiens) CpG-island No: 29964
ccgctaaaaccgaaccgaactacccctaacgaatcactcactaaaccataacgacgaacaaaacaaaaccgaaaaacgacgacgcgcgaaaaacgaataaaaaaaaaacccgcaacgactccctccaaaaactacgaccgctcacgccccgcttttcgacgccgaccaatcgaataaaaaaaaataaaaccataaaaccacaccattaactctccccgacgcctattaaaccatccgaaacaaacgtacccgcccacccccgaaaaccgaatcaataaaacgccgaacacctaaataacattaccccgacgaaactccgaactccccgcccacgcgcaaaactttccgctcgtcccaactacacctcgatcctacaaaccgtccgcctaacgcaactataaccataacaactcacgcaaaaccgcgctttacaatttaccaaacactcgaacgcctttaacgcgaacgcccgtcgctccttcctcaaatcactacgatacaccgtacgaatccgcgtcgtatcctccgctccgaaacaaaaaccgaacgtactcgttcaatcctatacgcactcgaaataaaaccgaaaaaaactaaacctcaaaacgaccctaatataaaaccgtacgaccgctcactacgattaaaaaaacccaaacgcaaacaacgcaaacgaaatatatattaattaaaatataataaaatcaaaacttaaatcttttacccaaacccgaaattaacgatattaaaccccttctcat

SEQ ID NO: 29965 - DNA, 795 bp, Artificial Sequence
  chemically treated genomic DNA (Homo sapiens) CpG-island No: 29965
agttttgggtttgattggttcgtatcgcgtttttgtattagtaacgaggggtcgacgtttttagggttagcgttttagagtttcggttcgaatcgtttatcgcgtacgggcgttatttggaatgtttaatgtcgacgttgtatttttacgaaaattttatttgagaaggggaaatcgaggatttatcgtaaggttagaaggtggtttttcgtcgtcggatttcggcgttcgtacgtttttttagaatcgttttttttttagttagcgtaggttagggtttagtcgcgttgtcgcggaaatcgttttttagtattattcgcggtagttaagttaacgtatgcgtagtcgcggggggcgttcgggggcggggtgtcgatgagaagtcgtcgggggttgtcgggtatttttttgtttagaaattcgacgtcgttttgttttagtttagttcgattttcgtttttttgtatttgttggtaagagaatcgttgttgtttttcggttttcgtttttttttttattattgcgggtcgattttgggtaaacgtaggagggtcgagaaggggcggtggtgcgcggttaggtcggattttttcgtcgcggcgcgagcgacgggtcgcgcgggcggataaagtacgtagtttcgttttgtttcgcgcgttttttggcggcgtttcgttgaggggatttcgtcgtcggtttttagttagttttttgtttagtttgttttgcggaggtggtcgggcgacgcggggatatgattatcgaggttattgttgtattttagagtttgattta

SEQ ID NO: 29966 - DNA, 795 bp, Artificial Sequence
  chemically treated genomic DNA (Homo sapiens) CpG-island No: 29966
taaatcaaactctaaaatacaacaataacctcgataatcatatccccgcgtcgcccgaccacctccgcaaaacaaactaaacaaaaaactaactaaaaaccgacgacgaaatcccctcaacgaaacgccgccaaaaaacgcgcgaaacaaaacgaaactacgtactttatccgcccgcgcgacccgtcgctcgcgccgcgacgaaaaaatccgacctaaccgcgcaccaccgccccttctcgaccctcctacgtttacccaaaatcgacccgcaataataaaaaaaaaaacgaaaaccgaaaaacaacaacgattctcttaccaacaaatacaaaaaaacgaaaatcgaactaaactaaaacaaaacgacgtcgaatttctaaacaaaaaaatacccgacaacccccgacgacttctcatcgacaccccgcccccgaacgccccccgcgactacgcatacgttaacttaactaccgcgaataatactaaaaaacgatttccgcgacaacgcgactaaaccctaacctacgctaactaaaaaaaaaacgattctaaaaaaacgtacgaacgccgaaatccgacgacgaaaaaccaccttctaaccttacgataaatcctcgatttccccttctcaaataaaattttcgtaaaaatacaacgtcgacattaaacattccaaataacgcccgtacgcgataaacgattcgaaccgaaactctaaaacgctaaccctaaaaacgtcgacccctcgttactaatacaaaaacgcgatacgaaccaatcaaacccaaaact

SEQ ID NO: 29967 - DNA, 795 bp, Artificial Sequence
  chemically treated genomic DNA (Homo sapiens) CpG-island No: 29967
tgaattaggttttggggtgtagtagtgatttcggtggttatgttttcgcgtcgttcggttattttcgtagagtaagttgagtagggggttggttggaggtcgacggcggaatttttttaacggagcgtcgttagggggcgcgcgaggtagggcggagttgcgtattttgttcgttcgcgcggttcgtcgttcgcgtcgcggcgggaaaattcgatttggtcgcgtattatcgttttttttcggtttttttgcgtttgtttagggtcggttcgtagtgatggaggaggaggcggagatcgaggagtagtagcgatttttttattaataggtataggaaaacgggggtcgggttgggttggggtaggacggcgtcgagtttttggatagaaaagtattcggtagttttcggcggttttttatcggtatttcgttttcgggcgtttttcgcggttgcgtatgcgttggtttaattgtcgcgggtggtgttgggaggcggttttcgcggtaacgcggttggattttggtttgcgttggttggggaggaagcggttttaggggagcgtgcgggcgtcggggttcggcggcgagaggttattttttggttttgcgatgaattttcggttttttttttttagatggggttttcgtgagggtataacgtcggtattagatattttaggtgacgttcgtacgcggtgggcggttcgggtcggagttttggaacgttggttttggaggcgtcgatttttcgttattgatgtagggacgcggtgcggattagttaggtttagagtt

SEQ ID NO: 29968 - DNA, 795 bp, Artificial Sequence
  chemically treated genomic DNA (Homo sapiens) CpG-island No: 29968
aactctaaacctaactaatccgcaccgcgtccctacatcaataacgaaaaatcgacgcctccaaaaccaacgttccaaaactccgacccgaaccgcccaccgcgtacgaacgtcacctaaaatatctaataccgacgttataccctcacgaaaaccccatctaaaaaaaaaaaaccgaaaattcatcgcaaaaccaaaaaataacctctcgccgccgaaccccgacgcccgcacgctcccctaaaaccgcttcctccccaaccaacgcaaaccaaaatccaaccgcgttaccgcgaaaaccgcctcccaacaccacccgcgacaattaaaccaacgcatacgcaaccgcgaaaaacgcccgaaaacgaaataccgataaaaaaccgccgaaaactaccgaatacttttctatccaaaaactcgacgccgtcctaccccaacccaacccgacccccgttttcctatacctattaataaaaaaatcgctactactcctcgatctccgcctcctcctccatcactacgaaccgaccctaaacaaacgcaaaaaaaccgaaaaaaaacgataatacgcgaccaaatcgaattttcccgccgcgacgcgaacgacgaaccgcgcgaacgaacaaaatacgcaactccgccctacctcgcgcgccccctaacgacgctccgttaaaaaaattccgccgtcgacctccaaccaaccccctactcaacttactctacgaaaataaccgaacgacgcgaaaacataaccaccgaaatcactactacaccccaaaacctaattca

SEQ ID NO: 29969 - DNA, 756 bp, Artificial Sequence
  chemically treated genomic DNA (Homo sapiens) CpG-island No: 29969
gttgcgcggtcgattttagtattagaaaatattcgttattttatttaagacgggtacgaaggttaacggacgtttttttttagaacgtttagtatatagagtaattttttacgtttatttttaaatggcgtattttaaattagtattttcgacgtttagttgtgaatttagagcggcggaaagtttttgaatttagcgttcgggtatgcgtagacgcgttgttgtggtgggcgtggtttttttcggattcggcgtttcgtttttcgtttcgtgttcgtatgcgcgattgagtcgggtggatggtattgttgtattcgggtgtttggaggttgtggtcgttttgtttttttggttaaaatcgggggagtgaggcgggtcggcgcggcgcgatatcgggtttcggaattattgtacgacggggttggacgtaagtgtcgggcggggagtgggggtaagagagtagcggtcgtaggttggagaggtttcggagtcggggtcgtttgacgggttggtgtttatagtataggttcgttgtcgttattttttcggaagtcgtagattcgggttgagtcgtcgcggatttttttttttttgggttcggcggcgttaggagaaggcgacggcgtttagatttcgttaagacggagaggggatcgcgttttttttcgggatattttaggatttttggaaaatttttcgattttttattttatagttggataagtcgaagtttcgagaaaggagcgtgattcggtt

SEQ ID NO: 29970 - DNA, 756 bp, Artificial Sequence
  chemically treated genomic DNA (Homo sapiens) CpG-island No: 29970
aaccgaatcacgctcctttctcgaaacttcgacttatccaactataaaataaaaaatcgaaaaattttccaaaaatcctaaaatatcccgaaaaaaaacgcgatcccctctccgtcttaacgaaatctaaacgccgtcgccttctcctaacgccgccgaacccaaaaaaaaaaaaatccgcgacgactcaacccgaatctacgacttccgaaaaaataacgacaacgaacctatactataaacaccaacccgtcaaacgaccccgactccgaaacctctccaacctacgaccgctactctcttacccccactccccgcccgacacttacgtccaaccccgtcgtacaataattccgaaacccgatatcgcgccgcgccgacccgcctcactcccccgattttaaccaaaaaaacaaaacgaccacaacctccaaacacccgaatacaacaataccatccacccgactcaatcgcgcatacgaacacgaaacgaaaaacgaaacgccgaatccgaaaaaaaccacgcccaccacaacaacgcgtctacgcatacccgaacgctaaattcaaaaactttccgccgctctaaattcacaactaaacgtcgaaaatactaatttaaaatacgccatttaaaaataaacgtaaaaaattactctatatactaaacgttctaaaaaaaaacgtccgttaaccttcgtacccgtcttaaataaaataacgaatattttctaatactaaaatcgaccgcgcaac

SEQ ID NO: 29971 - DNA, 756 bp, Artificial Sequence
  chemically treated genomic DNA (Homo sapiens) CpG-island No: 29971
ggtcgggttacgtttttttttcggggtttcggtttgtttagttgtgaagtgggggatcgggggattttttagggattttggggtgtttcgggggagggcgcggtttttttttcgttttggcggggtttggacgtcgtcgtttttttttggcgtcgtcggatttaggagaggagaggttcgcggcggtttagttcgggtttgcggttttcgggagggtggcggtaacgagtttgtgttgtgggtattagttcgttagacggtttcggtttcgaggtttttttagtttgcggtcgttatttttttatttttatttttcgttcgatatttacgtttagtttcgtcgtgtagtggtttcggagttcggtgtcgcgtcgcgtcggttcgttttattttttcgattttagttaagaaaataaaacggttatagtttttagatattcggatgtagtagtattatttattcggtttagtcgcgtatgcggatacggggcggagggcggggcgtcgggttcggagggagttacgtttattataataacgcgtttgcgtatgttcgggcgttgggtttaggggtttttcgtcgttttgggtttatagttggacgtcgggagtgttagtttggagtacgttatttgagagtaggcgtgagaagttgttttgtgtgttgagcgttttaaaggaaggcgttcgttggttttcgtattcgttttgagtgaggtgacgagtgttttttagtattggggtcggtcgcgtagt

SEQ ID NO: 29972 - DNA, 756 bp, Artificial Sequence
  chemically treated genomic DNA (Homo sapiens) CpG-island No: 29972
actacgcgaccgaccccaatactaaaaaacactcgtcacctcactcaaaacgaatacgaaaaccaacgaacgccttcctttaaaacgctcaacacacaaaacaacttctcacgcctactctcaaataacgtactccaaactaacactcccgacgtccaactataaacccaaaacgacgaaaaacccctaaacccaacgcccgaacatacgcaaacgcgttattataataaacgtaactccctccgaacccgacgccccgccctccgccccgtatccgcatacgcgactaaaccgaataaataatactactacatccgaatatctaaaaactataaccgttttattttcttaactaaaatcgaaaaaataaaacgaaccgacgcgacgcgacaccgaactccgaaaccactacacgacgaaactaaacgtaaatatcgaacgaaaaataaaaataaaaaaataacgaccgcaaactaaaaaaacctcgaaaccgaaaccgtctaacgaactaatacccacaacacaaactcgttaccgccaccctcccgaaaaccgcaaacccgaactaaaccgccgcgaacctctcctctcctaaatccgacgacgccaaaaaaaaacgacgacgtccaaaccccgccaaaacgaaaaaaaaaccgcgccctcccccgaaacaccccaaaatccctaaaaaatcccccgatcccccacttcacaactaaacaaaccgaaaccccgaaaaaaaaacgtaacccgacc

SEQ ID NO: 29973 - DNA, 624 bp, Artificial Sequence
  chemically treated genomic DNA (Homo sapiens) CpG-island No: 29973
tagggcgcggtttggggagggaggaggtagggcggtggttgggtaagagaagagtcgcgtttattacggaatatttttgcgtatgcgtcgggggttagtttttggtatttttgacgcgtttgttaacgtagttttttagtgcgtattcggacgtaggaggtggaggttgtggaattcgtcgttcgaaagtagggattaaaagttttatttcgttttacgtttcgaaaggaaggcgtttgttgagttttttttttagtcgtgagggaggcgtcgacggcgtgcggtaagttttttgttgacggggttttttaggattatcgtagtggttttttaggagtgagggacgggaaacgtgtcgggtttcgcgtttggggaacgtagcgtttcgttttaaggtcgcggttttagggcgtcgagcggggtttttagggttcggtttttgtcgcggcggtcgtcgttcgcgtcgtggtttcgtttttcggaggtttttcgattgtggttttcgggtggttaggcgtcggttttcgcgattcgatttgtttttttttttttggttttttaggaagttttgagttgaggtttgcgggatttttttcggagaaagcgtaggttaaagtcgtaggt

SEQ ID NO: 29974 - DNA, 624 bp, Artificial Sequence
  chemically treated genomic DNA (Homo sapiens) CpG-island No: 29974
acctacgactttaacctacgctttctccgaaaaaaatcccgcaaacctcaactcaaaacttcctaaaaaaccaaaaaaaaaaaaacaaatcgaatcgcgaaaaccgacgcctaaccacccgaaaaccacaatcgaaaaacctccgaaaaacgaaaccacgacgcgaacgacgaccgccgcgacaaaaaccgaaccctaaaaaccccgctcgacgccctaaaaccgcgaccttaaaacgaaacgctacgttccccaaacgcgaaacccgacacgtttcccgtccctcactcctaaaaaaccactacgataatcctaaaaaaccccgtcaacaaaaaacttaccgcacgccgtcgacgcctccctcacgactaaaaaaaaaactcaacaaacgccttcctttcgaaacgtaaaacgaaataaaacttttaatccctactttcgaacgacgaattccacaacctccacctcctacgtccgaatacgcactaaaaaactacgttaacaaacgcgtcaaaaataccaaaaactaacccccgacgcatacgcaaaaatattccgtaataaacgcgactcttctcttacccaaccaccgccctacctcctccctccccaaaccgcgcccta

SEQ ID NO: 29975 - DNA, 624 bp, Artificial Sequence
  chemically treated genomic DNA (Homo sapiens) CpG-island No: 29975
atttgcggttttagtttgcgtttttttcggaaaggatttcgtaagttttaatttaggattttttaaaaaattaagagagaaaaaataagtcgagtcgcggaagtcggcgtttggttattcggaagttatagtcggggaattttcgggaggcggagttacggcgcgggcggcgatcgtcgcgataggaatcgagttttagaaatttcgttcggcgttttgaggtcgcggttttgaagcgaaacgttgcgttttttaaacgcggggttcggtacgtttttcgttttttatttttgagagattattgcggtggttttgagagatttcgttagtagaaaatttatcgtacgtcgtcgacgttttttttacgattgagagaaaggtttaatagacgtttttttttcggaacgtaagacgaagtggggtttttagtttttgttttcgaacggcgaattttataatttttattttttacgttcggatgcgtattgagggattacgttagtagacgcgttaaaagtattagaagttggttttcggcgtatgcgtagagatgtttcgtggtgggcgcggttttttttttgtttaattatcgttttgttttttttttttttaagtcgcgttttg

SEQ ID NO: 29976 - DNA, 624 bp, Artificial Sequence
  chemically treated genomic DNA (Homo sapiens) CpG-island No: 29976
caaaacgcgacttaaaaaaaaaaaaaacaaaacgataattaaacaaaaaaaaaaccgcgcccaccacgaaacatctctacgcatacgccgaaaaccaacttctaatacttttaacgcgtctactaacgtaatccctcaatacgcatccgaacgtaaaaaataaaaattataaaattcgccgttcgaaaacaaaaactaaaaaccccacttcgtcttacgttccgaaaaaaaaacgtctattaaacctttctctcaatcgtaaaaaaaacgtcgacgacgtacgataaattttctactaacgaaatctctcaaaaccaccgcaataatctctcaaaaataaaaaacgaaaaacgtaccgaaccccgcgtttaaaaaacgcaacgtttcgcttcaaaaccgcgacctcaaaacgccgaacgaaatttctaaaactcgattcctatcgcgacgatcgccgcccgcgccgtaactccgcctcccgaaaattccccgactataacttccgaataaccaaacgccgacttccgcgactcgacttattttttctctcttaattttttaaaaaatcctaaattaaaacttacgaaatcctttccgaaaaaaacgcaaactaaaaccgcaaat

SEQ ID NO: 29977 - DNA, 530 bp, Artificial Sequence
  chemically treated genomic DNA (Homo sapiens) CpG-island No: 29977
acgtgaacgatatgtggtcgggttcgtcgtaggagaaggattcgttttcgatttcgcggtcgggcgggtttagtcggttgtcgtcgcggtttaggagtcgttttttttttagaagttttcggttttattttcgcgtttcgagtcggttttcgtttaggagtcggaggagtaagtttaggtttcgttttcgaaggcgttattagcggaagtataggcgttattcgcggttatattcgcggagtcggtcgcgatttcgtagtcgtcgttatcgagagaggcgttacgggtttattaggagatattatcggtttttttcgcggtatcggtttcggtttcgtagtaggtcgcgttttcggggaaggtcgtattgcggaagggcgtacgcgatcgcgcggggatagcgttattacggttttggtcgtatagtgtattcggaggagtatagtagatggagggatagatttaggacgaggtcgcggagtagaattttttttcgtttaagtgaaaaaggtgggtgggttatttatttt

SEQ ID NO: 29978 - DNA, 530 bp, Artificial Sequence
  chemically treated genomic DNA (Homo sapiens) CpG-island No: 29978
aaaataaataacccacccacctttttcacttaaacgaaaaaaaattctactccgcgacctcgtcctaaatctatccctccatctactatactcctccgaatacactatacgaccaaaaccgtaataacgctatccccgcgcgatcgcgtacgcccttccgcaatacgaccttccccgaaaacgcgacctactacgaaaccgaaaccgataccgcgaaaaaaaccgataatatctcctaataaacccgtaacgcctctctcgataacgacgactacgaaatcgcgaccgactccgcgaatataaccgcgaataacgcctatacttccgctaataacgccttcgaaaacgaaacctaaacttactcctccgactcctaaacgaaaaccgactcgaaacgcgaaaataaaaccgaaaacttctaaaaaaaaaacgactcctaaaccgcgacgacaaccgactaaacccgcccgaccgcgaaatcgaaaacgaatccttctcctacgacgaacccgaccacatatcgttcacgt

SEQ ID NO: 29979 - DNA, 530 bp, Artificial Sequence
  chemically treated genomic DNA (Homo sapiens) CpG-island No: 29979
aaggtaaatgatttatttattttttttatttaagcgaaagggggttttgtttcgcgatttcgttttggatttgtttttttatttgttgtgttttttcgggtatattgtgcgattaaagtcgtagtagcgttgttttcgcgcgatcgcgtacgttttttcgtagtacgatttttttcgagagcgcgatttgttacgggatcgggatcggtatcgcgaaggagatcggtagtattttttggtgaattcgtagcgtttttttcggtaacggcggttgcgggatcgcgatcggtttcgcgagtatgatcgcgagtagcgtttgtattttcgttggtggcgttttcgggaacgggatttggatttgttttttcgatttttggacgaaaatcggttcgagacgcgggaatgggatcgagagtttttggaaaaagagcggtttttagatcgcgacgatagtcggttggattcgttcgatcgcgaggtcgagggcgaattttttttttgcggcgagttcggttatatgtcgtttacgt

SEQ ID NO: 29980 - DNA, 530 bp, Artificial Sequence
  chemically treated genomic DNA (Homo sapiens) CpG-island No: 29980
acgtaaacgacatataaccgaactcgccgcaaaaaaaaaattcgccctcgacctcgcgatcgaacgaatccaaccgactatcgtcgcgatctaaaaaccgctctttttccaaaaactctcgatcccattcccgcgtctcgaaccgattttcgtccaaaaatcgaaaaaacaaatccaaatcccgttcccgaaaacgccaccaacgaaaatacaaacgctactcgcgatcatactcgcgaaaccgatcgcgatcccgcaaccgccgttaccgaaaaaaacgctacgaattcaccaaaaaatactaccgatctccttcgcgataccgatcccgatcccgtaacaaatcgcgctctcgaaaaaaatcgtactacgaaaaaacgtacgcgatcgcgcgaaaacaacgctactacgactttaatcgcacaatatacccgaaaaaacacaacaaataaaaaaacaaatccaaaacgaaatcgcgaaacaaaaccccctttcgcttaaataaaaaaaataaataaatcatttacctt

SEQ ID NO: 29981 - DNA, 668 bp, Artificial Sequence
  chemically treated genomic DNA (Homo sapiens) CpG-island No: 29981
cgttttcgatacggagtatttttttagttttttcgtttttaggattgacgtttaggtttttttttcgttttagtttaatttgttttttcgtttcgtaaatttcggtttttttttatttttaattttttttattatacgtttttttttttttattttttacgttacgaatttcgatttttagatttttttttttcgtttttttttttttttttttttttttttaattttttattcgtttttattttagattttgcgcgtatttaatttagtcgttcgttttcgttcggtttttcgaagttatggcgggatttgggggttggagggatagggaggttacggatttgggttatttgtcggtgagtagaggacgttcgtcgtttttcgaaatgtttttttttggcgggttttgcgtattagagggagggagcggacgtttttaaaacgggttagattaggatttcgacgggtttttcgggcgcggaaggggattttgggagtcggtatgcggaaaaggcgttttttgggtatcgggatcgtattaaattttaacgaaaggtaaaggtacggggcggtgggaaggagagatagagaaagagatggtagtggggtgttgcggattttaaatagcggggtattttaaatatgtgattcgttttgtttagcggagt

SEQ ID NO: 29982 - DNA, 668 bp, Artificial Sequence
  chemically treated genomic DNA (Homo sapiens) CpG-island No: 29982
actccgctaaacaaaacgaatcacatatttaaaataccccgctatttaaaatccgcaacaccccactaccatctctttctctatctctccttcccaccgccccgtacctttacctttcgttaaaatttaatacgatcccgatacccaaaaaacgccttttccgcataccgactcccaaaatccccttccgcgcccgaaaaacccgtcgaaatcctaatctaacccgttttaaaaacgtccgctccctccctctaatacgcaaaacccgccaaaaaaaaacatttcgaaaaacgacgaacgtcctctactcaccgacaaataacccaaatccgtaacctccctatccctccaacccccaaatcccgccataacttcgaaaaaccgaacgaaaacgaacgactaaattaaatacgcgcaaaatctaaaataaaaacgaataaaaaattaaaaaaaaaaaaaaaaaaaaaaaaaaacgaaaaaaaaaaatctaaaaatcgaaattcgtaacgtaaaaaataaaaaaaaaaaaacgtataataaaaaaaattaaaaataaaaaaaaaccgaaatttacgaaacgaaaaaacaaattaaactaaaacgaaaaaaaaacctaaacgtcaatcctaaaaacgaaaaaactaaaaaaatactccgtatcgaaaacg

SEQ ID NO: 29983 - DNA, 668 bp, Artificial Sequence
  chemically treated genomic DNA (Homo sapiens) CpG-island No: 29983
gtttcgttagataaggcgggttatatatttaaaatgtttcgttgtttagggttcgtagtattttattgttatttttttttttgttttttttttttatcgtttcgtgtttttgtttttcgttggagtttggtgcggtttcggtgtttagggggcgtttttttcgtatgtcggtttttaggattttttttcgcgttcgggggattcgtcgaagttttggtttagttcgttttgagggcgttcgttttttttttttggtacgtagaattcgttaaaagagagtatttcggggggcgacgggcgttttttatttatcggtaggtggtttagattcgtgatttttttgtttttttagtttttaggtttcgttatggtttcgaggagtcgaacgggagcgggcgattgaattgggtgcgcgtagagtttgaggtggaagcggatgaagagttgaagggaggagagaggaaggaggagggcgggagagaggagtttggggatcggggttcgtggcgtgggagatagaggaggggaaacgtgtagtgaaaagagttgggagtggagggaaatcggagtttgcgaggcgggaaagtaagttgggttaaggcgagagaggagtttgagcgttagttttggagacgaagaagttagaagggtgtttcgtgtcgagagcg

SEQ ID NO: 29984 - DNA, 668 bp, Artificial Sequence
  chemically treated genomic DNA (Homo sapiens) CpG-island No: 29984
cgctctcgacacgaaacacccttctaacttcttcgtctccaaaactaacgctcaaactcctctctcgccttaacccaacttactttcccgcctcgcaaactccgatttccctccactcccaactcttttcactacacgtttcccctcctctatctcccacgccacgaaccccgatccccaaactcctctctcccgccctcctccttcctctctcctcccttcaactcttcatccgcttccacctcaaactctacgcgcacccaattcaatcgcccgctcccgttcgactcctcgaaaccataacgaaacctaaaaactaaaaaaacaaaaaaatcacgaatctaaaccacctaccgataaataaaaaacgcccgtcgccccccgaaatactctcttttaacgaattctacgtaccaaaaaaaaaaaacgaacgccctcaaaacgaactaaaccaaaacttcgacgaatcccccgaacgcgaaaaaaaatcctaaaaaccgacatacgaaaaaaacgccccctaaacaccgaaaccgcaccaaactccaacgaaaaacaaaaacacgaaacgataaaaaaaaaaaacaaaaaaaaaaataacaataaaatactacgaaccctaaacaacgaaacattttaaatatataacccgccttatctaacgaaac

SEQ ID NO: 29985 - DNA, 643 bp, Artificial Sequence
  chemically treated genomic DNA (Homo sapiens) CpG-island No: 29985
aacgcggcgaacggtcgcgttgggaggttgaggcggggttttagcgagtcggcggttgggaaataatggcgcgagcgtgacgtgggtcggaggcgtcgcggcggcgcggaggaaggggttgtcgtggggcgggggtcgtatcgagggagttgggaggcgtgcggcgttcgcgagcgcgttggcggggattcggtttaaggagaggggttttggggttatggtttttgggggtcgggggcgggggtaggcggcggtcgttattttggggtcgcgtgttcggtcgcgtatttttttatttagtttttcgttcgttcgtttttttttcgttcgtttacggggttcgtcgtatttatcggttttagcgtacggtaataattttagcgcgtaattgtcgtagtcgttttaacgcgcgtttttttcgttttcgtcgttcggtatcgtttcgcgtcgtttttttgttcgcgttcggttagggatcggcgcgttgtttcgttttttagtttcgtcgtagagttcggcgaagtcgacgttttttgatcgcgttgcgtttgtttgtttcgcgggtttggagatttttaaacgatggaatatcggttttgtttttttgagggtttttattttttggtattttgtttgcgttttt

SEQ ID NO: 29986 - DNA, 643 bp, Artificial Sequence
  chemically treated genomic DNA (Homo sapiens) CpG-island No: 29986
aaaaacgcaaacaaaataccaaaaaataaaaaccctcaaaaaaacaaaaccgatattccatcgtttaaaaatctccaaacccgcgaaacaaacaaacgcaacgcgatcaaaaaacgtcgacttcgccgaactctacgacgaaactaaaaaacgaaacaacgcgccgatccctaaccgaacgcgaacaaaaaaacgacgcgaaacgataccgaacgacgaaaacgaaaaaaacgcgcgttaaaacgactacgacaattacgcgctaaaattattaccgtacgctaaaaccgataaatacgacgaaccccgtaaacgaacgaaaaaaaaacgaacgaacgaaaaactaaataaaaaaatacgcgaccgaacacgcgaccccaaaataacgaccgccgcctacccccgcccccgacccccaaaaaccataaccccaaaacccctctccttaaaccgaatccccgccaacgcgctcgcgaacgccgcacgcctcccaactccctcgatacgacccccgccccacgacaaccccttcctccgcgccgccgcgacgcctccgacccacgtcacgctcgcgccattatttcccaaccgccgactcgctaaaaccccgcctcaacctcccaacgcgaccgttcgccgcgtt

SEQ ID NO: 29987 - DNA, 643 bp, Artificial Sequence
  chemically treated genomic DNA (Homo sapiens) CpG-island No: 29987
aggggcgtaggtagaatgttaagggatggagatttttagaagggtaaagtcggtgttttatcgtttgaagatttttagattcgcgggatagatagacgtagcgcggttagggagcgtcggtttcgtcgaattttgcggcggagttgggggacggaatagcgcgtcggtttttggtcgggcgcgagtagaggggcggcgcggggcggtgtcgggcggcgggggcggggagggcgcgcgttgaggcggttgcggtagttgcgcgttgggattgttgtcgtgcgttggagtcggtgagtgcggcgggtttcgtgggcgggcggggaaggagcgggcgaacggggagttaggtggggaggtgcgcggtcgaatacgcgattttagggtagcggtcgtcgtttgttttcgttttcggtttttagggattatggttttaaggtttttttttttaggtcgagttttcgttagcgcgttcgcggacgtcgtacgttttttaattttttcggtgcggttttcgttttacggtagttttttttttcgcgtcgtcgcgacgttttcggtttacgttacgttcgcgttattgttttttagtcgtcggttcgttgggatttcgttttagttttttagcgcggtcgttcgtcgcgtt

SEQ ID NO: 29988 - DNA, 643 bp, Artificial Sequence
  chemically treated genomic DNA (Homo sapiens) CpG-island No: 29988
aacgcgacgaacgaccgcgctaaaaaactaaaacgaaatcccaacgaaccgacgactaaaaaacaataacgcgaacgtaacgtaaaccgaaaacgtcgcgacgacgcgaaaaaaaaaactaccgtaaaacgaaaaccgcaccgaaaaaattaaaaaacgtacgacgtccgcgaacgcgctaacgaaaactcgacctaaaaaaaaaaaccttaaaaccataatccctaaaaaccgaaaacgaaaacaaacgacgaccgctaccctaaaatcgcgtattcgaccgcgcacctccccacctaactccccgttcgcccgctccttccccgcccgcccacgaaacccgccgcactcaccgactccaacgcacgacaacaatcccaacgcgcaactaccgcaaccgcctcaacgcgcgccctccccgcccccgccgcccgacaccgccccgcgccgcccctctactcgcgcccgaccaaaaaccgacgcgctattccgtcccccaactccgccgcaaaattcgacgaaaccgacgctccctaaccgcgctacgtctatctatcccgcgaatctaaaaatcttcaaacgataaaacaccgactttacccttctaaaaatctccatcccttaacattctacctacgcccct

SEQ ID NO: 29989 - DNA, 559 bp, Artificial Sequence
  chemically treated genomic DNA (Homo sapiens) CpG-island No: 29989
gaagcggtgtttaggtcggggggcgtttagaggaaaggcggtttttttttgtttcgggacggggcgtttttttttttcgtttttttttcgtttttcgttagtttgtttcggttttcggggttttggtttagcgtttcgtattttcggtcggcgcgggggttgtacgtatttggtgtatgttgggttggtggcgtcgcgggttgcgggcgtggagcgcggattcgggatcgtagcggcggagcgtacggtggggggtttcgtgtggttgtggtagtggtagtggttgaggtgttggcggtggagatatcggcggcggcgcgggttttgtacgtattttcgcggtcgatcgttagtcgttgtatcggggaggtggtattagttttaaatgtcgttcgtttcgtttacgttttcgttagggcgtaggttagcggacgtttcggagggtaggaaattcgtcggcgcgcgcgtagggagggggatcgatagttaggggtcgggagagtttaggattgaggattttttgggaatttttttttttttagtagtcgaacgttagggg

SEQ ID NO: 29990 - DNA, 559 bp, Artificial Sequence
  chemically treated genomic DNA (Homo sapiens) CpG-island No: 29990
cccctaacgttcgactactaaaaaaaaaaaaattcccaaaaaatcctcaatcctaaactctcccgacccctaactatcgatccccctccctacgcgcgcgccgacgaatttcctaccctccgaaacgtccgctaacctacgccctaacgaaaacgtaaacgaaacgaacgacatttaaaactaataccacctccccgatacaacgactaacgatcgaccgcgaaaatacgtacaaaacccgcgccgccgccgatatctccaccgccaacacctcaaccactaccactaccacaaccacacgaaaccccccaccgtacgctccgccgctacgatcccgaatccgcgctccacgcccgcaacccgcgacgccaccaacccaacatacaccaaatacgtacaacccccgcgccgaccgaaaatacgaaacgctaaaccaaaaccccgaaaaccgaaacaaactaacgaaaaacgaaaaaaaaacgaaaaaaaaaaacgccccgtcccgaaacaaaaaaaaaccgcctttcctctaaacgccccccgacctaaacaccgcttc

SEQ ID NO: 29991 - DNA, 559 bp, Artificial Sequence
  chemically treated genomic DNA (Homo sapiens) CpG-island No: 29991
tttttggcgttcggttattaaagggaaggggatttttagggggtttttaattttggattttttcgatttttagttgtcggtttttttttttgcgcgcgcgtcggcgggttttttatttttcgaggcgttcgttggtttgcgttttggcggggacgtgggcggggcgggcggtatttaaggttggtgttattttttcggtgtagcggttggcgatcggtcgcggaggtgcgtgtagggttcgcgtcgtcgtcggtatttttatcgttaatattttagttattgttattgttatagttatacgaggttttttatcgtgcgtttcgtcgttgcggtttcggattcgcgttttacgttcgtagttcgcggcgttattagtttagtatgtattaggtgcgtgtagttttcgcgtcggtcgaggatgcgagacgttgggttaaggtttcggggatcggagtaggttgacgggaagcgaggaaaaggcgaagaggagaaacgtttcgtttcggggtaaggggaggtcgttttttttttgagcgtttttcggtttgggtatcgtttt

SEQ ID NO: 29992 - DNA, 559 bp, Artificial Sequence
  chemically treated genomic DNA (Homo sapiens) CpG-island No: 29992
aaaacgatacccaaaccgaaaaacgctcaaaaaaaaaacgacctccccttaccccgaaacgaaacgtttctcctcttcgccttttcctcgcttcccgtcaacctactccgatccccgaaaccttaacccaacgtctcgcatcctcgaccgacgcgaaaactacacgcacctaatacatactaaactaataacgccgcgaactacgaacgtaaaacgcgaatccgaaaccgcaacgacgaaacgcacgataaaaaacctcgtataactataacaataacaataactaaaatattaacgataaaaataccgacgacgacgcgaaccctacacgcacctccgcgaccgatcgccaaccgctacaccgaaaaaataacaccaaccttaaataccgcccgccccgcccacgtccccgccaaaacgcaaaccaacgaacgcctcgaaaaataaaaaacccgccgacgcgcgcgcaaaaaaaaaaaccgacaactaaaaatcgaaaaaatccaaaattaaaaaccccctaaaaatccccttccctttaataaccgaacgccaaaaa

SEQ ID NO: 29993 - DNA, 756 bp, Artificial Sequence
  chemically treated genomic DNA (Homo sapiens) CpG-island No: 29993
gttcgcgtaacgtttcgttgtatttgcggaggagggagagcgtttgggtgcgttatggaacgttcgtatcgcgtttttcgcgtttcgttcgtttgttcgcgaacggttgcgagttattttcgtattttttatatttttgttttttttagtcgtgcgcgggagagggggttagtatcgtaatgtttggaagagcggtcgcgcgaggggtttggggataggatagtttttcggtttcgaggcgaggttcgaatgcgcgtatattcggcgagcggggcggcgattggggagtcggagacgagagagggcggaagtgcgggacgtttcgtagtatttttataggtcgcggagttcgagattttcgtcgggtggcgagggcgtgggtgtttacgttatgcgtgacgtttgagtcgcggttcgagtttacgagttgggtgaggtcgttgtcgtcgtcgtcgttacgaagtttggcgggcggcgcggagtttcggggagttggttttttcgggcgggtacgtgacggggttggtagcgttcgggtttcggttgggagggggaagaagcggggagtagaaggtcgcgggcgggcggttggcgcgttgtgtatttaggtcgtgtgttggggttttttttttttaggagtcggcggggggaggggagggggaggggttatcgtttcgttttttttttttcgtaatgttgacgtaatttataaatagtggaataaaaggattaattttttcggagttttgttgaaat

SEQ ID NO: 29994 - DNA, 756 bp, Artificial Sequence
  chemically treated genomic DNA (Homo sapiens) CpG-island No: 29994
atttcaacaaaactccgaaaaaattaatccttttattccactatttataaattacgtcaacattacgaaaaaaaaaaaacgaaacgataacccctccccctcccctccccccgccgactcctaaaaaaaaaaaaccccaacacacgacctaaatacacaacgcgccaaccgcccgcccgcgaccttctactccccgcttcttccccctcccaaccgaaacccgaacgctaccaaccccgtcacgtacccgcccgaaaaaaccaactccccgaaactccgcgccgcccgccaaacttcgtaacgacgacgacgacaacgacctcacccaactcgtaaactcgaaccgcgactcaaacgtcacgcataacgtaaacacccacgccctcgccacccgacgaaaatctcgaactccgcgacctataaaaatactacgaaacgtcccgcacttccgccctctctcgtctccgactccccaatcgccgccccgctcgccgaatatacgcgcattcgaacctcgcctcgaaaccgaaaaactatcctatccccaaacccctcgcgcgaccgctcttccaaacattacgatactaaccccctctcccgcgcacgactaaaaaaaacaaaaatataaaaaatacgaaaataactcgcaaccgttcgcgaacaaacgaacgaaacgcgaaaaacgcgatacgaacgttccataacgcacccaaacgctctccctcctccgcaaatacaacgaaacgttacgcgaac

SEQ ID NO: 29995 - DNA, 756 bp, Artificial Sequence
  chemically treated genomic DNA (Homo sapiens) CpG-island No: 29995
gttttagtaaagtttcgaggaagttggtttttttgttttattatttatagattgcgttaatattgcgaaaaggagaaggcggagcggtggtttttttttttttttttttttcgtcggtttttgggagagaaaagttttagtatacgatttaagtatatagcgcgttagtcgttcgttcgcggttttttgtttttcgtttttttttttttttagtcggggttcgaacgttgttaatttcgttacgtgttcgttcgggaaaattagtttttcggggtttcgcgtcgttcgttaggtttcgtggcggcggcggcggtagcggttttatttagttcgtgggttcgggtcgcggtttaggcgttacgtatagcgtgggtatttacgttttcgttattcgacgaggatttcgggtttcgcgatttgtgggagtgttgcggggcgtttcgtattttcgttttttttcgttttcggttttttagtcgtcgtttcgttcgtcgagtgtgcgcgtattcgggtttcgtttcggagtcgggaggttgttttgtttttaggtttttcgcgcggtcgtttttttaggtattgcggtgttagttttttttttcgcgtacgattggggagggtagaggtgtgagggatgcgggggtggttcgtagtcgttcgcgggtaggcgggcggagcgcgggaagcgcggtgcgggcgttttatggcgtatttagacgttttttttttttcgtaggtgtagcggggcgttgcgcgagt

SEQ ID NO: 29996 - DNA, 756 bp, Artificial Sequence
  chemically treated genomic DNA (Homo sapiens) CpG-island No: 29996
actcgcgcaacgccccgctacacctacgaaaaaaaaaaaacgtctaaatacgccataaaacgcccgcaccgcgcttcccgcgctccgcccgcctacccgcgaacgactacgaaccacccccgcatccctcacacctctaccctccccaatcgtacgcgaaaaaaaaaactaacaccgcaatacctaaaaaaacgaccgcgcgaaaaacctaaaaacaaaacaacctcccgactccgaaacgaaacccgaatacgcgcacactcgacgaacgaaacgacgactaaaaaaccgaaaacgaaaaaaaacgaaaatacgaaacgccccgcaacactcccacaaatcgcgaaacccgaaatcctcgtcgaataacgaaaacgtaaatacccacgctatacgtaacgcctaaaccgcgacccgaacccacgaactaaataaaaccgctaccgccgccgccgccacgaaacctaacgaacgacgcgaaaccccgaaaaactaattttcccgaacgaacacgtaacgaaattaacaacgttcgaaccccgactaaaaaaaaaaaaaaacgaaaaacaaaaaaccgcgaacgaacgactaacgcgctatatacttaaatcgtatactaaaacttttctctcccaaaaaccgacgaaaaaaaaaaaaaaaaaaaaaccaccgctccgccttctccttttcgcaatattaacgcaatctataaataataaaacaaaaaaaccaacttcctcgaaactttactaaaac

SEQ ID NO: 29997 - DNA, 729 bp, Artificial Sequence
  chemically treated genomic DNA (Homo sapiens) CpG-island No: 29997
cggcgcggttcgcgtttttttttcggttcgggttgtggggcggttcgtttttttcggcgtttcggcgagttatttttttttttcggttcgaggttcgggttagggtttggggagcgcgcgcggttggagtattgtttgcgtatatcgtcgttttattcgtttatgagttcggttttcgagcgtcgagtcgttattgcggttttttttttttttttttttttttttttttttttttttttttcggttgcggtttttttcggttcgagttagtatttttcgcggtttcgttcggttcggtttttttcgcgcggattacggttttttcgaagcgagaatagtttagaagttggacgaaaagttttagtgcgacgtcgcgagtttcgattttttttatttcgttttcgggcgcgggtttcggtttttgttcgcggttcgtcgtcgcgtttattgttcgtcgtcggtcggggaggaggtggtagttggggttgggggcggtgtttgtttgtttgttcgttagcgcgattggttagttgcgggattttaagggggagggtttacgtcgcgtttcggcggttatttttaaaagtaggttatttattttgtttttgtcgttttcgttgttcgtacgttcgcgcgttttttttgatttcgtttttttttttttcgatttttttttggagtttttgttattttttttttttttttgttggtttttaaaatttatagtga

SEQ ID NO: 29998 - DNA, 729 bp, Artificial Sequence
  chemically treated genomic DNA (Homo sapiens) CpG-island No: 29998
tcactataaattttaaaaaccaacaaaaaaaaaaaaaaaataacaaaaactccaaaaaaaaatcgaaaaaaaaaaaaacgaaatcaaaaaaaacgcgcgaacgtacgaacaacgaaaacgacaaaaacaaaataaataacctacttttaaaaataaccgccgaaacgcgacgtaaaccctcccccttaaaatcccgcaactaaccaatcgcgctaacgaacaaacaaacaaacaccgcccccaaccccaactaccacctcctccccgaccgacgacgaacaataaacgcgacgacgaaccgcgaacaaaaaccgaaacccgcgcccgaaaacgaaataaaaaaaatcgaaactcgcgacgtcgcactaaaacttttcgtccaacttctaaactattctcgcttcgaaaaaaccgtaatccgcgcgaaaaaaaccgaaccgaacgaaaccgcgaaaaatactaactcgaaccgaaaaaaaccgcaaccgaaaaaaaaaaaaaaaaaaaaaaaaaaaaaaaaaaaaaaaaaaccgcaataacgactcgacgctcgaaaaccgaactcataaacgaataaaacgacgatatacgcaaacaatactccaaccgcgcgcgctccccaaaccctaacccgaacctcgaaccgaaaaaaaaaaataactcgccgaaacgccgaaaaaaacgaaccgccccacaacccgaaccgaaaaaaaaacgcgaaccgcgccg

SEQ ID NO: 29999 - DNA, 729 bp, Artificial Sequence
  chemically treated genomic DNA (Homo sapiens) CpG-island No: 29999
ttattgtggattttggaaattagtagaaagaggaaagaggtagtaagagttttagagagaagtcgaggaagagagagacggggttagagagagcgcgcgggcgtgcgagtagcgaaagcgataggggtaaagtgagtgatttgtttttgggggtgatcgtcggagcgcggcgtgagtttttttttttgggatttcgtagttgattagtcgcgttgacggatagatagatagatatcgtttttagttttagttattatttttttttcggtcggcggcggatagtggacgcggcggcgagtcgcgggtaggggtcggagttcgcgttcggaggcggggtggagggggtcggggttcgcggcgtcgtattgaaatttttcgtttaatttttgggttgttttcgtttcggaggagtcgtggttcgcgcgggggaagtcgagtcgagcggagtcgcgagaagtgttagttcgggtcgggaggagtcgtagtcggaggagggggaggaggaagaagagaaggaagaggagagggggtcgtagtggcgattcggcgttcggaagtcgggtttatggacgggtgaggcggcggtgtgcgtagatagtgttttagtcgcgcgcgttttttaggttttggttcgggtttcgggtcggggaggaagagtagttcgtcgaggcgtcgaggagagcgggtcgttttatagttcgagtcggagagggagcgcgagtcgcgtcg

SEQ ID NO: 30000 - DNA, 729 bp, Artificial Sequence
  chemically treated genomic DNA (Homo sapiens) CpG-island No: 30000
cgacgcgactcgcgctccctctccgactcgaactataaaacgacccgctctcctcgacgcctcgacgaactactcttcctccccgacccgaaacccgaaccaaaacctaaaaaacgcgcgcgactaaaacactatctacgcacaccgccgcctcacccgtccataaacccgacttccgaacgccgaatcgccactacgaccccctctcctcttccttctcttcttcctcctccccctcctccgactacgactcctcccgacccgaactaacacttctcgcgactccgctcgactcgacttcccccgcgcgaaccacgactcctccgaaacgaaaacaacccaaaaattaaacgaaaaatttcaatacgacgccgcgaaccccgaccccctccaccccgcctccgaacgcgaactccgacccctacccgcgactcgccgccgcgtccactatccgccgccgaccgaaaaaaaaataataactaaaactaaaaacgatatctatctatctatccgtcaacgcgactaatcaactacgaaatcccaaaaaaaaaaactcacgccgcgctccgacgatcacccccaaaaacaaatcactcactttacccctatcgctttcgctactcgcacgcccgcgcgctctctctaaccccgtctctctcttcctcgacttctctctaaaactcttactacctctttcctctttctactaatttccaaaatccacaataa

SEQ ID NO: 30001 - DNA, 1025 bp, Artificial Sequence
  chemically treated genomic DNA (Homo sapiens) CpG-island No: 30001
tttgcggtattttatcgttttagagtacgatatttgataggtcgtgggtgtcgataaggttaagtaatgggatgtttttgtcgttcgtcgttacgattattcgtgtttttgaattttttacgacgtagcggatttcgtcgacggtgaatatcgaattgatcggatttattatcgtatcgtatttggcgatcgcgtagtacgcgattagttatttttagtagttcgggtcgtataacgtgattcggttatttggttcgatatcgatcgttacgagatcgttggcgattcggttcgattttgcgtttagttcgtagaaattgaacgatttcggtttcgacgattaacgttattttgttatcgaagcgacgcgtcgtttcgggaagaattttattaatcgtttcgtttatcgtcggagtttacgttgggaaacgaacgagtgttgtcgcgtttgttgtgacgtacggatcgattttttggtggttagtattagttgatttttttggttatgtcgatttaaaagggttcgcgtagtttgtatttttgtagtttgtcggttgtcgtgtcggcgagttcggtgcggaattcgacggacgtcgggtatttgtattcggcgagtttcgatttgtagtattcgattagttggcgttcggtgatcgttgttttatcgacggggacgatgagggttttgatcgttttattttatttttcgtgcggtatttcgattatcgttatttcgtttattttcggatgggagaatagtacgttttcgatttcgatcgagttgacgtttttttcgtcggagatgatgacgttttttttgcggtcggtgatcgcgaagtagttttcgtcgtcgacgatttcgtcgtcgtcggtgtggaattaatcgttttcgatcgtttcggtagttgttttcgggtttcgttagtagttggtgaggatgtggttcgttcgtgcgatgatttcgtttttcgggttgattttgacggcgacgtcgatggcgggtgcgtttgttcgttttagttatg

SEQ ID NO: 30002 - DNA, 1025 bp, Artificial Sequence
  chemically treated genomic DNA (Homo sapiens) CpG-island No: 30002
cataactaaaacgaacaaacgcacccgccatcgacgtcgccgtcaaaatcaacccgaaaaacgaaatcatcgcacgaacgaaccacatcctcaccaactactaacgaaacccgaaaacaactaccgaaacgatcgaaaacgattaattccacaccgacgacgacgaaatcgtcgacgacgaaaactacttcgcgatcaccgaccgcaaaaaaaacgtcatcatctccgacgaaaaaaacgtcaactcgatcgaaatcgaaaacgtactattctcccatccgaaaataaacgaaataacgataatcgaaataccgcacgaaaaataaaataaaacgatcaaaaccctcatcgtccccgtcgataaaacaacgatcaccgaacgccaactaatcgaatactacaaatcgaaactcgccgaatacaaatacccgacgtccgtcgaattccgcaccgaactcgccgacacgacaaccgacaaactacaaaaatacaaactacgcgaacccttttaaatcgacataaccaaaaaaatcaactaatactaaccaccaaaaaatcgatccgtacgtcacaacaaacgcgacaacactcgttcgtttcccaacgtaaactccgacgataaacgaaacgattaataaaattcttcccgaaacgacgcgtcgcttcgataacaaaataacgttaatcgtcgaaaccgaaatcgttcaatttctacgaactaaacgcaaaatcgaaccgaatcgccaacgatctcgtaacgatcgatatcgaaccaaataaccgaatcacgttatacgacccgaactactaaaaataactaatcgcgtactacgcgatcgccaaatacgatacgataataaatccgatcaattcgatattcaccgtcgacgaaatccgctacgtcgtaaaaaattcaaaaacacgaataatcgtaacgacgaacgacaaaaacatcccattacttaaccttatcgacacccacgacctatcaaatatcgtactctaaaacgataaaataccgcaaa

SEQ ID NO: 30003 - DNA, 1025 bp, Artificial Sequence
  chemically treated genomic DNA (Homo sapiens) CpG-island No: 30003
tataattgggacgggtaggcgtattcgttatcggcgtcgtcgttagggttagttcggaaggcgagattatcgtacgggcgaattatatttttattaattattggcgaaattcggaagtaattgtcgaggcgatcgaggacggttggttttatatcggcgacggcgggatcgtcgacgacgagggttatttcgcgattatcgatcgtaagaaggacgttattattttcggcggagagaacgttagttcgatcgaggtcgaagacgtgttgtttttttattcggaggtgagcgaggtagcggtgatcggggtgtcgtacgagaagtggggtgagacggttaaggtttttatcgttttcgtcgatggagtaacgattatcgagcgttagttgatcgagtattgtaagtcgaagttcgtcggatataagtgttcgacgttcgtcgagtttcgtatcgaattcgtcggtacggtaatcggtaaattgtagaagtataagttgcgcgaatttttttggatcggtatgattaggaaggttaattgatgttgattattaagaagtcggttcgtgcgttatagtagacgcggtagtattcgttcgttttttaacgtaggtttcggcggtgagcgagacgattggtgagatttttttcgaggcggcgcgtcgtttcggtgataaggtggcgttgatcgtcggagtcggagtcgtttagtttttgcgagttggacgtaaggtcgaatcgggtcgttaacggtttcgtggcggtcggtgtcgagttaggtgatcgggttacgttgtacggttcgaattgttgggaatggttggtcgcgtattacgcgatcgttaagtgcggtgcggtggtgaattcgattagttcgatgtttatcgtcgacgaagttcgttgcgtcgtgggagatttaggggtacgggtggtcgtggcggcgagcgataaaggtattttattgtttgattttgtcggtatttacggtttgttaagtgtcgtgttttggggcgatgaggtgtcgtagg

SEQ ID NO: 30004 - DNA, 1025 bp, Artificial Sequence
  chemically treated genomic DNA (Homo sapiens) CpG-island No: 30004
cctacgacacctcatcgccccaaaacacgacacttaacaaaccgtaaataccgacaaaatcaaacaataaaatacctttatcgctcgccgccacgaccacccgtacccctaaatctcccacgacgcaacgaacttcgtcgacgataaacatcgaactaatcgaattcaccaccgcaccgcacttaacgatcgcgtaatacgcgaccaaccattcccaacaattcgaaccgtacaacgtaacccgatcacctaactcgacaccgaccgccacgaaaccgttaacgacccgattcgaccttacgtccaactcgcaaaaactaaacgactccgactccgacgatcaacgccaccttatcaccgaaacgacgcgccgcctcgaaaaaaatctcaccaatcgtctcgctcaccgccgaaacctacgttaaaaaacgaacgaatactaccgcgtctactataacgcacgaaccgacttcttaataatcaacatcaattaaccttcctaatcataccgatccaaaaaaattcgcgcaacttatacttctacaatttaccgattaccgtaccgacgaattcgatacgaaactcgacgaacgtcgaacacttatatccgacgaacttcgacttacaatactcgatcaactaacgctcgataatcgttactccatcgacgaaaacgataaaaaccttaaccgtctcaccccacttctcgtacgacaccccgatcaccgctacctcgctcacctccgaataaaaaaacaacacgtcttcgacctcgatcgaactaacgttctctccgccgaaaataataacgtccttcttacgatcgataatcgcgaaataaccctcgtcgtcgacgatcccgccgtcgccgatataaaaccaaccgtcctcgatcgcctcgacaattacttccgaatttcgccaataattaataaaaatataattcgcccgtacgataatctcgccttccgaactaaccctaacgacgacgccgataacgaatacgcctacccgtcccaattata

SEQ ID NO: 30005 - DNA, 577 bp, Artificial Sequence
  chemically treated genomic DNA (Homo sapiens) CpG-island No: 30005
cgttttcgacgcggaggtagtcggtgaggttaaggtggtggagttttgggtagtttcgagttaatttttgaatcgcggcgttttttacgttggcgttgacggttagagagaggttgcggagattagcgtcgcgtttttgcgttaggtatacgatggtttcgtttttgagttggcggtaggcggtgagatttagtttttttagggtcgggtagcgattagcgaggtcgcgtagcgttagttcgtttatttagttatagtgcgcgagcgataggcgttgtaggcgtgggtagttttcggttaaagttttaagcgttcggcgatttagttgttcgtagtcgtttaacgttatatttcgtagttgcggatttcgcgttagtatcggtattaggttttcgtttgatagttattcgtgatacggcgttagtgttagtttttgtagtttttcggtatttcgtagtagtcgggttaatgcggttcgcgggatttgcggatttatttgcgggcggggaggtattttaatttttagttcgtttcgtattttttagtcgtttatgtatttttgatttgagtttttttt

SEQ ID NO: 30006 - DNA, 577 bp, Artificial Sequence
  chemically treated genomic DNA (Homo sapiens) CpG-island No: 30006
aaaaaaaactcaaatcaaaaatacataaacgactaaaaaatacgaaacgaactaaaaattaaaatacctccccgcccgcaaataaatccgcaaatcccgcgaaccgcattaacccgactactacgaaataccgaaaaactacaaaaactaacactaacgccgtatcacgaataactatcaaacgaaaacctaataccgatactaacgcgaaatccgcaactacgaaatataacgttaaacgactacgaacaactaaatcgccgaacgcttaaaactttaaccgaaaactacccacgcctacaacgcctatcgctcgcgcactataactaaataaacgaactaacgctacgcgacctcgctaatcgctacccgaccctaaaaaaactaaatctcaccgcctaccgccaactcaaaaacgaaaccatcgtatacctaacgcaaaaacgcgacgctaatctccgcaacctctctctaaccgtcaacgccaacgtaaaaaacgccgcgattcaaaaattaactcgaaactacccaaaactccaccaccttaacctcaccgactacctccgcgtcgaaaacg

SEQ ID NO: 30007 - DNA, 577 bp, Artificial Sequence
  chemically treated genomic DNA (Homo sapiens) CpG-island No: 30007
gaaaagaatttaggttaggggtgtataggcggttgaggagtgcgggacgggttgagagttggggtgttttttcgttcgtaggtgggttcgtagatttcgcgggtcgtattggttcggttgttgcgggatgtcgaggggttgtaggagttggtattggcgtcgtgttacgaatggttgttagacgaggatttggtgtcggtgttggcgcggaattcgtagttgcggagtgtggcgttgggcggttgcgggtaattgagtcgtcgggcgtttggggttttggtcgagggttgtttacgtttgtagcgtttgtcgttcgcgtattgtgattgggtggacgggttggcgttgcgcggtttcgttgatcgttgttcggttttggaggagttggattttatcgtttgtcgttagtttaaggacgaggttatcgtgtatttggcgtagaggcgcggcgttggttttcgtagtttttttttggtcgttaacgttaacgtgggggacgtcgcggtttaagagttggttcggaattgtttagaattttattattttgattttatcggttgttttcgcgtcggaagcg

SEQ ID NO: 30008 - DNA, 577 bp, Artificial Sequence
  chemically treated genomic DNA (Homo sapiens) CpG-island No: 30008
cgcttccgacgcgaaaacaaccgataaaatcaaaataataaaattctaaacaattccgaaccaactcttaaaccgcgacgtcccccacgttaacgttaacgaccaaaaaaaaactacgaaaaccaacgccgcgcctctacgccaaatacacgataacctcgtccttaaactaacgacaaacgataaaatccaactcctccaaaaccgaacaacgatcaacgaaaccgcgcaacgccaacccgtccacccaatcacaatacgcgaacgacaaacgctacaaacgtaaacaaccctcgaccaaaaccccaaacgcccgacgactcaattacccgcaaccgcccaacgccacactccgcaactacgaattccgcgccaacaccgacaccaaatcctcgtctaacaaccattcgtaacacgacgccaataccaactcctacaacccctcgacatcccgcaacaaccgaaccaatacgacccgcgaaatctacgaacccacctacgaacgaaaaaacaccccaactctcaacccgtcccgcactcctcaaccgcctatacacccctaacctaaattcttttc

SEQ ID NO: 30009 - DNA, 545 bp, Artificial Sequence
  chemically treated genomic DNA (Homo sapiens) CpG-island No: 30009
  misc_feature (162)..(162): n is either a, c, g or t
agcgtttcgtcgttcgagggtattttttggtagattcggcggcggcgatagtttggtcggatagtgtttcgtgcgtaggcgcggagttagatttcgttgtagtttttatcgttcggggagttttatttatcgagttcgttcgttggttcgttagtgtttttntcgtcgtttgttttttttagtttttttagtgtttgttttacgtatttcgatggcggagttgcggtttagcggcgttttcggttttatcgcgttttcggtttttggttcgattgttttttcggttttcgtttcgttttttttttcgggattgtacgttatttacggagagtgtcgtcgtttttattttgattagtcgaattcgttttaggttatcgttatcgttaagtattggtatgttttgggtcgcggggagacggataggcgcgggttggaaagggttaaagcgtcgagggcgaagtaatttgtgggaggtgggaggaggggtagagaatggttaaagtatttagaaggagggttttttgttgcgagggaaggagttaagg

SEQ ID NO: 30010 - DNA, 545 bp, Artificial Sequence
  chemically treated genomic DNA (Homo sapiens) CpG-island No: 30010
  misc_feature (384)..(384): n is either a, c, g or t
ccttaactccttccctcgcaacaaaaaaccctccttctaaatactttaaccattctctacccctcctcccacctcccacaaattacttcgccctcgacgctttaaccctttccaacccgcgcctatccgtctccccgcgacccaaaacataccaatacttaacgataacgataacctaaaacgaattcgactaatcaaaataaaaacgacgacactctccgtaaataacgtacaatcccgaaaaaaaaaacgaaacgaaaaccgaaaaaacaatcgaaccaaaaaccgaaaacgcgataaaaccgaaaacgccgctaaaccgcaactccgccatcgaaatacgtaaaacaaacactaaaaaaactaaaaaaaacaaacgacganaaaaacactaacgaaccaacgaacgaactcgataaataaaactccccgaacgataaaaactacaacgaaatctaactccgcgcctacgcacgaaacactatccgaccaaactatcgccgccgccgaatctaccaaaaaataccctcgaacgacgaaacgct

SEQ ID NO: 30011 - DNA, 545 bp, Artificial Sequence
  chemically treated genomic DNA (Homo sapiens) CpG-island No: 30011
  misc_feature (384)..(384): n is either a, c, g or t
ttttaattttttttttcgtagtaagaagttttttttttgagtgttttaattattttttatttttttttttattttttataaattatttcgttttcggcgttttaattttttttagttcgcgtttgttcgttttttcgcggtttagagtatattagtatttgacgatagcggtaatttggagcgggttcggttggttagggtaaaggcggcggtatttttcgtagatggcgtgtagtttcgggggaaagagcgaagcgaaggtcgggggggtagtcgggttaggggtcgggggcgcggtggggtcgggggcgtcgttaggtcgtagtttcgttatcggggtgcgtagggtaggtattgggggaattggagagggtaaacgacggngagagtattgacgggttagcgggcggattcggtgggtgagatttttcgagcgatgggggttgtagcgaggtttagtttcgcgtttgcgtacggggtattgttcggttaggttgtcgtcgtcgtcgagtttgttagaaggtgttttcgggcggcggggcgtt

SEQ ID NO: 30012 - DNA, 545 bp, Artificial Sequence
  chemically treated genomic DNA (Homo sapiens) CpG-island No: 30012
  misc_feature (162)..(162): n is either a, c, g or t
aacgccccgccgcccgaaaacaccttctaacaaactcgacgacgacgacaacctaaccgaacaataccccgtacgcaaacgcgaaactaaacctcgctacaacccccatcgctcgaaaaatctcacccaccgaatccgcccgctaacccgtcaatactctcnccgtcgtttaccctctccaattcccccaatacctaccctacgcaccccgataacgaaactacgacctaacgacgcccccgaccccaccgcgcccccgacccctaacccgactacccccccgaccttcgcttcgctctttcccccgaaactacacgccatctacgaaaaataccgccgcctttaccctaaccaaccgaacccgctccaaattaccgctatcgtcaaatactaatatactctaaaccgcgaaaaaacgaacaaacgcgaactaaaaaaaattaaaacgccgaaaacgaaataatttataaaaaataaaaaaaaaaataaaaaataattaaaacactcaaaaaaaaaacttcttactacgaaaaaaaaaattaaaa

SEQ ID NO: 30013 - DNA, 675 bp, Artificial Sequence
  chemically treated genomic DNA (Homo sapiens) CpG-island No: 30013
tattatcgtttttacggtttcgtcgcgttattcgaggtcgcgtcgttttggtgggtttgtttttcggtttacgttacgattttgcgtcggttttgcgtcgtcgtcggtatttcgggattgtcgttgtaggcgttcgcggcggtggtcgagagttgggcgtcgtggtcggagggcgggagtttgtaaatcgagttgcgttggggtcgcgtggagcgcgcgcggggtttttttttgtagttatcggatttcgtgcgtcgggagttgcggcgcgcgtacggtatttattttcgcgtcgacgtgcgcgttatttagcgtcgcggttagtttttgttgtaggcgacgtcgcgcgtgttcgagttcgattatcgcgtggagtggcgcgtgcggcgtcggttcgatagcggcgatagtagtttagttcgggaagtcgcggagcgcggtcgttttaggaagagtaagggtttgagttgaagtcgtcgtaaggtttaggggcgggttcgcgtgtacgcgtttggtttttttttgtgtgtgtcgtcgtcgataggtagaagtgagtttttatttgtgcgcgggaggcggacgcgttgtttatttgtttttttggttttttttatgattgtcggttagttttttgtatttgtttttttcgttttattgttggacggtgggagaagg

SEQ ID NO: 30014 - DNA, 675 bp, Artificial Sequence
  chemically treated genomic DNA (Homo sapiens) CpG-island No: 30014
ccttctcccaccgtccaacaataaaacgaaaaaaacaaatacaaaaaactaaccgacaatcataaaaaaaaccaaaaaaacaaataaacaacgcgtccgcctcccgcgcacaaataaaaactcacttctacctatcgacgacgacacacacaaaaaaaaaccaaacgcgtacacgcgaacccgcccctaaaccttacgacgacttcaactcaaacccttactcttcctaaaacgaccgcgctccgcgacttcccgaactaaactactatcgccgctatcgaaccgacgccgcacgcgccactccacgcgataatcgaactcgaacacgcgcgacgtcgcctacaacaaaaactaaccgcgacgctaaataacgcgcacgtcgacgcgaaaataaataccgtacgcgcgccgcaactcccgacgcacgaaatccgataactacaaaaaaaaaccccgcgcgcgctccacgcgaccccaacgcaactcgatttacaaactcccgccctccgaccacgacgcccaactctcgaccaccgccgcgaacgcctacaacgacaatcccgaaataccgacgacgacgcaaaaccgacgcaaaatcgtaacgtaaaccgaaaaacaaacccaccaaaacgacgcgacctcgaataacgcgacgaaaccgtaaaaacgataata

SEQ ID NO: 30015 - DNA, 675 bp, Artificial Sequence
  chemically treated genomic DNA (Homo sapiens) CpG-island No: 30015
tttttttttatcgtttagtaataaagcgagagaaataagtgtaggaaattggtcggtagttatgggagaagttaaaaagataggtgagtagcgcgttcgtttttcgcgtataggtgagggtttatttttgtttgtcggcggcggtatatataggaaagagttaagcgcgtgtacgcgggttcgtttttaggttttgcggcggttttagtttaggtttttgttttttttggggcggtcgcgtttcgcggtttttcgggttgggttgttgtcgtcgttgtcgggtcggcgtcgtacgcgttattttacgcggtggtcgggttcgagtacgcgcggcgtcgtttgtagtaggaattggtcgcggcgttgggtgacgcgtacgtcggcgcgggggtaggtgtcgtacgcgcgtcgtagttttcggcgtacgaagttcggtagttgtagaggggggtttcgcgcgcgttttacgcggttttagcgtagttcggtttgtaggttttcgtttttcggttacggcgtttagttttcggttatcgtcgcgggcgtttgtagcgatagtttcgagatgtcggcggcggcgtagggtcggcgtagggtcgtggcgtaggtcggagggtaggtttattagggcggcgcggtttcgggtggcgcggcggggtcgtagaagcggtggta

SEQ ID NO: 30016 - DNA, 675 bp, Artificial Sequence
  chemically treated genomic DNA (Homo sapiens) CpG-island No: 30016
taccaccgcttctacgaccccgccgcgccacccgaaaccgcgccgccctaataaacctaccctccgacctacgccacgaccctacgccgaccctacgccgccgccgacatctcgaaactatcgctacaaacgcccgcgacgataaccgaaaactaaacgccgtaaccgaaaaacgaaaacctacaaaccgaactacgctaaaaccgcgtaaaacgcgcgcgaaacccccctctacaactaccgaacttcgtacgccgaaaactacgacgcgcgtacgacacctacccccgcgccgacgtacgcgtcacccaacgccgcgaccaattcctactacaaacgacgccgcgcgtactcgaacccgaccaccgcgtaaaataacgcgtacgacgccgacccgacaacgacgacaacaacccaacccgaaaaaccgcgaaacgcgaccgccccaaaaaaaacaaaaacctaaactaaaaccgccgcaaaacctaaaaacgaacccgcgtacacgcgcttaactctttcctatatataccgccgccgacaaacaaaaataaaccctcacctatacgcgaaaaacgaacgcgctactcacctatctttttaacttctcccataactaccgaccaatttcctacacttatttctctcgctttattactaaacgataaaaaaaaa

SEQ ID NO: 30017 - DNA, 600 bp, Artificial Sequence
  chemically treated genomic DNA (Homo sapiens) CpG-island No: 30017
gggtatcgttgttttttcgagttatatcgtcggcggtaggaatgggcgtagcggagagggttgcggtgcgtagggtttttcgtttttcgcggggtcgattagtttgaagacgcggttgacggcggtgggcgtttcggggttttagtttgggagaggtagtcgtaaagtagcggcgttttttacgacgttttatagcggtttttaataggtagttggaaagggtagttgggggcgcggttaggagggtacgtggtgcgagggattggtcgcgagaaagcggagttaaaaggggcgggagttgtgagttatttttacgtaatagggtagaggttcgtttcgtttcggttggtagggagttaataggggaggcgcgacgggtcgggacgggtattcgtcggtttcgttttttgttcggttttacgtgataaaggtgtgttttgcgtacgcgcgttcgtaatttggttattatgacgacgaggttttcgtcggtttttgaggacgcgcgcggagtagttttggtagtagttgtggattggttagagtgattggaggtgtttttttcgcgttttttaagtttacggggttttcgtatttttgagt

SEQ ID NO: 30018 - DNA, 600 bp, Artificial Sequence
  chemically treated genomic DNA (Homo sapiens) CpG-island No: 30018
actcaaaaatacgaaaaccccgtaaacttaaaaaacgcgaaaaaaacacctccaatcactctaaccaatccacaactactaccaaaactactccgcgcgcgtcctcaaaaaccgacgaaaacctcgtcgtcataataaccaaattacgaacgcgcgtacgcaaaacacacctttatcacgtaaaaccgaacaaaaaacgaaaccgacgaatacccgtcccgacccgtcgcgcctcccctattaactccctaccaaccgaaacgaaacgaacctctaccctattacgtaaaaataactcacaactcccgccccttttaactccgctttctcgcgaccaatccctcgcaccacgtaccctcctaaccgcgcccccaactaccctttccaactacctattaaaaaccgctataaaacgtcgtaaaaaacgccgctactttacgactacctctcccaaactaaaaccccgaaacgcccaccgccgtcaaccgcgtcttcaaactaatcgaccccgcgaaaaacgaaaaaccctacgcaccgcaaccctctccgctacgcccattcctaccgccgacgatataactcgaaaaaacaacgataccc

SEQ ID NO: 30019 - DNA, 600 bp, Artificial Sequence
  chemically treated genomic DNA (Homo sapiens) CpG-island No: 30019
atttagaggtgcgaaggtttcgtagatttggaggacgcgaggaaaatatttttaattattttggttagtttatagttattgttaagattgtttcgcgcgcgtttttaggaatcggcgagggtttcgtcgttatggtaattagattgcgaacgcgcgtgcgtaagatatatttttgttacgtgaggtcgggtagggggcggggtcggcgaatgttcgtttcgattcgtcgcgttttttttgttagttttttgttagtcgaggcggggcgaatttttgttttgttgcgtgggagtgatttatagttttcgttttttttggtttcgttttttcgcggttagtttttcgtattacgtgtttttttggtcgcgtttttagttgttttttttaattgtttgttggaagtcgttgtaaaacgtcgtgaggagcgtcgttgttttacggttgttttttttagattagagtttcggagcgtttatcgtcgttagtcgcgtttttaagttagtcggtttcgcggagagcgagagattttgcgtatcgtagtttttttcgttgcgtttatttttgtcgtcggcgatgtaattcggggaggtagcggtgttt

SEQ ID NO: 30020 - DNA, 600 bp, Artificial Sequence
  chemically treated genomic DNA (Homo sapiens) CpG-island No: 30020
aaacaccgctacctccccgaattacatcgccgacgacaaaaataaacgcaacgaaaaaaactacgatacgcaaaatctctcgctctccgcgaaaccgactaacttaaaaacgcgactaacgacgataaacgctccgaaactctaatctaaaaaaaacaaccgtaaaacaacgacgctcctcacgacgttttacaacgacttccaacaaacaattaaaaaaaacaactaaaaacgcgaccaaaaaaacacgtaatacgaaaaactaaccgcgaaaaaacgaaaccaaaaaaaacgaaaactataaatcactcccacgcaacaaaacaaaaattcgccccgcctcgactaacaaaaaactaacaaaaaaaacgcgacgaatcgaaacgaacattcgccgaccccgccccctacccgacctcacgtaacaaaaatatatcttacgcacgcgcgttcgcaatctaattaccataacgacgaaaccctcgccgattcctaaaaacgcgcgcgaaacaatcttaacaataactataaactaaccaaaataattaaaaatattttcctcgcgtcctccaaatctacgaaaccttcgcacctctaaat

SEQ ID NO: 30021 - DNA, 515 bp, Artificial Sequence
  chemically treated genomic DNA (Homo sapiens) CpG-island No: 30021
cgcggttcggcgggaagatggggagttttggacggagcgagtcggcgcgtcgttgttatttgggtcgttttcgtcgcggggtatttttttgaagtagtcgttgagcgataggttgtggcggatggagttttgttagttcgttttgttgcgtttgtagaaagggaagttattagttacgtattggtagatttggttgagcgttagttttcgtagcggcgcgttttggatggttatggcgatgagcgtcgagtaggagtagggcggtcgtattagttttagtagtttttgttggtcggagaggtttagttaggcgaggtcggcgttcgttaggtcgttcggggcgtcgaggagcgggtcgggagtttcgtagttcggggtcgcgtagggcggcgtaggttcgggattcgaagcgtaggatttggggttgagcgttggcgcgtttatttataggagggggttttcgtttatcgcgtttagattttttggtttatagttcggggggtgcgcggtggttt

SEQ ID NO: 30022 - DNA, 515 bp, Artificial Sequence
  chemically treated genomic DNA (Homo sapiens) CpG-island No: 30022
aaaccaccgcgcaccccccgaactataaaccaaaaaatctaaacgcgataaacgaaaaccccctcctataaataaacgcgccaacgctcaaccccaaatcctacgcttcgaatcccgaacctacgccgccctacgcgaccccgaactacgaaactcccgacccgctcctcgacgccccgaacgacctaacgaacgccgacctcgcctaactaaacctctccgaccaacaaaaactactaaaactaatacgaccgccctactcctactcgacgctcatcgccataaccatccaaaacgcgccgctacgaaaactaacgctcaaccaaatctaccaatacgtaactaataacttccctttctacaaacgcaacaaaacgaactaacaaaactccatccgccacaacctatcgctcaacgactacttcaaaaaaataccccgcgacgaaaacgacccaaataacaacgacgcgccgactcgctccgtccaaaactccccatcttcccgccgaaccgcg

SEQ ID NO: 30023 - DNA, 515 bp, Artificial Sequence
  chemically treated genomic DNA (Homo sapiens) CpG-island No: 30023
aggttatcgcgtatttttcgggttatgagttaggggatttgggcgcggtgggcgggggtttttttttgtgggtgaacgcgttagcgtttagttttaagttttacgtttcgggtttcgggtttgcgtcgttttacgcggtttcgagttacggggttttcggttcgtttttcggcgtttcgggcggtttggcgggcgtcgatttcgtttggttgagttttttcggttagtaggagttgttgaggttggtgcggtcgttttatttttattcggcgtttatcgttatggttatttagagcgcgtcgttgcggaagttgacgtttagttagatttattagtacgtggttggtaatttttttttttataagcgtagtaaggcgggttggtagaattttattcgttataatttgtcgtttaacgattgttttaagaaggtgtttcgcgacgaggacgatttaggtaatagcggcgcgtcggttcgtttcgtttaggattttttattttttcgtcgggtcgcg

SEQ ID NO: 30024 - DNA, 515 bp, Artificial Sequence
  chemically treated genomic DNA (Homo sapiens) CpG-island No: 30024
cgcgacccgacgaaaaaataaaaaatcctaaacgaaacgaaccgacgcgccgctattacctaaatcgtcctcgtcgcgaaacaccttcttaaaacaatcgttaaacgacaaattataacgaataaaattctaccaacccgccttactacgcttataaaaaaaaaaattaccaaccacgtactaataaatctaactaaacgtcaacttccgcaacgacgcgctctaaataaccataacgataaacgccgaataaaaataaaacgaccgcaccaacctcaacaactcctactaaccgaaaaaactcaaccaaacgaaatcgacgcccgccaaaccgcccgaaacgccgaaaaacgaaccgaaaaccccgtaactcgaaaccgcgtaaaacgacgcaaacccgaaacccgaaacgtaaaacttaaaactaaacgctaacgcgttcacccacaaaaaaaaacccccgcccaccgcgcccaaatcccctaactcataacccgaaaaatacgcgataacct

SEQ ID NO: 30025 - DNA, 803 bp, Artificial Sequence
  chemically treated genomic DNA (Homo sapiens) CpG-island No: 30025
cgttttggatcggacgtttttttgatttttttttttttttttgtgcgattcgtttcgagtttatagtcgttcgcggttttggttgtagggattttaagttcgtagtttcgtttggttttacgggtttcgtagtttcgattgttttggatcgtattacgattttttaaggtttttagggttgtggtttgggagtttcgtttaatgcgcggtttttttgttcggttcgggatatttcgttttaaagaaattcgtttcgtcggggtttttgggttattcgggattcggggttagggatagagggcgattatattgcgtaagagatcgtaatgaagttcgtagatttttaggttggagtcgtagagcgaggtggcgaggtggagaacgcggggttgggtttggatagcggttttggggtcgtttggagttttcgtttttttaattcggaaggtagcggattgatatttgcgtcgaagtcgcgcgtattttacggagggtcgggattttggaaatttcgaacgttttagtagtttagggtagttatcgttttttttaagtcggggagttcggggtttcgttaggttttttcgcgttgtgatttcgggcgcgtagagcggagagcgttaagttttttgttgggtgtcggaggacgcgtcgaaaatagggacgtttttgtagtgcgttcgatattagttttttagttttgttgtcgttcggggttgttgtagttcgggttatttcggttttttaagttgttcggttttcggttttttttgtttttcgcgttgtggggtggcggaggatgg

SEQ ID NO: 30026 - DNA, 803 bp, Artificial Sequence
  chemically treated genomic DNA (Homo sapiens) CpG-island No: 30026
ccatcctccgccaccccacaacgcgaaaaacaaaaaaaaccgaaaaccgaacaacttaaaaaaccgaaataacccgaactacaacaaccccgaacgacaacaaaactaaaaaactaatatcgaacgcactacaaaaacgtccctattttcgacgcgtcctccgacacccaacaaaaaacttaacgctctccgctctacgcgcccgaaatcacaacgcgaaaaaacctaacgaaaccccgaactccccgacttaaaaaaaacgataactaccctaaactactaaaacgttcgaaatttccaaaatcccgaccctccgtaaaatacgcgcgacttcgacgcaaatatcaatccgctaccttccgaattaaaaaaacgaaaactccaaacgaccccaaaaccgctatccaaacccaaccccgcgttctccacctcgccacctcgctctacgactccaacctaaaaatctacgaacttcattacgatctcttacgcaatataatcgccctctatccctaaccccgaatcccgaataacccaaaaaccccgacgaaacgaatttctttaaaacgaaatatcccgaaccgaacaaaaaaaccgcgcattaaacgaaactcccaaaccacaaccctaaaaaccttaaaaaatcgtaatacgatccaaaacaatcgaaactacgaaacccgtaaaaccaaacgaaactacgaacttaaaatccctacaaccaaaaccgcgaacgactataaactcgaaacgaatcgcacaaaaaaaaaaaaaaaaatcaaaaaaacgtccgatccaaaacg

SEQ ID NO: 30027 - DNA, 803 bp, Artificial Sequence
  chemically treated genomic DNA (Homo sapiens) CpG-island No: 30027
ttatttttcgttattttatagcgcggggagtaggggaggtcgaaagtcgggtagtttggggggtcgggataattcgggttgtagtaatttcgggcggtagtaggattggagagttggtgtcggacgtattgtagagacgtttttgttttcggcgcgtttttcgatatttagtagagagtttggcgtttttcgttttgcgcgttcgaggttatagcgcggagaaatttggcggggtttcggatttttcggtttgggaaaagcgatgattgttttgaattgttggggcgttcgaaatttttagggtttcgatttttcgtggggtacgcgcgatttcggcgtagatgttagttcgttgtttttcgggttgagggagcgaggattttagacgattttagggtcgttgtttaggtttagtttcgcgttttttatttcgttatttcgttttgcggttttagtttggagatttacggattttattgcgattttttgcgtagtgtagtcgttttttatttttagtttcgagtttcgggtaatttaggggtttcggcgaggcgagtttttttggggcgagatgtttcgagtcgagtaaaggggtcgcgtattggacggggtttttaagttatagttttgggggttttgaggagtcgtggtacggtttagggtagtcggggttgcggggttcgtgaagttagacgaggttacggatttagggtttttgtaattaagatcgcgagcgattgtggattcgggacggatcgtataaaggaggaagggggaattagaggggcgttcggtttaggacg

SEQ ID NO: 30028 - DNA, 803 bp, Artificial Sequence
  chemically treated genomic DNA (Homo sapiens) CpG-island No: 30028
cgtcctaaaccgaacgcccctctaattcccccttcctcctttatacgatccgtcccgaatccacaatcgctcgcgatcttaattacaaaaaccctaaatccgtaacctcgtctaacttcacgaaccccgcaaccccgactaccctaaaccgtaccacgactcctcaaaacccccaaaactataacttaaaaaccccgtccaatacgcgacccctttactcgactcgaaacatctcgccccaaaaaaactcgcctcgccgaaacccctaaattacccgaaactcgaaactaaaaataaaaaacgactacactacgcaaaaaatcgcaataaaatccgtaaatctccaaactaaaaccgcaaaacgaaataacgaaataaaaaacgcgaaactaaacctaaacaacgaccctaaaatcgtctaaaatcctcgctccctcaacccgaaaaacaacgaactaacatctacgccgaaatcgcgcgtaccccacgaaaaatcgaaaccctaaaaatttcgaacgccccaacaattcaaaacaatcatcgcttttcccaaaccgaaaaatccgaaaccccgccaaatttctccgcgctataacctcgaacgcgcaaaacgaaaaacgccaaactctctactaaatatcgaaaaacgcgccgaaaacaaaaacgtctctacaatacgtccgacaccaactctccaatcctactaccgcccgaaattactacaacccgaattatcccgaccccccaaactacccgactttcgacctcccctactccccgcgctataaaataacgaaaaataa

SEQ ID NO: 30029 - DNA, 620 bp, Artificial Sequence
  chemically treated genomic DNA (Homo sapiens) CpG-island No: 30029
ggcgaggaagtcgcgtttgaagtcgcgcggtttggggattaggggaaggcgggcggcgggagtttcggttgggggtgcgcggggattttcgatttcgcgttcggggttggcgtgttttaggtcggcgtcgtggggtcggcgcgcggggggtagggcgtagaggaggtgggggagtcggtaggaggaggggaggagcgtcgggttcgttatttttaggcgtcggttttgcggttgttgaatcggaagtcgtagggaggattcggggaaataaagacgtcggagaatgatttttagcgaggtcgtttgagtcggggttcgcgtatagtttcgttagttttcggtatgggcgatcgtagcgggtagtaggagcgttcggtttcgtattttttaggggttttcgtgggtattagcgtcgtcgttgtgaacgggttgttgtataacggtttttattcgtcgttagtttagtcgtcgtacgtttgtagtcggggtttagtgggcggtagcgacgcggcgttttagcgtttttcgtttttgtcggagttgtagtcgtagttattgtttttttagtatgatttttcggttaagaaatgtcggttgcggaggaggatggattcggggag

SEQ ID NO: 30030 - DNA, 620 bp, Artificial Sequence
  chemically treated genomic DNA (Homo sapiens) CpG-island No: 30030
ctccccgaatccatcctcctccgcaaccgacatttcttaaccgaaaaatcatactaaaaaaacaataactacgactacaactccgacaaaaacgaaaaacgctaaaacgccgcgtcgctaccgcccactaaaccccgactacaaacgtacgacgactaaactaacgacgaataaaaaccgttatacaacaacccgttcacaacgacgacgctaatacccacgaaaacccctaaaaaatacgaaaccgaacgctcctactacccgctacgatcgcccataccgaaaactaacgaaactatacgcgaaccccgactcaaacgacctcgctaaaaatcattctccgacgtctttatttccccgaatcctccctacgacttccgattcaacaaccgcaaaaccgacgcctaaaaataacgaacccgacgctcctcccctcctcctaccgactcccccacctcctctacgccctaccccccgcgcgccgaccccacgacgccgacctaaaacacgccaaccccgaacgcgaaatcgaaaatccccgcgcacccccaaccgaaactcccgccgcccgccttcccctaatccccaaaccgcgcgacttcaaacgcgacttcctcgcc

SEQ ID NO: 30031 - DNA, 620 bp, Artificial Sequence
  chemically treated genomic DNA (Homo sapiens) CpG-island No: 30031
tttttcgagtttattttttttcgtagtcggtattttttggtcggggagttatgttgagggagtagtggttgcggttgtagtttcggtaggagcgggaggcgttggggcgtcgcgtcgttgtcgtttattggatttcggttgtagacgtgcggcggttggattggcggcggatggaagtcgttgtgtagtagttcgtttatagcggcggcgttggtgtttacgggggtttttggagagtgcgggatcgagcgtttttgttgttcgttgcggtcgtttatgtcgggggttggcggggttgtgcgcgggtttcggtttaggcggtttcgttggaggttatttttcggcgtttttattttttcggattttttttgcggttttcgatttagtagtcgtagagtcggcgtttggggatggcgaattcggcgttttttttttttttttgtcgatttttttattttttttgcgttttgtttttcgcgcgtcggttttacggcgtcggtttggagtacgttagtttcgggcgcggaatcggggattttcgcgtatttttagtcggggttttcgtcgttcgtttttttttgatttttaggtcgcgcgattttaaacgcggttttttcgtt

SEQ ID NO: 30032 - DNA, 620 bp, Artificial Sequence
  chemically treated genomic DNA (Homo sapiens) CpG-island No: 30032
aacgaaaaaaccgcgtttaaaatcgcgcgacctaaaaatcaaaaaaaaacgaacgacgaaaaccccgactaaaaatacgcgaaaatccccgattccgcgcccgaaactaacgtactccaaaccgacgccgtaaaaccgacgcgcgaaaaacaaaacgcaaaaaaaataaaaaaatcgacaaaaaaaaaaaaaaaacgccgaattcgccatccccaaacgccgactctacgactactaaatcgaaaaccgcaaaaaaaatccgaaaaaataaaaacgccgaaaaataacctccaacgaaaccgcctaaaccgaaacccgcgcacaaccccgccaacccccgacataaacgaccgcaacgaacaacaaaaacgctcgatcccgcactctccaaaaacccccgtaaacaccaacgccgccgctataaacgaactactacacaacgacttccatccgccgccaatccaaccgccgcacgtctacaaccgaaatccaataaacgacaacgacgcgacgccccaacgcctcccgctcctaccgaaactacaaccgcaaccactactccctcaacataactccccgaccaaaaaataccgactacgaaaaaaaataaactcgaaaaa

SEQ ID NO: 30033 - DNA, 678 bp, Artificial Sequence
  chemically treated genomic DNA (Homo sapiens) CpG-island No: 30033
tttttcgtcgtcgcggtttttcgtcgtcgtcgttattttttcgggcgtttagcggttgcggatttttcggaggttttagggaaagcggagagagaaagcgggaggaggttcgggcgagggcgaggcgggtagaggtcgtagagtgggtttaatcgcggggaaggggggcggtgggaggagggagtagagagagtcggcgtcgtagttagtagtttgttggcggggagaggaaatttgaggcgtcgaggaggagttcgagaattatttcgcgggaatttttttcgtcggttttcggtttcggcgtataggcgcgttcgcgttcgtttttcgcgggttcgtaggcggggtcgggcgtcgttattcggatatttgtgagggcgcggacgcgtaggcgggttttttttttttgcgaggttttcgcgaacgtttagggtcgttttttgggggatgcggttttttcgcggtggtttcgtcgggagatttagttttaggcgtttgttttcggttggttttttatgtgacgtcgtagttttttttcggtttttttcgaaattttcgcgttggggcggttcgggggttgcgggcgcgaattcggtttttttatattcgagatggggttggaggggtggtaggagggcgttttttgtagttcggttggttttcgatggtaattttttt

SEQ ID NO: 30034 - DNA, 678 bp, Artificial Sequence
  chemically treated genomic DNA (Homo sapiens) CpG-island No: 30034
aaaaaaattaccatcgaaaaccaaccgaactacaaaaaacgccctcctaccacccctccaaccccatctcgaatataaaaaaaccgaattcgcgcccgcaacccccgaaccgccccaacgcgaaaatttcgaaaaaaaccgaaaaaaaactacgacgtcacataaaaaaccaaccgaaaacaaacgcctaaaactaaatctcccgacgaaaccaccgcgaaaaaaccgcatcccccaaaaaacgaccctaaacgttcgcgaaaacctcgcaaaaaaaaaaaacccgcctacgcgtccgcgccctcacaaatatccgaataacgacgcccgaccccgcctacgaacccgcgaaaaacgaacgcgaacgcgcctatacgccgaaaccgaaaaccgacgaaaaaaattcccgcgaaataattctcgaactcctcctcgacgcctcaaatttcctctccccgccaacaaactactaactacgacgccgactctctctactccctcctcccaccgccccccttccccgcgattaaacccactctacgacctctacccgcctcgccctcgcccgaacctcctcccgctttctctctccgctttccctaaaacctccgaaaaatccgcaaccgctaaacgcccgaaaaaataacgacgacgacgaaaaaccgcgacgacgaaaaa

SEQ ID NO: 30035 - DNA, 678 bp, Artificial Sequence
  chemically treated genomic DNA (Homo sapiens) CpG-island No: 30035
agaagggttattatcgggagttagtcgggttgtaggaggcgtttttttgttatttttttagttttatttcgggtgtgggaagatcgagttcgcgttcgtagttttcgggtcgttttagcgcgggagtttcgaggggagtcgggggagagttgcggcgttatatggggggttagtcggggataggcgtttggggttgagtttttcggcgaagttatcgcgaaggggtcgtattttttagagaacgattttgggcgttcgcgaaggtttcgtagagagggggagttcgtttgcgcgttcgcgtttttataggtgttcgggtggcggcgttcggtttcgtttgcggattcgcgagaggcgggcgcgggcgcgtttgtgcgtcggggtcgggggtcggcgggggaggttttcgcgaggtggttttcgggttttttttcggcgttttaggtttttttttttcgttagtaggttgttggttgcggcgtcgattttttttattttttttttttatcgtttttttttttcgcggttgggtttattttgcggtttttgttcgtttcgttttcgttcgggttttttttcgtttttttttttcgttttttttggagttttcgaggagttcgtagtcgttgggcgttcgggaagatggcggcggcggcgggagatcgcggcggcgagggg

SEQ ID NO: 30036 - DNA, 678 bp, Artificial Sequence
  chemically treated genomic DNA (Homo sapiens) CpG-island No: 30036
cccctcgccgccgcgatctcccgccgccgccgccatcttcccgaacgcccaacgactacgaactcctcgaaaactccaaaaaaaacgaaaaaaaaaaacgaaaaaaaacccgaacgaaaacgaaacgaacaaaaaccgcaaaataaacccaaccgcgaaaaaaaaaaacgataaaaaaaaaaaataaaaaaaatcgacgccgcaaccaacaacctactaacgaaaaaaaaaaacctaaaacgccgaaaaaaaacccgaaaaccacctcgcgaaaacctcccccgccgacccccgaccccgacgcacaaacgcgcccgcgcccgcctctcgcgaatccgcaaacgaaaccgaacgccgccacccgaacacctataaaaacgcgaacgcgcaaacgaactccccctctctacgaaaccttcgcgaacgcccaaaatcgttctctaaaaaatacgaccccttcgcgataacttcgccgaaaaactcaaccccaaacgcctatccccgactaaccccccatataacgccgcaactctcccccgactcccctcgaaactcccgcgctaaaacgacccgaaaactacgaacgcgaactcgatcttcccacacccgaaataaaactaaaaaaataacaaaaaaacgcctcctacaacccgactaactcccgataataacccttct

SEQ ID NO: 30037 - DNA, 963 bp, Artificial Sequence
  chemically treated genomic DNA (Homo sapiens) CpG-island No: 30037
acggtttagattaaggcgggggagggcgatagcgatttcgcgggtgtagcgcgtgggcggtcgaggggtggtggttgcgttcggggtttgggggtggggtggttgcggtcgcgttttttgttgttttttaacgtgtcgtttgttttcgtagcgttcgtcgtcgtcgtgcgtaggttcggcgaggatatcgcgttttcgagtttttcgagttgcggttattatcgcgaggagttcgcgttgggttcggttaaagtcgttcgttaggtcgttcgggacggggcgcggttggcgttggttcgcgcggtattcgagtgttgcgcgttttcgattttcgaggtttcgggcgcgtcggcgtagttgtttttcgtgttgtttaattattatcgcgtgttggttcggcgcggatcgttggggggcgtcgtattcgtcgttttcggtttggtttgcgttttcggcggtttcgaggcggcgatcggcgcgttgcggtttcggtattcgagtttcgtcgttattttttcgttcggcgcgtttttgtcgtattatttgggcgtttcggttattattattaacgggaggtgattcgttggtcgttcgcgttaggagtttggattcggtttttcggggttgcggcgttatcgagttcggtaaatgcgtacgatttatattaatttatgtagagatagttgtttgaattggatttcgtcgtcgatttgcggatttttatcgcggaggtttcgcgcgtcggtgtcgagggtcgaggagcgttcgggttcgggtaggtgatcgttcgtttttgttttgcgagggtcggtgcgatttagttgttgggggtttggtttttttattttgaaatcgggttttacgcgttttgttttgtttttaacgttttataatagtttcgttgggggattgaagcggttttatttcgtaaatattttttatttttaggagggaaaatttatt

SEQ ID NO: 30038 - DNA, 963 bp, Artificial Sequence
  chemically treated genomic DNA (Homo sapiens) CpG-island No: 30038
aataaattttccctcctaaaaataaaaaatatttacgaaataaaaccgcttcaatcccccaacgaaactattataaaacgttaaaaacaaaacaaaacgcgtaaaacccgatttcaaaataaaaaaaccaaacccccaacaactaaatcgcaccgaccctcgcaaaacaaaaacgaacgatcacctacccgaacccgaacgctcctcgaccctcgacaccgacgcgcgaaacctccgcgataaaaatccgcaaatcgacgacgaaatccaattcaaacaactatctctacataaattaatataaatcgtacgcatttaccgaactcgataacgccgcaaccccgaaaaaccgaatccaaactcctaacgcgaacgaccaacgaatcacctcccgttaataataataaccgaaacgcccaaataatacgacaaaaacgcgccgaacgaaaaaataacgacgaaactcgaataccgaaaccgcaacgcgccgatcgccgcctcgaaaccgccgaaaacgcaaaccaaaccgaaaacgacgaatacgacgccccccaacgatccgcgccgaaccaacacgcgataataattaaacaacacgaaaaacaactacgccgacgcgcccgaaacctcgaaaatcgaaaacgcgcaacactcgaataccgcgcgaaccaacgccaaccgcgccccgtcccgaacgacctaacgaacgactttaaccgaacccaacgcgaactcctcgcgataataaccgcaactcgaaaaactcgaaaacgcgatatcctcgccgaacctacgcacgacgacgacgaacgctacgaaaacaaacgacacgttaaaaaacaacaaaaaacgcgaccgcaaccaccccacccccaaaccccgaacgcaaccaccacccctcgaccgcccacgcgctacacccgcgaaatcgctatcgccctcccccgccttaatctaaaccgt

SEQ ID NO: 30039 - DNA, 963 bp, Artificial Sequence
  chemically treated genomic DNA (Homo sapiens) CpG-island No: 30039
ggtgggtttttttttttgaaagtggaggatatttgcggagtgaaatcgttttaattttttagcgggattgttgtggaacgttggggataaggtaagacgcgtgaagttcgattttaaggtgaggaaattaagtttttagtaattgggtcgtatcggttttcgtaggatagaggcgggcggttatttgttcggattcgggcgtttttcggttttcggtatcggcgcgcggggttttcgcggtggaaattcgtaagtcggcggcggggtttaatttaaatagttgtttttgtataaattaatgtaggtcgtgcgtatttgtcgggttcggtggcgtcgtagtttcgggaggtcgggtttaggtttttggcgcgggcggttagcgggttatttttcgttggtgatgatgatcgaggcgtttaggtagtgcggtaggggcgcgtcgggcggggaggtggcggcggggttcgggtgtcggagtcgtagcgcgtcggtcgtcgtttcggggtcgtcgggagcgtaggttaggtcggaggcggcgggtgcggcgttttttagcggttcgcgtcgggttagtacgcggtggtagttgagtagtacgaagggtagttgcgtcggcgcgttcggggtttcgggggtcgggggcgcgtagtattcgggtgtcgcgcgggttagcgttagtcgcgtttcgtttcgggcggtttggcgggcggttttggtcgggtttagcgcgggtttttcgcggtagtggtcgtagttcgggaagttcgggggcgcggtgttttcgtcgaatttgcgtacggcggcggcgggcgttgcggggataggcgatacgttagagggtagtaaggggcgcggtcgtagttattttatttttaagtttcgggcgtagttattatttttcggtcgtttacgcgttgtattcgcggggtcgttgtcgttttttttcgttttagtttaggtcgt

SEQ ID NO: 30040 - DNA, 963 bp, Artificial Sequence
  chemically treated genomic DNA (Homo sapiens) CpG-island No: 30040
acgacctaaactaaaacgaaaaaaaacgacaacgaccccgcgaatacaacgcgtaaacgaccgaaaaataataactacgcccgaaacttaaaaataaaataactacgaccgcgccccttactaccctctaacgtatcgcctatccccgcaacgcccgccgccgccgtacgcaaattcgacgaaaacaccgcgcccccgaacttcccgaactacgaccactaccgcgaaaaacccgcgctaaacccgaccaaaaccgcccgccaaaccgcccgaaacgaaacgcgactaacgctaacccgcgcgacacccgaatactacgcgcccccgacccccgaaaccccgaacgcgccgacgcaactacccttcgtactactcaactaccaccgcgtactaacccgacgcgaaccgctaaaaaacgccgcacccgccgcctccgacctaacctacgctcccgacgaccccgaaacgacgaccgacgcgctacgactccgacacccgaaccccgccgccacctccccgcccgacgcgcccctaccgcactacctaaacgcctcgatcatcatcaccaacgaaaaataacccgctaaccgcccgcgccaaaaacctaaacccgacctcccgaaactacgacgccaccgaacccgacaaatacgcacgacctacattaatttatacaaaaacaactatttaaattaaaccccgccgccgacttacgaatttccaccgcgaaaaccccgcgcgccgataccgaaaaccgaaaaacgcccgaatccgaacaaataaccgcccgcctctatcctacgaaaaccgatacgacccaattactaaaaacttaatttcctcaccttaaaatcgaacttcacgcgtcttaccttatccccaacgttccacaacaatcccgctaaaaaattaaaacgatttcactccgcaaatatcctccactttcaaaaaaaaaaacccacc

SEQ ID NO: 30041 - DNA, 629 bp, Artificial Sequence
  chemically treated genomic DNA (Homo sapiens) CpG-island No: 30041
agggcgcgtgggtcgtggcgggaggtcgcgttgttgggagtttacggttttcgtttttcgttttaggtttttttttagttattcgtagattaagatttatttttcgtatttcgatttgtattcggggttcgcgtagttgcgcgcgtacggttttaaggtggtggtcgtcgtgggcgacgcggtgaagagtatcgacgatatcggcggcgttttgtttaagttgagcgagttgtacgtttatattttgcgcgtggattcggttaattttaaggtgcgcggggcgcggtgcgggcggggcggggcggggtcgcggggcgggcggggtcgcggggcggggtcgcggggcggggcggggtggggtcgcggggcggggcggggtcgcggggcggggcggggcggggcggggcgggcggggcggtcggggttcggcggggcggggcggggcggggaggggttgggcggggcggggcgcggggcggggcgggtcgggtcggggcggggtcgcggggcggggtcgcggggcggggcgcggggcggggcggggcggggtggggtcgcggggcggggttcgggttaggtttcgttttcgtattgagtcgttttcgtttttagtttttgttttattgttt

SEQ ID NO: 30042 - DNA, 629 bp, Artificial Sequence
  chemically treated genomic DNA (Homo sapiens) CpG-island No: 30042
aaacaataaaacaaaaactaaaaacgaaaacgactcaatacgaaaacgaaacctaacccgaaccccgccccgcgaccccaccccgccccgccccgccccgcgccccgccccgcgaccccgccccgcgaccccgccccgacccgacccgccccgccccgcgccccgccccgcccaacccctccccgccccgccccgccccgccgaaccccgaccgccccgcccgccccgccccgccccgccccgccccgcgaccccgccccgccccgcgaccccaccccgccccgccccgcgaccccgccccgcgaccccgcccgccccgcgaccccgccccgccccgcccgcaccgcgccccgcgcaccttaaaattaaccgaatccacgcgcaaaatataaacgtacaactcgctcaacttaaacaaaacgccgccgatatcgtcgatactcttcaccgcgtcgcccacgacgaccaccaccttaaaaccgtacgcgcgcaactacgcgaaccccgaatacaaatcgaaatacgaaaaataaatcttaatctacgaataactaaaaaaaaacctaaaacgaaaaacgaaaaccgtaaactcccaacaacgcgacctcccgccacgacccacgcgccct

SEQ ID NO: 30043 - DNA, 629 bp, Artificial Sequence
  chemically treated genomic DNA (Homo sapiens) CpG-island No: 30043
aggtagtgggataggagttgggggcgggggcggtttagtgcgggggcggggtttagttcgggtttcgtttcgcgattttatttcgtttcgtttcgtttcgcgtttcgtttcgcgatttcgtttcgcgatttcgtttcggttcggttcgtttcgtttcgcgtttcgtttcgtttagttttttttcgtttcgtttcgtttcgtcgggtttcggtcgtttcgttcgtttcgtttcgtttcgtttcgtttcgcgatttcgtttcgtttcgcgattttatttcgtttcgtttcgcgatttcgtttcgcggtttcgttcgtttcgcggtttcgtttcgtttcgttcgtatcgcgtttcgcgtattttgaagttgatcgggtttacgcgtaggatgtaggcgtgtagttcgtttagtttggatagggcgtcgtcgatgtcgtcgatgttttttatcgcgtcgtttacggcggttattattttggagtcgtgcgcgcgtaattgcgcggatttcgggtgtaggtcgaagtgcgggaagtaggttttggtttgcgggtggttgaggaagagtttgggacggggggcgggggtcgtgagtttttagtagcgcggtttttcgttacggtttacgcgtttt

SEQ ID NO: 30044 - DNA, 629 bp, Artificial Sequence
  chemically treated genomic DNA (Homo sapiens) CpG-island No: 30044
aaaacgcgtaaaccgtaacgaaaaaccgcgctactaaaaactcacgacccccgccccccgtcccaaactcttcctcaaccacccgcaaaccaaaacctacttcccgcacttcgacctacacccgaaatccgcgcaattacgcgcgcacgactccaaaataataaccgccgtaaacgacgcgataaaaaacatcgacgacatcgacgacgccctatccaaactaaacgaactacacgcctacatcctacgcgtaaacccgatcaacttcaaaatacgcgaaacgcgatacgaacgaaacgaaacgaaaccgcgaaacgaacgaaaccgcgaaacgaaatcgcgaaacgaaacgaaataaaatcgcgaaacgaaacgaaatcgcgaaacgaaacgaaacgaaacgaaacgaacgaaacgaccgaaacccgacgaaacgaaacgaaacgaaaaaaaactaaacgaaacgaaacgcgaaacgaaacgaaccgaaccgaaacgaaatcgcgaaacgaaatcgcgaaacgaaacgcgaaacgaaacgaaacgaaataaaatcgcgaaacgaaacccgaactaaaccccgcccccgcactaaaccgcccccgcccccaactcctatcccactacct

SEQ ID NO: 30045 - DNA, 585 bp, Artificial Sequence
  chemically treated genomic DNA (Homo sapiens) CpG-island No: 30045
cgggtgcgcgtattttttttcgttttaggattgggcgaagtttttcggttcgtattcgttcgttcgtgtgtttttcgatttcgttggagtcgatgcgcgtttagcgcgtgttaggtcggggcgggggtgcgggttgattttttttttcgttagggacgtttcggcgttcgaaaggaaagggtggcgttgcgtttcggggtgtacgagtcgatagcgttcgattttaacgggtcggtttcgttagcgtcgttatcgttttgttttcgggcgagcgggatgggcgggagtggagtggcgggtggagggtggagacgttttggttttcgtttcgcgtgtatttttaggggaggtcgagttcgtcgttcggtttcgcgtaggtttcgttcgggatttttttgcggtttaggtcgcgtttcgggtttcgcgttagttaatgagcgtcgttcggtcgggcgtgttttcgcgttttaagtataaattttggcgcgttcgcgggtcggtatttttttggtttttatagatttagagagaatttattatggtgttgttttttgtcgataagattaacgttaaggtcgtttgggg

SEQ ID NO: 30046 - DNA, 585 bp, Artificial Sequence
  chemically treated genomic DNA (Homo sapiens) CpG-island No: 30046
ccccaaacgaccttaacgttaatcttatcgacaaaaaacaacaccataataaattctctctaaatctataaaaaccaaaaaaataccgacccgcgaacgcgccaaaatttatacttaaaacgcgaaaacacgcccgaccgaacgacgctcattaactaacgcgaaacccgaaacgcgacctaaaccgcaaaaaaatcccgaacgaaacctacgcgaaaccgaacgacgaactcgacctcccctaaaaatacacgcgaaacgaaaaccaaaacgtctccaccctccacccgccactccactcccgcccatcccgctcgcccgaaaacaaaacgataacgacgctaacgaaaccgacccgttaaaatcgaacgctatcgactcgtacaccccgaaacgcaacgccaccctttcctttcgaacgccgaaacgtccctaacgaaaaaaaaaatcaacccgcacccccgccccgacctaacacgcgctaaacgcgcatcgactccaacgaaatcgaaaaacacacgaacgaacgaatacgaaccgaaaaacttcgcccaatcctaaaacgaaaaaaaatacgcgcacccg

SEQ ID NO: 30047 - DNA, 585 bp, Artificial Sequence
  chemically treated genomic DNA (Homo sapiens) CpG-island No: 30047
ttttaggcggttttgacgttggttttgtcggtaggagatagtattatggtgggttttttttgagtttgtggggattagaagagtgtcggttcgcgagcgcgttagggtttatgtttggggcgcgggggtacgttcggtcgggcggcgtttattggttggcgcggagttcggggcgcggtttggatcgtaggggagtttcgggcggggtttgcgcggggtcgggcggcgggttcggttttttttgggggtgtacgcggggcgggggttaggacgtttttattttttattcgttattttattttcgtttatttcgttcgttcgggggtagggcggtagcggcgttggcggggtcggttcgttggggtcgggcgttgtcggttcgtgtatttcggagcgtagcgttatttttttttttcgggcgtcggagcgtttttagcgagggagaaagttagttcgtattttcgtttcggtttggtacgcgttggacgcgtatcgattttagcgggatcggggaatatacgggcgagcgagtgcgagtcggagggtttcgtttaattttggggcggagaggaatgcgcgtattcg

SEQ ID NO: 30048 - DNA, 585 bp, Artificial Sequence
  chemically treated genomic DNA (Homo sapiens) CpG-island No: 30048
cgaatacgcgcattcctctccgccccaaaattaaacgaaaccctccgactcgcactcgctcgcccgtatattccccgatcccgctaaaatcgatacgcgtccaacgcgtaccaaaccgaaacgaaaatacgaactaactttctccctcgctaaaaacgctccgacgcccgaaaaaaaaaaataacgctacgctccgaaatacacgaaccgacaacgcccgaccccaacgaaccgaccccgccaacgccgctaccgccctacccccgaacgaacgaaataaacgaaaataaaataacgaataaaaaataaaaacgtcctaacccccgccccgcgtacacccccaaaaaaaaccgaacccgccgcccgaccccgcgcaaaccccgcccgaaactcccctacgatccaaaccgcgccccgaactccgcgccaaccaataaacgccgcccgaccgaacgtacccccgcgccccaaacataaaccctaacgcgctcgcgaaccgacactcttctaatccccacaaactcaaaaaaaacccaccataatactatctcctaccgacaaaaccaacgtcaaaaccgcctaaaa

SEQ ID NO: 30049 - DNA, 557 bp, Artificial Sequence
  chemically treated genomic DNA (Homo sapiens) CpG-island No: 30049
ttattcgtattgttatcgttattttgattgttatcgttattttgattgttatcgttattcgtattgttatttttattcgtattgttatttttatttatattgttatcgttattcgtattgttatcgttattcgtattgttatcgttattcgtattgttatcgttattttgattgttatttttattcgtattgttatcgttattttgattgttatcgttattcgtattgttatcgttatttatattgttatttttattcgtattgttatcgttatttatattgttatcgttattcgtattgttatcgttattttgattgttatttttattcgtattgttatcgttattttgattgttatcgttatttataatgttatttttattcgtattgttatcgttattcgtattgttatttttattcgtattgttatcgttattcgtattgttatcgttattcgtattgttatcgttatttatattgttatcgttattcggattttttttaattttagaagattatattttttatggttaatttaggtcgaagtcgaaggattt

SEQ ID NO: 30050 - DNA, 557 bp, Artificial Sequence
  chemically treated genomic DNA (Homo sapiens) CpG-island No: 30050
aaatccttcgacttcgacctaaattaaccataaaaaatataatcttctaaaattaaaaaaaatccgaataacgataacaatataaataacgataacaatacgaataacgataacaatacgaataacgataacaatacgaataaaaataacaatacgaataacgataacaatacgaataaaaataacattataaataacgataacaatcaaaataacgataacaatacgaataaaaataacaatcaaaataacgataacaatacgaataacgataacaatataaataacgataacaatacgaataaaaataacaatataaataacgataacaatacgaataacgataacaatcaaaataacgataacaatacgaataaaaataacaatcaaaataacgataacaatacgaataacgataacaatacgaataacgataacaatacgaataacgataacaatataaataaaaataacaatacgaataaaaataacaatacgaataacgataacaatcaaaataacgataacaatcaaaataacgataacaatacgaataa

SEQ ID NO: 30051 - DNA, 557 bp, Artificial Sequence
  chemically treated genomic DNA (Homo sapiens) CpG-island No: 30051
gggtttttcggtttcgatttgggttggttatggggagtgtagttttttaaggttggagggggttcgggtggcgatggtagtgtgggtggcgatggtagtgcgggtagcgatggtagtgcgggtagcgatggtagtgcgggtggggatggtagtgcgggtggcgatggtagtgcgggtggggatggtattgtgggtggcgatggtagttagggtggcgatggtagtgcgggtggggatggtagttagagtggcgatggtagtgcgggtggcgatggtagtgtgggtggcgatggtagtgcgggtggggatggtagtgtgggtggcgatggtagtgcgggtggcgatggtagttagggtggcgatggtagtgcgggtggggatggtagttagagtggcgatggtagtgcgggtggcgatggtagtgcgggtggcgatggtagtgcgggtggcgatggtagtgtgggtggggatggtagtgcgggtggggatggtagtgcgggtggcgatggtagttagggtggcgatggtagttagggtggcgatggtagtgcgggtgg

SEQ ID NO: 30052 - DNA, 557 bp, Artificial Sequence
  chemically treated genomic DNA (Homo sapiens) CpG-island No: 30052
ccacccgcactaccatcgccaccctaactaccatcgccaccctaactaccatcgccacccgcactaccatccccacccgcactaccatccccacccacactaccatcgccacccgcactaccatcgccacccgcactaccatcgccacccgcactaccatcgccactctaactaccatccccacccgcactaccatcgccaccctaactaccatcgccacccgcactaccatcgccacccacactaccatccccacccgcactaccatcgccacccacactaccatcgccacccgcactaccatcgccactctaactaccatccccacccgcactaccatcgccaccctaactaccatcgccacccacaataccatccccacccgcactaccatcgccacccgcactaccatccccacccgcactaccatcgctacccgcactaccatcgctacccgcactaccatcgccacccacactaccatcgccacccgaaccccctccaaccttaaaaaactacactccccataaccaacccaaatcgaaaccgaaaaaccc

SEQ ID NO: 30053 - DNA, 1189 bp, Artificial Sequence
  chemically treated genomic DNA (Homo sapiens) CpG-island No: 30053
aatttcgatcgggggatcgaggaggaagcgcggggtttcgttcgtttcgatttttaggatacgaagcgttttaaagggttattgtgtatttttaattcgcggcggggatttttaatttcgcgtcggcgttagatgagcgtataggtgcgttcggggtgttataatttcgtttcgttcgtagtttcggttttacgttttcgatggcgttcgcgtttttcgtttatcgtttttttcgttgtagtcggcggaggtaggcgggggtcgggtaagtagtagtagtagtagcggtttcgttattatcgcggttatcgtttcgttttcggtttcggtgttagttcggtttatggtttcgcgttcggttcggcgttattcggttcgcgtttcgcgtcgtcggttttcgtcgtcgttcgggtagtttttgtcgttttcgtttttgtcgttttcgtttttgttttcggcgtttatggttcggtcggttttcgtcgtcgtcgtttcgggtattttcgttcgtaggtttcgtttcgtaggtcgagtcgggaaggcgagggcggggtcggggggcgggatcggggggggcgcggacgtcggggggaggggttacgtggggcgtcggtaggggggaggggttacgtggggcgcgcgggggacggatcggggcgcgcgcggttcggggggacgttggagggagggcgcgggatggagggatcgcgggggttttaggacggagaggtcgcgtcgggcgcgttcggaatacgtaggaaatttttttcgaggcgtgggtttcgcggggttttttcgtcggttcgttgagttttagtttcgttcggtcgggattttcgtggtagttcggggagtcgcgggggtagaggcgtcgattttcgtttgggatcgagaggaattcgcgttttgttttgtttcgttcggcgcgcgtgggtttgagttaggcgttttagtacggggattttcgggtcggtttttacgtcgtagagtcgttgtaggtgcgtgttagatttacgtttttatgtatagacgagaaggttgtttgtgtttagggattgtagtattcgatcggggtggcggtttatacgggtgcgtggtattaattttcggcgttttgtatttggatggatttttattatgtaagatttgagtcgaaaaaaggaagcgataaagtttagaaaattcgggg

SEQ ID NO: 30054 - DNA, 1189 bp, Artificial Sequence
  chemically treated genomic DNA (Homo sapiens) CpG-island No: 30054
ccccgaattttctaaactttatcgcttccttttttcgactcaaatcttacataataaaaatccatccaaatacaaaacgccgaaaattaataccacgcacccgtataaaccgccaccccgatcgaatactacaatccctaaacacaaacaaccttctcgtctatacataaaaacgtaaatctaacacgcacctacaacgactctacgacgtaaaaaccgacccgaaaatccccgtactaaaacgcctaactcaaacccacgcgcgccgaacgaaacaaaacaaaacgcgaattcctctcgatcccaaacgaaaatcgacgcctctacccccgcgactccccgaactaccacgaaaatcccgaccgaacgaaactaaaactcaacgaaccgacgaaaaaaccccgcgaaacccacgcctcgaaaaaaatttcctacgtattccgaacgcgcccgacgcgacctctccgtcctaaaacccccgcgatccctccatcccgcgccctccctccaacgtccccccgaaccgcgcgcgccccgatccgtcccccgcgcgccccacgtaacccctcccccctaccgacgccccacgtaacccctccccccgacgtccgcgccccccccgatcccgccccccgaccccgccctcgccttcccgactcgacctacgaaacgaaacctacgaacgaaaatacccgaaacgacgacgacgaaaaccgaccgaaccataaacgccgaaaacaaaaacgaaaacgacaaaaacgaaaacgacaaaaactacccgaacgacgacgaaaaccgacgacgcgaaacgcgaaccgaataacgccgaaccgaacgcgaaaccataaaccgaactaacaccgaaaccgaaaacgaaacgataaccgcgataataacgaaaccgctactactactactacttacccgacccccgcctacctccgccgactacaacgaaaaaaacgataaacgaaaaacgcgaacgccatcgaaaacgtaaaaccgaaactacgaacgaaacgaaattataacaccccgaacgcacctatacgctcatctaacgccgacgcgaaattaaaaatccccgccgcgaattaaaaatacacaataaccctttaaaacgcttcgtatcctaaaaatcgaaacgaacgaaaccccgcgcttcctcctcgatcccccgatcgaaatt

SEQ ID NO: 30055 - DNA, 1189 bp, Artificial Sequence
  chemically treated genomic DNA (Homo sapiens) CpG-island No: 30055
tttcgagttttttaggttttatcgtttttttttttcggtttaaattttatatggtgggaatttatttaggtgtaaagcgtcgggagttgatgttacgtattcgtgtgaatcgttatttcgatcgggtattatagtttttaaatataagtagttttttcgtttgtgtataaaagcgtggatttgatacgtatttgtagcggttttgcggcgtgaaggtcggttcgggggttttcgtgttgaggcgtttgatttaggtttacgcgcgtcgggcggggtagggtagggcgcgggtttttttcggttttaggcggaggtcggcgtttttgttttcgcggtttttcgagttgttacggaggtttcggtcgagcggagttgggatttagcgaatcggcggggaagtttcgcggagtttacgtttcggggagaattttttgcgtgtttcgagcgcgttcggcgcgattttttcgttttgggattttcgcgatttttttatttcgcgttttttttttagcgttttttcggatcgcgcgcgtttcggttcgtttttcgcgcgttttacgtgattttttttttttatcggcgttttacgtgattttttttttcggcgttcgcgtttttttcggtttcgtttttcgatttcgttttcgttttttcggttcggtttgcggggcggggtttgcgggcggaagtgttcggggcgacggcggcggggatcggtcgggttatgggcgtcgggggtagaggcggaggcggtagaggcggaggcggtagaggttgttcgggcggcggcgggggtcggcggcgcgggacgcgggtcgggtagcgtcgggtcgagcgcggagttatgggtcgggttggtatcgggatcgggggcgaggcggtggtcgcggtggtggcggggtcgttgttgttgttgttgtttgttcggttttcgtttgttttcgtcggttatagcgggaagagcggtgagcgggaggcgcgggcgttatcgggggcgtggggtcggggttgcgggcggggcgggattgtgatatttcgggcgtatttgtgcgtttatttggcgtcggcgcggggttgggggttttcgtcgcgggttgggggtgtatagtggttttttggggcgtttcgtgttttaggggtcgaggcggacgggatttcgcgtttttttttcggtttttcgatcggggtt

SEQ ID NO: 30056 - DNA, 1189 bp, Artificial Sequence
  chemically treated genomic DNA (Homo sapiens) CpG-island No: 30056
aaccccgatcgaaaaaccgaaaaaaaaacgcgaaatcccgtccgcctcgacccctaaaacacgaaacgccccaaaaaaccactatacacccccaacccgcgacgaaaacccccaaccccgcgccgacgccaaataaacgcacaaatacgcccgaaatatcacaatcccgccccgcccgcaaccccgaccccacgcccccgataacgcccgcgcctcccgctcaccgctcttcccgctataaccgacgaaaacaaacgaaaaccgaacaaacaacaacaacaacaacgaccccgccaccaccgcgaccaccgcctcgcccccgatcccgataccaacccgacccataactccgcgctcgacccgacgctacccgacccgcgtcccgcgccgccgacccccgccgccgcccgaacaacctctaccgcctccgcctctaccgcctccgcctctacccccgacgcccataacccgaccgatccccgccgccgtcgccccgaacacttccgcccgcaaaccccgccccgcaaaccgaaccgaaaaaacgaaaacgaaatcgaaaaacgaaaccgaaaaaaacgcgaacgccgaaaaaaaaaatcacgtaaaacgccgataaaaaaaaaaaatcacgtaaaacgcgcgaaaaacgaaccgaaacgcgcgcgatccgaaaaaacgctaaaaaaaaaacgcgaaataaaaaaatcgcgaaaatcccaaaacgaaaaaatcgcgccgaacgcgctcgaaacacgcaaaaaattctccccgaaacgtaaactccgcgaaacttccccgccgattcgctaaatcccaactccgctcgaccgaaacctccgtaacaactcgaaaaaccgcgaaaacaaaaacgccgacctccgcctaaaaccgaaaaaaacccgcgccctaccctaccccgcccgacgcgcgtaaacctaaatcaaacgcctcaacacgaaaacccccgaaccgaccttcacgccgcaaaaccgctacaaatacgtatcaaatccacgcttttatacacaaacgaaaaaactacttatatttaaaaactataatacccgatcgaaataacgattcacacgaatacgtaacatcaactcccgacgctttacacctaaataaattcccaccatataaaatttaaaccgaaaaaaaaaaacgataaaacctaaaaaactcgaaa

SEQ ID NO: 30057 - DNA, 792 bp, Artificial Sequence
  chemically treated genomic DNA (Homo sapiens) CpG-island No: 30057
tcggggttcgtagttttcggtcggttgcgtttagtatagtaggttttggatttcgcggttcggtagggggatttttatttcggtttattcggttttttaaagggtttttgcggaagtggatttcgtgtacgtttatatgcgtttttttattcgcgttgatcgtttaaatgacgttttcgggtagttcggttttcgtcgcgtcggttacgtcggttacgtcgagttcgggttttcggatcgtcggcggtagtagtagtagtagtagtcgtaggagcgttatagcggtttttttaatcgtttaggtttttagtatggcggttattattacgggggtagttttcgtcgattttcgttttcggtcggttgttaggttatttcggatttagaaaaatagcgttacgggtcgtttcgtttgagtcgtcggggatatgtcgtttttaggtttttttttttttagttacgggtatcgttttttattttaggaataatttatttcgtcgttttgttttcggttacgacgttgtagttaattagcgttcggtttttattaattatttattatttcgtcgggaggcgttcgtttattggttgttaggcgcgggaaagggcgtggttttttttaggcgtcggtttagtagtcgggtattagatggagcgcgcgtagagggagtgagttcggttgaagcggcggttcgatgcggaagtggcgggtgtagcgtttaggcggtttcggaattttatagttgaatgggaaaggtggtttggggggggaaggtttagggtagggcgtat

SEQ ID NO: 30058 - DNA, 792 bp, Artificial Sequence
  chemically treated genomic DNA (Homo sapiens) CpG-island No: 30058
atacgccctaccctaaaccttccccccccaaaccacctttcccattcaactataaaattccgaaaccgcctaaacgctacacccgccacttccgcatcgaaccgccgcttcaaccgaactcactccctctacgcgcgctccatctaatacccgactactaaaccgacgcctaaaaaaaaccacgccctttcccgcgcctaacaaccaataaacgaacgcctcccgacgaaataataaataattaataaaaaccgaacgctaattaactacaacgtcgtaaccgaaaacaaaacgacgaaataaattattcctaaaataaaaaacgatacccgtaactaaaaaaaaaaaaacctaaaaacgacatatccccgacgactcaaacgaaacgacccgtaacgctatttttctaaatccgaaataacctaacaaccgaccgaaaacgaaaatcgacgaaaactacccccgtaataataaccgccatactaaaaacctaaacgattaaaaaaaccgctataacgctcctacgactactactactactactaccgccgacgatccgaaaacccgaactcgacgtaaccgacgtaaccgacgcgacgaaaaccgaactacccgaaaacgtcatttaaacgatcaacgcgaataaaaaaacgcatataaacgtacacgaaatccacttccgcaaaaaccctttaaaaaaccgaataaaccgaaataaaaatccccctaccgaaccgcgaaatccaaaacctactatactaaacgcaaccgaccgaaaactacgaaccccga

SEQ ID NO: 30059 - DNA, 792 bp, Artificial Sequence
  chemically treated genomic DNA (Homo sapiens) CpG-island No: 30059
gtgcgttttattttaaattttttttttttaggttattttttttatttagttgtgggatttcggggtcgtttgggcgttgtattcgttattttcgtatcgaatcgtcgttttaatcgaatttattttttttgcgcgcgttttatttggtgttcgattgttgggtcggcgtttgggaaaagttacgttttttttcgcgtttgatagttaatgagcgggcgtttttcggcggggtggtgggtaattaatgagggtcgggcgttgattggttgtagcgtcgtggtcgggggtagggcggcggggtaggttgtttttgaggtgggaggcggtattcgtggttgagaagaaggaggtttgagagcgatatgttttcggcggtttaggcggagcggttcgtggcgttgtttttttgagttcggggtggtttggtagtcggtcgaggacgagggtcggcgggggttgttttcgtggtggtggtcgttatgttgggagtttgggcggttgagggaatcgttgtggcgtttttgcgattgttgttgttgttgttgtcgtcggcgattcggggattcgggttcggcgtggtcggcgtggtcggcgcggcgggggtcgggttgttcgagagcgttatttgggcggttaacgcgggtggagaggcgtatgtggacgtgtacgggatttattttcgtaaggattttttggaaggtcgggtgggtcgaggtgagagtttttttgtcgagtcgcgggatttagggtttgttgtgttgggcgtagtcggtcgggggttgcgggtttcga

SEQ ID NO: 30060 - DNA, 792 bp, Artificial Sequence
  chemically treated genomic DNA (Homo sapiens) CpG-island No: 30060
tcgaaacccgcaacccccgaccgactacgcccaacacaacaaaccctaaatcccgcgactcgacaaaaaaactctcacctcgacccacccgaccttccaaaaaatccttacgaaaataaatcccgtacacgtccacatacgcctctccacccgcgttaaccgcccaaataacgctctcgaacaacccgacccccgccgcgccgaccacgccgaccacgccgaacccgaatccccgaatcgccgacgacaacaacaacaacaacaatcgcaaaaacgccacaacgattccctcaaccgcccaaactcccaacataacgaccaccaccacgaaaacaacccccgccgaccctcgtcctcgaccgactaccaaaccaccccgaactcaaaaaaacaacgccacgaaccgctccgcctaaaccgccgaaaacatatcgctctcaaacctccttcttctcaaccacgaataccgcctcccacctcaaaaacaacctaccccgccgccctacccccgaccacgacgctacaaccaatcaacgcccgaccctcattaattacccaccaccccgccgaaaaacgcccgctcattaactatcaaacgcgaaaaaaaacgtaacttttcccaaacgccgacccaacaatcgaacaccaaataaaacgcgcgcaaaaaaaataaattcgattaaaacgacgattcgatacgaaaataacgaatacaacgcccaaacgaccccgaaatcccacaactaaataaaaaaaataacctaaaaaaaaaaaatttaaaataaaacgcac

SEQ ID NO: 30061 - DNA, 576 bp, Artificial Sequence
  chemically treated genomic DNA (Homo sapiens) CpG-island No: 30061
  misc_feature (437)..(437): n is either a, c, g or t
gtcggagttttttagttaacgacggtcgtaattatcgtaacgttcggaacgagcgtatcgtaggaaattaacgtacgtatacgttcgatatgtaatcgttgtttcgttaaagtgttttcgagcgtatcgatatcgttagttaacgttacgcgtgatataattttaatcgttagtttcgtagttacgcggcgcgtattgttattagttaacgtattaattaatatattacggcgtaattttaaatggttttcgtttattttcgatatcgtatatttttttttttttttcgtaaacgttttattttttttttaaaaaagtagttcgtttttttcgttatcgcgtttttgtttttaatataacgtgcgtagcgtttagacgcgtatttttttttttcgttagggttatcgtacgtttcgcgatgagtttacgtatcgaanacgtatcgcgtttttttcgtattattgtttattagagtataaacgtttatacgttttacgattttaacgcgttaagcgtgatacgcgtaaacgatttaatcgtggtgatcgatgtaaacgattttattttttatcgttt

SEQ ID NO: 30062 - DNA, 576 bp, Artificial Sequence
  chemically treated genomic DNA (Homo sapiens) CpG-island No: 30062
  misc_feature (140)..(140): n is either a, c, g or t
aaacgataaaaaataaaatcgtttacatcgatcaccacgattaaatcgtttacgcgtatcacgcttaacgcgttaaaatcgtaaaacgtataaacgtttatactctaataaacaataatacgaaaaaaacgcgatacgtnttcgatacgtaaactcatcgcgaaacgtacgataaccctaacgaaaaaaaaaaatacgcgtctaaacgctacgcacgttatattaaaaacaaaaacgcgataacgaaaaaaacgaactacttttttaaaaaaaaaataaaacgtttacgaaaaaaaaaaaaaaatatacgatatcgaaaataaacgaaaaccatttaaaattacgccgtaatatattaattaatacgttaactaataacaatacgcgccgcgtaactacgaaactaacgattaaaattatatcacgcgtaacgttaactaacgatatcgatacgctcgaaaacactttaacgaaacaacgattacatatcgaacgtatacgtacgttaatttcctacgatacgctcgttccgaacgttacgataattacgaccgtcgttaactaaaaaactccgac

SEQ ID NO: 30063 - DNA, 576 bp, Artificial Sequence
  chemically treated genomic DNA (Homo sapiens) CpG-island No: 30063
  misc_feature (140)..(140): n is either a, c, g or t
aggcggtaaggggtggggtcgtttgtatcgattattacggttaggtcgtttgcgcgtattacgtttagcgcgttgggatcgtaaggcgtgtaggcgtttatgttttgataggtagtagtgcgggggaagcgcgatgcgtnttcggtgcgtggatttatcgcggggcgtgcggtggttttggcggagagaggggatacgcgtttaagcgttacgtacgttgtgttagggatagagacgcggtagcggggggggcgaattgtttttttgagaggaaggtgaggcgtttgcggagaaggggaaggagtgtgcggtgtcgggggtgggcgagagttatttaggattgcgtcgtggtatgttagttggtgcgttggttgataatagtgcgcgtcgcgtagttgcgaagttggcggttggggttgtattacgcgtgacgttggttggcggtgtcggtgcgttcgggaatattttagcgggataacggttgtatatcgaacgtgtgcgtgcgttggttttttacggtgcgttcgtttcgggcgttacgatggttgcggtcgtcgttgattagggggtttcggt

SEQ ID NO: 30064 - DNA, 576 bp, Artificial Sequence
  chemically treated genomic DNA (Homo sapiens) CpG-island No: 30064
  misc_feature (437)..(437): n is either a, c, g or t
accgaaaccccctaatcaacgacgaccgcaaccatcgtaacgcccgaaacgaacgcaccgtaaaaaaccaacgcacgcacacgttcgatatacaaccgttatcccgctaaaatattcccgaacgcaccgacaccgccaaccaacgtcacgcgtaatacaaccccaaccgccaacttcgcaactacgcgacgcgcactattatcaaccaacgcaccaactaacataccacgacgcaatcctaaataactctcgcccacccccgacaccgcacactccttccccttctccgcaaacgcctcaccttcctctcaaaaaaacaattcgccccccccgctaccgcgtctctatccctaacacaacgtacgtaacgcttaaacgcgtatcccctctctccgccaaaaccaccgcacgccccgcgataaatccacgcaccgaanacgcatcgcgcttcccccgcactactacctatcaaaacataaacgcctacacgccttacgatcccaacgcgctaaacgtaatacgcgcaaacgacctaaccgtaataatcgatacaaacgaccccaccccttaccgcct

SEQ ID NO: 30065 - DNA, 518 bp, Artificial Sequence
  chemically treated genomic DNA (Homo sapiens) CpG-island No: 30065
tttcggatttttgtttttataagttttgtttcggaggcgggggagttggattagtagtcgtttggagcgttcgagttatcgtcgtcggggttttcgcgttttttagaacggtgggacgcggggttcggtagtcgttagcggaatatggcgttttggacgttgtggcgttgttgttagcgcgtcgtgggttgggtgtcggtgttttttattattttcgtggtcgtttggttttattacgcgtacgtggtggagttttgcgtgtgtgagtatcgttttcggggattgcggcggggcgcgggtcgcggttagggcgcgagataggtttttgcgttttatattcgtcgtttttttggagttagcgtcggacgtcgggcgttcggtttcgaacgcgttcggaagcgtcgaggttgttgtattcgtcgttttgtttaattttgcggcgcggttttggggcgatttggggtttttgaagttttgcggcggtttttcgggtgtaggtttggtttagggaggtttta

SEQ ID NO: 30066 - DNA, 518 bp, Artificial Sequence
  chemically treated genomic DNA (Homo sapiens) CpG-island No: 30066
taaaacctccctaaaccaaacctacacccgaaaaaccgccgcaaaacttcaaaaaccccaaatcgccccaaaaccgcgccgcaaaattaaacaaaacgacgaatacaacaacctcgacgcttccgaacgcgttcgaaaccgaacgcccgacgtccgacgctaactccaaaaaaacgacgaatataaaacgcaaaaacctatctcgcgccctaaccgcgacccgcgccccgccgcaatccccgaaaacgatactcacacacgcaaaactccaccacgtacgcgtaataaaaccaaacgaccacgaaaataataaaaaacaccgacacccaacccacgacgcgctaacaacaacgccacaacgtccaaaacgccatattccgctaacgactaccgaaccccgcgtcccaccgttctaaaaaacgcgaaaaccccgacgacgataactcgaacgctccaaacgactactaatccaactcccccgcctccgaaacaaaacttataaaaacaaaaatccgaaa

SEQ ID NO: 30067 - DNA, 518 bp, Artificial Sequence
  chemically treated genomic DNA (Homo sapiens) CpG-island No: 30067
tggggtttttttgggttagatttgtattcgggaagtcgtcgtaaggttttaggagttttaggtcgttttaaggtcgcgtcgtaggattgaataaagcggcgggtgtagtaatttcggcgttttcgagcgcgttcggggtcggacgttcggcgttcggcgttggttttagaaaggcggcgggtgtggggcgtagaggtttatttcgcgttttagtcgcggttcgcgtttcgtcgtagttttcggggacggtatttatatacgtagagttttattacgtacgcgtagtaggattagacgattacgaaggtgatgaagagtatcggtatttagtttacgacgcgttggtagtagcgttatagcgtttagggcgttatgtttcgttggcggttgtcgagtttcgcgttttatcgttttggggagcgcgggagtttcggcgacggtgattcggacgttttaggcggttgttggtttagttttttcgttttcgaggtaggatttgtgggagtaaaagttcgagg

SEQ ID NO: 30068 - DNA, 518 bp, Artificial Sequence
  chemically treated genomic DNA (Homo sapiens) CpG-island No: 30068
cctcgaacttttactcccacaaatcctacctcgaaaacgaaaaaactaaaccaacaaccgcctaaaacgtccgaatcaccgtcgccgaaactcccgcgctccccaaaacgataaaacgcgaaactcgacaaccgccaacgaaacataacgccctaaacgctataacgctactaccaacgcgtcgtaaactaaataccgatactcttcatcaccttcgtaatcgtctaatcctactacgcgtacgtaataaaactctacgtatataaataccgtccccgaaaactacgacgaaacgcgaaccgcgactaaaacgcgaaataaacctctacgccccacacccgccgcctttctaaaaccaacgccgaacgccgaacgtccgaccccgaacgcgctcgaaaacgccgaaattactacacccgccgctttattcaatcctacgacgcgaccttaaaacgacctaaaactcctaaaaccttacgacgacttcccgaatacaaatctaacccaaaaaaacccca

SEQ ID NO: 30069 - DNA, 1099 bp, Artificial Sequence
  chemically treated genomic DNA (Homo sapiens) CpG-island No: 30069
taggttttcgaaacgcggttttttttcggttttagttgtttttttgttagcgttgggagattcggtagtcgtagcgtttttagcggcgcgtagcggtttaggaagagagtgtttatcgtcggcgtttttttagtttttttttggaacgcgggagcgggcgcgattagcgtttattttgatcgtcgcgacggtgtttttgattggttgcgttgtgtgacgtaacgggagggtttcggcggtcgtcgggagtcggggtttagcgcgtgcgtagacggagcgcgttgagcggagggggaggtggttgtcgtttttttcgcgttcgttattttgttgttgtggttattgggaataagttgggtaaaagtatttcggaggcgcgacgttttttcgagttcggtgtttcgtgtgacggcgggggtcggtgaagattcgtcgagttgcggcgtcggcgcgttttaggtcgggagttattggaggtatttttgggacgtcgagtagttcgagaatttcggggtggttttcgttgcggttcgggtttgtttgtttcgatttttcggttttgtcgtgtattttcgggcggtttttttcgtgtggcggtttcggagtaggcgggcggcgtcggaggatgttgcgggttcggagtcgagaggaaagtgttggtttagttttttgagcgtttttcgaggtgtgcgagaggttttttttcggttttaaagtcgtttgtcgggttaaggcgtgtagagtaggcgaggatagtcgtcgtttttatcgtcgtagagttttcggtttaatattatgtttttcgttaggttcgatttttcggatcgtttcgtttggtatatggggtcggtgtttcgttaggaggcgtagattcggttttagggttagcgttacggtatgtttttcgttcgcgatttttttatttgttttggggattatgtgttgtcggtgttcgagaattcgcgggttttttattatattattaattcgttgtttaatcgtcgttttaagatcggggattaggaatttgattatttgtcggttttgttggagttttataagatttattatttggatattattatttttatcgagtttg

SEQ ID NO: 30070 - DNA, 1099 bp, Artificial Sequence
  chemically treated genomic DNA (Homo sapiens) CpG-island No: 30070
caaactcgataaaaataataatatccaaataataaatcttataaaactccaacaaaaccgacaaataatcaaattcctaatccccgatcttaaaacgacgattaaacaacgaattaataatataataaaaaacccgcgaattctcgaacaccgacaacacataatccccaaaacaaataaaaaaatcgcgaacgaaaaacataccgtaacgctaaccctaaaaccgaatctacgcctcctaacgaaacaccgaccccatataccaaacgaaacgatccgaaaaatcgaacctaacgaaaaacataatattaaaccgaaaactctacgacgataaaaacgacgactatcctcgcctactctacacgccttaacccgacaaacgactttaaaaccgaaaaaaaacctctcgcacacctcgaaaaacgctcaaaaaactaaaccaacactttcctctcgactccgaacccgcaacatcctccgacgccgcccgcctactccgaaaccgccacacgaaaaaaaccgcccgaaaatacacgacaaaaccgaaaaatcgaaacaaacaaacccgaaccgcaacgaaaaccaccccgaaattctcgaactactcgacgtcccaaaaatacctccaataactcccgacctaaaacgcgccgacgccgcaactcgacgaatcttcaccgacccccgccgtcacacgaaacaccgaactcgaaaaaacgtcgcgcctccgaaatacttttacccaacttattcccaataaccacaacaacaaaataacgaacgcgaaaaaaacgacaaccacctccccctccgctcaacgcgctccgtctacgcacgcgctaaaccccgactcccgacgaccgccgaaaccctcccgttacgtcacacaacgcaaccaatcaaaaacaccgtcgcgacgatcaaaataaacgctaatcgcgcccgctcccgcgttccaaaaaaaaactaaaaaaacgccgacgataaacactctcttcctaaaccgctacgcgccgctaaaaacgctacgactaccgaatctcccaacgctaacaaaaaaacaactaaaaccgaaaaaaaaccgcgtttcgaaaaccta

SEQ ID NO: 30071 - DNA, 1099 bp, Artificial Sequence
  chemically treated genomic DNA (Homo sapiens) CpG-island No: 30071
taggttcgatgagggtggtggtgtttaggtagtggattttgtaaaattttagtagggtcggtaaatggttaaatttttggttttcgattttaaaacggcggttgggtagcgagttgatgatgtagtgggagattcgcgagttttcggatatcgatagtatatagtttttagggtaggtggaagaatcgcggacgaggaatatatcgtggcgttggttttggagtcgggtttgcgttttttggcgagatatcggttttatatattaggcggagcggttcgaggagtcgaatttggcggaggatatggtgttggatcggggattttgcggcggtaggggcggcggttgttttcgtttgttttgtacgttttagttcggtagacggttttggggtcgaggaagggtttttcgtatatttcgaggagcgtttagagggttgggttagtatttttttttcggtttcgggttcgtagtatttttcgacgtcgttcgtttgtttcggggtcgttatacggagagagtcgttcgggaatgtacggtagagtcggggggtcggggtaggtaaattcgagtcgtagcggaggttatttcggggttttcgggttgttcggcgttttaggggtgtttttagtgattttcggtttggaacgcgtcggcgtcgtagttcgacgggtttttatcgattttcgtcgttatacgaggtatcgaattcgaaggagcgtcgcgttttcggggtgtttttgtttagtttgtttttaatagttatagtaataaaatggcggacgcgggagaagcggtagttattttttttttcgtttagcgcgtttcgtttgcgtacgcgttgggtttcggttttcggcggtcgtcggggttttttcgttacgttatatagcgtagttaattaggagtatcgtcgcgacgattagggtgggcgttggtcgcgttcgttttcgcgttttaggaggaggttgaagaggcgtcggcggtaggtattttttttttgggtcgttgcgcgtcgttgggggcgttgcggttgtcgggttttttagcgttggtaggaaaatagttggagtcgagagggaatcgcgtttcgaaaatttg

SEQ ID NO: 30072 - DNA, 1099 bp, Artificial Sequence
  chemically treated genomic DNA (Homo sapiens) CpG-island No: 30072
caaattttcgaaacgcgattccctctcgactccaactattttcctaccaacgctaaaaaacccgacaaccgcaacgcccccaacgacgcgcaacgacccaaaaaaaaaatacctaccgccgacgcctcttcaacctcctcctaaaacgcgaaaacgaacgcgaccaacgcccaccctaatcgtcgcgacgatactcctaattaactacgctatataacgtaacgaaaaaaccccgacgaccgccgaaaaccgaaacccaacgcgtacgcaaacgaaacgcgctaaacgaaaaaaaaaataactaccgcttctcccgcgtccgccattttattactataactattaaaaacaaactaaacaaaaacaccccgaaaacgcgacgctccttcgaattcgatacctcgtataacgacgaaaatcgataaaaacccgtcgaactacgacgccgacgcgttccaaaccgaaaatcactaaaaacacccctaaaacgccgaacaacccgaaaaccccgaaataacctccgctacgactcgaatttacctaccccgaccccccgactctaccgtacattcccgaacgactctctccgtataacgaccccgaaacaaacgaacgacgtcgaaaaatactacgaacccgaaaccgaaaaaaaaatactaacccaaccctctaaacgctcctcgaaatatacgaaaaacccttcctcgaccccaaaaccgtctaccgaactaaaacgtacaaaacaaacgaaaacaaccgccgcccctaccgccgcaaaatccccgatccaacaccatatcctccgccaaattcgactcctcgaaccgctccgcctaatatataaaaccgatatctcgccaaaaaacgcaaacccgactccaaaaccaacgccacgatatattcctcgtccgcgattcttccacctaccctaaaaactatatactatcgatatccgaaaactcgcgaatctcccactacatcatcaactcgctacccaaccgccgttttaaaatcgaaaaccaaaaatttaaccatttaccgaccctactaaaattttacaaaatccactacctaaacaccaccaccctcatcgaaccta

SEQ ID NO: 30073 - DNA, 592 bp, Artificial Sequence
  chemically treated genomic DNA (Homo sapiens) CpG-island No: 30073
ttagattcgggttcggggcgttttcggttagagcggtttttggttgtttttttacgtttcgcgatttcggttcggacgtcgagggtttcggtttgtttttgtttttcggtcgttttttatttgtttcggttcggcggggcggtgttgggttcgcgggtttttcggtcgtagtgtaaacgtagcgttagatacgtttcgttcgcgttttttcgttttttcgcgttcgcggttttaagcggttttcgagtttaggttcgcgtcgagtttaggtgagcgttcgtttcggggattttggttttcggaatttcggttttcgttcgtcgtttcgttttttcgtttcggcgtcgggggttagcgtttgcgtttttaagtttcggatttcggttcggtacgttaggggttgggggttggtaagcggggttagaggtattggtcggggttcgaagtttatttcgtttttttttcgttttataacggttttttttcggttcgtcgcggggttttattgtgtgttagttttttttttcgggttgtaaggtttggcgggggtaacgggacggagtcggcgaggttgttggtatcggttttttag

SEQ ID NO: 30074 - DNA, 592 bp, Artificial Sequence
  chemically treated genomic DNA (Homo sapiens) CpG-island No: 30074
ctaaaaaaccgataccaacaacctcgccgactccgtcccgttacccccgccaaaccttacaacccgaaaaaaaaaactaacacacaataaaaccccgcgacgaaccgaaaaaaaaccgttataaaacgaaaaaaaaacgaaataaacttcgaaccccgaccaatacctctaaccccgcttaccaacccccaacccctaacgtaccgaaccgaaatccgaaacttaaaaacgcaaacgctaacccccgacgccgaaacgaaaaaacgaaacgacgaacgaaaaccgaaattccgaaaaccaaaatccccgaaacgaacgctcacctaaactcgacgcgaacctaaactcgaaaaccgcttaaaaccgcgaacgcgaaaaaacgaaaaaacgcgaacgaaacgtatctaacgctacgtttacactacgaccgaaaaacccgcgaacccaacaccgccccgccgaaccgaaacaaataaaaaacgaccgaaaaacaaaaacaaaccgaaaccctcgacgtccgaaccgaaatcgcgaaacgtaaaaaaacaaccaaaaaccgctctaaccgaaaacgccccgaacccgaatctaa

SEQ ID NO: 30075 - DNA, 592 bp, Artificial Sequence
  chemically treated genomic DNA (Homo sapiens) CpG-island No: 30075
ttgggaagtcgatgttagtagtttcgtcggtttcgtttcgttgttttcgttagattttgtagttcgagaagggggattggtatatagtggggtttcgcggcgagtcgggaaggggtcgttgtgggacgagagaaggacgaggtgagtttcggatttcggttagtgtttttggtttcgtttgttaatttttagtttttaacgtgtcgggtcggggttcgagatttgggagcgtaagcgttggttttcggcgtcggggcgaagaggcggggcggcgggcggggatcggggtttcggggattagggttttcggggcgggcgtttatttgggttcggcgcgggtttgggttcgggaatcgtttggggtcgcgggcgcgggggggcggggaggcgcgggcggggcgtgtttggcgttgcgtttgtattgcggtcggggagttcgcgggtttagtatcgtttcgtcgggtcggagtaggtggggggcggtcgggggataggggtaggtcgaggttttcggcgttcggatcggagtcgcggggcgtagggaggtagttaggggtcgttttggtcgggggcgtttcgggttcgagtttgg

SEQ ID NO: 30076 - DNA, 592 bp, Artificial Sequence
  chemically treated genomic DNA (Homo sapiens) CpG-island No: 30076
ccaaactcgaacccgaaacgcccccgaccaaaacgacccctaactacctccctacgccccgcgactccgatccgaacgccgaaaacctcgacctacccctatcccccgaccgccccccacctactccgacccgacgaaacgatactaaacccgcgaactccccgaccgcaatacaaacgcaacgccaaacacgccccgcccgcgcctccccgcccccccgcgcccgcgaccccaaacgattcccgaacccaaacccgcgccgaacccaaataaacgcccgccccgaaaaccctaatccccgaaaccccgatccccgcccgccgccccgcctcttcgccccgacgccgaaaaccaacgcttacgctcccaaatctcgaaccccgacccgacacgttaaaaactaaaaattaacaaacgaaaccaaaaacactaaccgaaatccgaaactcacctcgtccttctctcgtcccacaacgaccccttcccgactcgccgcgaaaccccactatataccaatcccccttctcgaactacaaaatctaacgaaaacaacgaaacgaaaccgacgaaactactaacatcgacttcccaa

SEQ ID NO: 30077 - DNA, 721 bp, Artificial Sequence
  chemically treated genomic DNA (Homo sapiens) CpG-island No: 30077
cggtagcggtagacgatttaggtcggagttacgcgtagatttagggtatgtcgggaattgcgagtcggtcgcgggttttcgggttgcgtgggtttgggaggcgtcgggaagagtagtcgcgacggggttagggacgatatattgtatttattggaagggataacgtagcgttagtatatagtttgaaacgttttttagaaggttttacgttcgtcgcgcggtcgataatcgtattttgcgttcgttcgcggtgtttcggtaagcggtaggtttgtcgggaagagttggagggcgtaagtgcggcgttggtcggacgtgtcgtatcgttagcgtagggttcgtcgggaaatgtggtttttttagtcggttcggggcggtggtcgtaagttgggtttatagcgcggtcgattcggcgtggattcgggatggttggatcgggtagtacgggggggtagatcggggttgcggttttggtaggcggcgcgcggtttaaggtagtttcgagcgtggatttcgattatagttgttcggatagtgtcgagtatttgacgtttaatttcgggtttttcgaaatagtgtatcgttggcggcgtttttcgttttgcgacgagttcgtgggtgttcggtacggtgggttttatggggttttgaggataggaagggcgatttgcgagggttttagggcgggtttaggggcgaagtcggggggtggtgttttggg

SEQ ID NO: 30078 - DNA, 721 bp, Artificial Sequence
  chemically treated genomic DNA (Homo sapiens) CpG-island No: 30078
cccaaaacaccaccccccgacttcgcccctaaacccgccctaaaaccctcgcaaatcgcccttcctatcctcaaaaccccataaaacccaccgtaccgaacacccacgaactcgtcgcaaaacgaaaaacgccgccaacgatacactatttcgaaaaacccgaaattaaacgtcaaatactcgacactatccgaacaactataatcgaaatccacgctcgaaactaccttaaaccgcgcgccgcctaccaaaaccgcaaccccgatctacccccccgtactacccgatccaaccatcccgaatccacgccgaatcgaccgcgctataaacccaacttacgaccaccgccccgaaccgactaaaaaaaccacatttcccgacgaaccctacgctaacgatacgacacgtccgaccaacgccgcacttacgccctccaactcttcccgacaaacctaccgcttaccgaaacaccgcgaacgaacgcaaaatacgattatcgaccgcgcgacgaacgtaaaaccttctaaaaaacgtttcaaactatatactaacgctacgttatcccttccaataaatacaatatatcgtccctaaccccgtcgcgactactcttcccgacgcctcccaaacccacgcaacccgaaaacccgcgaccgactcgcaattcccgacataccctaaatctacgcgtaactccgacctaaatcgtctaccgctaccg

SEQ ID NO: 30079 - DNA, 721 bp, Artificial Sequence
  chemically treated genomic DNA (Homo sapiens) CpG-island No: 30079
tttaggatattatttttcggtttcgtttttggattcgttttgggattttcgtagatcgttttttttgtttttaggattttatgaagtttatcgtatcgggtatttacgaattcgtcgtagggcgggaggcgtcgttagcgatgtattgtttcgaagggttcgaagttgagcgttaggtattcgatattgttcgagtagttatggtcgaagtttacgttcggggttattttggatcgcgcgtcgtttgttagggtcgtagtttcgatttgttttttcgtgttgttcggtttagttatttcgggtttacgtcggatcggtcgcgttgtaagtttaatttgcggttatcgtttcgggtcggttggagaaattatatttttcggcgagttttgcgttgacggtgcggtacgttcggttagcgtcgtatttgcgttttttagtttttttcgataagtttatcgtttgtcgagatatcgcgggcgagcgtaggatgcggttgtcgatcgcgcggcgagcgtgggattttttggggagcgttttaggttatgtattggcgttgcgttgttttttttagtgaatgtagtgtgtcgtttttagtttcgtcgcgattgtttttttcggcgttttttaggtttacgtagttcgaagattcgcggtcggttcgtagttttcggtatgttttgggtttgcgcgtggtttcggtttggatcgtttgtcgttgtcg

SEQ ID NO: 30080 - DNA, 721 bp, Artificial Sequence
  chemically treated genomic DNA (Homo sapiens) CpG-island No: 30080
cgacaacgacaaacgatccaaaccgaaaccacgcgcaaacccaaaacataccgaaaactacgaaccgaccgcgaatcttcgaactacgtaaacctaaaaaacgccgaaaaaaacaatcgcgacgaaactaaaaacgacacactacattcactaaaaaaaacaacgcaacgccaatacataacctaaaacgctccccaaaaaatcccacgctcgccgcgcgatcgacaaccgcatcctacgctcgcccgcgatatctcgacaaacgataaacttatcgaaaaaaactaaaaaacgcaaatacgacgctaaccgaacgtaccgcaccgtcaacgcaaaactcgccgaaaaatataatttctccaaccgacccgaaacgataaccgcaaattaaacttacaacgcgaccgatccgacgtaaacccgaaataactaaaccgaacaacacgaaaaaacaaatcgaaactacgaccctaacaaacgacgcgcgatccaaaataaccccgaacgtaaacttcgaccataactactcgaacaatatcgaatacctaacgctcaacttcgaacccttcgaaacaatacatcgctaacgacgcctcccgccctacgacgaattcgtaaatacccgatacgataaacttcataaaatcctaaaaacaaaaaaaacgatctacgaaaatcccaaaacgaatccaaaaacgaaaccgaaaaataatatcctaaa

SEQ ID NO: 30081 - DNA, 642 bp, Artificial Sequence
  chemically treated genomic DNA (Homo sapiens) CpG-island No: 30081
ggttcgcgttttttgggttttgcggatttgggttcgggggcgcgcgtttcgtttttttttttttttggcggtgtagttgttcgggcgggggtggggcgggggtcggggttcgcgtgggattaattaggatcggggcgggagtcgatcgcggtcggcggggagggttagtttcgttttggcgggcgggcgcgtggtaggggttttcggaggtttcgagttttcgggaggcgtttcggttaatttcgggtcggtggggatcgggtttgggcgcggggttttgtaggtgtggaaggaaagtttgggatttcgttatttttttatagcgttttttttttcgtaatatttagtttttttatcgcggggttcgggagtttttggagttgatttcgttattattattttttcgggcgagcgcggaggacgggttggttattttggttaggtcggaggtgttttttagttcggggttttgtgataattgggtcgaaattcgagggttttggagcgcggcgggtggcgggagtttgcggagcgcggcgtattcggcggttaggtatcggttagtttagcggtagtttttttttttttatttttatttttatttttggaaggagttgagaattagtcgattggttggtaggt

SEQ ID NO: 30082 - DNA, 642 bp, Artificial Sequence
  chemically treated genomic DNA (Homo sapiens) CpG-island No: 30082
acctaccaaccaatcgactaattctcaactccttccaaaaataaaaataaaaataaaaaaaaaaaaactaccgctaaactaaccgatacctaaccgccgaatacgccgcgctccgcaaactcccgccacccgccgcgctccaaaaccctcgaatttcgacccaattatcacaaaaccccgaactaaaaaacacctccgacctaaccaaaataaccaacccgtcctccgcgctcgcccgaaaaaataataataacgaaatcaactccaaaaactcccgaaccccgcgataaaaaaactaaatattacgaaaaaaaaaacgctataaaaaaataacgaaatcccaaactttccttccacacctacaaaaccccgcgcccaaacccgatccccaccgacccgaaattaaccgaaacgcctcccgaaaactcgaaacctccgaaaacccctaccacgcgcccgcccgccaaaacgaaactaaccctccccgccgaccgcgatcgactcccgccccgatcctaattaatcccacgcgaaccccgacccccgccccacccccgcccgaacaactacaccgccaaaaaaaaaaaaaaacgaaacgcgcgcccccgaacccaaatccgcaaaacccaaaaaacgcgaacc

SEQ ID NO: 30083 - DNA, 642 bp, Artificial Sequence
  chemically treated genomic DNA (Homo sapiens) CpG-island No: 30083
atttgttaattaatcgattaatttttagttttttttaaaaataaaaataaaaataggagaaagggggttgtcgttgggttggtcgatgtttggtcgtcgagtgcgtcgcgtttcgtaagttttcgttattcgtcgcgttttaggattttcgggtttcggtttagttattataaagtttcgggttggaaaatattttcggtttggttagaatggttagttcgtttttcgcgttcgttcggggggataatggtggcgagattaattttaagggttttcgagtttcgcgataaagaggttggatattacgggaggaaggacgttgtggaagaataacggagttttaaattttttttttatatttgtagagtttcgcgtttaggttcggtttttatcggttcgaagttggtcggagcgtttttcgggagttcggggttttcgggagtttttgttacgcgttcgttcgttagagcggggttagtttttttcgtcggtcgcggtcgattttcgtttcggttttagttaattttacgcgggtttcggttttcgttttattttcgttcggatagttgtatcgttagggagggggaggggcggggcgcgcgttttcgggtttagattcgtaggatttagggggcgcgggtt

SEQ ID NO: 30084 - DNA, 642 bp, Artificial Sequence
  chemically treated genomic DNA (Homo sapiens) CpG-island No: 30084
aacccgcgccccctaaatcctacgaatctaaacccgaaaacgcgcgccccgcccctccccctccctaacgatacaactatccgaacgaaaataaaacgaaaaccgaaacccgcgtaaaattaactaaaaccgaaacgaaaatcgaccgcgaccgacgaaaaaaactaaccccgctctaacgaacgaacgcgtaacaaaaactcccgaaaaccccgaactcccgaaaaacgctccgaccaacttcgaaccgataaaaaccgaacctaaacgcgaaactctacaaatataaaaaaaaaatttaaaactccgttattcttccacaacgtccttcctcccgtaatatccaacctctttatcgcgaaactcgaaaacccttaaaattaatctcgccaccattatccccccgaacgaacgcgaaaaacgaactaaccattctaaccaaaccgaaaatattttccaacccgaaactttataataactaaaccgaaacccgaaaatcctaaaacgcgacgaataacgaaaacttacgaaacgcgacgcactcgacgaccaaacatcgaccaacccaacgacaaccccctttctcctatttttatttttatttttaaaaaaaactaaaaattaatcgattaattaacaaat

SEQ ID NO: 30085 - DNA, 1406 bp, Artificial Sequence
  chemically treated genomic DNA (Homo sapiens) CpG-island No: 30085
tcggtgtttagatgtgggttagcggtatcgtttcgttgattgtagtttcggcgttttggtagtgttggtgtacgtcgtgtaggcgatcgtcgggtagcggagaggcggcgtcggtcgcgttttcgtcgggtggtaggtatatgttgattatgtcgcgtaggtcgtcgaggtacgcgcgttgagagtgcgatgcgatggcgggcggcggcgagttgggtttagattttattatcgagtttatggggtttaggtttatggcggttgcggtcgtagttgcggtcgcggcggtggcgggttgttgttcgtaggcggcggtcgcggttgttgtggttgagggcgttatgttttcgtagttcgaggcggcggcggtcgcggtagcgacgtttatgtagttttgagcgtcgggcggtattattgggttgtattgtaggtcggttatgtcgtagcggtgtatcggcggtagcgcgggcggcggcggcgggttgtttatgttcgggggttgcgcgtagtttagttgtttttgtattagcgagtacgcgtcgttggtttagtcgtttacgtgcgtgtacgtgtttaggcgttggtttacgtttatcggattgttggcggtagcggttgcggtcgcggtagcggcggcggcggtcgcggtatcgggaggtaggaggtcgttgggtagggagtatttattttttttgagtagcgttttggttttgcggcgcggtcggtatttgtagttcggatatttttttatgtgtacggcgcgaagtcgtttggtttcgtcgatgaatggtcgtttttcggcgtcggttagtagtttttagtcggcgtttaagcgtttgttgattttagaattgtgtattttggggttttttagggttattttgcgtcgttgttcgcgggattatattatgaaggcgtttatgggtcgttttatacggttttggtttgtattttcgttattttcgttcgtattatcgttgttgtcgtcgttcgagttcgcgtcgtcggttgcgttcgtattatttttgtttgcgtttttcggggttgcggggtcgtcggtgttcgtcgtttgtgtgggtgtttttacggggtttttgagtttagtttttagaaggttgtatattgtcggggcgggaagaaggtgcgttagcgtggcgggaggagaaggcgttttcggggttggagcggttacggtgaaaaggttttgggatttcgtcggagcggagtttgggggtttgtgggttagcgagttcggcgggaagggtaggtttattaaaatgtttcgcgttaaattagtaggaattcgcgggtttttcgtatttgatgagttttttcgaataggtcgtatttatagtttgtttgggttttagttgggttttttatatatttgttcggatttttcgggg

SEQ ID NO: 30086 - DNA, 1406 bp, Artificial Sequence
  chemically treated genomic DNA (Homo sapiens) CpG-island No: 30086
ccccgaaaaatccgaacaaatatataaaaaacccaactaaaacccaaacaaactataaatacgacctattcgaaaaaactcatcaaatacgaaaaacccgcgaattcctactaatttaacgcgaaacattttaataaacctacccttcccgccgaactcgctaacccacaaacccccaaactccgctccgacgaaatcccaaaaccttttcaccgtaaccgctccaaccccgaaaacgccttctcctcccgccacgctaacgcaccttcttcccgccccgacaatatacaaccttctaaaaactaaactcaaaaaccccgtaaaaacacccacacaaacgacgaacaccgacgaccccgcaaccccgaaaaacgcaaacaaaaataatacgaacgcaaccgacgacgcgaactcgaacgacgacaacaacgataatacgaacgaaaataacgaaaatacaaaccaaaaccgtataaaacgacccataaacgccttcataatataatcccgcgaacaacgacgcaaaataaccctaaaaaaccccaaaatacacaattctaaaatcaacaaacgcttaaacgccgactaaaaactactaaccgacgccgaaaaacgaccattcatcgacgaaaccaaacgacttcgcgccgtacacataaaaaaatatccgaactacaaataccgaccgcgccgcaaaaccaaaacgctactcaaaaaaaataaatactccctacccaacgacctcctacctcccgataccgcgaccgccgccgccgctaccgcgaccgcaaccgctaccgccaacaatccgataaacgtaaaccaacgcctaaacacgtacacgcacgtaaacgactaaaccaacgacgcgtactcgctaatacaaaaacaactaaactacgcgcaacccccgaacataaacaacccgccgccgccgcccgcgctaccgccgatacaccgctacgacataaccgacctacaatacaacccaataataccgcccgacgctcaaaactacataaacgtcgctaccgcgaccgccgccgcctcgaactacgaaaacataacgccctcaaccacaacaaccgcgaccgccgcctacgaacaacaacccgccaccgccgcgaccgcaactacgaccgcaaccgccataaacctaaaccccataaactcgataataaaatctaaacccaactcgccgccgcccgccatcgcatcgcactctcaacgcgcgtacctcgacgacctacgcgacataatcaacatatacctaccacccgacgaaaacgcgaccgacgccgcctctccgctacccgacgatcgcctacacgacgtacaccaacactaccaaaacgccgaaactacaatcaacgaaacgataccgctaacccacatctaaacaccga

SEQ ID NO: 30087 - DNA, 1406 bp, Artificial Sequence
  chemically treated genomic DNA (Homo sapiens) CpG-island No: 30087
tttcggggaattcgagtaggtatataaggggtttagttagagtttaggtagattgtgaatgcgatttgttcgagagaatttattaggtgcgagaagttcgcgggtttttgttgatttggcgcggagtattttgataagtttatttttttcgtcggattcgttggtttataggtttttaagtttcgtttcgacggagttttagggtttttttatcgtggtcgttttagtttcgggagcgtttttttttttcgttacgttggcgtatttttttttcgtttcggtaatgtatagttttttggagattgaatttaagaatttcgtagggatatttatataagcggcgggtatcggcggtttcgtagtttcgggaggcgtaggtaagagtagtgcgaacgtagtcggcggcgcgaattcgggcggcggtagtagcggtggtgcgagcggaggtggcgggggtatagattaggatcgtgtgaaacggtttatgaacgtttttatggtatggtttcgcgggtagcggcgtaaaatggttttggagaattttaagatgtataattttgagattagtaagcgtttgggcgtcgattggaaattgttgatcgacgtcgagaagcgattatttatcgacgaggttaagcgatttcgcgtcgtgtatatgaaggagtattcggattataagtatcgatcgcgtcgtaagattaagacgttgtttaagaaagataagtattttttgtttagcggttttttgtttttcggtgtcgcggtcgtcgtcgtcgttgtcgcggtcgtagtcgttgtcgttagtagttcggtgggcgtgggttagcgtttggatacgtatacgtacgtgaacggttgggttaacggcgcgtattcgttggtgtaggagtagttgggttacgcgtagttttcgagtatgagtagttcgtcgtcgtcgttcgcgttgtcgtcgatgtatcgttacgatatggtcggtttgtagtatagtttaatgatgtcgttcggcgtttagagttatatgaacgtcgttgtcgcggtcgtcgtcgtttcgggttacgggggtatggcgtttttagttatagtagtcgcggtcgtcgtttacgggtagtagttcgttatcgtcgcggtcgtagttgcggtcgtagtcgttatgagtttgggttttatgggttcggtagtgaagtttgagtttagttcgtcgtcgttcgttatcgtatcgtatttttagcgcgcgtgtttcggcgatttgcgcgatatgattagtatgtatttgttattcggcggggacgcggtcgacgtcgttttttcgttgttcggcggtcgtttgtacggcgtgtattagtattattagggcgtcgggattgtagttaacggaacggtgtcgttgatttatatttgagtatcgg

SEQ ID NO: 30088 - DNA, 1406 bp, Artificial Sequence
  chemically treated genomic DNA (Homo sapiens) CpG-island No: 30088
ccgatactcaaatataaatcaacgacaccgttccgttaactacaatcccgacgccctaataatactaatacacgccgtacaaacgaccgccgaacaacgaaaaaacgacgtcgaccgcgtccccgccgaataacaaatacatactaatcatatcgcgcaaatcgccgaaacacgcgcgctaaaaatacgatacgataacgaacgacgacgaactaaactcaaacttcactaccgaacccataaaacccaaactcataacgactacgaccgcaactacgaccgcgacgataacgaactactacccgtaaacgacgaccgcgactactataactaaaaacgccatacccccgtaacccgaaacgacgacgaccgcgacaacgacgttcatataactctaaacgccgaacgacatcattaaactatactacaaaccgaccatatcgtaacgatacatcgacgacaacgcgaacgacgacgacgaactactcatactcgaaaactacgcgtaacccaactactcctacaccaacgaatacgcgccgttaacccaaccgttcacgtacgtatacgtatccaaacgctaacccacgcccaccgaactactaacgacaacgactacgaccgcgacaacgacgacgacgaccgcgacaccgaaaaacaaaaaaccgctaaacaaaaaatacttatctttcttaaacaacgtcttaatcttacgacgcgatcgatacttataatccgaatactccttcatatacacgacgcgaaatcgcttaacctcgtcgataaataatcgcttctcgacgtcgatcaacaatttccaatcgacgcccaaacgcttactaatctcaaaattatacatcttaaaattctccaaaaccattttacgccgctacccgcgaaaccataccataaaaacgttcataaaccgtttcacacgatcctaatctatacccccgccacctccgctcgcaccaccgctactaccgccgcccgaattcgcgccgccgactacgttcgcactactcttacctacgcctcccgaaactacgaaaccgccgatacccgccgcttatataaatatccctacgaaattcttaaattcaatctccaaaaaactatacattaccgaaacgaaaaaaaaatacgccaacgtaacgaaaaaaaaaaacgctcccgaaactaaaacgaccacgataaaaaaaccctaaaactccgtcgaaacgaaacttaaaaacctataaaccaacgaatccgacgaaaaaaataaacttatcaaaatactccgcgccaaatcaacaaaaacccgcgaacttctcgcacctaataaattctctcgaacaaatcgcattcacaatctacctaaactctaactaaaccccttatatacctactcgaattccccgaaa

SEQ ID NO: 30089 - DNA, 837 bp, Artificial Sequence
  chemically treated genomic DNA (Homo sapiens) CpG-island No: 30089
cggcggcggcggcggcggtgttgttgatttttattaagcggtgtatggacggcgcggcggcgcggcgcggggcgcggggggttcgggggcggtcggggggggtttcggtcggcgttcggagttggggtttcgtatgtaggaggcgcgcggcgggggaggcgcgtttcggttcgtcgggttcgggtcgtcgttaagttttcggggcgtcgcggggtttagtgcgcgggatcgcgtttcgttgcgttttttcggttttttttcggtagtttcgggggcgtcggtagtgttcgcgggtggcgttcggaaaatgggttggtagcggggcgcgcgttgtcgtcggggttgagtttttgtcgttagttttttttagtcgagcgttttcgtcgtcgtcgtcgtcgtcgtttttttttttttatttaagtttaaggagatcgggtttcgtttcgagatcgcggtcggaggtaggtagacggtttgacgttagcgttagacggggttgtcggtttttatcgcgcgggggtcggggagggggcgcgcgttgcgttaattttcgtcgaggttttttcgtatttttttttcgagtcggggggcggggtgacgggaaacggggcgggtttttaaagggttagagttaggcggtttacgtagattcggtattcgcgtaacggaggaggggcgttgtgttttttttttaacggcggttagtttggaacgtttgttcggcgtacgttcggggtcggggagtcgaattcggtgttagtcgtattcgggcgggttgttggtgcgtttttttttcgttttcgtttttggggtttttgatttaggtttttggggtta

SEQ ID NO: 30090 - DNA, 837 bp, Artificial Sequence
  chemically treated genomic DNA (Homo sapiens) CpG-island No: 30090
taaccccaaaaacctaaatcaaaaaccccaaaaacgaaaacgaaaaaaaaacgcaccaacaacccgcccgaatacgactaacaccgaattcgactccccgaccccgaacgtacgccgaacaaacgttccaaactaaccgccgttaaaaaaaaaacacaacgcccctcctccgttacgcgaataccgaatctacgtaaaccgcctaactctaaccctttaaaaacccgccccgtttcccgtcaccccgccccccgactcgaaaaaaaaatacgaaaaaacctcgacgaaaattaacgcaacgcgcgccccctccccgacccccgcgcgataaaaaccgacaaccccgtctaacgctaacgtcaaaccgtctacctacctccgaccgcgatctcgaaacgaaacccgatctccttaaacttaaataaaaaaaaaaaaacgacgacgacgacgacgacgaaaacgctcgactaaaaaaaactaacgacaaaaactcaaccccgacgacaacgcgcgccccgctaccaacccattttccgaacgccacccgcgaacactaccgacgcccccgaaactaccgaaaaaaaaccgaaaaaacgcaacgaaacgcgatcccgcgcactaaaccccgcgacgccccgaaaacttaacgacgacccgaacccgacgaaccgaaacgcgcctcccccgccgcgcgcctcctacatacgaaaccccaactccgaacgccgaccgaaaccccccccgaccgcccccgaaccccccgcgccccgcgccgcgccgccgcgccgtccatacaccgcttaataaaaatcaacaacaccgccgccgccgccgccg

SEQ ID NO: 30091 - DNA, 837 bp, Artificial Sequence
  chemically treated genomic DNA (Homo sapiens) CpG-island No: 30091
tagttttaagagtttgggttaaggattttagggacgggggcgaggggagggcgtattagtaattcgttcgggtgcggttggtatcgagttcggtttttcggtttcgggcgtgcgtcgggtaggcgttttaagttgatcgtcgttggggagagggtatagcgtttttttttcgttgcgcgggtgtcgggtttacgtgggtcgtttagttttggttttttaagagttcgtttcgtttttcgttatttcgtttttcggttcggggagggggtgcgggggaatttcggcggggattggcgtagcgcgcgtttttttttcggttttcgcgcggtgggaatcggtagtttcgtttagcgttgacgttagatcgtttgtttgttttcgatcgcggtttcggagcgaaattcgatttttttggatttgaatgaggaggaggaggcggcggcggcggcggcggcggaggcgttcggttggggaaagttagcggtagaggtttagtttcggcggtagcgcgcgtttcgttgttagtttatttttcggacgttattcgcgggtattgtcgacgttttcggggttgtcgaggggaggtcgggggggcgtagcggagcgcggtttcgcgtattgagtttcgcggcgtttcgggaatttggcggcgattcgagttcggcgagtcggggcgcgtttttttcgtcgcgcgttttttgtatgcggggttttagtttcgggcgtcggtcggagtttttttcggtcgttttcgagtttttcgcgtttcgcgtcgcgtcgtcgcgtcgtttatgtatcgtttgatgggggttaatagtatcgtcgtcgtcgtcgtcg

SEQ ID NO: 30092 - DNA, 837 bp, Artificial Sequence
  chemically treated genomic DNA (Homo sapiens) CpG-island No: 30092
cgacgacgacgacgacgatactattaacccccatcaaacgatacataaacgacgcgacgacgcgacgcgaaacgcgaaaaactcgaaaacgaccgaaaaaaactccgaccgacgcccgaaactaaaaccccgcatacaaaaaacgcgcgacgaaaaaaacgcgccccgactcgccgaactcgaatcgccgccaaattcccgaaacgccgcgaaactcaatacgcgaaaccgcgctccgctacgcccccccgacctcccctcgacaaccccgaaaacgtcgacaatacccgcgaataacgtccgaaaaataaactaacaacgaaacgcgcgctaccgccgaaactaaacctctaccgctaactttccccaaccgaacgcctccgccgccgccgccgccgccgcctcctcctcctcattcaaatccaaaaaaatcgaatttcgctccgaaaccgcgatcgaaaacaaacaaacgatctaacgtcaacgctaaacgaaactaccgattcccaccgcgcgaaaaccgaaaaaaaaacgcgcgctacgccaatccccgccgaaattcccccgcaccccctccccgaaccgaaaaacgaaataacgaaaaacgaaacgaactcttaaaaaaccaaaactaaacgacccacgtaaacccgacacccgcgcaacgaaaaaaaaacgctataccctctccccaacgacgatcaacttaaaacgcctacccgacgcacgcccgaaaccgaaaaaccgaactcgataccaaccgcacccgaacgaattactaatacgccctcccctcgcccccgtccctaaaatccttaacccaaactcttaaaacta

SEQ ID NO: 30093 - DNA, 903 bp, Artificial Sequence
  chemically treated genomic DNA (Homo sapiens) CpG-island No: 30093
tttataggttttagatattagatattcgtcggttatatagttcgcggatatttttatttatttcgtaggtcgttcgtttaacgcgttgatagtttattttttcgcgtagaaattagtcggattaggttttgttcgttaattatcgtttcgtcgtaattattttcggagatttagttataaattattcgttaaggacgacgtttacgacggtattttttatatttttttttagggtttttcgtcgttttaggtttttaagttaattttcgtatacgataaaaggaaagggaatcgttttaattcgtatacgttagttcgtcgatataatattttaataaatttatcgtttatcgattagcgaattattttttttatcgttcgttattattaatttcgtcgaagattaggtagtcgtaggtaagcggtttaattttcgggtttttaatttcgttttatcgttttacgcgttcgtcgttatattcgtagttcgtttcggttatcgtcgtttcgtagtatatttcgaagtttagtagcgagatattttcggtttcgtatttttcgtttaggatcgttcgggcgattcgggttttttttcggttttatacgaattttagaatagtttttttttattttcgcgaaaagcgatatcggtagttcgataggaatagtatcgaatttataaatcggttcgaatagagcggttattttaattatatcgattttttttatttacgaatacgggacgtttttttgttcgttcgtatcgttttcgatttttttttagtaacgtttcggtatttttcggtcgtagagaatttttatttttttcggtaaaaacgtatattttaggaattttatttttcgattcgtttttcgattcggtcgttatcggcggatcggaaa

SEQ ID NO: 30094 - DNA, 903 bp, Artificial Sequence
  chemically treated genomic DNA (Homo sapiens) CpG-island No: 30094
tttccgatccgccgataacgaccgaatcgaaaaacgaatcgaaaaataaaattcctaaaatatacgtttttaccgaaaaaaataaaaattctctacgaccgaaaaataccgaaacgttactaaaaaaaaatcgaaaacgatacgaacgaacaaaaaaacgtcccgtattcgtaaataaaaaaaatcgatataattaaaataaccgctctattcgaaccgatttataaattcgatactattcctatcgaactaccgatatcgcttttcgcgaaaataaaaaaaaactattctaaaattcgtataaaaccgaaaaaaaacccgaatcgcccgaacgatcctaaacgaaaaatacgaaaccgaaaatatctcgctactaaacttcgaaatatactacgaaacgacgataaccgaaacgaactacgaatataacgacgaacgcgtaaaacgataaaacgaaattaaaaacccgaaaattaaaccgcttacctacgactacctaatcttcgacgaaattaataataacgaacgataaaaaaaataattcgctaatcgataaacgataaatttattaaaatattatatcgacgaactaacgtatacgaattaaaacgattccctttccttttatcgtatacgaaaattaacttaaaaacctaaaacgacgaaaaaccctaaaaaaaaatataaaaaataccgtcgtaaacgtcgtccttaacgaataatttataactaaatctccgaaaataattacgacgaaacgataattaacgaacaaaacctaatccgactaatttctacgcgaaaaaataaactatcaacgcgttaaacgaacgacctacgaaataaataaaaatatccgcgaactatataaccgacgaatatctaatatctaaaacctataaa

SEQ ID NO: 30095 - DNA, 903 bp, Artificial Sequence
  chemically treated genomic DNA (Homo sapiens) CpG-island No: 30095
ttttcggttcgtcggtagcggtcggatcggagaacgagtcggggggtggggtttttagaatgtgcgtttttatcgagaggaataggggttttttgcggtcggaaggtgtcggagcgttattagggaagggtcgagaacggtgcggacgggtaagagggcgtttcgtattcgtaagtgagggagatcggtgtaattggggtaatcgttttattcgggtcggtttgtgagttcggtattgtttttgtcgggttgtcggtatcgtttttcgcgaggatgagggggggttgttttggagttcgtgtaaggtcgggggaagattcgggtcgttcgggcggttttggacgggggatgcgggatcgagagtgtttcgttgttaggtttcgggatgtgttgcggagcggcgatggtcggggcgaattgcgaatgtagcggcgagcgcgtgagacggtaaggcgaggttgaaggttcgagggttggatcgtttgtttgcggttgtttagttttcggcggggttagtggtggcgggcggtagagagggtggttcgttgatcgatgggcgataggtttgttagggtattgtgtcggcgaattgacgtgtacgagttaaggcgattttttttttttttgtcgtgtgcgggggttgatttgggagtttggggcggcggggggttttgaggaggggtatggagggtgtcgtcgtgagcgtcgtttttaacgggtggtttgtagttggattttcggggataattacggcggggcggtggttagcggatagggtttggttcggttgatttttacgcgagggggtgggttgttaacgcgttgggcgagcggtttgcgagataaataggggtattcgcgggttgtatggtcggcgggtatttggtgtttaaggtttgtgga

SEQ ID NO: 30096 - DNA, 903 bp, Artificial Sequence
  chemically treated genomic DNA (Homo sapiens) CpG-island No: 30096
tccacaaaccttaaacaccaaatacccgccgaccatacaacccgcgaatacccctatttatctcgcaaaccgctcgcccaacgcgttaacaacccaccccctcgcgtaaaaatcaaccgaaccaaaccctatccgctaaccaccgccccgccgtaattatccccgaaaatccaactacaaaccacccgttaaaaacgacgctcacgacgacaccctccatacccctcctcaaaaccccccgccgccccaaactcccaaatcaacccccgcacacgacaaaaaaaaaaaaaatcgccttaactcgtacacgtcaattcgccgacacaataccctaacaaacctatcgcccatcgatcaacgaaccaccctctctaccgcccgccaccactaaccccgccgaaaactaaacaaccgcaaacaaacgatccaaccctcgaaccttcaacctcgccttaccgtctcacgcgctcgccgctacattcgcaattcgccccgaccatcgccgctccgcaacacatcccgaaacctaacaacgaaacactctcgatcccgcatcccccgtccaaaaccgcccgaacgacccgaatcttcccccgaccttacacgaactccaaaacaaccccccctcatcctcgcgaaaaacgataccgacaacccgacaaaaacaataccgaactcacaaaccgacccgaataaaacgattaccccaattacaccgatctccctcacttacgaatacgaaacgccctcttacccgtccgcaccgttctcgacccttccctaataacgctccgacaccttccgaccgcaaaaaacccctattcctctcgataaaaacgcacattctaaaaaccccaccccccgactcgttctccgatccgaccgctaccgacgaaccgaaaa

SEQ ID NO: 30097 - DNA, 945 bp, Artificial Sequence
  chemically treated genomic DNA (Homo sapiens) CpG-island No: 30097
gttatcgtagtttcgtaatagggttcgaagttaggtaatacgacgtttttagtttcgttttttcggtttagtatcgattcggtaacgtgggttttttttcggttttatacgaattttaaagtagttttttttaatttcgcgaagaaagttatcggtagttcgacggggacggtatcgaatttataaattatttcggttagtacggttatttttacgatatcgattttttttatttatgagtacggaacgtttttttattcgttcgtatttttttttattttatcgagtagcgtttcgtagtttttttcgaagaggttttttatatttttcgtaagttagatttttaggtattttatttttttcgaagtaatcgcgaacgggagtttatttacgattcggtttttcgttcgttatcggcgtataggaacgttcgcgattttcgtatatcgatttcgtatttcgaaatttcgtcgaagtcgtttattagtttaaagagatttcgggtcgagacgacggggttttttaaatatattattacgttgttcgtaaagagagataattcgattttttttttttttattcgaatatgttttatttttttttttcgttcgatcgtttcggttggaatttttaatattacgtcgaataggagcggcgaaagagggtattttcgtttcgcgttgatttttaaagggaacgtttttagttttcgtttatttagcgcgatatcgttcgcgggatcgttataaatagtttcgattatttcgaaatacgttttattaatatttagtttatcgagagtttttagtacgaaggttcgtcgaatttcgttgaaggtttttttcgtatttattgagataatttcgcggttttcgttatcggtttcgtttacgcggtggattatatttatcgattcgtgtacgtcgaattagtttcgtattttaa

SEQ ID NO: 30098 - DNA, 945 bp, Artificial Sequence
  chemically treated genomic DNA (Homo sapiens) CpG-island No: 30098
ttaaaatacgaaactaattcgacgtacacgaatcgataaatataatccaccgcgtaaacgaaaccgataacgaaaaccgcgaaattatctcaataaatacgaaaaaaaccttcaacgaaattcgacgaaccttcgtactaaaaactctcgataaactaaatattaataaaacgtatttcgaaataatcgaaactatttataacgatcccgcgaacgatatcgcgctaaataaacgaaaactaaaaacgttccctttaaaaatcaacgcgaaacgaaaataccctctttcgccgctcctattcgacgtaatattaaaaattccaaccgaaacgatcgaacgaaaaaaaaaaataaaacatattcgaataaaaaaaaaaaaaatcgaattatctctctttacgaacaacgtaataatatatttaaaaaaccccgtcgtctcgacccgaaatctctttaaactaataaacgacttcgacgaaatttcgaaatacgaaatcgatatacgaaaatcgcgaacgttcctatacgccgataacgaacgaaaaaccgaatcgtaaataaactcccgttcgcgattacttcgaaaaaaataaaatacctaaaaatctaacttacgaaaaatataaaaaacctcttcgaaaaaaactacgaaacgctactcgataaaataaaaaaaaatacgaacgaataaaaaaacgttccgtactcataaataaaaaaaatcgatatcgtaaaaataaccgtactaaccgaaataatttataaattcgataccgtccccgtcgaactaccgataactttcttcgcgaaattaaaaaaaactactttaaaattcgtataaaaccgaaaaaaaacccacgttaccgaatcgatactaaaccgaaaaaacgaaactaaaaacgtcgtattacctaacttcgaaccctattacgaaactacgataac

SEQ ID NO: 30099 - DNA, 945 bp, Artificial Sequence
  chemically treated genomic DNA (Homo sapiens) CpG-island No: 30099
ttaaggtacggaattaattcggcgtgtacgggtcggtgggtatggtttatcgcgtgggcgaggtcgatagcgggggtcgcggagttgttttagtgagtacgaggggaatttttaacggggttcggcgaattttcgtattgggggttttcggtgggttgaatgttagtaaggcgtgtttcggggtggtcgaaattgtttgtagcggtttcgcgaacggtgtcgcgttaggtaaacgggggttaaggacgttttttttaggggttaacgcggagcggaagtattttttttcgtcgtttttgttcggcgtgatgttaaggattttaatcgaaacggtcgaacggagagggagggtgggatatgttcgagtgaaggagagaaggatcgagttatttttttttacgagtagcgtagtgatatgtttgaggggtttcgtcgtttcggttcggggtttttttggattagtggacggtttcgacgggatttcgaagtgcggggtcggtatacgggggtcgcggacgtttttgtgcgtcggtggcgggcgagagatcgggtcgtagataggttttcgttcgcggttatttcgggagaggtggggtgtttgaaggtttggtttgcggaaagtataggaagttttttcggaagaggttgcggggcgttattcggtagggtggggagaagtgcgggcgggtaaggaggcgtttcgtatttataaatgaaggaggtcggtgtcgtaggggtaatcgtgttagtcggaatagtttgtgaattcggtatcgttttcgtcggattgtcggtagtttttttcgcgaggttaaggggggttgttttgggattcgtgtaaggtcggggggagatttacgttatcggatcggtgttggatcggggaggcgggattaagaacgtcgtattgtttagtttcgagttttgttgcggaattgcgatggt

SEQ ID NO: 30100 - DNA, 945 bp, Artificial Sequence
  chemically treated genomic DNA (Homo sapiens) CpG-island No: 30100
accatcgcaattccgcaacaaaactcgaaactaaacaatacgacgttcttaatcccgcctccccgatccaacaccgatccgataacgtaaatctccccccgaccttacacgaatcccaaaacaaccccccttaacctcgcgaaaaaaactaccgacaatccgacgaaaacgataccgaattcacaaactattccgactaacacgattacccctacgacaccgacctccttcatttataaatacgaaacgcctccttacccgcccgcacttctccccaccctaccgaataacgccccgcaacctcttccgaaaaaacttcctatactttccgcaaaccaaaccttcaaacaccccacctctcccgaaataaccgcgaacgaaaacctatctacgacccgatctctcgcccgccaccgacgcacaaaaacgtccgcgacccccgtataccgaccccgcacttcgaaatcccgtcgaaaccgtccactaatccaaaaaaaccccgaaccgaaacgacgaaacccctcaaacatatcactacgctactcgtaaaaaaaaataactcgatccttctctccttcactcgaacatatcccaccctccctctccgttcgaccgtttcgattaaaatccttaacatcacgccgaacaaaaacgacgaaaaaaaatacttccgctccgcgttaacccctaaaaaaaacgtccttaacccccgtttacctaacgcgacaccgttcgcgaaaccgctacaaacaatttcgaccaccccgaaacacgccttactaacattcaacccaccgaaaacccccaatacgaaaattcgccgaaccccgttaaaaattcccctcgtactcactaaaacaactccgcgacccccgctatcgacctcgcccacgcgataaaccatacccaccgacccgtacacgccgaattaattccgtaccttaa

SEQ ID NO: 30101 - DNA, 607 bp, Artificial Sequence
  chemically treated genomic DNA (Homo sapiens) CpG-island No: 30101
gacgagataggtttattcggcgcggatgagataggtttagatttgcgcggtttgaggacggcgcgttcgtcgagtaattcggtaggttagaattttggatagcggcgtcggttttcgtatttttatttattttcggttgttgcggagaaagaagtcgtatcgggggtttagtcggggtttttcgttgtttaggggtgggattcgttcggtcggattttaggcgttcggggatcgattttaatttttttttagtttaaatttgcgaaagttatttcggatatgcgtttagcgttggtaatagagataaaattttttttttcgtagtattacgcgtcgtttttattcggtcgttgtagtcggaaattatttcgcggttttcgaggagagttcggtcgttttattgattagataattagtcgagtttttttaatatatttatttcgcgggggttttaagtcggtttgggattttcggtttcgtttcgttcggcgtttttttttcggagtcgttaggttgggttttttttcgttggtaaaatagcgagtaaataaataattaaataattttagaaacgaaaggttgtattaaattttgatgacgttagttt

SEQ ID NO: 30102 - DNA, 607 bp, Artificial Sequence
  chemically treated genomic DNA (Homo sapiens) CpG-island No: 30102
aaactaacgtcatcaaaatttaatacaacctttcgtttctaaaattatttaattatttatttactcgctattttaccaacgaaaaaaaacccaacctaacgactccgaaaaaaaaacgccgaacgaaacgaaaccgaaaatcccaaaccgacttaaaacccccgcgaaataaatatattaaaaaaactcgactaattatctaatcaataaaacgaccgaactctcctcgaaaaccgcgaaataatttccgactacaacgaccgaataaaaacgacgcgtaatactacgaaaaaaaaaattttatctctattaccaacgctaaacgcatatccgaaataactttcgcaaatttaaactaaaaaaaaattaaaatcgatccccgaacgcctaaaatccgaccgaacgaatcccacccctaaacaacgaaaaaccccgactaaacccccgatacgacttctttctccgcaacaaccgaaaataaataaaaatacgaaaaccgacgccgctatccaaaattctaacctaccgaattactcgacgaacgcgccgtcctcaaaccgcgcaaatctaaacctatctcatccgcgccgaataaacctatctcgtc

SEQ ID NO: 30103 - DNA, 607 bp, Artificial Sequence
  chemically treated genomic DNA (Homo sapiens) CpG-island No: 30103
gggttggcgttattaaagtttggtgtagtttttcgtttttaaggttgtttggttgtttgtttattcgttgttttgttaacgggaaggagtttagtttagcggtttcgggagaggagcgtcgggcgaggcgaggtcgagggttttaagtcggtttagagttttcgcgaggtgggtgtgttgagggagttcggttggttatttagttagtgaggcggtcggatttttttcgggggtcgcgagatggttttcggttgtagcggtcgggtaggagcggcgcgtggtattgcggagaagggagttttgtttttgttgttagcgttgagcgtatgttcggagtaattttcgtaggtttggattgggagaggattggggtcggttttcggacgtttggggttcggtcgggcggattttatttttgagtagcgaggggtttcggttgggttttcggtacggttttttttttcgtagtagtcgggggtgggtgggggtgcggaaatcggcgtcgttgtttagggttttgatttgtcgggttgttcggcgagcgcgtcgtttttagatcgcgtaggtttgagtttgttttattcgcgtcggatgagtttgtttcgtt

SEQ ID NO: 30104 - DNA, 607 bp, Artificial Sequence
  chemically treated genomic DNA (Homo sapiens) CpG-island No: 30104
aacgaaacaaactcatccgacgcgaataaaacaaactcaaacctacgcgatctaaaaacgacgcgctcgccgaacaacccgacaaatcaaaaccctaaacaacgacgccgatttccgcacccccacccacccccgactactacgaaaaaaaaaaccgtaccgaaaacccaaccgaaacccctcgctactcaaaaataaaatccgcccgaccgaaccccaaacgtccgaaaaccgaccccaatcctctcccaatccaaacctacgaaaattactccgaacatacgctcaacgctaacaacaaaaacaaaactcccttctccgcaataccacgcgccgctcctacccgaccgctacaaccgaaaaccatctcgcgacccccgaaaaaaatccgaccgcctcactaactaaataaccaaccgaactccctcaacacacccacctcgcgaaaactctaaaccgacttaaaaccctcgacctcgcctcgcccgacgctcctctcccgaaaccgctaaactaaactccttcccgttaacaaaacaacgaataaacaaacaaccaaacaaccttaaaaacgaaaaactacaccaaactttaataacgccaaccc

SEQ ID NO: 30105 - DNA, 648 bp, Artificial Sequence
  chemically treated genomic DNA (Homo sapiens) CpG-island No: 30105
tcgtcgcgtttcgatttcgaggttttcgaggaggtagcgacgtttcggggtcgggggtcgggtatcgggtggtttttgcggcggcggcgtcgggtttttttagttagagcgaggagcgcgttaaggtagggttcggcgttttttttttgttcgattcgtcggcgttttagttagagtttagcgtcgttatcgtcgttaggacgttttttcgtcgttttagttttgttcggagttttagggttttatttatttcgcgggagatttttatttcgggatttaggtgtttacgtcgttagcgattcggagtttttacgtcgtcgttcgtttggcgtagattgtttcgggacgtttcgtcgcgcgttttttttgtgcgcgtttattcgcgcgcgttttattgtcgtcgcgcgttcgcgtcgttcgaattcgtattttttaggtacgtattgcgcgcgttcgcggcgtttaaagggtcgggtttcgtcgcgttgggggatttcgcggtcgtttttcgggggttttcggttaaggtgtgaagttcgagttgggggatagtatcgtgaaaatttttaattttatcgtcgagcgatttacgcggagaaaagtaatagggatgtgtgtttgaagtttgtaagagatgggatattaatt

SEQ ID NO: 30106 - DNA, 648 bp, Artificial Sequence
  chemically treated genomic DNA (Homo sapiens) CpG-island No: 30106
aattaatatcccatctcttacaaacttcaaacacacatccctattacttttctccgcgtaaatcgctcgacgataaaattaaaaattttcacgatactatcccccaactcgaacttcacaccttaaccgaaaacccccgaaaaacgaccgcgaaatcccccaacgcgacgaaacccgaccctttaaacgccgcgaacgcgcgcaatacgtacctaaaaaatacgaattcgaacgacgcgaacgcgcgacgacaataaaacgcgcgcgaataaacgcgcacaaaaaaaacgcgcgacgaaacgtcccgaaacaatctacgccaaacgaacgacgacgtaaaaactccgaatcgctaacgacgtaaacacctaaatcccgaaataaaaatctcccgcgaaataaataaaaccctaaaactccgaacaaaactaaaacgacgaaaaaacgtcctaacgacgataacgacgctaaactctaactaaaacgccgacgaatcgaacaaaaaaaaaacgccgaaccctaccttaacgcgctcctcgctctaactaaaaaaacccgacgccgccgccgcaaaaaccacccgatacccgacccccgaccccgaaacgtcgctacctcctcgaaaacctcgaaatcgaaacgcgacga

SEQ ID NO: 30107 - DNA, 648 bp, Artificial Sequence
  chemically treated genomic DNA (Homo sapiens) CpG-island No: 30107
aattaatgttttattttttgtaagttttagatatatatttttattgttttttttcgcgtgggtcgttcggcgatggggttggggatttttacggtgttgttttttaattcgaattttatattttgatcgaggattttcgggaggcggtcgcgaggttttttagcgcggcggggttcggttttttaagcgtcgcgggcgcgcgtagtgcgtgtttaaggagtgcgagttcgggcggcgcgagcgcgcggcggtagtagagcgcgcgcgggtgggcgcgtatagggagagcgcgcggcggggcgtttcggaatagtttgcgttagacgggcggcggcgtgagggtttcgggtcgttggcggcgtggatatttgagtttcggggtaggggtttttcgcgaggtgagtggggttttaggatttcgggtagggttggagcgacgggagggcgttttggcggcggtggcggcgttgggttttggttgggacgtcggcgggtcgggtagagagggggcgtcggattttgttttggcgcgtttttcgttttgattaggggagttcggcgtcgtcgtcgtagaggttattcggtgttcgattttcgatttcggggcgtcgttgttttttcggggatttcggagtcggggcgcggcgg

SEQ ID NO: 30108 - DNA, 648 bp, Artificial Sequence
  chemically treated genomic DNA (Homo sapiens) CpG-island No: 30108
ccgccgcgccccgactccgaaatccccgaaaaaacaacgacgccccgaaatcgaaaatcgaacaccgaataacctctacgacgacgacgccgaactcccctaatcaaaacgaaaaacgcgccaaaacaaaatccgacgccccctctctacccgacccgccgacgtcccaaccaaaacccaacgccgccaccgccgccaaaacgccctcccgtcgctccaaccctacccgaaatcctaaaaccccactcacctcgcgaaaaacccctaccccgaaactcaaatatccacgccgccaacgacccgaaaccctcacgccgccgcccgtctaacgcaaactattccgaaacgccccgccgcgcgctctccctatacgcgcccacccgcgcgcgctctactaccgccgcgcgctcgcgccgcccgaactcgcactccttaaacacgcactacgcgcgcccgcgacgcttaaaaaaccgaaccccgccgcgctaaaaaacctcgcgaccgcctcccgaaaatcctcgatcaaaatataaaattcgaattaaaaaacaacaccgtaaaaatccccaaccccatcgccgaacgacccacgcgaaaaaaaacaataaaaatatatatctaaaacttacaaaaaataaaacattaatt

SEQ ID NO: 30109 - DNA, 747 bp, Artificial Sequence
  chemically treated genomic DNA (Homo sapiens) CpG-island No: 30109
  misc_feature (527)..(527): n is either a, c, g or t
  misc_feature (532)..(532): n is either a, c, g or t
ttcgggttcgggatacggggagttttttttttaggggcgtaaacggggtttcggtttttcgggtttttttcgggttaatggcggcgttttgatttcgattcggtattaacgcgaggagttcgcgcggttcggggttgattttatgtcgtttagttgtcgcgcgttggtgggtcgcggtttcgattttcgtcgtttcgtttcggtcgggtttcggttgtagaagcgggcggggagttgggtttaggggtcgcgtcggagatatatgggtttatttgtttcgaaggttcgtaagacggcgacggcggttatagtattcgggatggttagacgtcgtaggatcgcgttgtttggtcggtcgtaggtgttgggcgtttcgagggcgttgttgtgagtagggtcgggacggaattcgacggaattcgacggtggtcgagattcggacggaatcgtttgataggtttaggtttcgcggggacgttttaggttaggtttagttcgtattacgtttcgtttcggtacgtttcgtntcgtntcggtacgttcgttttcgtttcgtttcggtacgttttttttcgtttcggtacgtttcgtttcgtttttacgaggttcgttttcggttcgtcgtttttcgtcgcgtttcgtacggtgaaaggcgcgtattgaaaatttgtaggtcggttttaggggttgtttgataaggtttgtgggaaagtttaagcgaggggaggagtaggatgattttttttt

SEQ ID NO: 30110 - DNA, 747 bp, Artificial Sequence
  chemically treated genomic DNA (Homo sapiens) CpG-island No: 30110
  misc_feature (216)..(216): n is either a, c, g or t
  misc_feature (221)..(221): n is either a, c, g or t
aaaaaaaaatcatcctactcctcccctcgcttaaactttcccacaaaccttatcaaacaacccctaaaaccgacctacaaattttcaatacgcgcctttcaccgtacgaaacgcgacgaaaaacgacgaaccgaaaacgaacctcgtaaaaacgaaacgaaacgtaccgaaacgaaaaaaaacgtaccgaaacgaaacgaaaacgaacgtaccganacganacgaaacgtaccgaaacgaaacgtaatacgaactaaacctaacctaaaacgtccccgcgaaacctaaacctatcaaacgattccgtccgaatctcgaccaccgtcgaattccgtcgaattccgtcccgaccctactcacaacaacgccctcgaaacgcccaacacctacgaccgaccaaacaacgcgatcctacgacgtctaaccatcccgaatactataaccgccgtcgccgtcttacgaaccttcgaaacaaataaacccatatatctccgacgcgacccctaaacccaactccccgcccgcttctacaaccgaaacccgaccgaaacgaaacgacgaaaatcgaaaccgcgacccaccaacgcgcgacaactaaacgacataaaatcaaccccgaaccgcgcgaactcctcgcgttaataccgaatcgaaatcaaaacgccgccattaacccgaaaaaaacccgaaaaaccgaaaccccgtttacgcccctaaaaaaaaaactccccgtatcccgaacccgaa

SEQ ID NO: 30111 - DNA, 747 bp, Artificial Sequence
  chemically treated genomic DNA (Homo sapiens) CpG-island No: 30111
  misc_feature (216)..(216): n is either a, c, g or t
  misc_feature (221)..(221): n is either a, c, g or t
aaaaagaaattattttattttttttttcgtttaaatttttttataggttttgttaaataatttttggagtcggtttgtaggtttttaatgcgcgttttttatcgtgcggggcgcggcggggagcggcgagtcgggggcgggtttcgtgggggcggggcggggcgtgtcggggcggggaggggcgtgtcggggcggggcgggggcgggcgtgtcggngcggngcggggcgtgtcggggcggggcgtagtacggattgggtttggtttggggcgttttcgcgaagtttgggtttgttaggcggtttcgttcgggtttcggttatcgtcgagtttcgtcgagtttcgtttcggttttgtttatagtagcgttttcggagcgtttagtatttgcggtcggttaggtagcgcgattttgcggcgtttggttatttcgaatgttatggtcgtcgtcgtcgttttgcgggttttcggggtaagtgggtttatgtgttttcggcgcggtttttgggtttagtttttcgttcgtttttgtagtcgggattcggtcggggcggggcggcgggagtcggagtcgcggtttattagcgcgcggtagttggacggtataaggttagtttcgggtcgcgcgggtttttcgcgttggtgtcgagtcggggttagggcgtcgttattgattcggggaggattcggggaatcggagtttcgtttacgtttttggggagggaatttttcgtgtttcggattcggg

SEQ ID NO: 30112 - DNA, 747 bp, Artificial Sequence
  chemically treated genomic DNA (Homo sapiens) CpG-island No: 30112
  misc_feature (527)..(527): n is either a, c, g or t
  misc_feature (532)..(532): n is either a, c, g or t
cccgaatccgaaacacgaaaaattccctccccaaaaacgtaaacgaaactccgattccccgaatcctccccgaatcaataacgacgccctaaccccgactcgacaccaacgcgaaaaacccgcgcgacccgaaactaaccttataccgtccaactaccgcgcgctaataaaccgcgactccgactcccgccgccccgccccgaccgaatcccgactacaaaaacgaacgaaaaactaaacccaaaaaccgcgccgaaaacacataaacccacttaccccgaaaacccgcaaaacgacgacgacgaccataacattcgaaataaccaaacgccgcaaaatcgcgctacctaaccgaccgcaaatactaaacgctccgaaaacgctactataaacaaaaccgaaacgaaactcgacgaaactcgacgataaccgaaacccgaacgaaaccgcctaacaaacccaaacttcgcgaaaacgccccaaaccaaacccaatccgtactacgccccgccccgacacgccccgcnccgcnccgacacgcccgcccccgccccgccccgacacgcccctccccgccccgacacgccccgccccgcccccacgaaacccgcccccgactcgccgctccccgccgcgccccgcacgataaaaaacgcgcattaaaaacctacaaaccgactccaaaaattatttaacaaaacctataaaaaaatttaaacgaaaaaaaaaataaaataatttcttttt

SEQ ID NO: 30113 - DNA, 580 bp, Artificial Sequence
  chemically treated genomic DNA (Homo sapiens) CpG-island No: 30113
gcgcgtttttttcgaggagtcgcggttcgcgaattgtacggtgatgttttggggtcggggtagggagtttgcgcggcgttagttttgggcgtcgttgggttgtcggggttcggggaagttttgacgggttcgcgtgttgggtagggtcgggttagggcggaagtagagggattttttagcgggcgcgaaggagttgggtgcgttttttagggtttcgtgcgtatttgggaagtcgttggttagcgtcgggtttcgcggagtttgattttttgttcggagatttttagcggggttcggtaggtttcggttacgcgttattcgtttcggggaggagtcgttttttggggttttttcgtcggcgtttttcgcggcggggaaggcgtcggcgtggtcgtggatggtggttaatatttgcgttttgcgtttttgtacgttgacggtcgttttggatagggttttgcggggttttcgggtcgcgtcgttggtgacgatgatgttgttggggaagcggggtgttttgggttgcgtcgggtggttgggtttcgggttagggtttttattgcggggttttcgggcggta

SEQ ID NO: 30114 - DNA, 580 bp, Artificial Sequence
  chemically treated genomic DNA (Homo sapiens) CpG-island No: 30114
taccgcccgaaaaccccgcaataaaaaccctaacccgaaacccaaccacccgacgcaacccaaaacaccccgcttccccaacaacatcatcgtcaccaacgacgcgacccgaaaaccccgcaaaaccctatccaaaacgaccgtcaacgtacaaaaacgcaaaacgcaaatattaaccaccatccacgaccacgccgacgccttccccgccgcgaaaaacgccgacgaaaaaaccccaaaaaacgactcctccccgaaacgaataacgcgtaaccgaaacctaccgaaccccgctaaaaatctccgaacaaaaaatcaaactccgcgaaacccgacgctaaccaacgacttcccaaatacgcacgaaaccctaaaaaacgcacccaactccttcgcgcccgctaaaaaatccctctacttccgccctaacccgaccctacccaacacgcgaacccgtcaaaacttccccgaaccccgacaacccaacgacgcccaaaactaacgccgcgcaaactccctaccccgaccccaaaacatcaccgtacaattcgcgaaccgcgactcctcgaaaaaaacgcgc

SEQ ID NO: 30115 - DNA, 580 bp, Artificial Sequence
  chemically treated genomic DNA (Homo sapiens) CpG-island No: 30115
tgtcgttcgggggtttcgtagtggagattttggttcggggtttagttattcggcgtagtttaaggtatttcgtttttttagtaatattatcgttattaacggcgcggttcgggagtttcgtaggattttgtttagggcggtcgttagcgtgtaggagcgtagggcgtaggtgttggttattatttacggttacgtcggcgtttttttcgtcgcgggggacgtcggcgagggggttttagggggcggttttttttcggagcgggtggcgcgtggtcggggtttgtcgggtttcgttgagagttttcgggtagggggttaggtttcgcggggttcggcgttggttaacggttttttaagtgcgtacgaggttttgaagagcgtatttagttttttcgcgttcgttgggaagtttttttgttttcgttttggttcggttttgtttagtacgcgggttcgttagagttttttcgggtttcggtagtttaacggcgtttaggattggcgtcgcgtagattttttgtttcggttttagggtattatcgtgtagttcgcgggtcgcggtttttcggaggaggcgcgt

SEQ ID NO: 30116 - DNA, 580 bp, Artificial Sequence
  chemically treated genomic DNA (Homo sapiens) CpG-island No: 30116
acgcgcctcctccgaaaaaccgcgacccgcgaactacacgataataccctaaaaccgaaacaaaaaatctacgcgacgccaatcctaaacgccgttaaactaccgaaacccgaaaaaactctaacgaacccgcgtactaaacaaaaccgaaccaaaacgaaaacaaaaaaacttcccaacgaacgcgaaaaaactaaatacgctcttcaaaacctcgtacgcacttaaaaaaccgttaaccaacgccgaaccccgcgaaacctaaccccctacccgaaaactctcaacgaaacccgacaaaccccgaccacgcgccacccgctccgaaaaaaaaccgccccctaaaaccccctcgccgacgtcccccgcgacgaaaaaaacgccgacgtaaccgtaaataataaccaacacctacgccctacgctcctacacgctaacgaccgccctaaacaaaatcctacgaaactcccgaaccgcgccgttaataacgataatattactaaaaaaacgaaataccttaaactacgccgaataactaaaccccgaaccaaaatctccactacgaaacccccgaacgaca

SEQ ID NO: 30117 - DNA, 704 bp, Artificial Sequence
  chemically treated genomic DNA (Homo sapiens) CpG-island No: 30117
gcgggagcggattcgcgggagtatttgtgacgtcgtttagtaattcggcgtcgtttcggcggtttcgacgtggtttagtgttcggttggcgtgggttttttaggtcgtatttattaaatcgcgtcggagcgggatacgtatgcgtcggtttggattcggtatttagtaacggattcgagttttttttatcggaagtgggtagtcgcgtagcgggaagagtcggtcgaagcgtggcggttatagattgtgggtatcgggttcgagggattcgcgttttttttttcgtgttatggcgttagcgaaagttacgaacgtggtgcggttgttattaggttttatagcgttgtggttttcgtagttcggtttcgggacggtcgtcgcgtttaagtcggtgattgtttatttggtcgcgaagtggttcgagatttcgttgttgttggaggtaaggtgggtgcgggtcgggttttcgttcgggcgggtgtgggcgcgttgttatttttagtcgcgtttttttcgtgttcgtagcgggtgtttggtttttattcgggttttttagacgttttcgttttggttttgagtattattatttttttttttttcgattcggggcggtttttcggttttcgtgtagtatttatttgtagttttttttttttttagttttattttatttacgatttttaaagtttttttgttttgtttta

SEQ ID NO: 30118 - DNA, 704 bp, Artificial Sequence
  chemically treated genomic DNA (Homo sapiens) CpG-island No: 30118
taaaacaaaacaaaaaaactttaaaaatcgtaaataaaataaaactaaaaaaaaaaaaaactacaaataaatactacacgaaaaccgaaaaaccgccccgaatcgaaaaaaaaaaaaataataatactcaaaaccaaaacgaaaacgtctaaaaaacccgaataaaaaccaaacacccgctacgaacacgaaaaaaacgcgactaaaaataacaacgcgcccacacccgcccgaacgaaaacccgacccgcacccaccttacctccaacaacaacgaaatctcgaaccacttcgcgaccaaataaacaatcaccgacttaaacgcgacgaccgtcccgaaaccgaactacgaaaaccacaacgctataaaacctaataacaaccgcaccacgttcgtaactttcgctaacgccataacacgaaaaaaaaaacgcgaatccctcgaacccgatacccacaatctataaccgccacgcttcgaccgactcttcccgctacgcgactacccacttccgataaaaaaaactcgaatccgttactaaataccgaatccaaaccgacgcatacgtatcccgctccgacgcgatttaataaatacgacctaaaaaacccacgccaaccgaacactaaaccacgtcgaaaccgccgaaacgacgccgaattactaaacgacgtcacaaatactcccgcgaatccgctcccgc

SEQ ID NO: 30119 - DNA, 704 bp, Artificial Sequence
  chemically treated genomic DNA (Homo sapiens) CpG-island No: 30119
taaagtagggtagggaagttttaaaaatcgtaggtaaagtaagattgagggggaaaggaattgtaagtgagtgttgtacgggaatcgagaagtcgtttcgggtcgggaaggaaggaggtggtgatgtttagggttagagcgggggcgtttggagaattcgggtgggagttagatattcgttgcgagtacgaagaaagcgcggttgagggtggtagcgcgtttatattcgttcggacgagggttcggttcgtatttattttgtttttagtagtagcggggtttcgggttatttcgcggttaagtgggtagttatcgatttggacgcggcgatcgtttcggagtcgagttgcgaaagttatagcgttgtggagtttagtagtagtcgtattacgttcgtggttttcgttggcgttatggtacggagagaaaagcgcgagtttttcggattcggtatttatagtttgtggtcgttacgtttcggtcggtttttttcgttgcgcggttgtttattttcggtgggaggagttcgagttcgttattgggtgtcgggtttagatcggcgtatgcgtgtttcgtttcggcgcggtttagtgggtgcggtttggagagtttacgttagtcggatattgggttacgtcggagtcgtcggggcggcgtcgggttgttgagcggcgttatagatgttttcgcgggttcgttttcgt

SEQ ID NO: 30120 - DNA, 704 bp, Artificial Sequence
  chemically treated genomic DNA (Homo sapiens) CpG-island No: 30120
acgaaaacgaacccgcgaaaacatctataacgccgctcaacaacccgacgccgccccgacgactccgacgtaacccaatatccgactaacgtaaactctccaaaccgcacccactaaaccgcgccgaaacgaaacacgcatacgccgatctaaacccgacacccaataacgaactcgaactcctcccaccgaaaataaacaaccgcgcaacgaaaaaaaccgaccgaaacgtaacgaccacaaactataaataccgaatccgaaaaactcgcgcttttctctccgtaccataacgccaacgaaaaccacgaacgtaatacgactactactaaactccacaacgctataactttcgcaactcgactccgaaacgatcgccgcgtccaaatcgataactacccacttaaccgcgaaataacccgaaaccccgctactactaaaaacaaaataaatacgaaccgaaccctcgtccgaacgaatataaacgcgctaccaccctcaaccgcgctttcttcgtactcgcaacgaatatctaactcccacccgaattctccaaacgcccccgctctaaccctaaacatcaccacctccttccttcccgacccgaaacgacttctcgattcccgtacaacactcacttacaattcctttccccctcaatcttactttacctacgatttttaaaacttccctaccctacttta

SEQ ID NO: 30121 - DNA, 558 bp, Artificial Sequence
  chemically treated genomic DNA (Homo sapiens) CpG-island No: 30121
cggttcgggtttcgggagttacggcgcgttggtcgatcggttcgggtagttttacgttcgtttcgggtttagaagcgtagcgatagttttttttttatataaatttgtacgttagagttgtgatttataagcgacgcgttatagttttggcgttatcgggttagtcgggttgacgatcgcgggtttttcggagttttgtttagtttatagcggggacggttttttttttcggtagttgttatcgtagtttcggaagtcgagagtacgattttaaagcggtcgttagatggagttcgataatcgtcgcggacgttagcgagatagattcggttggtagggcggttcgtggatcgcgaaagcgaaatcgtgagtcgagaagtttttttcgaggtcgaaaacgtagtttttttgttttaattttatataaacggtgtttaaaacgcgtttttgtttcgatcgcgatagagttagaagataatttacggcgcgtgggtgtttggagatgtttttcggaagtagggagggagggagggagggagggagggagggagggaggga

SEQ ID NO: 30122 - DNA, 558 bp, Artificial Sequence
  chemically treated genomic DNA (Homo sapiens) CpG-island No: 30122
tccctccctccctccctccctccctccctccctccctccctacttccgaaaaacatctccaaacacccacgcgccgtaaattatcttctaactctatcgcgatcgaaacaaaaacgcgttttaaacaccgtttatataaaattaaaacaaaaaaactacgttttcgacctcgaaaaaaacttctcgactcacgatttcgctttcgcgatccacgaaccgccctaccaaccgaatctatctcgctaacgtccgcgacgattatcgaactccatctaacgaccgctttaaaatcgtactctcgacttccgaaactacgataacaactaccgaaaaaaaaaaccgtccccgctataaactaaacaaaactccgaaaaacccgcgatcgtcaacccgactaacccgataacgccaaaactataacgcgtcgcttataaatcacaactctaacgtacaaatttatataaaaaaaaaactatcgctacgcttctaaacccgaaacgaacgtaaaactacccgaaccgatcgaccaacgcgccgtaactcccgaaacccgaaccg

SEQ ID NO: 30123 - DNA, 558 bp, Artificial Sequence
  chemically treated genomic DNA (Homo sapiens) CpG-island No: 30123
tttttttttttttttttttttttttttttttttttttttttgttttcgagaggtatttttaaatatttacgcgtcgtgggttgttttttgattttgtcgcggtcgaggtagagacgcgttttgggtatcgtttgtgtggggttggggtagaggggttgcgttttcggtttcgggaagagtttttcgatttacggtttcgttttcgcggtttacgggtcgttttgttagtcggatttgtttcgttgacgttcgcggcggttgtcgggttttatttggcggtcgttttgagatcgtgttttcggttttcggagttgcggtggtagttgtcgagggaggggatcgttttcgttgtgagttaggtagagtttcggaaagttcgcggtcgttagttcggttggttcggtggcgttagagttgtggcgcgtcgtttgtgagttatagttttggcgtgtaggtttatgtgggggagaggttgtcgttgcgtttttgggttcgaggcgggcgtggggttgttcgggtcggtcgattagcgcgtcgtagttttcgaggttcgagtcg

SEQ ID NO: 30124 - DNA, 558 bp, Artificial Sequence
  chemically treated genomic DNA (Homo sapiens) CpG-island No: 30124
cgactcgaacctcgaaaactacgacgcgctaatcgaccgacccgaacaaccccacgcccgcctcgaacccaaaaacgcaacgacaacctctcccccacataaacctacacgccaaaactataactcacaaacgacgcgccacaactctaacgccaccgaaccaaccgaactaacgaccgcgaactttccgaaactctacctaactcacaacgaaaacgatcccctccctcgacaactaccaccgcaactccgaaaaccgaaaacacgatctcaaaacgaccgccaaataaaacccgacaaccgccgcgaacgtcaacgaaacaaatccgactaacaaaacgacccgtaaaccgcgaaaacgaaaccgtaaatcgaaaaactcttcccgaaaccgaaaacgcaacccctctaccccaaccccacacaaacgatacccaaaacgcgtctctacctcgaccgcgacaaaatcaaaaaacaacccacgacgcgtaaatatttaaaaatacctctcgaaaacaaaaaaaaaaaaaaaaaaaaaaaaaaaaaaaaaaaaaaaaa

SEQ ID NO: 30125 - DNA, 1303 bp, Artificial Sequence
  chemically treated genomic DNA (Homo sapiens) CpG-island No: 30125
cggtggggttgaaaaaaatgtgggagagggagtttcgcgtggttttagttttatcgcgggtcgaggtcggtggaggtcgcgggcgcgcgaacgggaatcgacgttttcgcgtcggtgcgtcgtagcgttcggcggtcgtttgttggtcgattcgggatacgtgtaggcgtcggttaagttcggagttcgcgggcggtagttggtcgatttcggaggtgtcgatcgagacggggacgtttcggttgcggttcgtttcgacgggtatttttatacgtcgttcggtggagaaggttcgtcggtcgattcgggatacggcgagacgtcggttgagttttacgttcgcgggcggtaggcggtcgatttcggaggttcgatcgaggagaggtcgcgagcggaggtcggtcgggtgcggggacgtttcgtggggtttcgtcgttcgtcgttcgttattcgcggtttgttggtcgattcgtgcggaggagcgaggaggaaggacgcgcgagggtcgggatttcgggtggtcgttttatcggggttcgcgcggttaattttcgggacggggatcggcgggttacgggttcggttcggcgcggtcgttttcgcggtttttaaattacgtttttcggatttcgtttcggttcggagcggacgagtcgtttcggcggtgaacggggaggaggcgggaatcgaagaagcggggcgcgtcgatcggggtcgcgcgtttttttttttttatttttattattacgttcgcggtcggcgggagaggtcgggagggaggaagacgaacggaaggacggacggcgtcggacgcgtacgtttcgtcgggtttttcgtacgtacgcgcgcgcgcgcgcgcgcggataaatttttgtgtcgagggttgatttttaatagatcgtagcgagggagttgttttgttacgtacgaaatttcgatttagaagtaggtcgtttacgaatggtttagcgttaggttttttacgaacgtgcggtgcgtgacgggcgagggggcggtcgttttttcggtcgcgtttcgttttttaggacgaagggtatttcgtatcggatttcggtttcggcgcgcggcggggtacgcgttttttcgcgcgcgcggggcgcgtggagggggggggcggttcgtcggcggggataggcgggggatcggttattcgaggttaatcgaggtttcgcggcgttgtcgtatcgtttcgtttgggcgggattttgatttagaggcgtttagttataattttatagatggtagtttcgttttattggttttttagttaagtatatatatt

SEQ ID NO: 30126 - DNA, 1303 bp, Artificial Sequence
  chemically treated genomic DNA (Homo sapiens) CpG-island No: 30126
aatatatatacttaactaaaaaaccaataaaacgaaactaccatctataaaattataactaaacgcctctaaatcaaaatcccgcccaaacgaaacgatacgacaacgccgcgaaacctcgattaacctcgaataaccgatcccccgcctatccccgccgacgaaccgccccccccctccacgcgccccgcgcgcgcgaaaaaacgcgtaccccgccgcgcgccgaaaccgaaatccgatacgaaatacccttcgtcctaaaaaacgaaacgcgaccgaaaaaacgaccgccccctcgcccgtcacgcaccgcacgttcgtaaaaaacctaacgctaaaccattcgtaaacgacctacttctaaatcgaaatttcgtacgtaacaaaacaactccctcgctacgatctattaaaaatcaaccctcgacacaaaaatttatccgcgcgcgcgcgcgcgcgcgtacgtacgaaaaacccgacgaaacgtacgcgtccgacgccgtccgtccttccgttcgtcttcctccctcccgacctctcccgccgaccgcgaacgtaataataaaaataaaaaaaaaaaaacgcgcgaccccgatcgacgcgccccgcttcttcgattcccgcctcctccccgttcaccgccgaaacgactcgtccgctccgaaccgaaacgaaatccgaaaaacgtaatttaaaaaccgcgaaaacgaccgcgccgaaccgaacccgtaacccgccgatccccgtcccgaaaattaaccgcgcgaaccccgataaaacgaccacccgaaatcccgaccctcgcgcgtccttcctcctcgctcctccgcacgaatcgaccaacaaaccgcgaataacgaacgacgaacgacgaaaccccacgaaacgtccccgcacccgaccgacctccgctcgcgacctctcctcgatcgaacctccgaaatcgaccgcctaccgcccgcgaacgtaaaactcaaccgacgtctcgccgtatcccgaatcgaccgacgaaccttctccaccgaacgacgtataaaaatacccgtcgaaacgaaccgcaaccgaaacgtccccgtctcgatcgacacctccgaaatcgaccaactaccgcccgcgaactccgaacttaaccgacgcctacacgtatcccgaatcgaccaacaaacgaccgccgaacgctacgacgcaccgacgcgaaaacgtcgattcccgttcgcgcgcccgcgacctccaccgacctcgacccgcgataaaactaaaaccacgcgaaactccctctcccacatttttttcaaccccaccg

SEQ ID NO: 30127 - DNA, 1303 bp, Artificial Sequence
  chemically treated genomic DNA (Homo sapiens) CpG-island No: 30127
ggtgtatgtgtttggttgaggagttaatggggcgaagttattatttgtgggattatgattgaacgtttttaagttagaatttcgtttaggcggaacgatacggtagcgtcgcggagtttcggttggtttcggatagtcggtttttcgtttgttttcgtcggcgggtcgttttttttttttacgcgtttcgcgcgcgcgggagggcgcgtgtttcgtcgcgcgtcgggatcggggttcggtgcggagtgtttttcgttttgggaaacggggcgcggtcggaaaggcggtcgttttttcgttcgttacgtatcgtacgttcgtggggaatttggcgttaaattattcgtagacgatttgtttttgggtcggggtttcgtacgtagtagagtagttttttcgttgcgatttattgaaagttagttttcgatataagggtttgttcgcgcgcgcgcgcgcgcgcgtgcgtgcggggggttcggcggggcgtgcgcgttcggcgtcgttcgttttttcgttcgtttttttttttttcggtttttttcgtcgatcgcgggcgtggtggtgggggtgggggggggagggcgcgcgatttcggtcggcgcgtttcgttttttcggttttcgtttttttttcgtttatcgtcggggcggttcgttcgtttcgggtcgggacggggttcggggagcgtggtttgggagtcgcggaggcggtcgcgtcgagtcgggttcgtggttcgtcggttttcgtttcgggggttggtcgcgcgggtttcggtggggcggttattcggggtttcggttttcgcgcgtttttttttttcgttttttcgtacgggtcgattagtagatcgcgggtggcgggcggcgggcggcgaggttttacggggcgttttcgtattcggtcgattttcgttcgcgattttttttcggtcgggttttcggggtcgatcgtttgtcgttcgcgggcgtgagatttagtcggcgtttcgtcgtgtttcgggtcgatcggcgggttttttttatcgagcggcgtgtaggagtgttcgtcgggacgaatcgtaatcggagcgttttcgtttcggtcggtattttcggggtcgattagttgtcgttcgcgagtttcggatttagtcggcgtttgtacgtgtttcgggtcgattagtaggcggtcgtcggacgttgcggcgtatcgacgcgagggcgtcgattttcgttcgcgcgttcgcgatttttatcggtttcggttcgcggtggagttgggattacgcggaatttttttttttatattttttttagttttatcg

SEQ ID NO: 30128 - DNA, 1303 bp, Artificial Sequence
  chemically treated genomic DNA (Homo sapiens) CpG-island No: 30128
cgataaaactaaaaaaaatataaaaaaaaaaattccgcgtaatcccaactccaccgcgaaccgaaaccgataaaaatcgcgaacgcgcgaacgaaaatcgacgccctcgcgtcgatacgccgcaacgtccgacgaccgcctactaatcgacccgaaacacgtacaaacgccgactaaatccgaaactcgcgaacgacaactaatcgaccccgaaaataccgaccgaaacgaaaacgctccgattacgattcgtcccgacgaacactcctacacgccgctcgataaaaaaaacccgccgatcgacccgaaacacgacgaaacgccgactaaatctcacgcccgcgaacgacaaacgatcgaccccgaaaacccgaccgaaaaaaaatcgcgaacgaaaatcgaccgaatacgaaaacgccccgtaaaacctcgccgcccgccgcccgccacccgcgatctactaatcgacccgtacgaaaaaacgaaaaaaaaaaacgcgcgaaaaccgaaaccccgaataaccgccccaccgaaacccgcgcgaccaacccccgaaacgaaaaccgacgaaccacgaacccgactcgacgcgaccgcctccgcgactcccaaaccacgctccccgaaccccgtcccgacccgaaacgaacgaaccgccccgacgataaacgaaaaaaaaacgaaaaccgaaaaaacgaaacgcgccgaccgaaatcgcgcgccctcccccccccacccccaccaccacgcccgcgatcgacgaaaaaaaccgaaaaaaaaaaaaacgaacgaaaaaacgaacgacgccgaacgcgcacgccccgccgaaccccccgcacgcacgcgcgcgcgcgcgcgcgcgaacaaacccttatatcgaaaactaactttcaataaatcgcaacgaaaaaactactctactacgtacgaaaccccgacccaaaaacaaatcgtctacgaataatttaacgccaaattccccacgaacgtacgatacgtaacgaacgaaaaaacgaccgcctttccgaccgcgccccgtttcccaaaacgaaaaacactccgcaccgaaccccgatcccgacgcgcgacgaaacacgcgccctcccgcgcgcgcgaaacgcgtaaaaaaaaaaaacgacccgccgacgaaaacaaacgaaaaaccgactatccgaaaccaaccgaaactccgcgacgctaccgtatcgttccgcctaaacgaaattctaacttaaaaacgttcaatcataatcccacaaataataacttcgccccattaactcctcaaccaaacacatacacc

SEQ ID NO: 30129 - DNA, 2321 bp, Artificial Sequence
  chemically treated genomic DNA (Homo sapiens) CpG-island No: 30129
agcgcggcgaggtttcgacgcggtcggacggtcggtcggggggtttcgcgaggacgggttcggcgtttcgtaagcgaggaggacgacggacggacggacgggtcgcggacgggcggacgggagggagcgagcgggcgcgggggcggcggtcgggatcggtggggtcggggcggggcgcggcgaatcggacgttttaattattcgttttttacgcgatacgattatcggggtttcgcgttatagattcgcgacgttttttcgtcgcgttcgttcgcgaggaggcggacggttcgattcgcgttcggcggtcgggagggatcggcggttacgcgcgcgcgcgcgcggtcggcgttcgcgggcggcggcgaggcggggacggcgtttcgttcgtttcgcggggcggtttcgacgttcgggcggcgagcgagaggcggatcgcggtgttcggttcggggatagtcgcgtcgtgcggtcgtagcgttcgcgtatcggttcggtcgagggttcggggttcggtcgaagttcggtttcgagtttcgtcggcgggcgcgggcgtaggggtggtatacgttatacgacggttaagggagggtcgatcgaggtcggtcggcgcgttcgttttcgttcgggacgggggatcgcgatcggggtcgaggtttcggttcgggttttatttttcgattcggggaaagggcgagcgatcggtaaggcggaggtcgatttacgttatacgtcgtacgaacgtttgttcgggagggattatcgggtcgcgttcgggcgtacgcgcgcgtcgaacggggcgacgttacgcggggaggacgggtttttttcgacgtcgacgttcgggacggacgtttcggggaagggtcgcggtaggttcgggaagcgaggcgtattcgggggacgcgtcgattcggttcggaagagcgggtcgggagaagacgagagattacgggcgaggtcggggcgacggggaaggcgcgagaaaggcggtcggcggggaaggggacgttacggggatttcgcgagcgcggtcgatcgtagtcgggatatacgcgcggggttttatcgtcgtcggcggtatcgcgcggtattcggggcggtcgatcggttttcggcgattttcgcggttttttttattatcgtcgtcgtagtcgcggtcggtttttcggaatcgttttttttttcgtacgcgtcgtaggtcgattttcggaatttttcgggaagtttatcgggttttacgcggggcgttatcgattcggtttttaaggcgcgcgtcgggggacgcggacgtcgggtcgattagtggtcggcggcggcgttttacgaggcggtgtcgggttcggttttaggcggggttattaacggacgtgaagtcggtgagtcgttcggggggaagaagaggatcggcgggcggcgggcggggaagagggtatagacgggcgagggtcggggatcgcgagggtaagggtattcgggagttcgtagaggcggcggttcggggagaaattttaggtacggtcgggttattaggaaaatacggtcgcgggattttatcgttatagatacgagggcggtttcgcggcgtttcgtttgggacgtcggacggttttcggtttttatcgagaatcgtttcgcgagtttcggggtttcgttatcgggggtttcggagcgatcgtagttacgaattcgatacgttcgtattatcgtcgttcgtgattttcgtttatttttcgattcggtttcgtttcgggagatcggcgcgtttttatcgtgggacgtttttttagggttaggcgggttcgatttcgtgttacgtaaacgcggtcgtcggtatcggttacgattcggtacgggagcgggcggagagtcgattcgcggcggagggggttacgcgtcggatagagcgtcgggcgcgtatatttatcgttcgtcggtcgtcgcgttttaattcgttgggaacgtcgggttcggttcggcgggattttttttcgattcggaaggggggaggcgcgggttatagtaggcgacgagtcgtattcggttattatcgcggtggtcggcggaattttcgttttttttttttaatttcgtcgagggggaagcggaggagggttttttgcgagcgggtcgttaacggtagcgttattataacggaggtagagatagaggcggcggttcgggggattcggtatttttaaggtacgttttttagatcgttagagaaggttttttttatcgagggtgggttatattttttttattcgttagtcgttttttttcgggttcgtagaggcgtcgagggacgtttggggaaggga

SEQ ID NO: 30130 - DNA, 2321 bp, Artificial Sequence
  chemically treated genomic DNA (Homo sapiens) CpG-island No: 30130
tcccttccccaaacgtccctcgacgcctctacgaacccgaaaaaaaacgactaacgaataaaaaaaatataacccaccctcgataaaaaaaaccttctctaacgatctaaaaaacgtaccttaaaaataccgaatcccccgaaccgccgcctctatctctacctccgttataataacgctaccgttaacgacccgctcgcaaaaaaccctcctccgcttccccctcgacgaaattaaaaaaaaaaaacgaaaattccgccgaccaccgcgataataaccgaatacgactcgtcgcctactataacccgcgcctccccccttccgaatcgaaaaaaaatcccgccgaaccgaacccgacgttcccaacgaattaaaacgcgacgaccgacgaacgataaatatacgcgcccgacgctctatccgacgcgtaaccccctccgccgcgaatcgactctccgcccgctcccgtaccgaatcgtaaccgataccgacgaccgcgtttacgtaacacgaaatcgaacccgcctaaccctaaaaaaacgtcccacgataaaaacgcgccgatctcccgaaacgaaaccgaatcgaaaaataaacgaaaatcacgaacgacgataatacgaacgtatcgaattcgtaactacgatcgctccgaaacccccgataacgaaaccccgaaactcgcgaaacgattctcgataaaaaccgaaaaccgtccgacgtcccaaacgaaacgccgcgaaaccgccctcgtatctataacgataaaatcccgcgaccgtattttcctaataacccgaccgtacctaaaatttctccccgaaccgccgcctctacgaactcccgaatacccttaccctcgcgatccccgaccctcgcccgtctataccctcttccccgcccgccgcccgccgatcctcttcttccccccgaacgactcaccgacttcacgtccgttaataaccccgcctaaaaccgaacccgacaccgcctcgtaaaacgccgccgccgaccactaatcgacccgacgtccgcgtcccccgacgcgcgccttaaaaaccgaatcgataacgccccgcgtaaaacccgataaacttcccgaaaaattccgaaaatcgacctacgacgcgtacgaaaaaaaaaacgattccgaaaaaccgaccgcgactacgacgacgataataaaaaaaaccgcgaaaatcgccgaaaaccgatcgaccgccccgaataccgcgcgataccgccgacgacgataaaaccccgcgcgtatatcccgactacgatcgaccgcgctcgcgaaatccccgtaacgtccccttccccgccgaccgcctttctcgcgccttccccgtcgccccgacctcgcccgtaatctctcgtcttctcccgacccgctcttccgaaccgaatcgacgcgtcccccgaatacgcctcgcttcccgaacctaccgcgacccttccccgaaacgtccgtcccgaacgtcgacgtcgaaaaaaacccgtcctccccgcgtaacgtcgccccgttcgacgcgcgcgtacgcccgaacgcgacccgataatccctcccgaacaaacgttcgtacgacgtataacgtaaatcgacctccgccttaccgatcgctcgccctttccccgaatcgaaaaataaaacccgaaccgaaacctcgaccccgatcgcgatcccccgtcccgaacgaaaacgaacgcgccgaccgacctcgatcgaccctcccttaaccgtcgtataacgtataccacccctacgcccgcgcccgccgacgaaactcgaaaccgaacttcgaccgaaccccgaaccctcgaccgaaccgatacgcgaacgctacgaccgcacgacgcgactatccccgaaccgaacaccgcgatccgcctctcgctcgccgcccgaacgtcgaaaccgccccgcgaaacgaacgaaacgccgtccccgcctcgccgccgcccgcgaacgccgaccgcgcgcgcgcgcgcgtaaccgccgatccctcccgaccgccgaacgcgaatcgaaccgtccgcctcctcgcgaacgaacgcgacgaaaaaacgtcgcgaatctataacgcgaaaccccgataatcgtatcgcgtaaaaaacgaataattaaaacgtccgattcgccgcgccccgccccgaccccaccgatcccgaccgccgcccccgcgcccgctcgctccctcccgtccgcccgtccgcgacccgtccgtccgtccgtcgtcctcctcgcttacgaaacgccgaacccgtcctcgcgaaaccccccgaccgaccgtccgaccgcgtcgaaacctcgccgcgct

SEQ ID NO: 30131 - DNA, 2321 bp, Artificial Sequence
  chemically treated genomic DNA (Homo sapiens) CpG-island No: 30131
ttttttttttaggcgtttttcggcgtttttgcgggttcgaggaggagcggttggcgggtggggggagtgtgatttattttcggtgagaaaagttttttttagcgatttgagaggcgtgttttgggggtatcggatttttcgggtcgtcgtttttgtttttgttttcgttatggtagcgttgtcgttagcgattcgttcgtagaggattttttttcgtttttttttcgacggggttgggggggagaagcgagggtttcgtcggttatcgcggtggtggtcgagtgcggttcgtcgtttattgtggttcgcgttttttttttttcgagtcgggggaggatttcgtcgggtcgggttcggcgtttttagcgggttgggacgcggcggtcggcgggcggtgggtgtgcgcgttcggcgttttgttcggcgcgtgatttttttcgtcgcgagtcggtttttcgttcgttttcgtgtcgagtcgtgatcggtgtcgacgatcgcgtttgcgtggtacggggtcgggttcgtttggttttgggaaagcgttttacggtgggggcgcgtcggtttttcggagcgggatcgggtcggaggatggacgagaattacgagcgacggtggtgcgggcgtgtcgggttcgtggttgcggtcgtttcggggttttcggtggcggggtttcggggttcgcgaggcggttttcggtgggggtcgagggtcgttcggcgttttaggcggggcgtcgcgggatcgttttcgtgtttgtggcggtgggatttcgcggtcgtgtttttttggtggttcggtcgtgtttgaggttttttttcgagtcgtcgtttttgcgggttttcgggtgtttttgttttcgcggttttcggttttcgttcgtttgtgttttttttttcgttcgtcgttcgtcgatttttttttttttttcgagcggtttatcggttttacgttcgttggtggtttcgtttgggatcgaattcggtatcgtttcgtggggcgtcgtcgtcggttattgatcggttcggcgttcgcgtttttcggcgcgcgttttggggatcgggtcggtggcgtttcgcgtggggttcggtgggtttttcggagggtttcgggggtcggtttgcggcgcgtgcgggggaggagacggtttcgggggatcggtcgcgattgcggcggcggtggtggggggagtcgcggggatcgtcgagggtcggtcggtcgtttcgggtgtcgcgcggtgtcgtcggcggcggtgaggtttcgcgcgtgtgtttcggttgcggtcggtcgcgttcgcggggttttcgtggcgttttttttttcgtcggtcgtttttttcgcgtttttttcgtcgtttcggtttcgttcgtggtttttcgttttttttcggttcgttttttcgaatcgggtcggcgcgtttttcgggtgcgtttcgtttttcgggtttgtcgcggttttttttcgaggcgttcgtttcgggcgtcggcgtcggggagagttcgtttttttcgcgtggcgtcgtttcgttcggcgcgcgcgtgcgttcgagcgcggttcggtggtttttttcggataggcgttcgtgcgacgtgtggcgtgggtcgattttcgttttgtcggtcgttcgtttttttttcgggtcggggggtggggttcgggtcggggtttcggtttcggtcgcggtttttcgtttcgggcgggggcgggcgcgtcggtcggtttcggtcggtttttttttggtcgtcgtgtggcgtgtgttatttttgcgttcgcgttcgtcggcggggttcggagtcgggtttcggtcgggtttcgggttttcgatcggatcggtgcgcgggcgttgcggtcgtacggcgcgattgttttcgggtcgggtatcgcggttcgtttttcgttcgtcgttcggacgtcggggtcgtttcgcggggcgggcggagcgtcgttttcgtttcgtcgtcgttcgcgggcgtcggtcgcgcgcgcgcgcgcgtggtcgtcggtttttttcggtcgtcgggcgcgggtcgggtcgttcgttttttcgcgggcgggcgcgacgaagaagcgtcgcgggtttgtggcgcggggtttcggtggtcgtgtcgcgtggggggcgggtggttggggcgttcggttcgtcgcgtttcgtttcggttttatcggtttcggtcgtcgttttcgcgttcgttcgttttttttcgttcgttcgttcgcggttcgttcgttcgttcgtcgtttttttcgtttgcggggcgtcgggttcgttttcgcgaggtttttcggtcggtcgttcggtcgcgtcggggtttcgtcgcgtt

SEQ ID NO: 30132 - DNA, 2321 bp, Artificial Sequence
  chemically treated genomic DNA (Homo sapiens) CpG-island No: 30132
aacgcgacgaaaccccgacgcgaccgaacgaccgaccgaaaaacctcgcgaaaacgaacccgacgccccgcaaacgaaaaaaacgacgaacgaacgaacgaaccgcgaacgaacgaacgaaaaaaaacgaacgaacgcgaaaacgacgaccgaaaccgataaaaccgaaacgaaacgcgacgaaccgaacgccccaaccacccgccccccacgcgacacgaccaccgaaaccccgcgccacaaacccgcgacgcttcttcgtcgcgcccgcccgcgaaaaaacgaacgacccgacccgcgcccgacgaccgaaaaaaaccgacgaccacgcgcgcgcgcgcgcgaccgacgcccgcgaacgacgacgaaacgaaaacgacgctccgcccgccccgcgaaacgaccccgacgtccgaacgacgaacgaaaaacgaaccgcgatacccgacccgaaaacaatcgcgccgtacgaccgcaacgcccgcgcaccgatccgatcgaaaacccgaaacccgaccgaaacccgactccgaaccccgccgacgaacgcgaacgcaaaaataacacacgccacacgacgaccaaaaaaaaaccgaccgaaaccgaccgacgcgcccgcccccgcccgaaacgaaaaaccgcgaccgaaaccgaaaccccgacccgaaccccaccccccgacccgaaaaaaaaacgaacgaccgacaaaacgaaaatcgacccacgccacacgtcgcacgaacgcctatccgaaaaaaaccaccgaaccgcgctcgaacgcacgcgcgcgccgaacgaaacgacgccacgcgaaaaaaacgaactctccccgacgccgacgcccgaaacgaacgcctcgaaaaaaaaccgcgacaaacccgaaaaacgaaacgcacccgaaaaacgcgccgacccgattcgaaaaaacgaaccgaaaaaaaacgaaaaaccacgaacgaaaccgaaacgacgaaaaaaacgcgaaaaaaacgaccgacgaaaaaaaaaacgccacgaaaaccccgcgaacgcgaccgaccgcaaccgaaacacacgcgcgaaacctcaccgccgccgacgacaccgcgcgacacccgaaacgaccgaccgaccctcgacgatccccgcgactccccccaccaccgccgccgcaatcgcgaccgatcccccgaaaccgtctcctcccccgcacgcgccgcaaaccgacccccgaaaccctccgaaaaacccaccgaaccccacgcgaaacgccaccgacccgatccccaaaacgcgcgccgaaaaacgcgaacgccgaaccgatcaataaccgacgacgacgccccacgaaacgataccgaattcgatcccaaacgaaaccaccaacgaacgtaaaaccgataaaccgctcgaaaaaaaaaaaaaaatcgacgaacgacgaacgaaaaaaaaaacacaaacgaacgaaaaccgaaaaccgcgaaaacaaaaacacccgaaaacccgcaaaaacgacgactcgaaaaaaaacctcaaacacgaccgaaccaccaaaaaaacacgaccgcgaaatcccaccgccacaaacacgaaaacgatcccgcgacgccccgcctaaaacgccgaacgaccctcgacccccaccgaaaaccgcctcgcgaaccccgaaaccccgccaccgaaaaccccgaaacgaccgcaaccacgaacccgacacgcccgcaccaccgtcgctcgtaattctcgtccatcctccgacccgatcccgctccgaaaaaccgacgcgcccccaccgtaaaacgctttcccaaaaccaaacgaacccgaccccgtaccacgcaaacgcgatcgtcgacaccgatcacgactcgacacgaaaacgaacgaaaaaccgactcgcgacgaaaaaaatcacgcgccgaacaaaacgccgaacgcgcacacccaccgcccgccgaccgccgcgtcccaacccgctaaaaacgccgaacccgacccgacgaaatcctcccccgactcgaaaaaaaaaaaacgcgaaccacaataaacgacgaaccgcactcgaccaccaccgcgataaccgacgaaaccctcgcttctcccccccaaccccgtcgaaaaaaaaacgaaaaaaaatcctctacgaacgaatcgctaacgacaacgctaccataacgaaaacaaaaacaaaaacgacgacccgaaaaatccgatacccccaaaacacgcctctcaaatcgctaaaaaaaacttttctcaccgaaaataaatcacactccccccacccgccaaccgctcctcctcgaacccgcaaaaacgccgaaaaacgcctaaaaaaaaaa

SEQ ID NO: 30133 - DNA, 953 bp, Artificial Sequence
  chemically treated genomic DNA (Homo sapiens) CpG-island No: 30133
gtgttttaagacgggtcgggtgggtagtcgacgtcgtcgtcgatttcgtgcgttcgtttcgtcgttttttttttcgggggacgcgcgcgtggtttcgagagaatttttttcgggttcgacggcgcgattcgttcggggcgtattggggatagttcgtttcgtttttcgattcgcgcgcggtatttttttcgtcgtcggggcgggggcgcggggaggaggggtgggagagcggtcgcgtcgtgggaggggtggttcggtttttttacgaggagacgtcggcgcgttttcgcgggggagatttttttcgcgggggatttttcgcgggggtgggcgtcgggaggggggagagcgcggcgacgggtttcgttttttcggtttcgggattcggcgagtgttgttgtcgggggggttgtaatattcggggggggtttcggtttcgtcgtcgtcgtcgttatcgtcgtcgtcgtcgtttcgattcgcgcgttttttcgagggaggacgcggggtcggggggcggagacgggggaggaggaggacggacggacggacggggtttttcgagttatttttttcgtcgggtttttttagtcgtttcggagtcggtcgcggcgtatcgtcgcggtggaaatgcgttcggcggcggtcggtcgtcggtcgggggacggtttttcgtcgattttattttcggtttcgttcgtttattttcgtattcgtcggagttcgtttttttcggggaggaggaggaggggcggcgggggaagggagggcgggtggaggggtcgggaggaacggggggcgggaaagattcgtcgggtcgtcgatacggtcggattcgtcgtcgggttgaatttttcgggcggattgcgcggattttattcgtttattttttaacggttttacgtttttttgaattttttttttaaagttttttttaatttttttttacggtattt

SEQ ID NO: 30134 - DNA, 953 bp, Artificial Sequence
  chemically treated genomic DNA (Homo sapiens) CpG-island No: 30134
aaataccgtaaaaaaaaattaaaaaaaactttaaaaaaaaaattcaaaaaaacgtaaaaccgttaaaaaataaacgaataaaatccgcgcaatccgcccgaaaaattcaacccgacgacgaatccgaccgtatcgacgacccgacgaatctttcccgccccccgttcctcccgacccctccacccgccctcccttcccccgccgcccctcctcctcctccccgaaaaaaacgaactccgacgaatacgaaaataaacgaacgaaaccgaaaataaaatcgacgaaaaaccgtcccccgaccgacgaccgaccgccgccgaacgcatttccaccgcgacgatacgccgcgaccgactccgaaacgactaaaaaaacccgacgaaaaaaataactcgaaaaaccccgtccgtccgtccgtcctcctcctcccccgtctccgccccccgaccccgcgtcctccctcgaaaaaacgcgcgaatcgaaacgacgacgacgacgataacgacgacgacgacgaaaccgaaaccccccccgaatattacaacccccccgacaacaacactcgccgaatcccgaaaccgaaaaaacgaaacccgtcgccgcgctctcccccctcccgacgcccacccccgcgaaaaatcccccgcgaaaaaaatctcccccgcgaaaacgcgccgacgtctcctcgtaaaaaaaccgaaccacccctcccacgacgcgaccgctctcccacccctcctccccgcgcccccgccccgacgacgaaaaaaataccgcgcgcgaatcgaaaaacgaaacgaactatccccaatacgccccgaacgaatcgcgccgtcgaacccgaaaaaaattctctcgaaaccacgcgcgcgtcccccgaaaaaaaaaacgacgaaacgaacgcacgaaatcgacgacgacgtcgactacccacccgacccgtcttaaaacac

SEQ ID NO: 30135 - DNA, 953 bp, Artificial Sequence
  chemically treated genomic DNA (Homo sapiens) CpG-island No: 30135
aagtatcgtaagggaaagttgaaaagaattttgaagagagagtttaagagggcgtgaaatcgttaagaggtaaacgggtggggttcgcgtagttcgttcggaggatttaattcggcggcgggttcggtcgtgtcggcggttcggcggatttttttcgtttttcgtttttttcgatttttttattcgtttttttttttttcgtcgtttttttttttttttttcggagggggcgggtttcggcgggtgcgggggtgggcgggcggggtcgggggtggggtcggcgggggatcgtttttcgatcggcgatcggtcgtcgtcgggcgtatttttatcgcggcggtgcgtcgcgatcggtttcgggacggttgggaaggttcggcggggaaggtggttcggggggtttcgttcgttcgttcgttttttttttttttcgttttcgtttttcggtttcgcgttttttttcgggagggcgcgcgggtcggggcggcggcggcggcggtggcggcggcggcggcgggatcgaaatttttttcgagtgttatagttttttcggtagtagtattcgtcgaatttcggggtcgagggagcgagattcgtcgtcgcgtttttttttttttcggcgtttattttcgcggggaatttttcgcgaggggggtttttttcgcgggggcgcgtcggcgttttttcgtgggggggtcgggttattttttttacggcgcgatcgtttttttatttttttttttcgcgttttcgtttcggcgacggggggggtgtcgcgcgcgggtcggggggcggggcggattgtttttagtgcgtttcgggcgggtcgcgtcgtcgggttcgggggaggttttttcggggttacgcgcgcgtttttcgaagagggggacggcggagcgagcgtacggggtcggcggcgacgtcggttatttattcgattcgttttgaaatat

SEQ ID NO: 30136 - DNA, 953 bp, Artificial Sequence
  chemically treated genomic DNA (Homo sapiens) CpG-island No: 30136
atatttcaaaacgaatcgaataaataaccgacgtcgccgccgaccccgtacgctcgctccgccgtccccctcttcgaaaaacgcgcgcgtaaccccgaaaaaacctcccccgaacccgacgacgcgacccgcccgaaacgcactaaaaacaatccgccccgccccccgacccgcgcgcgacaccccccccgtcgccgaaacgaaaacgcgaaaaaaaaaaataaaaaaacgatcgcgccgtaaaaaaaataacccgacccccccacgaaaaaacgccgacgcgcccccgcgaaaaaaacccccctcgcgaaaaattccccgcgaaaataaacgccgaaaaaaaaaaaaacgcgacgacgaatctcgctccctcgaccccgaaattcgacgaatactactaccgaaaaaactataacactcgaaaaaaatttcgatcccgccgccgccgccgccaccgccgccgccgccgccccgacccgcgcgccctcccgaaaaaaaacgcgaaaccgaaaaacgaaaacgaaaaaaaaaaaaaacgaacgaacgaacgaaaccccccgaaccaccttccccgccgaaccttcccaaccgtcccgaaaccgatcgcgacgcaccgccgcgataaaaatacgcccgacgacgaccgatcgccgatcgaaaaacgatcccccgccgaccccacccccgaccccgcccgcccacccccgcacccgccgaaacccgccccctccgaaaaaaaaaaaaaaaaacgacgaaaaaaaaaaaaacgaataaaaaaatcgaaaaaaacgaaaaacgaaaaaaatccgccgaaccgccgacacgaccgaacccgccgccgaattaaatcctccgaacgaactacgcgaaccccacccgtttacctcttaacgatttcacgccctcttaaactctctcttcaaaattcttttcaactttcccttacgatactt

SEQ ID NO: 30137 - DNA, 792 bp, Artificial Sequence
  chemically treated genomic DNA (Homo sapiens) CpG-island No: 30137
attcgatttcgggaagattcgggttcggcgcgtcgggggtcgttatcggttttatatcgtttacgggttgggtttcgattagaaggatttgggttttttacgagcggcgtcggggagcgggtttttcgtacgttatatgtttcgcgtttcgtcgcggggcggggattcggcgttgggtttttttttgtttattcgtcgttattgagggaattttggttagttttttttttttcgttgattaatatgtttaaatttagcgggtcgttacgtttgatttgaggtcgcgtttcggagggggacgggtcgttcggcggacggacggacggaatcgcgtcggttcgatcgttcgttcgacgtttcgtcgggagacgggttcggcgagggggagaggcgacgggagagagagcgcgcggtcgacggtattttcgcgtcgtttcgtcggagcgggacgatcggagggaggggtacgggtcgggggcgggacgggcgtcgtacgtttcgattcgtttttttcgcggaggtcggggggacgggttcgaggacgcggcggcggagtcgtttcgtttcgacgcggaagttcgggacggggtttcggcgcggcgcggcgcggtcgcgagtcggaggcgggcgcgcgacggcggacgatatcgcggcgtttcgcgggtcgtcgtcggggatacgcgaatttcggcgtcgcggttacgggcgcggtcgggcgggtcgcggggcgggttttcggtttcggtcgacgcgtcgcgaggcgagtcgggcgggcgggcgcgcgcgcgtacg

SEQ ID NO: 30138 - DNA, 792 bp, Artificial Sequence
  chemically treated genomic DNA (Homo sapiens) CpG-island No: 30138
cgtacgcgcgcgcgcccgcccgcccgactcgcctcgcgacgcgtcgaccgaaaccgaaaacccgccccgcgacccgcccgaccgcgcccgtaaccgcgacgccgaaattcgcgtatccccgacgacgacccgcgaaacgccgcgatatcgtccgccgtcgcgcgcccgcctccgactcgcgaccgcgccgcgccgcgccgaaaccccgtcccgaacttccgcgtcgaaacgaaacgactccgccgccgcgtcctcgaacccgtccccccgacctccgcgaaaaaaacgaatcgaaacgtacgacgcccgtcccgcccccgacccgtacccctccctccgatcgtcccgctccgacgaaacgacgcgaaaataccgtcgaccgcgcgctctctctcccgtcgcctctccccctcgccgaacccgtctcccgacgaaacgtcgaacgaacgatcgaaccgacgcgattccgtccgtccgtccgccgaacgacccgtccccctccgaaacgcgacctcaaatcaaacgtaacgacccgctaaatttaaacatattaatcaacgaaaaaaaaaaaactaaccaaaattccctcaataacgacgaataaacaaaaaaaaacccaacgccgaatccccgccccgcgacgaaacgcgaaacatataacgtacgaaaaacccgctccccgacgccgctcgtaaaaaacccaaatccttctaatcgaaacccaacccgtaaacgatataaaaccgataacgacccccgacgcgccgaacccgaatcttcccgaaatcgaat

SEQ ID NO: 30139 - DNA, 792 bp, Artificial Sequence
  chemically treated genomic DNA (Homo sapiens) CpG-island No: 30139
cgtacgcgcgcgcgttcgttcgttcggttcgtttcgcggcgcgtcggtcggggtcgggagttcgtttcgcggttcgttcggtcgcgttcgtggtcgcggcgtcggggttcgcgtgttttcggcggcgattcgcgggacgtcgcggtgtcgttcgtcgtcgcgcgttcgttttcggttcgcggtcgcgtcgcgtcgcgtcggggtttcgtttcgagttttcgcgtcggggcggggcggtttcgtcgtcgcgttttcggattcgttttttcgattttcgcgggggagacgggtcggggcgtgcggcgttcgtttcgttttcggttcgtgttttttttttcggtcgtttcgtttcggcggggcggcgcgggggtgtcgtcggtcgcgcgttttttttttcgtcgtttttttttttcgtcgggttcgtttttcgacggagcgtcgggcgggcggtcgggtcggcgcgatttcgttcgttcgttcgtcgagcggttcgttttttttcgagacgcgattttagattagacgtggcgattcgttgaatttaagtatattagttagcggaggagaagaaattaattaggatttttttagtaacggcgagtgaatagggaagagtttagcgtcgaattttcgtttcgcggcggggcgcgggatatgtggcgtacggaagattcgtttttcggcgtcgttcgtggggggtttaagtttttttgatcgaggtttagttcgtggacggtgtgaggtcggtagcggttttcggcgcgtcgggttcgggttttttcggagtcgggt

SEQ ID NO: 30140 - DNA, 792 bp, Artificial Sequence
  chemically treated genomic DNA (Homo sapiens) CpG-island No: 30140
acccgactccgaaaaaacccgaacccgacgcgccgaaaaccgctaccgacctcacaccgtccacgaactaaacctcgatcaaaaaaacttaaaccccccacgaacgacgccgaaaaacgaatcttccgtacgccacatatcccgcgccccgccgcgaaacgaaaattcgacgctaaactcttccctattcactcgccgttactaaaaaaatcctaattaatttcttctcctccgctaactaatatacttaaattcaacgaatcgccacgtctaatctaaaatcgcgtctcgaaaaaaaacgaaccgctcgacgaacgaacgaacgaaatcgcgccgacccgaccgcccgcccgacgctccgtcgaaaaacgaacccgacgaaaaaaaaaaacgacgaaaaaaaaaacgcgcgaccgacgacacccccgcgccgccccgccgaaacgaaacgaccgaaaaaaaaaacacgaaccgaaaacgaaacgaacgccgcacgccccgacccgtctcccccgcgaaaatcgaaaaaacgaatccgaaaacgcgacgacgaaaccgccccgccccgacgcgaaaactcgaaacgaaaccccgacgcgacgcgacgcgaccgcgaaccgaaaacgaacgcgcgacgacgaacgacaccgcgacgtcccgcgaatcgccgccgaaaacacgcgaaccccgacgccgcgaccacgaacgcgaccgaacgaaccgcgaaacgaactcccgaccccgaccgacgcgccgcgaaacgaaccgaacgaacgaacgcgcgcgcgtacg

SEQ ID NO: 30141 - DNA, 954 bp, Artificial Sequence
  chemically treated genomic DNA (Homo sapiens) CpG-island No: 30141
gtttattatttttcgggttttaatacgtgcgttcgtgttttattttttcggcgcggcgggcgagacgggtcggtggtgcgttttcggcggattggagaggtttcgggattttatttcggtcggcgagcgcgtcggtttttatttttattgcgttacggcggttttcgtgcgagttttcgattcgcgtacgtgttagattttttggttcgtgttttaagacgggtcgggtgggtagtcgacgtcgtcgtcgatttcgtgcgttcgtttcgtcgttttttttttcgggggacgcgcgcgtggtttcgagagaatttttttcgggttcgacggcgcgattcgttcggggcgtattggggatagttcgtttcgtttttcgattcgcgcgcggtatttttttcgtcgtcggggcgggggcgcggggaggaggggtgggagagcggtcgcgtcgtgggaggggtggttcggtttttttacgaggagacgtcggcgcgttttcgcgggggagatttttttcgcgggggatttttcgcgggggtgggcgtcgggaggggggagagcgcggcgacgggtttcgttttttcggtttcgggattcggcgagtgttgttgtcgggggggttgtaatattcggggggggtttcggtttcgtcgtcgtcgtcgtcgtcgttatcgtcgtcgtcgtcgtttcgattcgcgcgttttttcgagggaggacgcggggtcggggggcggagacgggggaggaggaggacggacggacggacggacggggtttttcgagttatttttttcgtcgggtttttttagtcgtttcggagtcggtcgcggcgtatcgtcgcggtggaaatgcgttcggcggcggtcggtcgtcggtcgggggacggtttttcgtcgattttattattggtttttttttttttttttttttttcgtttttttttttcgtttttttttt

SEQ ID NO: 30142 - DNA, 954 bp, Artificial Sequence
  chemically treated genomic DNA (Homo sapiens) CpG-island No: 30142
aaaaaaaaaacgaaaaaaaaaaacgaaaaaaaaaaaaaaaaaaaaaaaccaataataaaatcgacgaaaaaccgtcccccgaccgacgaccgaccgccgccgaacgcatttccaccgcgacgatacgccgcgaccgactccgaaacgactaaaaaaacccgacgaaaaaaataactcgaaaaaccccgtccgtccgtccgtccgtcctcctcctcccccgtctccgccccccgaccccgcgtcctccctcgaaaaaacgcgcgaatcgaaacgacgacgacgacgataacgacgacgacgacgacgacgaaaccgaaaccccccccgaatattacaacccccccgacaacaacactcgccgaatcccgaaaccgaaaaaacgaaacccgtcgccgcgctctcccccctcccgacgcccacccccgcgaaaaatcccccgcgaaaaaaatctcccccgcgaaaacgcgccgacgtctcctcgtaaaaaaaccgaaccacccctcccacgacgcgaccgctctcccacccctcctccccgcgcccccgccccgacgacgaaaaaaataccgcgcgcgaatcgaaaaacgaaacgaactatccccaatacgccccgaacgaatcgcgccgtcgaacccgaaaaaaattctctcgaaaccacgcgcgcgtcccccgaaaaaaaaaacgacgaaacgaacgcacgaaatcgacgacgacgtcgactacccacccgacccgtcttaaaacacgaaccaaaaaatctaacacgtacgcgaatcgaaaactcgcacgaaaaccgccgtaacgcaataaaaataaaaaccgacgcgctcgccgaccgaaataaaatcccgaaacctctccaatccgccgaaaacgcaccaccgacccgtctcgcccgccgcgccgaaaaaataaaacacgaacgcacgtattaaaacccgaaaaataataaac

SEQ ID NO: 30143 - DNA, 954 bp, Artificial Sequence
  chemically treated genomic DNA (Homo sapiens) CpG-island No: 30143
aagaaaagagcgaagaaagaaaacgaaaaaaaaaagaaaaaaaaaaaattaatggtggggtcggcgggggatcgtttttcgatcggcgatcggtcgtcgtcgggcgtatttttatcgcggcggtgcgtcgcgatcggtttcgggacggttgggaaggttcggcggggaaggtggttcggggggtttcgttcgttcgttcgttcgttttttttttttttcgttttcgtttttcggtttcgcgttttttttcgggagggcgcgcgggtcggggcggcggcggcggcggtggcggcggcggcggcggcggcgggatcgaaatttttttcgagtgttatagttttttcggtagtagtattcgtcgaatttcggggtcgagggagcgagattcgtcgtcgcgtttttttttttttcggcgtttattttcgcggggaatttttcgcgaggggggtttttttcgcgggggcgcgtcggcgttttttcgtgggggggtcgggttattttttttacggcgcgatcgtttttttatttttttttttcgcgttttcgtttcggcgacggggggggtgtcgcgcgcgggtcggggggcggggcggattgtttttagtgcgtttcgggcgggtcgcgtcgtcgggttcgggggaggttttttcggggttacgcgcgcgtttttcgaagagggggacggcggagcgagcgtacggggtcggcggcgacgtcggttatttattcgattcgttttgaaatacggattaaggagtttaatacgtgcgcgagtcgggggttcgtacgaaagtcgtcgtggcgtaatgaaggtgaaggtcggcgcgttcgtcggtcgaggtgggatttcgaggtttttttagttcgtcgagggcgtattatcggttcgtttcgttcgtcgcgtcggggaggtggagtacgagcgtacgtgttaggattcgaaagatggtgaat

SEQ ID NO: 30144 - DNA, 954 bp, Artificial Sequence
  chemically treated genomic DNA (Homo sapiens) CpG-island No: 30144
attcaccatctttcgaatcctaacacgtacgctcgtactccacctccccgacgcgacgaacgaaacgaaccgataatacgccctcgacgaactaaaaaaacctcgaaatcccacctcgaccgacgaacgcgccgaccttcaccttcattacgccacgacgactttcgtacgaacccccgactcgcgcacgtattaaactccttaatccgtatttcaaaacgaatcgaataaataaccgacgtcgccgccgaccccgtacgctcgctccgccgtccccctcttcgaaaaacgcgcgcgtaaccccgaaaaaacctcccccgaacccgacgacgcgacccgcccgaaacgcactaaaaacaatccgccccgccccccgacccgcgcgcgacaccccccccgtcgccgaaacgaaaacgcgaaaaaaaaaaataaaaaaacgatcgcgccgtaaaaaaaataacccgacccccccacgaaaaaacgccgacgcgcccccgcgaaaaaaacccccctcgcgaaaaattccccgcgaaaataaacgccgaaaaaaaaaaaaacgcgacgacgaatctcgctccctcgaccccgaaattcgacgaatactactaccgaaaaaactataacactcgaaaaaaatttcgatcccgccgccgccgccgccgccgccaccgccgccgccgccgccccgacccgcgcgccctcccgaaaaaaaacgcgaaaccgaaaaacgaaaacgaaaaaaaaaaaaaacgaacgaacgaacgaacgaaaccccccgaaccaccttccccgccgaaccttcccaaccgtcccgaaaccgatcgcgacgcaccgccgcgataaaaatacgcccgacgacgaccgatcgccgatcgaaaaacgatcccccgccgaccccaccattaattttttttttttcttttttttttcgttttctttcttcgctcttttctt

SEQ ID NO: 30145 - DNA, 617 bp, Artificial Sequence
  chemically treated genomic DNA (Homo sapiens) CpG-island No: 30145
gagcgtcgtttcgaagggacgggcgatggttttcgttgttttcggtcgatcgaaagggagtcgggtttagattttcgaattcggagtggcggagatgggcgtcgcgaggcgtttagtgcggtaacgcgatcgatttcggagaagtcggcgggagtttcggggagagtttttttttttttgtgaagggtagggcgttttggaatgggttcgtttcgagagaggggttcgtgttttggaaagcgtcgcggtttcggcggcgttcggtgagttttcgttggtttttgaaaattcgggggagagggtgtaaatttcgcgtcgggtcgtatttatattcgtagtaggtttttaaggtgaatagtttttggtatgttggaataatgtaggtaagggaagtcggtaagtcggattcgtaatttcgggataaggattggttttaagggttgggtcggtcgggttggggcgcgaagcggggttgggcgcgcgtcgcggttggacgaggcgtcgtcgttttttttatcgtcggtgtattttttttgcggtattcgggttggagatttattttaattgttttttttggtatttatttttagtattcgtattttgtttatttttgaatt

SEQ ID NO: 30146 - DNA, 617 bp, Artificial Sequence
  chemically treated genomic DNA (Homo sapiens) CpG-island No: 30146
aattcaaaaataaacaaaatacgaatactaaaaataaataccaaaaaaaacaattaaaataaatctccaacccgaataccgcaaaaaaaatacaccgacgataaaaaaaacgacgacgcctcgtccaaccgcgacgcgcgcccaaccccgcttcgcgccccaacccgaccgacccaacccttaaaaccaatccttatcccgaaattacgaatccgacttaccgacttcccttacctacattattccaacataccaaaaactattcaccttaaaaacctactacgaatataaatacgacccgacgcgaaatttacaccctctcccccgaattttcaaaaaccaacgaaaactcaccgaacgccgccgaaaccgcgacgctttccaaaacacgaacccctctctcgaaacgaacccattccaaaacgccctacccttcacaaaaaaaaaaaaactctccccgaaactcccgccgacttctccgaaatcgatcgcgttaccgcactaaacgcctcgcgacgcccatctccgccactccgaattcgaaaatctaaacccgactccctttcgatcgaccgaaaacaacgaaaaccatcgcccgtcccttcgaaacgacgctc

SEQ ID NO: 30147 - DNA, 617 bp, Artificial Sequence
  chemically treated genomic DNA (Homo sapiens) CpG-island No: 30147
ggtttagagatgagtaaaatgcgggtattaaagataggtattaaaggggatagttgaaatgaatttttagttcgagtgtcgtaaagagggtgtatcgacgatggggggggcggcggcgtttcgtttagtcgcggcgcgcgtttagtttcgtttcgcgttttagttcgatcgatttagtttttagagttaatttttatttcgaagttacggattcggtttgtcgattttttttatttatattgttttaatatgttagaggttgtttattttggagatttgttgcggatatgggtacggttcggcgcgagatttatattttttttttcggatttttaagggttagcgagagtttatcggacgtcgtcggaatcgcgacgttttttaaggtacgggtttttttttcggggcgaatttattttagggcgttttgttttttataaagaaaagagaatttttttcggggttttcgtcggttttttcgggatcggtcgcgttatcgtattggacgtttcgcggcgtttattttcgttatttcggattcggggatttgaattcgattttttttcgatcggtcgagggtaacggaggttatcgttcgttttttcggaacggcgttt

SEQ ID NO: 30148 - DNA, 617 bp, Artificial Sequence
  chemically treated genomic DNA (Homo sapiens) CpG-island No: 30148
aaacgccgttccgaaaaaacgaacgataacctccgttaccctcgaccgatcgaaaaaaaatcgaattcaaatccccgaatccgaaataacgaaaataaacgccgcgaaacgtccaatacgataacgcgaccgatcccgaaaaaaccgacgaaaaccccgaaaaaaattctcttttctttataaaaaacaaaacgccctaaaataaattcgccccgaaaaaaaaacccgtaccttaaaaaacgtcgcgattccgacgacgtccgataaactctcgctaacccttaaaaatccgaaaaaaaaaatataaatctcgcgccgaaccgtacccatatccgcaacaaatctccaaaataaacaacctctaacatattaaaacaatataaataaaaaaaatcgacaaaccgaatccgtaacttcgaaataaaaattaactctaaaaactaaatcgatcgaactaaaacgcgaaacgaaactaaacgcgcgccgcgactaaacgaaacgccgccgccccccccatcgtcgatacaccctctttacgacactcgaactaaaaattcatttcaactatcccctttaatacctatctttaatacccgcattttactcatctctaaacc

SEQ ID NO: 30149 - DNA, 585 bp, Artificial Sequence
  chemically treated genomic DNA (Homo sapiens) CpG-island No: 30149
tcgttagttcgtttgttatttggcgtatttggttttataggttacgtttttaagttttttaagaggttagcggtaagcgcggtttattttttttttttattaggcgtcggttttacgtcgcgtttacgtttcgaggatagttttagttttttcgttttttggtttcgttttttcgttttttggtttcgttttttttagttttttagcgtcgtcggcgtcgagttcgagtttgcgtttgcgcgtgcgttttggggtttaagttggggcgcgtcgtggttagaatacggagagcggcgggtagtgtagttaatgggaggcggcgttgtttagcggttggtaggcggtgtttgcgcgggtgttaggttagcgcgaggcgtgatttagttgataggttttgaggtgttgttgtggcggcgttcgcggggttgaggcgggtgggagtcggagtcgagcgcgggttgagggaggagggcggcgattggagagcggcgagcggcgagtagcgtaggacgtagagttttttttattttttttttgttgagtgtttttttttattttttttattttatatatattttgtttgtt

SEQ ID NO: 30150 - DNA, 585 bp, Artificial Sequence
  chemically treated genomic DNA (Homo sapiens) CpG-island No: 30150
aacaaacaaaatatatataaaataaaaaaaataaaaaaaaacactcaacaaaaaaaaaataaaaaaaactctacgtcctacgctactcgccgctcgccgctctccaatcgccgccctcctccctcaacccgcgctcgactccgactcccacccgcctcaaccccgcgaacgccgccacaacaacacctcaaaacctatcaactaaatcacgcctcgcgctaacctaacacccgcgcaaacaccgcctaccaaccgctaaacaacgccgcctcccattaactacactacccgccgctctccgtattctaaccacgacgcgccccaacttaaaccccaaaacgcacgcgcaaacgcaaactcgaactcgacgccgacgacgctaaaaaactaaaaaaaacgaaaccaaaaaacgaaaaaacgaaaccaaaaaacgaaaaaactaaaactatcctcgaaacgtaaacgcgacgtaaaaccgacgcctaataaaaaaaaaaaataaaccgcgcttaccgctaacctcttaaaaaacttaaaaacgtaacctataaaaccaaatacgccaaataacaaacgaactaacga

SEQ ID NO: 30151 - DNA, 585 bp, Artificial Sequence
  chemically treated genomic DNA (Homo sapiens) CpG-island No: 30151
ggtaaatagggtgtgtgtggagtgggaggggtgggagggggtatttagtagggaaaaagtgaaagaggttttgcgttttgcgttgttcgtcgttcgtcgttttttagtcgtcgttttttttttttagttcgcgttcggtttcggtttttattcgttttagtttcgcggacgtcgttatagtagtattttagagtttgttaattaggttacgtttcgcgttaatttaatattcgcgtaggtatcgtttattagtcgttaggtagcgtcgttttttattggttgtattgttcgtcgtttttcgtgttttagttacggcgcgttttaatttgggttttagggcgtacgcgtaggcgtaggttcgggttcgacgtcgacgacgttagggagttggagggggcggagttagggagcgagggggcggagttagggagcgagggggttggagttgttttcgagacgtgggcgcggcgtgaagtcgacgtttagtgggagagggaggtggatcgcgtttatcgttggttttttggaagatttgagggcgtggtttgtagagttaggtgcgttaagtgataggcgagttagcgg

SEQ ID NO: 30152 - DNA, 585 bp, Artificial Sequence
  chemically treated genomic DNA (Homo sapiens) CpG-island No: 30152
ccgctaactcgcctatcacttaacgcacctaactctacaaaccacgccctcaaatcttccaaaaaaccaacgataaacgcgatccacctccctctcccactaaacgtcgacttcacgccgcgcccacgtctcgaaaacaactccaaccccctcgctccctaactccgccccctcgctccctaactccgccccctccaactccctaacgtcgtcgacgtcgaacccgaacctacgcctacgcgtacgccctaaaacccaaattaaaacgcgccgtaactaaaacacgaaaaacgacgaacaatacaaccaataaaaaacgacgctacctaacgactaataaacgatacctacgcgaatattaaattaacgcgaaacgtaacctaattaacaaactctaaaatactactataacgacgtccgcgaaactaaaacgaataaaaaccgaaaccgaacgcgaactaaaaaaaaaaaacgacgactaaaaaacgacgaacgacgaacaacgcaaaacgcaaaacctctttcactttttccctactaaataccccctcccacccctcccactccacacacaccctatttacc

SEQ ID NO: 30153 - DNA, 596 bp, Artificial Sequence
  chemically treated genomic DNA (Homo sapiens) CpG-island No: 30153
aggcgtacggtcgtttggttcgcgggggagcgaacgggaggtcggggaatgcgaatcggcgtaaattttcgaggcgtaaattttcgaggcgtaaatttggttttggcgttggcgttgtagttacgggcgtcgtaggagggtcgggtttaaggcgtttcgtttttcgtttttttttttttcgcgtttattggttcggtcgttcgggacggtttcgagaggagggaaggagggaggaaaagtggggatttcgagttcggtttttaagcgtcgttcggttcgtttagtttggtttgtatcgaggtcgatcgggagagggaaagcgacgttagcgggcgtcgtcgtttggttttgtagttggaggcgggacgcgtttttttttttttcgggttgatcgttttagtttttcgttagataaaacgattttatttagcgggcgttttttattagagagtattatttatttcgttttattttgttttggtttcgtcgtcgtagtcgaagcggttgagtggttgcgttttttttttaagtcgtagagggtttttttgtcggtggttggaagttggagcgtcgtagttattagattttttattttt

SEQ ID NO: 30154 - DNA, 596 bp, Artificial Sequence
  chemically treated genomic DNA (Homo sapiens) CpG-island No: 30154
aaaaataaaaaatctaataactacgacgctccaacttccaaccaccgacaaaaaaaccctctacgacttaaaaaaaaaacgcaaccactcaaccgcttcgactacgacgacgaaaccaaaacaaaataaaacgaaataaataatactctctaataaaaaacgcccgctaaataaaatcgttttatctaacgaaaaactaaaacgatcaacccgaaaaaaaaaaaaacgcgtcccgcctccaactacaaaaccaaacgacgacgcccgctaacgtcgctttccctctcccgatcgacctcgatacaaaccaaactaaacgaaccgaacgacgcttaaaaaccgaactcgaaatccccacttttcctccctccttccctcctctcgaaaccgtcccgaacgaccgaaccaataaacgcgaaaaaaaaaaaaacgaaaaacgaaacgccttaaacccgaccctcctacgacgcccgtaactacaacgccaacgccaaaaccaaatttacgcctcgaaaatttacgcctcgaaaatttacgccgattcgcattccccgacctcccgttcgctcccccgcgaaccaaacgaccgtacgcct

SEQ ID NO: 30155 - DNA, 596 bp, Artificial Sequence
  chemically treated genomic DNA (Homo sapiens) CpG-island No: 30155
ggaagtagggagtttggtggttgcggcgttttagtttttagttatcggtagaggaattttttacggtttgaaagggaaacgtagttatttagtcgtttcgattgcggcggcgaaattaaaatagggtggggcggggtgggtggtgttttttagtggaaggcgttcgttgggtgaggtcgttttgtttggcggggggttaggacggttagttcgggaggaggaaaggcgcgtttcgtttttagttgtagggttaggcggcggcgttcgttggcgtcgttttttttttttcggtcggtttcggtgtaggttaggttgggcgggtcgggcggcgtttgggggtcgggttcggagtttttatttttttttttttttttttttttttcggggtcgtttcgagcggtcgggttaatgggcgcggagaggaagggagcgggaagcggggcgttttgggttcggtttttttacggcgttcgtggttgtagcgttagcgttaaagttaagtttgcgtttcgagagtttgcgtttcgagagtttgcgtcggttcgtatttttcggtttttcgttcgttttttcgcgaattaggcggtcgtgcgttt

SEQ ID NO: 30156 - DNA, 596 bp, Artificial Sequence
  chemically treated genomic DNA (Homo sapiens) CpG-island No: 30156
aaacgcacgaccgcctaattcgcgaaaaaacgaacgaaaaaccgaaaaatacgaaccgacgcaaactctcgaaacgcaaactctcgaaacgcaaacttaactttaacgctaacgctacaaccacgaacgccgtaaaaaaaccgaacccaaaacgccccgcttcccgctcccttcctctccgcgcccattaacccgaccgctcgaaacgaccccgaaaaaaaaaaaaaaaaaaaaaaaaataaaaactccgaacccgacccccaaacgccgcccgacccgcccaacctaacctacaccgaaaccgaccgaaaaaaaaaaaacgacgccaacgaacgccgccgcctaaccctacaactaaaaacgaaacgcgcctttcctcctcccgaactaaccgtcctaaccccccgccaaacaaaacgacctcacccaacgaacgccttccactaaaaaacaccacccaccccgccccaccctattttaatttcgccgccgcaatcgaaacgactaaataactacgtttccctttcaaaccgtaaaaaattcctctaccgataactaaaaactaaaacgccgcaaccaccaaactccctacttcc

SEQ ID NO: 30157 - DNA, 570 bp, Artificial Sequence
  chemically treated genomic DNA (Homo sapiens) CpG-island No: 30157
tttcgttttagaagggttattgtagtagtggcggttgacgtagagatggcgggttcgcgagtgttgttcgtgttttgcgttcgttttaatttcgattttaagttttcgaatcggttatttagttgttgtcgatgttggtgcggttgcggtacggcggtagaggagacgacggggacgaaaggtaaggagtaagagggatggttgtagcggtaaaggcgtaggcggcggtaagtttttggggagttcgcgcggtttgggtttcgaagcgttagttggtttggttttattttggcgatcgggtttttgcggcgtagggaattcgttttttttgagttcgttttagttttggtttcgtttttagttatttcgtttttcgttttgcgggcggtaagtcgggttggttagcgcgcgtgttcgtgtttagtttgtattgatatacgcgtttttttttttattttttttttcgttttttcgatcgtttttttttaaacgttagttagataggtcgattttttttttttttttttttggcggtttgttgttcgttagttttttatatagtggttttat

SEQ ID NO: 30158 - DNA, 570 bp, Artificial Sequence
  chemically treated genomic DNA (Homo sapiens) CpG-island No: 30158
ataaaaccactatataaaaaactaacgaacaacaaaccgccaaaaaaaaaaaaaaaaaaaatcgacctatctaactaacgtttaaaaaaaaacgatcgaaaaaacgaaaaaaaaaataaaaaaaaaaacgcgtatatcaatacaaactaaacacgaacacgcgcgctaaccaacccgacttaccgcccgcaaaacgaaaaacgaaataactaaaaacgaaaccaaaactaaaacgaactcaaaaaaaacgaattccctacgccgcaaaaacccgatcgccaaaataaaaccaaaccaactaacgcttcgaaacccaaaccgcgcgaactccccaaaaacttaccgccgcctacgcctttaccgctacaaccatccctcttactccttacctttcgtccccgtcgtctcctctaccgccgtaccgcaaccgcaccaacatcgacaacaactaaataaccgattcgaaaacttaaaatcgaaattaaaacgaacgcaaaacacgaacaacactcgcgaacccgccatctctacgtcaaccgccactactacaataacccttctaaaacgaaa

SEQ ID NO: 30159 - DNA, 570 bp, Artificial Sequence
  chemically treated genomic DNA (Homo sapiens) CpG-island No: 30159
atggagttattgtgtaggaggttggcgggtagtagatcgttagaaaggaggaggaggggagtcggtttgtttggttggcgtttgagggaaaacggtcgagggggcggaggaggaaatgaaagagagggcgcgtgtgttaatataaattgaatacgggtacgcgcgttgattagttcggtttgtcgttcgtagagcggaaggcgggatggttgggggcggggttaaggttaaggcgggtttagagggggcgggttttttgcgtcgtaaagattcggtcgttagagtgaagttaagttagttagcgtttcgaagtttaggtcgcgcggattttttagagatttgtcgtcgtttgcgtttttgtcgttgtagttattttttttattttttgtttttcgttttcgtcgttttttttgtcgtcgtgtcgtagtcgtattagtatcgataatagttaagtggtcgattcggggatttggggtcggggttggggcggacgtaaggtacgaatagtattcgcgagttcgttatttttacgttagtcgttattgttgtagtaatttttttagggcgaga

SEQ ID NO: 30160 - DNA, 570 bp, Artificial Sequence
  chemically treated genomic DNA (Homo sapiens) CpG-island No: 30160
tctcgccctaaaaaaattactacaacaataacgactaacgtaaaaataacgaactcgcgaatactattcgtaccttacgtccgccccaaccccgaccccaaatccccgaatcgaccacttaactattatcgatactaatacgactacgacacgacgacaaaaaaaacgacgaaaacgaaaaacaaaaaataaaaaaaataactacaacgacaaaaacgcaaacgacgacaaatctctaaaaaatccgcgcgacctaaacttcgaaacgctaactaacttaacttcactctaacgaccgaatctttacgacgcaaaaaacccgccccctctaaacccgccttaaccttaaccccgcccccaaccatcccgccttccgctctacgaacgacaaaccgaactaatcaacgcgcgtacccgtattcaatttatattaacacacgcgccctctctttcatttcctcctccgccccctcgaccgttttccctcaaacgccaaccaaacaaaccgactcccctcctcctcctttctaacgatctactacccgccaacctcctacacaataactccat

SEQ ID NO: 30161 - DNA, 504 bp, Artificial Sequence
  chemically treated genomic DNA (Homo sapiens) CpG-island No: 30161
ttcggtaggtcggtcggggattattattttcgttgtaacgtagaggaagttatggtcgggacgcggttagggttacgaaataaaaatatgtggatttacggcgcgagttgagttttgtcggtttatttcgttttcgaattttgtagagttaggcgaggtcgaggttttaggtttaaggtcggggcgtattcgggtttacgtttgcgggagaaagaggtgggtggtgcggttggcgaagttagtgagggatcggagatagtcgggtttggagagagtcgggatcggagagtcggggcgcgggcgtcgcggaggttcggagtcgtaaggaggtttaggtttttcgggacgcggttattgtatttttatagttaaagcggcgggcgtttaaggttagagcgttatcgacgagaaagtcggggtcgcgtcgttcgggaattagagtttttcgcggggatttttaagtttttatttattaggttttgaatttatttttaaaaagtaatt

SEQ ID NO: 30162 - DNA, 504 bp, Artificial Sequence
  chemically treated genomic DNA (Homo sapiens) CpG-island No: 30162
aattactttttaaaaataaattcaaaacctaataaataaaaacttaaaaatccccgcgaaaaactctaattcccgaacgacgcgaccccgactttctcgtcgataacgctctaaccttaaacgcccgccgctttaactataaaaatacaataaccgcgtcccgaaaaacctaaacctccttacgactccgaacctccgcgacgcccgcgccccgactctccgatcccgactctctccaaacccgactatctccgatccctcactaacttcgccaaccgcaccacccacctctttctcccgcaaacgtaaacccgaatacgccccgaccttaaacctaaaacctcgacctcgcctaactctacaaaattcgaaaacgaaataaaccgacaaaactcaactcgcgccgtaaatccacatatttttatttcgtaaccctaaccgcgtcccgaccataacttcctctacgttacaacgaaaataataatccccgaccgacctaccgaa

SEQ ID NO: 30163 - DNA, 504 bp, Artificial Sequence
  chemically treated genomic DNA (Homo sapiens) CpG-island No: 30163
aattgttttttaaaaataggtttagagtttagtgagtgaaaatttaaaagttttcgcgaggagttttagttttcgggcggcgcggtttcgattttttcgtcggtagcgttttggttttgggcgttcgtcgttttggttatggaggtatagtggtcgcgtttcggggagtttgggtttttttgcggtttcgagttttcgcggcgttcgcgtttcgatttttcggtttcggttttttttaggttcggttgttttcggttttttattgatttcgttagtcgtattatttatttttttttttcgtagacgtaaattcgaatacgtttcggttttgggtttagggtttcggtttcgtttggttttataggattcgggggcggggtaggtcggtagagtttagttcgcgtcgtgggtttatatgtttttatttcgtgattttgatcgcgtttcggttataattttttttgcgttataacggggataataattttcggtcggtttgtcgga

SEQ ID NO: 30164 - DNA, 504 bp, Artificial Sequence
  chemically treated genomic DNA (Homo sapiens) CpG-island No: 30164
tccgacaaaccgaccgaaaattattatccccgttataacgcaaaaaaaattataaccgaaacgcgatcaaaatcacgaaataaaaacatataaacccacgacgcgaactaaactctaccgacctaccccgcccccgaatcctataaaaccaaacgaaaccgaaaccctaaacccaaaaccgaaacgtattcgaatttacgtctacgaaaaaaaaaaataaataatacgactaacgaaatcaataaaaaaccgaaaacaaccgaacctaaaaaaaaccgaaaccgaaaaatcgaaacgcgaacgccgcgaaaactcgaaaccgcaaaaaaacccaaactccccgaaacgcgaccactatacctccataaccaaaacgacgaacgcccaaaaccaaaacgctaccgacgaaaaaatcgaaaccgcgccgcccgaaaactaaaactcctcgcgaaaacttttaaattttcactcactaaactctaaacctatttttaaaaaacaatt

SEQ ID NO: 30165 - DNA, 523 bp, Artificial Sequence
  chemically treated genomic DNA (Homo sapiens) CpG-island No: 30165
tcggtcggcgttcggaggcgtaggcgcggcgcggacgttcgtattaagttataatttttgacgggttttgaaacgtaggtagttgagaggcgttttcgagatagtcgtttcgggagatgatgtatttatttttcgtatttattgtgtatttagtatcgagagggtcgtattttgtatttattaatagaaattcgcgtttcgcgttttttgatttttcgtggtcgtcgagtgacgtgttgtcgtcgttggcgcggtttttgggtttgggttttttaataggtggagagagttggaagcgatcggtcggattagtttcgtttagtttgatatttacgtttcgggggttcgggggcgcggtcggttaggtttttttagggaagggggcgcgggttgggttggagtcgggatttcggagcgggggtttatattggaaagtgaatgcgtaggcggttttagaattttaagaagtcgcgttgtagagtttttttaggcgttttttttgattttttttaaaaagggtatt

SEQ ID NO: 30166 - DNA, 523 bp, Artificial Sequence
  chemically treated genomic DNA (Homo sapiens) CpG-island No: 30166
aataccctttttaaaaaaaatcaaaaaaaacgcctaaaaaaactctacaacgcgacttcttaaaattctaaaaccgcctacgcattcactttccaatataaacccccgctccgaaatcccgactccaacccaacccgcgcccccttccctaaaaaaacctaaccgaccgcgcccccgaacccccgaaacgtaaatatcaaactaaacgaaactaatccgaccgatcgcttccaactctctccacctattaaaaaacccaaacccaaaaaccgcgccaacgacgacaacacgtcactcgacgaccacgaaaaatcaaaaaacgcgaaacgcgaatttctattaataaatacaaaatacgaccctctcgatactaaatacacaataaatacgaaaaataaatacatcatctcccgaaacgactatctcgaaaacgcctctcaactacctacgtttcaaaacccgtcaaaaattataacttaatacgaacgtccgcgccgcgcctacgcctccgaacgccgaccga

SEQ ID NO: 30167 - DNA, 523 bp, Artificial Sequence
  chemically treated genomic DNA (Homo sapiens) CpG-island No: 30167
gatattttttttaagagagattaaagaaggcgtttagggaagttttataacgcggttttttggagttttgaggtcgtttgcgtatttattttttagtgtaagttttcgtttcggaatttcggttttagtttagttcgcgtttttttttttggaaagatttggtcggtcgcgttttcgaattttcgaggcgtgggtgttaggttaagcggggttggttcgatcggtcgtttttagttttttttatttgttggaaagtttaggtttaagaatcgcgttagcggcggtagtacgttattcggcggttacggggagttagggagcgcggaacgcgggtttttgttgataagtgtaaagtacggttttttcggtgttaagtgtatagtaagtgcgaagaataaatatattatttttcggggcggttgtttcgaaaacgttttttagttgtttgcgttttagagttcgttaagggttatagtttagtgcgggcgttcgcgtcgcgtttgcgttttcgagcgtcggtcga

SEQ ID NO: 30168 - DNA, 523 bp, Artificial Sequence
  chemically treated genomic DNA (Homo sapiens) CpG-island No: 30168
tcgaccgacgctcgaaaacgcaaacgcgacgcgaacgcccgcactaaactataacccttaacgaactctaaaacgcaaacaactaaaaaacgttttcgaaacaaccgccccgaaaaataatatatttattcttcgcacttactatacacttaacaccgaaaaaaccgtactttacacttatcaacaaaaacccgcgttccgcgctccctaactccccgtaaccgccgaataacgtactaccgccgctaacgcgattcttaaacctaaactttccaacaaataaaaaaaactaaaaacgaccgatcgaaccaaccccgcttaacctaacacccacgcctcgaaaattcgaaaacgcgaccgaccaaatctttccaaaaaaaaaaacgcgaactaaactaaaaccgaaattccgaaacgaaaacttacactaaaaaataaatacgcaaacgacctcaaaactccaaaaaaccgcgttataaaacttccctaaacgccttctttaatctctcttaaaaaaaatatc

SEQ ID NO: 30169 - DNA, 821 bp, Artificial Sequence
  chemically treated genomic DNA (Homo sapiens) CpG-island No: 30169
ttggttttttcgttttttttcgggcgtcgttttgttcgggttcgcgttcgcgtttagtttttatttcgttttttgggtagtggaggtttttgggggttcggttaggtcgttttaaaatcggcgtttttcggcgtcgcggggtcgggcgggggtagggaagttcggcggggagtttttcgtttttttgagtttttttttgtcgatttttaacggtcggcgcgggttttatttgcgttttacgtttcggtatcgcgtcggttcggtttaggggcggggaagcgttcgtgcgtttagagttttcgaggtttagtcgggggtttcgtcggtcgttcgtgttcgttttagttcgtatttatcgtcggggttcggcgttttcgcggcgtcgcgggttatgtcgagtagtagtaatagcggtagtaggcggcgagacgggttcgtattttagggttttcggtttatgtcgtcgtcggtttttttcggcgcgttcgcgttttttttcggggtttttagggtgtagagataaggttataggcgtcgcggggaggggattagtcggcggttttcggcgtcgtcgagggaagcggggggcgttgcggggttttcgggaggtcgtagagcgcgggtttttttttttgtcggggtttgggtttaggatacgttcgtttcgcgttcgtttttggtttcgtatttgttgttttttcgtcgtttatattcgtaaagggggatagatatttatcggataatgatatagttggacgtagagtttcggagagtgttggggaggaaatgttgcggaggatttaagttattcgagggtttag

SEQ ID NO: 30170 - DNA, 821 bp, Artificial Sequence
  chemically treated genomic DNA (Homo sapiens) CpG-island No: 30170
ctaaaccctcgaataacttaaatcctccgcaacatttcctccccaacactctccgaaactctacgtccaactatatcattatccgataaatatctatccccctttacgaatataaacgacgaaaaaacaacaaatacgaaaccaaaaacgaacgcgaaacgaacgtatcctaaacccaaaccccgacaaaaaaaaaaacccgcgctctacgacctcccgaaaaccccgcaacgccccccgcttccctcgacgacgccgaaaaccgccgactaatcccctccccgcgacgcctataaccttatctctacaccctaaaaaccccgaaaaaaaacgcgaacgcgccgaaaaaaaccgacgacgacataaaccgaaaaccctaaaatacgaacccgtctcgccgcctactaccgctattactactactcgacataacccgcgacgccgcgaaaacgccgaaccccgacgataaatacgaactaaaacgaacacgaacgaccgacgaaacccccgactaaacctcgaaaactctaaacgcacgaacgcttccccgcccctaaaccgaaccgacgcgataccgaaacgtaaaacgcaaataaaacccgcgccgaccgttaaaaatcgacaaaaaaaaactcaaaaaaacgaaaaactccccgccgaacttccctacccccgcccgaccccgcgacgccgaaaaacgccgattttaaaacgacctaaccgaacccccaaaaacctccactacccaaaaaacgaaataaaaactaaacgcgaacgcgaacccgaacaaaacgacgcccgaaaaaaaacgaaaaaaccaa

SEQ ID NO: 30171 - DNA, 821 bp, Artificial Sequence
  chemically treated genomic DNA (Homo sapiens) CpG-island No: 30171
ttgagttttcgagtggtttgaatttttcgtaatattttttttttagtatttttcggggttttgcgtttagttgtgttattattcgatgagtgtttgtttttttttgcgaatgtgagcggcgagagggtagtaagtgcggagttagagacggacgcggaacgggcgtgttttaagtttaggtttcgataagaggaaggattcgcgttttgcggtttttcggggatttcgtagcgtttttcgtttttttcggcggcgtcggaagtcgtcggttggtttttttttcgcggcgtttgtagttttatttttgtattttgagggtttcgggaggaggcgcgggcgcgtcgggagggatcggcggcggtatgggtcgggggttttgggatgcgggttcgtttcgtcgtttgttgtcgttgttgttgttgttcggtatggttcgcggcgtcgcgggagcgtcgggtttcgacggtgagtgcgggttgggacgggtacgggcggtcggcggggttttcggttgggtttcgaggattttgggcgtacggacgttttttcgtttttgggtcgggtcggcgcggtgtcgaggcgtggggcgtaggtggggttcgcgtcggtcgttggagatcggtaaggaggagtttagagaagcggggggtttttcgtcgggtttttttgttttcgttcgatttcgcgacgtcgggggacgtcggttttaaggcggtttggtcgggtttttagggatttttattgtttaggaggcggggtgggggttgggcgcgagcgcggattcgggtagggcggcgttcggggaagggcggggaggttag

SEQ ID NO: 30172 - DNA, 821 bp, Artificial Sequence
  chemically treated genomic DNA (Homo sapiens) CpG-island No: 30172
ctaacctccccgcccttccccgaacgccgccctacccgaatccgcgctcgcgcccaacccccaccccgcctcctaaacaataaaaatccctaaaaacccgaccaaaccgccttaaaaccgacgtcccccgacgtcgcgaaatcgaacgaaaacaaaaaaacccgacgaaaaaccccccgcttctctaaactcctccttaccgatctccaacgaccgacgcgaaccccacctacgccccacgcctcgacaccgcgccgacccgacccaaaaacgaaaaaacgtccgtacgcccaaaatcctcgaaacccaaccgaaaaccccgccgaccgcccgtacccgtcccaacccgcactcaccgtcgaaacccgacgctcccgcgacgccgcgaaccataccgaacaacaacaacaacgacaacaaacgacgaaacgaacccgcatcccaaaacccccgacccataccgccgccgatccctcccgacgcgcccgcgcctcctcccgaaaccctcaaaatacaaaaataaaactacaaacgccgcgaaaaaaaaaccaaccgacgacttccgacgccgccgaaaaaaacgaaaaacgctacgaaatccccgaaaaaccgcaaaacgcgaatccttcctcttatcgaaacctaaacttaaaacacgcccgttccgcgtccgtctctaactccgcacttactaccctctcgccgctcacattcgcaaaaaaaaacaaacactcatcgaataataacacaactaaacgcaaaaccccgaaaaatactaaaaaaaaaatattacgaaaaattcaaaccactcgaaaactcaa

SEQ ID NO: 30173 - DNA, 803 bp, Artificial Sequence
  chemically treated genomic DNA (Homo sapiens) CpG-island No: 30173
gttagcgcgttgttttcgaagttcggtagtaaatgagcgtagatcgtacgggtttttcgcgtattaaggtatacgtatgcgtattggttttgggagttttgaagatttggcggagtttagcgcggatggaggtttgagggtggcgggggcggagcgcgtcgcgagttgggggtatgttcgcggcgggcgtcgtttagaggaaggttaagtagtcgttattacgttgtcggtcgcggagagacgtaagcgagttaggtcgagggtcgcggcggcgatgtagcgacggcgtcgtttttcgtcgtttatttttcggttgttcgagggttgcgggggaggaggcggtggtagcgaggaggtggaagtgtagtttttcgtcgggcgttggggttcggtcgcggcggtttcggcggtagcggcggcggttacgcgtagtatcgaggaggaggaggagaggtttgagcgtgagtatttttggaagattattaatgtttttcgttattacgggtaaggagttcgtggcggatttcggtttagatcgtcggggcgtttattggtggcggcggattcgtcggaacgggggcgttcgtcgtttcgtcgttacgttttcgaggcgtcgggattcggttgttgtagttgattttcgggtttcgagttatttcgtattattttagtttttttcggttttgtatattcgcgtgttcgtcgcgtcgtttgttgtatagtttcgtgttttttgattttaggattagattagtttttttgttttcgttttcgtaaaggtttggttttgaggtcgatggggg

SEQ ID NO: 30174 - DNA, 803 bp, Artificial Sequence
  chemically treated genomic DNA (Homo sapiens) CpG-island No: 30174
cccccatcgacctcaaaaccaaacctttacgaaaacgaaaacaaaaaaactaatctaatcctaaaatcaaaaaacacgaaactatacaacaaacgacgcgacgaacacgcgaatatacaaaaccgaaaaaaactaaaataatacgaaataactcgaaacccgaaaatcaactacaacaaccgaatcccgacgcctcgaaaacgtaacgacgaaacgacgaacgcccccgttccgacgaatccgccgccaccaataaacgccccgacgatctaaaccgaaatccgccacgaactccttacccgtaataacgaaaaacattaataatcttccaaaaatactcacgctcaaacctctcctcctcctcctcgatactacgcgtaaccgccgccgctaccgccgaaaccgccgcgaccgaaccccaacgcccgacgaaaaactacacttccacctcctcgctaccaccgcctcctcccccgcaaccctcgaacaaccgaaaaataaacgacgaaaaacgacgccgtcgctacatcgccgccgcgaccctcgacctaactcgcttacgtctctccgcgaccgacaacgtaataacgactacttaaccttcctctaaacgacgcccgccgcgaacatacccccaactcgcgacgcgctccgcccccgccaccctcaaacctccatccgcgctaaactccgccaaatcttcaaaactcccaaaaccaatacgcatacgtataccttaatacgcgaaaaacccgtacgatctacgctcatttactaccgaacttcgaaaacaacgcgctaac

SEQ ID NO: 30175 - DNA, 803 bp, Artificial Sequence
  chemically treated genomic DNA (Homo sapiens) CpG-island No: 30175
tttttatcggttttaaagttaaatttttacgaggacggaggtaggagagttaatttgattttgaggttagaagatacgaggttgtgtagtagacggcgcggcggatacgcgggtgtgtagggtcgggaggggttggggtggtgcgaggtgattcggggttcggaggttagttgtagtagtcgggtttcgacgtttcggaggcgtggcggcgggacggcgagcgttttcgtttcggcgggttcgtcgttattagtgggcgtttcgacggtttgggtcggggttcgttacgggttttttattcgtagtagcggaaggtattaatgattttttagaagtgtttacgtttaagtttttttttttttttttcggtgttgcgcgtggtcgtcgtcgttgtcgtcgaaatcgtcgcggtcgagttttaacgttcggcggaaaattgtatttttattttttcgttgttatcgttttttttttcgtagttttcgggtagtcgggaggtgggcggcggagggcgacgtcgtcgttgtatcgtcgtcgcggttttcggtttggttcgtttgcgttttttcgcgatcgatagcgtggtggcggttgtttggtttttttttagacggcgttcgtcgcggatatgtttttagttcgcggcgcgtttcgttttcgttatttttaggtttttattcgcgttgggtttcgttaggtttttagggtttttagaattaatgcgtatgcgtgtgttttggtacgcggagggttcgtgcggtttgcgtttatttgttgtcgggtttcggagatagcgcgttgat

SEQ ID NO: 30176 - DNA, 803 bp, Artificial Sequence
  chemically treated genomic DNA (Homo sapiens) CpG-island No: 30176
atcaacgcgctatctccgaaacccgacaacaaataaacgcaaaccgcacgaaccctccgcgtaccaaaacacacgcatacgcattaattctaaaaaccctaaaaacctaacgaaacccaacgcgaataaaaacctaaaaataacgaaaacgaaacgcgccgcgaactaaaaacatatccgcgacgaacgccgtctaaaaaaaaaccaaacaaccgccaccacgctatcgatcgcgaaaaaacgcaaacgaaccaaaccgaaaaccgcgacgacgatacaacgacgacgtcgccctccgccgcccacctcccgactacccgaaaactacgaaaaaaaaaacgataacaacgaaaaaataaaaatacaattttccgccgaacgttaaaactcgaccgcgacgatttcgacgacaacgacgacgaccacgcgcaacaccgaaaaaaaaaaaaaaaaacttaaacgtaaacacttctaaaaaatcattaataccttccgctactacgaataaaaaacccgtaacgaaccccgacccaaaccgtcgaaacgcccactaataacgacgaacccgccgaaacgaaaacgctcgccgtcccgccgccacgcctccgaaacgtcgaaacccgactactacaactaacctccgaaccccgaatcacctcgcaccaccccaacccctcccgaccctacacacccgcgtatccgccgcgccgtctactacacaacctcgtatcttctaacctcaaaatcaaattaactctcctacctccgtcctcgtaaaaatttaactttaaaaccgataaaaa

SEQ ID NO: 30177 - DNA, 920 bp, Artificial Sequence
  chemically treated genomic DNA (Homo sapiens) CpG-island No: 30177
tgcgggtcgtttgatcgggtttttaattaatttcgtcgcggttttttcgtttattttcgagcgcgtattttcggtcgcgagggcgttcgggagcgcgtttcgcgagtttttattaattagcggtttcgtttggttagatagagtgcgcgcgcgtacgttgtgcgtaggttcgaattttcgtcgtttcgcggttgttttttaacgttcgggtcgtatttcggcggcggcgagggttgagcgcgggagttgttttcgagtcggagttttagttttaggttttgcgcgagttgtttcgttttattttttttagcgttttgtcgttttttcgttcgatttcggtttgttttttttttacgcgtttagttttcgtttttcgtttttcgtagttatcggtattcggtttttcgcgtttggcgggtttcgttcgagtttttgggtttatggttaagcggcgtgcggtcgagtcggtgacgttttacgtgttttggaagcggtttttgttttgcgatttcgttgagtagtcgtcgttatcgtttttttggattcggtcgttcggggtcgcgtatgttgggtagtttttcggcgttttagagtagtatcgaaagcgtaaaatcgacgtagggattatggtagagttttcggtttcgtttagtaagcgtcgtgatagcggggataatagcgtttcgagcggttaggagcgtgaggattacggtttggagataggcgattcgtcgttgtcgtcgtcgttcgtattgtcggggtcgggggaggagttttcgggcgttcggttttcggggggcggtggcgacgacggggcggggcgcgtaggattttcgcggggagattggggggtcgtatcgcgttaggtaggggttgggggcgggtgggttgaggggcgaaggggtttgttttttttttat

SEQ ID NO: 30178 - DNA, 920 bp, Artificial Sequence
  chemically treated genomic DNA (Homo sapiens) CpG-island No: 30178
ataaaaaaaaaacaaaccccttcgcccctcaacccacccgcccccaacccctacctaacgcgatacgaccccccaatctccccgcgaaaatcctacgcgccccgccccgtcgtcgccaccgccccccgaaaaccgaacgcccgaaaactcctcccccgaccccgacaatacgaacgacgacgacaacgacgaatcgcctatctccaaaccgtaatcctcacgctcctaaccgctcgaaacgctattatccccgctatcacgacgcttactaaacgaaaccgaaaactctaccataatccctacgtcgattttacgctttcgatactactctaaaacgccgaaaaactacccaacatacgcgaccccgaacgaccgaatccaaaaaaacgataacgacgactactcaacgaaatcgcaaaacaaaaaccgcttccaaaacacgtaaaacgtcaccgactcgaccgcacgccgcttaaccataaacccaaaaactcgaacgaaacccgccaaacgcgaaaaaccgaataccgataactacgaaaaacgaaaaacgaaaactaaacgcgtaaaaaaaaaacaaaccgaaatcgaacgaaaaaacgacaaaacgctaaaaaaaataaaacgaaacaactcgcgcaaaacctaaaactaaaactccgactcgaaaacaactcccgcgctcaaccctcgccgccgccgaaatacgacccgaacgttaaaaaacaaccgcgaaacgacgaaaattcgaacctacgcacaacgtacgcgcgcgcactctatctaaccaaacgaaaccgctaattaataaaaactcgcgaaacgcgctcccgaacgccctcgcgaccgaaaatacgcgctcgaaaataaacgaaaaaaccgcgacgaaattaattaaaaacccgatcaaacgacccgca

SEQ ID NO: 30179 - DNA, 920 bp, Artificial Sequence
  chemically treated genomic DNA (Homo sapiens) CpG-island No: 30179
gtggggaaaaggtaagttttttcgttttttagtttattcgtttttagtttttatttggcgcgatgcgattttttagttttttcgcgggggttttgcgcgtttcgtttcgtcgtcgttatcgtttttcgggagtcgggcgttcgggagtttttttttcggtttcggtagtacgggcggcggcggtagcggcggatcgtttgtttttagatcgtggtttttacgtttttggtcgttcggggcgttgttgttttcgttgttacggcgtttgttgggcgaagtcgagggttttgttatggtttttgcgtcgattttgcgttttcggtgttgttttgggacgtcgaggagttgtttagtatgcgcgatttcgggcggtcggatttagagaggcggtggcggcggttgtttagcgaagtcgtaaagtaggagtcgtttttaaggtacgtggaacgttatcggttcggtcgtacgtcgtttggttatgggtttagaggttcgggcggagttcgttaggcgcgggagatcgagtgtcgatagttgcggggggcgaagagcgaggattgagcgcgtgagagagggataggtcgaagtcgggcgaggaggcgataggacgttggagggggtagggcggggtagttcgcgtagggtttagggttggggtttcggttcggaggtagttttcgcgtttagttttcgtcgtcgtcgagatgcggttcggacgttgagaagtaatcgcgaagcggcggagattcgaatttgcgtataacgtgcgcgcgcgtattttgtttggttaggcggagtcgttggttggtggaggttcgcggggcgcgttttcgagcgttttcgcgatcggaagtgcgcgttcgggggtaggcgggaaggtcgcggcgggattaattaaagattcgattaagcggttcgta

SEQ ID NO: 30180 - DNA, 920 bp, Artificial Sequence
  chemically treated genomic DNA (Homo sapiens) CpG-island No: 30180
tacgaaccgcttaatcgaatctttaattaatcccgccgcgaccttcccgcctacccccgaacgcgcacttccgatcgcgaaaacgctcgaaaacgcgccccgcgaacctccaccaaccaacgactccgcctaaccaaacaaaatacgcgcgcgcacgttatacgcaaattcgaatctccgccgcttcgcgattacttctcaacgtccgaaccgcatctcgacgacgacgaaaactaaacgcgaaaactacctccgaaccgaaaccccaaccctaaaccctacgcgaactaccccgccctaccccctccaacgtcctatcgcctcctcgcccgacttcgacctatccctctctcacgcgctcaatcctcgctcttcgccccccgcaactatcgacactcgatctcccgcgcctaacgaactccgcccgaacctctaaacccataaccaaacgacgtacgaccgaaccgataacgttccacgtaccttaaaaacgactcctactttacgacttcgctaaacaaccgccgccaccgcctctctaaatccgaccgcccgaaatcgcgcatactaaacaactcctcgacgtcccaaaacaacaccgaaaacgcaaaatcgacgcaaaaaccataacaaaaccctcgacttcgcccaacaaacgccgtaacaacgaaaacaacaacgccccgaacgaccaaaaacgtaaaaaccacgatctaaaaacaaacgatccgccgctaccgccgccgcccgtactaccgaaaccgaaaaaaaaactcccgaacgcccgactcccgaaaaacgataacgacgacgaaacgaaacgcgcaaaacccccgcgaaaaaactaaaaaatcgcatcgcgccaaataaaaactaaaaacgaataaactaaaaaacgaaaaaacttaccttttccccac

SEQ ID NO: 30181 - DNA, 695 bp, Artificial Sequence
  chemically treated genomic DNA (Homo sapiens) CpG-island No: 30181
atcgcgtacgggcgagcgtttatttttggttttatttcgcgtgggttagtgggattcgcgggatttttttcgttcgaacggcgttttcgaggtatttaggcgtttttttcgcgcgttggttttagatttttaggttttcgtttttttaaaagggacgcgtttcgtcgggtcgggagggatcgtagggtttgcgcgcggcgggcggggtttttagcgtgagaggcgtggcgtcgagcgcggcgggcgtggtttcgagcggatgggtcgggaggttggggatggcgcgtggtttttttaagacgtatcggggcgggttcgggcggcgcgcggtttttttaaggtttggtttacgtggtagtcgttggagtcgtagtcgacgcggagcgaggtcggtcgtcgggtattttttgtggaggtcgtagcgggtgcgggcgtcgacgggcgagagttagcgagcgagcgagcgagtcgagtcgagtttttcgtcgtcgttatgggttagaacgatttgatgggtacggtcgaggatttcgtcgattaggtgcggtttgcgggtttttttttcggtttcggtttcgatttaggtcgttcgggtcgtttcggagtcggttttttagcgtagggcgttaggttcgggtcgttttttgattttttgtttttatagagggattttttcgttcgggttttttgtttcg

SEQ ID NO: 30182 - DNA, 695 bp, Artificial Sequence
  chemically treated genomic DNA (Homo sapiens) CpG-island No: 30182
cgaaacaaaaaacccgaacgaaaaaatccctctataaaaacaaaaaatcaaaaaacgacccgaacctaacgccctacgctaaaaaaccgactccgaaacgacccgaacgacctaaatcgaaaccgaaaccgaaaaaaaaacccgcaaaccgcacctaatcgacgaaatcctcgaccgtacccatcaaatcgttctaacccataacgacgacgaaaaactcgactcgactcgctcgctcgctcgctaactctcgcccgtcgacgcccgcacccgctacgacctccacaaaaaatacccgacgaccgacctcgctccgcgtcgactacgactccaacgactaccacgtaaaccaaaccttaaaaaaaccgcgcgccgcccgaacccgccccgatacgtcttaaaaaaaccacgcgccatccccaacctcccgacccatccgctcgaaaccacgcccgccgcgctcgacgccacgcctctcacgctaaaaaccccgcccgccgcgcgcaaaccctacgatccctcccgacccgacgaaacgcgtcccttttaaaaaaacgaaaacctaaaaatctaaaaccaacgcgcgaaaaaaacgcctaaatacctcgaaaacgccgttcgaacgaaaaaaatcccgcgaatcccactaacccacgcgaaataaaaccaaaaataaacgctcgcccgtacgcgat

SEQ ID NO: 30183 - DNA, 695 bp, Artificial Sequence
  chemically treated genomic DNA (Homo sapiens) CpG-island No: 30183
cgggatagagggttcgggcgggggggtttttttgtgggaataaggagttagggggcggttcgggtttggcgttttgcgttgggaggtcgatttcggagcggttcgggcggtttgggtcgggatcggggtcgggggaggagttcgtaggtcgtatttggtcggcgaagttttcggtcgtgtttattaggtcgttttggtttatggcgacggcgggaggttcggttcggttcgttcgttcgttcgttggttttcgttcgtcggcgttcgtattcgttgcggtttttataggaagtgttcggcggtcggtttcgtttcgcgtcggttgcggttttagcggttgttacgtaggttaagttttaaaggggtcgcgcgtcgttcgggttcgtttcggtgcgttttaaaggggttacgcgttatttttagtttttcgatttattcgttcgaagttacgttcgtcgcgttcgacgttacgttttttacgttggaggtttcgttcgtcgcgcgtaggttttgcggtttttttcggttcggcggaacgcgttttttttaagggggcggggatttgggggtttggggttagcgcgcgggagggacgtttgagtgtttcgagggcgtcgttcgggcggggaggatttcgcgggttttattgatttacgcggggtggggttaggggtggacgttcgttcgtacgcggt

SEQ ID NO: 30184 - DNA, 695 bp, Artificial Sequence
  chemically treated genomic DNA (Homo sapiens) CpG-island No: 30184
accgcgtacgaacgaacgtccacccctaaccccaccccgcgtaaatcaataaaacccgcgaaatcctccccgcccgaacgacgccctcgaaacactcaaacgtccctcccgcgcgctaaccccaaacccccaaatccccgcccccttaaaaaaaacgcgttccgccgaaccgaaaaaaaccgcaaaacctacgcgcgacgaacgaaacctccaacgtaaaaaacgtaacgtcgaacgcgacgaacgtaacttcgaacgaataaatcgaaaaactaaaaataacgcgtaacccctttaaaacgcaccgaaacgaacccgaacgacgcgcgacccctttaaaacttaacctacgtaacaaccgctaaaaccgcaaccgacgcgaaacgaaaccgaccgccgaacacttcctataaaaaccgcaacgaatacgaacgccgacgaacgaaaaccaacgaacgaacgaacgaaccgaaccgaacctcccgccgtcgccataaaccaaaacgacctaataaacacgaccgaaaacttcgccgaccaaatacgacctacgaactcctcccccgaccccgatcccgacccaaaccgcccgaaccgctccgaaatcgacctcccaacgcaaaacgccaaacccgaaccgccccctaactccttattcccacaaaaaaacccccccgcccgaaccctctatcccg

SEQ ID NO: 30185 - DNA, 640 bp, Artificial Sequence
  chemically treated genomic DNA (Homo sapiens) CpG-island No: 30185
ggcgcgcgggttttttggggatgcgcgcgaggaggcgtcgtttttttttagtaggggtttttggggattcgcggtcgtttttcgcgtttttttgttttttttcgtgttcggtttcgggaagtcggggcggcgggcggcgcgggtcgggagggggcgtttcgggtttatttcgttttagggtcgtcgggcggaaggcggaggtcgagattagacgcggagttatggtcgaggtgttgcggacgttggtcggtgagtgtaggtttcggtttcgggtgttcgcgagggagtcgttatcgtagggaatgcggggtgtattcgatagtcgggtcggggtgggggcgtttagggttgcgaggtttcgggtcggtcgtcgttttagttttcgagattttgcgttttggggagtcggcgggtaggtgggtttggtcgcgttgtgggtgtttgggattcgtagggaggatgggcgcggtggcgcggtttggcggggggttcgttttcggggttttcgggttttggtgagagcggggtttttcgacgtcgtggcggtttttagttttttttcgtttttttacgtttttcgttttttatgagttgttatttttagtatttatcgttcgattttggattaggataaggtttt

SEQ ID NO: 30186 - DNA, 640 bp, Artificial Sequence
  chemically treated genomic DNA (Homo sapiens) CpG-island No: 30186
aaaaccttatcctaatccaaaatcgaacgataaatactaaaaataacaactcataaaaaacgaaaaacgtaaaaaaacgaaaaaaaactaaaaaccgccacgacgtcgaaaaaccccgctctcaccaaaacccgaaaaccccgaaaacgaaccccccgccaaaccgcgccaccgcgcccatcctccctacgaatcccaaacacccacaacgcgaccaaacccacctacccgccgactccccaaaacgcaaaatctcgaaaactaaaacgacgaccgacccgaaacctcgcaaccctaaacgcccccaccccgacccgactatcgaatacaccccgcattccctacgataacgactccctcgcgaacacccgaaaccgaaacctacactcaccgaccaacgtccgcaacacctcgaccataactccgcgtctaatctcgacctccgccttccgcccgacgaccctaaaacgaaataaacccgaaacgccccctcccgacccgcgccgcccgccgccccgacttcccgaaaccgaacacgaaaaaaaacaaaaaaacgcgaaaaacgaccgcgaatccccaaaaacccctactaaaaaaaaacgacgcctcctcgcgcgcatccccaaaaaacccgcgcgcc

SEQ ID NO: 30187 - DNA, 640 bp, Artificial Sequence
  chemically treated genomic DNA (Homo sapiens) CpG-island No: 30187
agagttttgttttagtttagggtcgggcggtaggtgttgaaaatagtagtttatggaaggcggggagcgtggaggggcgaggagaggttggagatcgttacggcgtcgagggatttcgtttttattaggattcggggatttcggagacgagtttttcgttaggtcgcgttatcgcgtttattttttttgcgggttttaggtatttatagcgcggttaagtttatttgttcgtcggttttttaggacgtagggtttcggaggttggggcggcggtcggttcgaagtttcgtagttttgagcgtttttatttcggttcggttgtcgggtgtatttcgtattttttgcggtagcggttttttcgcgggtattcggggtcgaggtttgtatttatcggttagcgttcgtaatatttcggttatggtttcgcgtttggtttcggttttcgtttttcgttcggcggttttggggcggggtgagttcgaggcgttttttttcggttcgcgtcgttcgtcgtttcgatttttcgaggtcgaatacgggaggggatagaggggcgcgggaggcggtcgcgggtttttagggatttttgttaggaagggacggcgttttttcgcgcgtatttttaagggattcgcgcgtt

SEQ ID NO: 30188 - DNA, 640 bp, Artificial Sequence
  chemically treated genomic DNA (Homo sapiens) CpG-island No: 30188
aacgcgcgaatcccttaaaaatacgcgcgaaaaaacgccgtcccttcctaacaaaaatccctaaaaacccgcgaccgcctcccgcgcccctctatcccctcccgtattcgacctcgaaaaatcgaaacgacgaacgacgcgaaccgaaaaaaaacgcctcgaactcaccccgccccaaaaccgccgaacgaaaaacgaaaaccgaaaccaaacgcgaaaccataaccgaaatattacgaacgctaaccgataaatacaaacctcgaccccgaatacccgcgaaaaaaccgctaccgcaaaaaatacgaaatacacccgacaaccgaaccgaaataaaaacgctcaaaactacgaaacttcgaaccgaccgccgccccaacctccgaaaccctacgtcctaaaaaaccgacgaacaaataaacttaaccgcgctataaatacctaaaacccgcaaaaaaaataaacgcgataacgcgacctaacgaaaaactcgtctccgaaatccccgaatcctaataaaaacgaaatccctcgacgccgtaacgatctccaacctctcctcgcccctccacgctccccgccttccataaactactattttcaacacctaccgcccgaccctaaactaaaacaaaactct

SEQ ID NO: 30189 - DNA, 796 bp, Artificial Sequence
  chemically treated genomic DNA (Homo sapiens) CpG-island No: 30189
gcgggtcgcggcgcgtagttttttagggtcgggaagtttaatttggcgcgattttcggtttttcggcgggggtttttttcgggttcgtttttttttcgggtttttcggaaatcgcgtcggggcgtttcgttcgcgcgttttttattcgtatttcgggttttcgtattttttaggatttggtttgcggcggacgagggagacggcgaggttcgggagcgcggggtttcgaattatttcgtagcgggcgagttcgcgggtttatttgatttgtttatggtcggtttcgcgcgtttttcgtttttcgcggttgcgttgtattgcgttcgttcggtttagcgtcgttttagagtttaggatcgggttgatgtcgcggtttttttttcggcgtcgttcggttttcgttttataaggagcgatagttgagggcggaggcgttcggggttatttcgtgggtttttcggagagtttatttttgggaagtagtttcgcgattgtcgagggtttttcggatgcggtcgcggggtttaagtttttcggattttatatcgagttgttttttttcggggcgcgtggggaagttcgcgtttgttgggtttcgggtggttgttttgcgtcgacgcgcggcgaggatagaggggcgcgcggtcgcggtacgaggggcgtttcggtcggcgttattaggggacggtttttttttgtcgcggtttgatacgatatacgtagtttcggggtgtgtttttattttcggtgattttgggtttcggagggcggttggttcggggagggggatgttttt

SEQ ID NO: 30190 - DNA, 796 bp, Artificial Sequence
  chemically treated genomic DNA (Homo sapiens) CpG-island No: 30190
aaaaacatccccctccccgaaccaaccgccctccgaaacccaaaatcaccgaaaataaaaacacaccccgaaactacgtatatcgtatcaaaccgcgacaaaaaaaaaccgtcccctaataacgccgaccgaaacgcccctcgtaccgcgaccgcgcgcccctctatcctcgccgcgcgtcgacgcaaaacaaccacccgaaacccaacaaacgcgaacttccccacgcgccccgaaaaaaaacaactcgatataaaatccgaaaaacttaaaccccgcgaccgcatccgaaaaaccctcgacaatcgcgaaactacttcccaaaaataaactctccgaaaaacccacgaaataaccccgaacgcctccgccctcaactatcgctccttataaaacgaaaaccgaacgacgccgaaaaaaaaaccgcgacatcaacccgatcctaaactctaaaacgacgctaaaccgaacgaacgcaatacaacgcaaccgcgaaaaacgaaaaacgcgcgaaaccgaccataaacaaatcaaataaacccgcgaactcgcccgctacgaaataattcgaaaccccgcgctcccgaacctcgccgtctccctcgtccgccgcaaaccaaatcctaaaaaatacgaaaacccgaaatacgaataaaaaacgcgcgaacgaaacgccccgacgcgatttccgaaaaacccgaaaaaaaaacgaacccgaaaaaaacccccgccgaaaaaccgaaaatcgcgccaaattaaacttcccgaccctaaaaaactacgcgccgcgacccgc

SEQ ID NO: 30191 - DNA, 796 bp, Artificial Sequence
  chemically treated genomic DNA (Homo sapiens) CpG-island No: 30191
aggagtattttttttttcggattagtcgtttttcggagtttagagttatcggagatgggggtatatttcggggttgcgtgtgtcgtgttaggtcgcggtagggagaggtcgttttttggtggcgtcggtcggaacgtttttcgtgtcgcgatcgcgcgtttttttgttttcgtcgcgcgtcggcgtagagtagttattcggggtttagtaggcgcgggtttttttacgcgtttcgggaagggatagttcggtgtggggttcgggaggtttgagtttcgcggtcgtattcggggagttttcggtagtcgcggagttgttttttaggggtgagtttttcgggaggtttacggggtggtttcgggcgttttcgtttttagttgtcgttttttataaggcgggggtcgggcggcgtcggaggaggggtcgcggtattagttcggttttgggttttggggcggcgttgggtcgggcgagcgtagtgtagcgtagtcgcggggagcgaggagcgcgcggagtcggttatgggtaagttaggtgagttcgcgggttcgttcgttgcggaatggttcggaatttcgcgttttcggatttcgtcgtttttttcgttcgtcgtaagttaggttttggggagtgcgggagttcggggtgcgggtggagggcgcgcgggcggagcgtttcggcgcggttttcggggaattcggggggaaggcgagttcgagggaggttttcgtcggagagtcggggatcgcgttaagttgggtttttcgattttgaggggttgcgcgtcgcggttcgt

SEQ ID NO: 30192 - DNA, 796 bp, Artificial Sequence
  chemically treated genomic DNA (Homo sapiens) CpG-island No: 30192
acgaaccgcgacgcgcaacccctcaaaatcgaaaaacccaacttaacgcgatccccgactctccgacgaaaacctccctcgaactcgccttccccccgaattccccgaaaaccgcgccgaaacgctccgcccgcgcgccctccacccgcaccccgaactcccgcactccccaaaacctaacttacgacgaacgaaaaaaacgacgaaatccgaaaacgcgaaattccgaaccattccgcaacgaacgaacccgcgaactcacctaacttacccataaccgactccgcgcgctcctcgctccccgcgactacgctacactacgctcgcccgacccaacgccgccccaaaacccaaaaccgaactaataccgcgacccctcctccgacgccgcccgacccccgccttataaaaaacgacaactaaaaacgaaaacgcccgaaaccaccccgtaaacctcccgaaaaactcacccctaaaaaacaactccgcgactaccgaaaactccccgaatacgaccgcgaaactcaaacctcccgaaccccacaccgaactatcccttcccgaaacgcgtaaaaaaacccgcgcctactaaaccccgaataactactctacgccgacgcgcgacgaaaacaaaaaaacgcgcgatcgcgacacgaaaaacgttccgaccgacgccaccaaaaaacgacctctccctaccgcgacctaacacgacacacgcaaccccgaaatatacccccatctccgataactctaaactccgaaaaacgactaatccgaaaaaaaaaatactcct

SEQ ID NO: 30193 - DNA, 570 bp, Artificial Sequence
  chemically treated genomic DNA (Homo sapiens) CpG-island No: 30193
ttatttatacgttgtgattacggtttatttatacgttgtgattacggtttatttatacgttgtaattacggtttatttatacgttgtaattacggtttatttatacgttgtaattacggtttatttatacgttgtaattacggtttatttatatattgtaattacggtttatttatatattgtaattacggtttatttatatattgtaattacggtttatttacgtattgtaattacggtttatttacgtattgtaattacggtttatttatatattgtaattacggtttatttatatattgtaattacggtttatttatatattgtagttacggtttatttatatattgtagttacggtttatttatatattgtagttacggtttatttatatattgtaattacggtttatttatatattgtagttacggtttatttatatattgtaattacggtttatttacgtattgtaattacggtttatttatatattgtaattacgggttatttatatattgtaattacggtttatttatatattgtagttacggtttatttaggtattgtaat

SEQ ID NO: 30194 - DNA, 570 bp, Artificial Sequence
  chemically treated genomic DNA (Homo sapiens) CpG-island No: 30194
attacaatacctaaataaaccgtaactacaatatataaataaaccgtaattacaatatataaataacccgtaattacaatatataaataaaccgtaattacaatacgtaaataaaccgtaattacaatatataaataaaccgtaactacaatatataaataaaccgtaattacaatatataaataaaccgtaactacaatatataaataaaccgtaactacaatatataaataaaccgtaactacaatatataaataaaccgtaattacaatatataaataaaccgtaattacaatatataaataaaccgtaattacaatacgtaaataaaccgtaattacaatacgtaaataaaccgtaattacaatatataaataaaccgtaattacaatatataaataaaccgtaattacaatatataaataaaccgtaattacaacgtataaataaaccgtaattacaacgtataaataaaccgtaattacaacgtataaataaaccgtaattacaacgtataaataaaccgtaatcacaacgtataaataaaccgtaatcacaacgtataaataa

SEQ ID NO: 30195 - DNA, 570 bp, Artificial Sequence
  chemically treated genomic DNA (Homo sapiens) CpG-island No: 30195
gttatagtgtttggatagatcgtggttgtagtgtgtggataggtcgtggttatagtgtgtggatagttcgtggttatagtgtgtggatagatcgtggttatagtgcgtggataggtcgtggttgtagtgtgtggatagatcgtggttgtagtgtgtggataggtcgtggttatagtgtgtggataggtcgtggttatagtgtgtggataggtcgtggttatagtgtgtggatagatcgtggttgtagtgtgtggataggtcgtggttatagtgtgtggatagatcgtggttatagtgtgtggataggtcgtggttgtagtgcgtggataggtcgtggttgtagtgcgtggataggtcgtggttgtagtgtgtggataggtcgtggttatagtgtgtggataggtcgtggttatagtgtgtggataggtcgtggttgtagcgtgtggatgggtcgtggttatagcgtgtggataggtcgtggttatagcgtgtggatgggtcgtggttatagcgtgtggatgggtcgtggttatagcgtgtggatgggtcgtggttatagcgtgtggatgg

SEQ ID NO: 30196 - DNA, 570 bp, Artificial Sequence
  chemically treated genomic DNA (Homo sapiens) CpG-island No: 30196
ccatccacacgctataaccacgacccatccacacgctataaccacgacccatccacacgctataaccacgacccatccacacgctataaccacgacctatccacacgctataaccacgacccatccacacgctacaaccacgacctatccacacactataaccacgacctatccacacactataaccacgacctatccacacactacaaccacgacctatccacgcactacaaccacgacctatccacgcactacaaccacgacctatccacacactataaccacgatctatccacacactataaccacgacctatccacacactacaaccacgatctatccacacactataaccacgacctatccacacactataaccacgacctatccacacactataaccacgacctatccacacactacaaccacgatctatccacacactacaaccacgacctatccacgcactataaccacgatctatccacacactataaccacgaactatccacacactataaccacgacctatccacacactacaaccacgatctatccaaacactataac

SEQ ID NO: 30197 - DNA, 928 bp, Artificial Sequence
  chemically treated genomic DNA (Homo sapiens) CpG-island No: 30197
gcgtcgaggtggcgggaggttgcggggagtttgcgcggttaagtattatttgtagttaggagttttcgggtagtttgtagggcgtagtttttgaaagcgagtgttgcgtgcggatcgcgggtttgtagggtgcgcgggtcgggttgggggttgtttttggagagtagagtggttttggggttcgtacgtttatttgttggcgggggatggcgaagatacgggcggttttttcgagggcggtttttacgggtggtttaggttagttcggattcgggagtgtgggagtggcgtagagttgcgggaaaaggcgcggggcgtttgcgtggcgaaggaacgtagtcgtttgatacgttcgtaaggttcgcggagttgtttttgtttcggtttttttgagttaattacggggcggggcgtgaacgtcgggcggggacgtgtcgttttggggggcgtgtttatcggcgggggcgtgtcgttttgggggcgtggttttttgtttcggtgtaggttcgtagggcgttttgggttgggagtaacgcgattgatcgtggtcgtgggcggacggcggttgtagcgcggaggagttggggtcgttgtgggtcgcgaagtagagttcgggacgtgcgcgtttggtgtacgattttgaaggggagtttcgaggggttcgggtttttagggttgttgcggttattttcggagttcggcgcggggttcgcgagatattggtttaggtcgttttagggtttcgggcgtattcggtggtcgttgttgtagcggagggagcgcggcggcgcgggggttcggagatagcgtttttttcggaagtttttttcgggtagtaggtgggaagtgggagtcggagcggtagttggtagcgtttttttcgtaggtcggtattatgcgttttgtagttttgcgcggggttttgttg

SEQ ID NO: 30198 - DNA, 928 bp, Artificial Sequence
  chemically treated genomic DNA (Homo sapiens) CpG-island No: 30198
caacaaaaccccgcgcaaaactacaaaacgcataataccgacctacgaaaaaaacgctaccaactaccgctccgactcccacttcccacctactacccgaaaaaaacttccgaaaaaaacgctatctccgaacccccgcgccgccgcgctccctccgctacaacaacgaccaccgaatacgcccgaaaccctaaaacgacctaaaccaatatctcgcgaaccccgcgccgaactccgaaaataaccgcaacaaccctaaaaacccgaacccctcgaaactccccttcaaaatcgtacaccaaacgcgcacgtcccgaactctacttcgcgacccacaacgaccccaactcctccgcgctacaaccgccgtccgcccacgaccacgatcaatcgcgttactcccaacccaaaacgccctacgaacctacaccgaaacaaaaaaccacgcccccaaaacgacacgcccccgccgataaacacgccccccaaaacgacacgtccccgcccgacgttcacgccccgccccgtaattaactcaaaaaaaccgaaacaaaaacaactccgcgaaccttacgaacgtatcaaacgactacgttccttcgccacgcaaacgccccgcgccttttcccgcaactctacgccactcccacactcccgaatccgaactaacctaaaccacccgtaaaaaccgccctcgaaaaaaccgcccgtatcttcgccatcccccgccaacaaataaacgtacgaaccccaaaaccactctactctccaaaaacaacccccaacccgacccgcgcaccctacaaacccgcgatccgcacgcaacactcgctttcaaaaactacgccctacaaactacccgaaaactcctaactacaaataatacttaaccgcgcaaactccccgcaacctcccgccacctcgacgc

SEQ ID NO: 30199 - DNA, 928 bp, Artificial Sequence
  chemically treated genomic DNA (Homo sapiens) CpG-island No: 30199
tagtagggtttcgcgtagggttgtagggcgtatggtgtcgatttgcggagagaacgttgttagttgtcgtttcggtttttattttttatttgttgttcgaggaagattttcgggagaaacgttgttttcgagttttcgcgtcgtcgcgtttttttcgttgtagtagcggttatcgggtgcgttcggagttttgggacggtttaaattagtatttcgcgggtttcgcgtcgggtttcgggaatggtcgtagtagttttggagattcgggtttttcggagtttttttttaggatcgtgtattaagcgcgtacgtttcgggttttgtttcgcgatttatagcgattttagttttttcgcgttgtagtcgtcgttcgtttacgattacggttagtcgcgttgtttttagtttagggcgttttgcgggtttgtatcggagtagagagttacgtttttaggacggtacgttttcgtcggtggatacgttttttagaacggtacgttttcgttcggcgtttacgtttcgtttcgtggttggtttagagaggtcgaggtaggagtagtttcgcgggttttgcgggcgtgttaggcggttgcgttttttcgttacgtaggcgtttcgcgttttttttcgtagttttgcgttatttttatattttcgggttcgagttaatttagattattcgtgaggatcgttttcggggggatcgttcgtgttttcgttatttttcgttagtaagtgggcgtgcgggttttagggttattttattttttagggatagtttttagttcgattcgcgtattttgtaggttcgcggttcgtacgtagtattcgtttttaaaaattgcgttttgtaagttgttcgggagtttttgattgtagatggtgtttggtcgcgtaggtttttcgtagtttttcgttatttcggcgt

SEQ ID NO: 30200 - DNA, 928 bp, Artificial Sequence
  chemically treated genomic DNA (Homo sapiens) CpG-island No: 30200
acgccgaaataacgaaaaactacgaaaaacctacgcgaccaaacaccatctacaatcaaaaactcccgaacaacttacaaaacgcaatttttaaaaacgaatactacgtacgaaccgcgaacctacaaaatacgcgaatcgaactaaaaactatccctaaaaaataaaataaccctaaaacccgcacgcccacttactaacgaaaaataacgaaaacacgaacgatccccccgaaaacgatcctcacgaataatctaaattaactcgaacccgaaaatataaaaataacgcaaaactacgaaaaaaaacgcgaaacgcctacgtaacgaaaaaacgcaaccgcctaacacgcccgcaaaacccgcgaaactactcctacctcgacctctctaaaccaaccacgaaacgaaacgtaaacgccgaacgaaaacgtaccgttctaaaaaacgtatccaccgacgaaaacgtaccgtcctaaaaacgtaactctctactccgatacaaacccgcaaaacgccctaaactaaaaacaacgcgactaaccgtaatcgtaaacgaacgacgactacaacgcgaaaaaactaaaatcgctataaatcgcgaaacaaaacccgaaacgtacgcgcttaatacacgatcctaaaaaaaaactccgaaaaacccgaatctccaaaactactacgaccattcccgaaacccgacgcgaaacccgcgaaatactaatttaaaccgtcccaaaactccgaacgcacccgataaccgctactacaacgaaaaaaacgcgacgacgcgaaaactcgaaaacaacgtttctcccgaaaatcttcctcgaacaacaaataaaaaataaaaaccgaaacgacaactaacaacgttctctccgcaaatcgacaccatacgccctacaaccctacgcgaaaccctacta

SEQ ID NO: 30201 - DNA, 2543 bp, Artificial Sequence
  chemically treated genomic DNA (Homo sapiens) CpG-island No: 30201
aacgttgcgtgaacgtatatacgtgggggagaaagttaggggaacgtatagagtaaatagaacgtaatgggaacgtataggaaagagaacgttacgggaatatatcgggggagaacgttaggagaatatattgaggagagaatttcgcgtgaatataatgcgggagaattttaggttaacgtacggagaggagaacgtttgttgaatgtacggggttggagaacgtcggtgaacgtcggtgaacgtacggggaagagaacgttacgtgaatatacgggggagacgtcgtacgaatatatagaagggagaatgtcgggtgaatatatacgggggagaacgtttacgcgaacgtatagggtagagaatttcgggtgaaggtataggagggaaacggcgcgcgaacgtttagcggggagaacgtttggtgaatgtacgggagggagaaggttaggtgaacgtatagggggaaaatgtcgcgttaaagtatacgggaaataacgtcgagtaaatatataggtgggagaacgtcgtacgaacgtatagcgtggagaacgcgacgtgaacgtatacggggaagaatattgcgcgaacgtatagtagggagaacgttatttgaaagtaaagtgaggggagaatgtcgcgttgaacgtatagtggggagaataattcgcgaatttataaaggggagaacgtagcgtgaaagtatatagcggggagaacgtttggggaacgtaaagagtaaagagaatgttttgggaacgtataggagagagaacgtaatttgaatatacggtgggggttggaggaagaacgtcgggagattatatagggaggagaacgttaggtgaacgtataagagaaaacgtttggtgaacgcgtaaagaaaggagaaagttaggtgaacgtatagggagaacgtcgtataatcgtataggtaggagaaagttatgtgaacgtataaagaaaggagaacgttgagtgaacgtatatagggtcgagaacgttaggggaacgtatatagtaaagagaatatcgagaacgtcgtgggaacgtataggagagagaacgttacgtgaatatacgagggagaacgtcgcgggaatatatagaagggcgaatgttcggcgaacgtatagaggggagaacgttaggggaatacgtacgggggagaacgttgcgcgattatatagcggggagaatatcgggtaaatatatattggggaaaatatcgcgtgaacgtatagaggggagaatttcgggtgaatatatagaggggagagtttcgtgtgaatataaagggaggagaacgtttggtgagtatatacggggagagaatatcgcgcggatttataagggggagaatgtttggtgaacgtatagcgggaggggagaacgttggtgaacgtatagcggggaaaacgttatgtgaacgtataaaggaaggagaacgttaggtgaatttatatagggggtaggaacgttagaggaaagtatatagtaaagagaaggtcgtgggaacgcgtaggggagagaacgtcgggagaatatagagggaggaaaatgttaggtgaacgtataagggggaaaacgtttggtgaacgtataaaggagaaagttaggtgaacgtataagtagtagaacgttaagtgaacgtacgaggggagaatgttgcgttaatatatacgggaaatataatcgcgcgagtacgtagtggggagaacggtacgcgaacgtttagtaagaagaacgtaagttgaacggatagcggggagaacgtcgttttaatatacgcgggaaataacgacgcgtgaatatatagtagggagaacgtcgcgtgaaagtataggggggagaacgtcgcgtgaatgtatatacgggaaataacgtcgtgtgaatatatagcggggagaacgtcgcgtgaacgtatataggggaaataacgtcgcgcgaatatatagggggaagaacgttatagggacgtatagtggggaaacgttatgtgaacgtataaagagagaacgttacgtgaattcgtatacgcggggagaacgtcggggaaacgtatatagtaaagagaacgtagtttgaacgtataggggagagaacgttacgtgaatatatagaagggagaatgtagtgcgaatatatataaggagaatatttggtgaagtatagagggagaacgtcgagcgaacgtatagggtggagaatgttatgtgaacgtataaagaaaggagaatttttggtgaacgtatataggtagaaagaatgtcgaggaacgtatagagtaaagagatcgtcgtgggaatatataggggagagaacgttacgtgaatatatggggagaacgtcgcgggaatatatagaagggcgatcgtttggtggatgtatagaggggagaacgttaggggaatatatataggggagaacgttgggcgattatatagggtggagaacgtcgggtaaatatatattggggaaaacgttgtgtaatcgtatagagggaagaacgtcgggtgaatatatagggtgcgtttttttat

SEQ ID NO: 30202 - DNA, 2543 bp, Artificial Sequence
  chemically treated genomic DNA (Homo sapiens) CpG-island No: 30202
ataaaaaaacgcaccctatatattcacccgacgttcttccctctatacgattacacaacgttttccccaatatatatttacccgacgttctccaccctatataatcgcccaacgttctcccctatatatattcccctaacgttctcccctctatacatccaccaaacgatcgcccttctatatattcccgcgacgttctccccatatattcacgtaacgttctctcccctatatattcccacgacgatctctttactctatacgttcctcgacattctttctacctatatacgttcaccaaaaattctcctttctttatacgttcacataacattctccaccctatacgttcgctcgacgttctccctctatacttcaccaaatattctccttatatatattcgcactacattctcccttctatatattcacgtaacgttctctcccctatacgttcaaactacgttctctttactatatacgtttccccgacgttctccccgcgtatacgaattcacgtaacgttctctctttatacgttcacataacgtttccccactatacgtccctataacgttcttccccctatatattcgcgcgacgttatttcccctatatacgttcacgcgacgttctccccgctatatattcacacgacgttatttcccgtatatacattcacgcgacgttctcccccctatactttcacgcgacgttctccctactatatattcacgcgtcgttatttcccgcgtatattaaaacgacgttctccccgctatccgttcaacttacgttcttcttactaaacgttcgcgtaccgttctccccactacgtactcgcgcgattatatttcccgtatatattaacgcaacattctcccctcgtacgttcacttaacgttctactacttatacgttcacctaactttctcctttatacgttcaccaaacgttttcccccttatacgttcacctaacattttcctccctctatattctcccgacgttctctcccctacgcgttcccacgaccttctctttactatatactttcctctaacgttcctaccccctatataaattcacctaacgttctccttcctttatacgttcacataacgttttccccgctatacgttcaccaacgttctcccctcccgctatacgttcaccaaacattctcccccttataaatccgcgcgatattctctccccgtatatactcaccaaacgttctcctccctttatattcacacgaaactctcccctctatatattcacccgaaattctcccctctatacgttcacgcgatattttccccaatatatatttacccgatattctccccgctatataatcgcgcaacgttctcccccgtacgtattcccctaacgttctcccctctatacgttcgccgaacattcgcccttctatatattcccgcgacgttctccctcgtatattcacgtaacgttctctctcctatacgttcccacgacgttctcgatattctctttactatatacgttcccctaacgttctcgaccctatatacgttcactcaacgttctcctttctttatacgttcacataactttctcctacctatacgattatacgacgttctccctatacgttcacctaactttctcctttctttacgcgttcaccaaacgttttctcttatacgttcacctaacgttctcctccctatataatctcccgacgttcttcctccaacccccaccgtatattcaaattacgttctctctcctatacgttcccaaaacattctctttactctttacgttccccaaacgttctccccgctatatactttcacgctacgttctcccctttataaattcgcgaattattctccccactatacgttcaacgcgacattctcccctcactttactttcaaataacgttctccctactatacgttcgcgcaatattcttccccgtatacgttcacgtcgcgttctccacgctatacgttcgtacgacgttctcccacctatatatttactcgacgttatttcccgtatactttaacgcgacattttccccctatacgttcacctaaccttctccctcccgtacattcaccaaacgttctccccgctaaacgttcgcgcgccgtttccctcctataccttcacccgaaattctctaccctatacgttcgcgtaaacgttctcccccgtatatattcacccgacattctcccttctatatattcgtacgacgtctcccccgtatattcacgtaacgttctcttccccgtacgttcaccgacgttcaccgacgttctccaaccccgtacattcaacaaacgttctcctctccgtacgttaacctaaaattctcccgcattatattcacgcgaaattctctcctcaatatattctcctaacgttctcccccgatatattcccgtaacgttctctttcctatacgttcccattacgttctatttactctatacgttcccctaactttctcccccacgtatatacgttcacgcaacgtt

SEQ ID NO: 30203 - DNA, 2543 bp, Artificial Sequence
  chemically treated genomic DNA (Homo sapiens) CpG-island No: 30203
atggaagaacgtattttgtgtgtttattcggcgtttttttttttatgcgattgtatagcgttttttttagtgtgtatttattcggcgttttttattttgtgtgatcgtttagcgtttttttttgtgtgtgtttttttggcgtttttttttttgtgtatttattaggcggtcgtttttttgtgtgttttcgcggcgttttttttatgtgtttacgtggcgtttttttttttgtgtgtttttacggcggtttttttattttgtgcgtttttcggtattttttttgtttgtgtgcgtttattaggggtttttttttttttgtgcgtttatatggtattttttattttgtgcgttcgttcggcgttttttttttgtgttttattaggtgttttttttgtgtgtgttcgtattgtatttttttttttgtgtgtttacgtggcgtttttttttttgtgcgtttaaattgcgttttttttattgtgtgcgttttttcggcgtttttttcgcgtgtgcgagtttacgtggcgttttttttttgtgcgtttatatggcgtttttttattgtgcgtttttgtgacgtttttttttttgtgtgttcgcgcggcgttattttttttgtgtgcgtttacgcggcgtttttttcgttgtgtgtttatacggcgttatttttcgtgtgtgtatttacgcggcgtttttttttttgtgtttttacgcggcgttttttttgttgtgtgtttacgcgtcgttatttttcgcgtgtgttagggcggcgtttttttcgttgttcgtttaatttacgttttttttgttgagcgttcgcgtgtcgttttttttattgcgtgttcgcgcggttgtgtttttcgtgtgtgttggcgtagtatttttttttcgtgcgtttatttggcgttttgttgtttgtgcgtttatttggtttttttttttgtgcgtttattaggcgtttttttttttgtgcgtttatttggtatttttttttttttgtgttttttcggcgtttttttttttgcgcgtttttacggttttttttttattgtgtgtttttttttggcgtttttattttttgtatgagtttatttggcgtttttttttttttgtgcgtttatatggcgtttttttcgttgtgcgtttattagcgtttttttttttcgttgtacgtttattaggtatttttttttttgtgggttcgcgcggtgtttttttttcgtgtgtgtttattaggcgtttttttttttttgtgtttatacggagtttttttttttgtgtgtttattcggggtttttttttttatgcgtttacgcggtgttttttttagtgtgtgtttattcggtgtttttttcgttgtgtgatcgcgtagcgttttttttcgtgcgtgtttttttggcgtttttttttttgtgcgttcgtcgggtattcgtttttttgtgtgttttcgcggcgttttttttcgtgtgtttacgtggcgtttttttttttgtgcgtttttacggcgttttcggtgttttttttattgtgtgcgtttttttggcgttttcggttttgtgtgcgtttatttagcgtttttttttttttgtgcgtttatatggtttttttttatttgtgcggttgtgcggcgttttttttgtgcgtttatttggtttttttttttttttgcgcgtttattaggcgtttttttttgtgcgtttatttggcgtttttttttttgtgtgatttttcgacgttttttttttagtttttatcgtgtgtttaggttgcgtttttttttttgtgcgtttttaaggtattttttttattttttgcgttttttaggcgtttttttcgttgtgtgtttttacgttgcgtttttttttttatgagttcgcgggttgttttttttattgtgcgtttaacgcggtattttttttttattttgtttttaagtggcgttttttttgttgtgcgttcgcgtagtgttttttttcgtgtgcgtttacgtcgcgttttttacgttgtgcgttcgtgcgacgtttttttatttgtgtgtttgttcggcgttatttttcgtgtgttttagcgcggtattttttttttgtgcgtttatttggttttttttttttcgtgtatttattaggcgtttttttcgttgagcgttcgcgcgtcgttttttttttgtgtttttattcggaattttttattttgtgcgttcgcgtgggcgttttttttcgtgtgtgtttattcggtatttttttttttgtgtgttcgtgcggcgtttttttcgtgtgtttacgtggcgttttttttttcgtgcgtttatcggcgtttatcggcgttttttaatttcgtgtatttagtaggcgttttttttttcgtgcgttgatttggagttttttcgtattgtgtttacgcggagttttttttttagtgtgtttttttggcgttttttttcggtgtgttttcgtggcgtttttttttttgtgcgtttttattgcgttttatttattttgtgcgtttttttggtttttttttttacgtgtgtgcgtttacgtagcgtt

SEQ ID NO: 30204 - DNA, 2543 bp, Artificial Sequence
  chemically treated genomic DNA (Homo sapiens) CpG-island No: 30204
aacgctacgtaaacgcacacacgtaaaaaaaaaaaccaaaaaaacgcacaaaataaataaaacgcaataaaaacgcacaaaaaaaaaaacgccacgaaaacacaccgaaaaaaaacgccaaaaaaacacactaaaaaaaaaactccgcgtaaacacaatacgaaaaaactccaaatcaacgcacgaaaaaaaaaacgcctactaaatacacgaaattaaaaaacgccgataaacgccgataaacgcacgaaaaaaaaaacgccacgtaaacacacgaaaaaaacgccgcacgaacacacaaaaaaaaaaataccgaataaacacacacgaaaaaaaacgcccacgcgaacgcacaaaataaaaaattccgaataaaaacacaaaaaaaaaacgacgcgcgaacgctcaacgaaaaaaacgcctaataaatacacgaaaaaaaaaaaaccaaataaacgcacaaaaaaaaaataccgcgctaaaacacacgaaaaataacgccgaacaaacacacaaataaaaaaacgtcgcacgaacgcacaacgtaaaaaacgcgacgtaaacgcacacgaaaaaaaacactacgcgaacgcacaacaaaaaaaacgccacttaaaaacaaaataaaaaaaaaataccgcgttaaacgcacaataaaaaaaacaacccgcgaactcataaaaaaaaaaacgcaacgtaaaaacacacaacgaaaaaaacgcctaaaaaacgcaaaaaataaaaaaaataccttaaaaacgcacaaaaaaaaaaacgcaacctaaacacacgataaaaactaaaaaaaaaacgtcgaaaaatcacacaaaaaaaaaaacgccaaataaacgcacaaaaaaaaacgcctaataaacgcgcaaaaaaaaaaaaaaaccaaataaacgcacaaaaaaaacgccgcacaaccgcacaaataaaaaaaaaccatataaacgcacaaaaaaaaaaaaacgctaaataaacgcacacaaaaccgaaaacgccaaaaaaacgcacacaataaaaaaaacaccgaaaacgccgtaaaaacgcacaaaaaaaaaaacgccacgtaaacacacgaaaaaaaacgccgcgaaaacacacaaaaaaacgaatacccgacgaacgcacaaaaaaaaaaacgccaaaaaaacacgcacgaaaaaaaacgctacgcgatcacacaacgaaaaaaacaccgaataaacacacactaaaaaaaacaccgcgtaaacgcataaaaaaaaaaaccccgaataaacacacaaaaaaaaaaactccgtataaacacaaaaaaaaaaaaacgcctaataaacacacacgaaaaaaaaacaccgcgcgaacccacaaaaaaaaaaatacctaataaacgtacaacgaaaaaaaaaaacgctaataaacgcacaacgaaaaaaacgccatataaacgcacaaaaaaaaaaaaacgccaaataaactcatacaaaaaataaaaacgccaaaaaaaaacacacaataaaaaaaaaaccgtaaaaacgcgcaaaaaaaaaaacgccgaaaaaacacaaaaaaaaaaaaataccaaataaacgcacaaaaaaaaaaacgcctaataaacgcacaaaaaaaaaaaccaaataaacgcacaaacaacaaaacgccaaataaacgcacgaaaaaaaaatactacgccaacacacacgaaaaacacaaccgcgcgaacacgcaataaaaaaaacgacacgcgaacgctcaacaaaaaaaacgtaaattaaacgaacaacgaaaaaaacgccgccctaacacacgcgaaaaataacgacgcgtaaacacacaacaaaaaaaacgccgcgtaaaaacacaaaaaaaaaaacgccgcgtaaatacacacacgaaaaataacgccgtataaacacacaacgaaaaaaacgccgcgtaaacgcacacaaaaaaaataacgccgcgcgaacacacaaaaaaaaaaacgtcacaaaaacgcacaataaaaaaacgccatataaacgcacaaaaaaaaaacgccacgtaaactcgcacacgcgaaaaaaacgccgaaaaaacgcacacaataaaaaaaacgcaatttaaacgcacaaaaaaaaaaacgccacgtaaacacacaaaaaaaaaaatacaatacgaacacacacaaaaaaaacacctaataaaacacaaaaaaaaaacgccgaacgaacgcacaaaataaaaaataccatataaacgcacaaaaaaaaaaaaacccctaataaacgcacacaaacaaaaaaaataccgaaaaacgcacaaaataaaaaaaccgccgtaaaaacacacaaaaaaaaaaacgccacgtaaacacataaaaaaaacgccgcgaaaacacacaaaaaaacgaccgcctaataaatacacaaaaaaaaaaacgccaaaaaaacacacacaaaaaaaaacgctaaacgatcacacaaaataaaaaacgccgaataaatacacactaaaaaaaacgctatacaatcgcataaaaaaaaaaacgccgaataaacacacaaaatacgttcttccat

SEQ ID NO: 30205 - DNA, 615 bp, Artificial Sequence
  chemically treated genomic DNA (Homo sapiens) CpG-island No: 30205
tattttgttattttgtggtttaatcggtattttttttttttatgagcgtttatttggcgtttttttcgttgtgtgcgtttaattcgcgtttttttcgttgtgtgcgtttattcggcgttcgtttatttgtgtgtatgtatcgttttgtgtacgtttattaggcgtttttttttttgtgtgcgattatttggagtttttttcgttgagtacgtttattcggtgtttttttttttgtgcgtttattgggcgttttttttattgtgcgcgtttattcggtattttgttttttgtgtgcgtttatcgggcgtttttttttttgtgtgcgtttattcggcgtttttttcgttgtgtgcgtttatttcgcgtttttttagttttgtgagtttatttaattttttttttattttgtgtatttattcggtattttttcgattgtgtgcgtttattcggcgtttttttttttgtgtgcgtttttttggcgtttttttatttgtgtgcgtttattcggcgtttttttttttatgtgcgtttatttggcgtttttttttttgtgtgtttatatggcgtttttttcgttgtgtgtgttttcgtggtattgtttttgtgtgtgtttat

SEQ ID NO: 30206 - DNA, 615 bp, Artificial Sequence
  chemically treated genomic DNA (Homo sapiens) CpG-island No: 30206
ataaacacacacaaaaacaataccacgaaaacacacacaacgaaaaaaacgccatataaacacacaaaaaaaaaaacgccaaataaacgcacataaaaaaaaaaacgccgaataaacgcacacaaataaaaaaacgccaaaaaaacgcacacaaaaaaaaaaacgccgaataaacgcacacaatcgaaaaaataccgaataaatacacaaaataaaaaaaaaattaaataaactcacaaaactaaaaaaacgcgaaataaacgcacacaacgaaaaaaacgccgaataaacgcacacaaaaaaaaaaacgcccgataaacgcacacaaaaaacaaaataccgaataaacgcgcacaataaaaaaaacgcccaataaacgcacaaaaaaaaaaacaccgaataaacgtactcaacgaaaaaaactccaaataatcgcacacaaaaaaaaaaacgcctaataaacgtacacaaaacgatacatacacacaaataaacgaacgccgaataaacgcacacaacgaaaaaaacgcgaattaaacgcacacaacgaaaaaaacgccaaataaacgctcataaaaaaaaaaaataccgattaaaccacaaaataacaaaata

SEQ ID NO: 30207 - DNA, 615 bp, Artificial Sequence
  chemically treated genomic DNA (Homo sapiens) CpG-island No: 30207
gtgaatatatataggaataatgttacgggaatatatataacggggagaacgttatgtgaatatatagaggggagaacgttaggtgaacgtatatggaggggagaacgtcgggtgaacgtatataggtgggagaacgttaggagaacgtatatagagaggagaacgtcgggtgaacgtatatagtcgggagaatgtcgggtgaatgtataaagtaaggagaaagttgggtgaatttatagagttgggagaacgcggggtgaacgtatatagcggggagaacgtcgggtgaacgtatataggggggagaacgttcggtgaacgtatatagagggtaggatgtcgggtgaacgcgtatagtggggagaacgtttagtgaacgtatagaggggagaatatcggatgaacgtatttagcggggagaattttaggtgatcgtatatagaggggagaacgtttggtgaacgtatatagggcgatgtatgtatataggtgggcgaacgtcgggtgaacgtatatagcggggagaacgcgggttgaacgtatataacggggagaacgttaggtgaacgtttatagagggggagaatgtcggttgaattatagagtaatagagta

SEQ ID NO: 30208 - DNA, 615 bp, Artificial Sequence
  chemically treated genomic DNA (Homo sapiens) CpG-island No: 30208
tactctattactctataattcaaccgacattctccccctctataaacgttcacctaacgttctccccgttatatacgttcaacccgcgttctccccgctatatacgttcacccgacgttcgcccacctatatacatacatcgccctatatacgttcaccaaacgttctcccctctatatacgatcacctaaaattctccccgctaaatacgttcatccgatattctcccctctatacgttcactaaacgttctccccactatacgcgttcacccgacatcctaccctctatatacgttcaccgaacgttctcccccctatatacgttcacccgacgttctccccgctatatacgttcaccccgcgttctcccaactctataaattcacccaactttctccttactttatacattcacccgacattctcccgactatatacgttcacccgacgttctcctctctatatacgttctcctaacgttctcccacctatatacgttcacccgacgttctcccctccatatacgttcacctaacgttctcccctctatatattcacataacgttctccccgttatatatattcccgtaacattattcctatatatattcac

SEQ ID NO: 30209 - DNA, 797 bp, Artificial Sequence
  chemically treated genomic DNA (Homo sapiens) CpG-island No: 30209
cgcggggtcgaggcgagtacgggagtgggacgcgggttttttcgtagttaacggcggggggcgcgagggttaaaagagcggtttaagtagtagtagtaagatggaggcgagtggggtttaggcgtttcggggcgttaagcggtcgtcgtcgtcgttgtttttgcgtttaggtttatagggtaggttttcgcggtcgttcgatgtagtagcgtcgttgttcgggcgcggtgggtgcgggacgtcgtcgtcgtcgtttagcggttgtttattattcgcgttttcggtgcgttgttcgttatcgtagtttttatcgtagtagtcgtttaggttttcgttcgagtcgttgttgtcggggtcgttgtttagttcggcgtcgaagtataggcgggttatgttttttttgatcgattcgtagatgggtcgttcgaggtcgtcgtatacgtagtcgttgagtagcgtcgttttgggtatagttagtatgtttttaatgacggtgcggtattcgttcgtgtagcgtagttcgttgaagattttgtcgtagtaggttaggtagcggtttatcgttaggttgtagcggttgtcgcggtcgtagcgtcgtcgggtttcggtgtagtttatgatttcgttcgcgtcggggtcgttcgcgtcgtcgtcgttcgtgcggggtaggtacggtttaatggcgcgtttggtggatttgtagttttcgttttgcgcgtagttatagttttttagggcgggttcgcggcgcgtgtggttgagttgaatgagggtcgagatgtagtgattcgggtagt

SEQ ID NO: 30210 - DNA, 797 bp, Artificial Sequence
  chemically treated genomic DNA (Homo sapiens) CpG-island No: 30210
actacccgaatcactacatctcgaccctcattcaactcaaccacacgcgccgcgaacccgccctaaaaaactataactacgcgcaaaacgaaaactacaaatccaccaaacgcgccattaaaccgtacctaccccgcacgaacgacgacgacgcgaacgaccccgacgcgaacgaaatcataaactacaccgaaacccgacgacgctacgaccgcgacaaccgctacaacctaacgataaaccgctacctaacctactacgacaaaatcttcaacgaactacgctacacgaacgaataccgcaccgtcattaaaaacatactaactatacccaaaacgacgctactcaacgactacgtatacgacgacctcgaacgacccatctacgaatcgatcaaaaaaaacataacccgcctatacttcgacgccgaactaaacaacgaccccgacaacaacgactcgaacgaaaacctaaacgactactacgataaaaactacgataacgaacaacgcaccgaaaacgcgaataataaacaaccgctaaacgacgacgacgacgtcccgcacccaccgcgcccgaacaacgacgctactacatcgaacgaccgcgaaaacctaccctataaacctaaacgcaaaaacaacgacgacgacgaccgcttaacgccccgaaacgcctaaaccccactcgcctccatcttactactactacttaaaccgctcttttaaccctcgcgccccccgccgttaactacgaaaaaacccgcgtcccactcccgtactcgcctcgaccccgcg

SEQ ID NO: 30211 - DNA, 797 bp, Artificial Sequence
  chemically treated genomic DNA (Homo sapiens) CpG-island No: 30211
gttgttcgagttattgtatttcggtttttatttagtttaattatacgcgtcgcgggttcgttttggaggattgtgattgcgcgtaggacgagaattgtaagtttattaagcgcgttattgagtcgtgtttgtttcgtacgagcggcggcggcgcgggcggtttcggcgcgggcggggttatgggttgtatcgaggttcggcggcgttgcgatcgcgatagtcgttgtaatttggcgatgagtcgttatttgatttattgcggtaaagtttttaacgggttgcgttgtacggacgaatgtcgtatcgttattgaggatatgttggttatgtttaaggcggcgttgtttaacgattgcgtgtgcgacggtttcgagcggtttatttgcgagtcggttaaggagaatatggttcgtttgtgtttcggcgtcgagttgggtaacggtttcggtagtagcggttcggacgggggtttggacgattattacgatgaggattacgatgacgagtagcgtatcgggggcgcgggtggtgagtagtcgttggacgacgacgacggcgtttcgtatttatcgcgttcgggtagcggcgttgttgtatcgggcggtcgcggggatttgttttatgggtttgggcgtaggagtagcggcggcggcggtcgtttggcgtttcggggcgtttggattttattcgtttttattttgttgttgttgtttgggtcgtttttttagttttcgcgtttttcgtcgttggttgcgggagagttcgcgttttattttcgtgttcgtttcgatttcgcg

SEQ ID NO: 30212 - DNA, 797 bp, Artificial Sequence
  chemically treated genomic DNA (Homo sapiens) CpG-island No: 30212
cgcgaaatcgaaacgaacacgaaaataaaacgcgaactctcccgcaaccaacgacgaaaaacgcgaaaactaaaaaaacgacccaaacaacaacaacaaaataaaaacgaataaaatccaaacgccccgaaacgccaaacgaccgccgccgccgctactcctacgcccaaacccataaaacaaatccccgcgaccgcccgatacaacaacgccgctacccgaacgcgataaatacgaaacgccgtcgtcgtcgtccaacgactactcaccacccgcgcccccgatacgctactcgtcatcgtaatcctcatcgtaataatcgtccaaacccccgtccgaaccgctactaccgaaaccgttacccaactcgacgccgaaacacaaacgaaccatattctccttaaccgactcgcaaataaaccgctcgaaaccgtcgcacacgcaatcgttaaacaacgccgccttaaacataaccaacatatcctcaataacgatacgacattcgtccgtacaacgcaacccgttaaaaactttaccgcaataaatcaaataacgactcatcgccaaattacaacgactatcgcgatcgcaacgccgccgaacctcgatacaacccataaccccgcccgcgccgaaaccgcccgcgccgccgccgctcgtacgaaacaaacacgactcaataacgcgcttaataaacttacaattctcgtcctacgcgcaatcacaatcctccaaaacgaacccgcgacgcgtataattaaactaaataaaaaccgaaatacaataactcgaacaac

SEQ ID NO: 30213 - DNA, 1112 bp, Artificial Sequence
  chemically treated genomic DNA (Homo sapiens) CpG-island No: 30213
atattcggttcgatttcgagcggcgtcgttttgtcgggtcgagggtcgtttttttttgtttttacggttttggtggtgacgttgttagtgttgttgatcgtcgttatttttttgtggaatttgttggtttcggttattatttcgcgggttcgtgttttttatcgcgtgtcgtataatttggtggtttcgacggtcgtttcggacgaattagtggtagcgttggcgatgttatcgagtttggcgagtgagttgtcgatcgggcgacgtcggttgttgggtcggagtttgtgttacgtgtagatttttttcgacgtcggagtttgtgttacgtgtggatttttttttacggttgtgttgtttcgtcggtttcgggaacgtggcggttatcgttttgggtcgcgacggggttattatacggtatttgtagtatacgttgcgtattcgtagtcgcgtttcgttgtttatgatcgcgtttattcgggtgtcgtcggcgtttatcgttttcgcgtcgttgttttttggtcggggcgaggtgtgcgacgttcggttttagcgttgttaggtgagtcgggaatttttttatgtcgttttttttattcgcggcgttttttatttgtcgtttggcgtggtgtcgtttgtttatcggaagatttacgaggcggttaagtttcgtttcggtcgtcgtcggagagttgtgttgtcgttgtcggttattatgtaggtgaggggtgggttgaggaacgttgttttggggaagcggttgttagagaaggaggcggtttcgcgaatgggagagtgggcggaagtttgtattaatggagcgcgcgtttagagattatttggggcgtacgaggataagtttgttattagtttttttgaagcgggtatcgaggggtttgttatcggtttatttggtacgtaagtgaggggttcgttagttgcgtatttggtgcgcgtagaggaaagggttttataatttgtacgttagggaggtagatttgatatcgatttacgacgtacgatatggtcggaggggtttgtaggtttagttcgttttagtagcgatgagggtatattttgttatttgtattatttgttgtttttttttttaa

SEQ ID NO: 30214 - DNA, 1112 bp, Artificial Sequence
  chemically treated genomic DNA (Homo sapiens) CpG-island No: 30214
ttaaaaaaaaaaacaacaaataatacaaataacaaaatataccctcatcgctactaaaacgaactaaacctacaaacccctccgaccatatcgtacgtcgtaaatcgatatcaaatctacctccctaacgtacaaattataaaaccctttcctctacgcgcaccaaatacgcaactaacgaacccctcacttacgtaccaaataaaccgataacaaacccctcgatacccgcttcaaaaaaactaataacaaacttatcctcgtacgccccaaataatctctaaacgcgcgctccattaatacaaacttccgcccactctcccattcgcgaaaccgcctccttctctaacaaccgcttccccaaaacaacgttcctcaacccacccctcacctacataataaccgacaacgacaacacaactctccgacgacgaccgaaacgaaacttaaccgcctcgtaaatcttccgataaacaaacgacaccacgccaaacgacaaataaaaaacgccgcgaataaaaaaaacgacataaaaaaattcccgactcacctaacaacgctaaaaccgaacgtcgcacacctcgccccgaccaaaaaacaacgacgcgaaaacgataaacgccgacgacacccgaataaacgcgatcataaacaacgaaacgcgactacgaatacgcaacgtatactacaaataccgtataataaccccgtcgcgacccaaaacgataaccgccacgttcccgaaaccgacgaaacaacacaaccgtaaaaaaaaatccacacgtaacacaaactccgacgtcgaaaaaaatctacacgtaacacaaactccgacccaacaaccgacgtcgcccgatcgacaactcactcgccaaactcgataacatcgccaacgctaccactaattcgtccgaaacgaccgtcgaaaccaccaaattatacgacacgcgataaaaaacacgaacccgcgaaataataaccgaaaccaacaaattccacaaaaaaataacgacgatcaacaacactaacaacgtcaccaccaaaaccgtaaaaacaaaaaaaaacgaccctcgacccgacaaaacgacgccgctcgaaatcgaaccgaatat

SEQ ID NO: 30215 - DNA, 1112 bp, Artificial Sequence
  chemically treated genomic DNA (Homo sapiens) CpG-island No: 30215
ttgagggggaaaataatagatagtgtaggtaataagatgtgtttttatcgttattgagacgggttgaatttataagttttttcggttatatcgtgcgtcgtgggtcggtgttagatttgtttttttaacgtgtagattgtgaaatttttttttttgcgcgtattaagtacgtagttggcgaattttttatttgcgtgttaggtgagtcggtgataagtttttcggtgttcgttttagaagaattgatggtaaatttgttttcgtgcgttttaggtgatttttgggcgcgcgttttattagtataagttttcgtttatttttttattcgcgaagtcgtttttttttttagtaatcgtttttttaaagtaacgttttttagtttattttttatttgtatggtggtcggtaacggtagtatagtttttcggcggcggtcgaaacgaaatttggtcgtttcgtagatttttcggtagataaacggtattacgttaagcggtaggtggaaggcgtcgcgggtggagaaggcggtataggagggttttcggtttatttggtagcgttggagtcgagcgtcgtatatttcgtttcggttaaagagtagcggcgcgagggcgatgagcgtcgacggtattcgggtgagcgcgattatgagtaacgaggcgcggttgcgggtgcgtagcgtgtgttgtaggtgtcgtgtgatggtttcgtcgcggtttagggcgatggtcgttacgttttcgaggtcggcggggtagtatagtcgtggaaggagatttatacgtggtataggtttcggcgtcgagggagatttatacgtggtataggtttcggtttagtagtcgacgtcgttcggtcgatagtttattcgttaggttcggtggtatcgttagcgttgttattagttcgttcgagacggtcgtcgaggttattaagttatgcggtacgcggtggaaggtacggattcgcgggatggtgatcggaattagtaggttttataggaaagtggcggcgattagtagtattagtagcgttattattaggatcgtgaagatagagaagggcggttttcggttcggtaggacggcgtcgttcggggtcgaatcgagtat

SEQ ID NO: 30216 - DNA, 1112 bp, Artificial Sequence
  chemically treated genomic DNA (Homo sapiens) CpG-island No: 30216
atactcgattcgaccccgaacgacgccgtcctaccgaaccgaaaaccgcccttctctatcttcacgatcctaataataacgctactaatactactaatcgccgccactttcctataaaacctactaattccgatcaccatcccgcgaatccgtaccttccaccgcgtaccgcataacttaataacctcgacgaccgtctcgaacgaactaataacaacgctaacgataccaccgaacctaacgaataaactatcgaccgaacgacgtcgactactaaaccgaaacctataccacgtataaatctccctcgacgccgaaacctataccacgtataaatctccttccacgactatactaccccgccgacctcgaaaacgtaacgaccatcgccctaaaccgcgacgaaaccatcacacgacacctacaacacacgctacgcacccgcaaccgcgcctcgttactcataatcgcgctcacccgaataccgtcgacgctcatcgccctcgcgccgctactctttaaccgaaacgaaatatacgacgctcgactccaacgctaccaaataaaccgaaaaccctcctataccgccttctccacccgcgacgccttccacctaccgcttaacgtaataccgtttatctaccgaaaaatctacgaaacgaccaaatttcgtttcgaccgccgccgaaaaactatactaccgttaccgaccaccatacaaataaaaaataaactaaaaaacgttactttaaaaaaacgattactaaaaaaaaaaacgacttcgcgaataaaaaaataaacgaaaacttatactaataaaacgcgcgcccaaaaatcacctaaaacgcacgaaaacaaatttaccatcaattcttctaaaacgaacaccgaaaaacttatcaccgactcacctaacacgcaaataaaaaattcgccaactacgtacttaatacgcgcaaaaaaaaaaatttcacaatctacacgttaaaaaaacaaatctaacaccgacccacgacgcacgatataaccgaaaaaacttataaattcaacccgtctcaataacgataaaaacacatcttattacctacactatctattattttccccctcaa

SEQ ID NO: 30217 - DNA, 890 bp, Artificial Sequence
  chemically treated genomic DNA (Homo sapiens) CpG-island No: 30217
cgcggggcggggagggggcgtggttcggggggtagggcggtgtgacgcgcgcgtcgcggatttcggaagcggtgttagatgttggggagtcgggcgggcgggtgcggtggcggcgggcggcgcgggggtatttgttgtttttcgcgaagtcggagttcgagcgttaggcggcggcggcggtcgaggggagcgcgatagtgagcgtcggcgcgaggatagcgcgtgttcgcgaggagtcgtcgcgcgttcgcgtttttcgcgcgacgttaggtgaggggcggtggggtagcggggttcgggtcgcggcggggacggggatcggggcgcggggtcggggttatttggtcgttgagttacggtcgtttgggggcgcgggtcgagggtggcggggttgggtgcgcggggttcgagatttttatgcggttcgcggcgcggttcgggtatttgtttaggtgggtttcgtttcgtaggttcgggggttttttcgggacgcgaggtttttttttttgtacgtgtcgttcgggttatgtttgtcgcgtcgggggttttagggcgcggattttagatttgggaggacgaggatttacgcgggtcggcggcgcgtatcgggttcgcgtttttatatttgcggggggcggggcggggcgggcgttacgtgcgggcggtgcggggagggcgcgggcgcgtggatttttcgcggttttcgttttagcgtggttttcgcgtgcggtttcggattgtttttcgcgttttttttcggtgacgggcggcgttttggtttagtggttggggttacgcgtgttcgggaacggggtgggggtaatcgggtttttttataggcgggattttgggattggtgtcgtttttagtcgtttatttgttagggttgt

SEQ ID NO: 30218 - DNA, 890 bp, Artificial Sequence
  chemically treated genomic DNA (Homo sapiens) CpG-island No: 30218
acaaccctaacaaataaacgactaaaaacgacaccaatcccaaaatcccgcctataaaaaaacccgattacccccaccccgttcccgaacacgcgtaaccccaaccactaaaccaaaacgccgcccgtcaccgaaaaaaaacgcgaaaaacaatccgaaaccgcacgcgaaaaccacgctaaaacgaaaaccgcgaaaaatccacgcgcccgcgccctccccgcaccgcccgcacgtaacgcccgccccgccccgccccccgcaaatataaaaacgcgaacccgatacgcgccgccgacccgcgtaaatcctcgtcctcccaaatctaaaatccgcgccctaaaacccccgacgcgacaaacataacccgaacgacacgtacaaaaaaaaaaacctcgcgtcccgaaaaaacccccgaacctacgaaacgaaacccacctaaacaaatacccgaaccgcgccgcgaaccgcataaaaatctcgaaccccgcgcacccaaccccgccaccctcgacccgcgcccccaaacgaccgtaactcaacgaccaaataaccccgaccccgcgccccgatccccgtccccgccgcgacccgaaccccgctaccccaccgcccctcacctaacgtcgcgcgaaaaacgcgaacgcgcgacgactcctcgcgaacacgcgctatcctcgcgccgacgctcactatcgcgctcccctcgaccgccgccgccgcctaacgctcgaactccgacttcgcgaaaaacaacaaatacccccgcgccgcccgccgccaccgcacccgcccgcccgactccccaacatctaacaccgcttccgaaatccgcgacgcgcgcgtcacaccgccctaccccccgaaccacgccccctccccgccccgcg

SEQ ID NO: 30219 - DNA, 890 bp, Artificial Sequence
  chemically treated genomic DNA (Homo sapiens) CpG-island No: 30219
gtaattttggtaggtgggcggttgagagcgatattagttttaggatttcgtttgtggggagattcggttatttttatttcgttttcgggtacgcgtgattttagttattgggttagagcgtcgttcgttatcgggaggaagcgcggggggtagttcggggtcgtacgcggaagttacgttggggcggaagtcgcggagaatttacgcgttcgcgtttttttcgtatcgttcgtacgtggcgttcgtttcgtttcgtttttcgtaggtgtgaaggcgcgggttcgatgcgcgtcgtcgattcgcgtggattttcgtttttttaggtttggggttcgcgttttggggttttcggcgcggtaagtatggttcgggcggtacgtgtaggggagagagtttcgcgtttcggggaagttttcgggtttgcggggcggggtttatttgggtaggtgttcgggtcgcgtcgcgggtcgtatgagggtttcgggtttcgcgtatttaatttcgttattttcggttcgcgtttttaggcggtcgtgatttagcggttaggtagtttcggtttcgcgtttcggttttcgttttcgtcgcggttcgggtttcgttgttttatcgttttttatttggcgtcgcgcggagggcgcgggcgcgcggcggtttttcgcgggtacgcgttgttttcgcgtcggcgtttattgtcgcgtttttttcggtcgtcgtcgtcgtttggcgttcgggtttcgatttcgcgaagaataataagtgttttcgcgtcgttcgtcgttatcgtattcgttcgttcggttttttagtatttgatatcgttttcgggattcgcggcgcgcgcgttatatcgttttgtttttcgggttacgtttttttttcgtttcgcg

SEQ ID NO: 30220 - DNA, 890 bp, Artificial Sequence
  chemically treated genomic DNA (Homo sapiens) CpG-island No: 30220
cgcgaaacgaaaaaaaaacgtaacccgaaaaacaaaacgatataacgcgcgcgccgcgaatcccgaaaacgatatcaaatactaaaaaaccgaacgaacgaatacgataacgacgaacgacgcgaaaacacttattattcttcgcgaaatcgaaacccgaacgccaaacgacgacgacgaccgaaaaaaacgcgacaataaacgccgacgcgaaaacaacgcgtacccgcgaaaaaccgccgcgcgcccgcgccctccgcgcgacgccaaataaaaaacgataaaacaacgaaacccgaaccgcgacgaaaacgaaaaccgaaacgcgaaaccgaaactacctaaccgctaaatcacgaccgcctaaaaacgcgaaccgaaaataacgaaattaaatacgcgaaacccgaaaccctcatacgacccgcgacgcgacccgaacacctacccaaataaaccccgccccgcaaacccgaaaacttccccgaaacgcgaaactctctcccctacacgtaccgcccgaaccatacttaccgcgccgaaaaccccaaaacgcgaaccccaaacctaaaaaaacgaaaatccacgcgaatcgacgacgcgcatcgaacccgcgccttcacacctacgaaaaacgaaacgaaacgaacgccacgtacgaacgatacgaaaaaaacgcgaacgcgtaaattctccgcgacttccgccccaacgtaacttccgcgtacgaccccgaactaccccccgcgcttcctcccgataacgaacgacgctctaacccaataactaaaatcacgcgtacccgaaaacgaaataaaaataaccgaatctccccacaaacgaaatcctaaaactaatatcgctctcaaccgcccacctaccaaaattac

SEQ ID NO: 30221 - DNA, 555 bp, Artificial Sequence
  chemically treated genomic DNA (Homo sapiens) CpG-island No: 30221
gagaacgtttcggtgtttagcgatgatgagttggtgtttatgtcggtgcgggagttgaattagtatttgcggggttttattaaggaggaggtgattcgtttgaagtagcgtcggcgtatatttaagaatcgcggttacgcggttagttgtcgtattaagcgggtgacgtagaaggaggagttggagcggtagcgcgtggagttgtagtaggaggtggagaagttggcgcgtgagaatagtagtatgcggttggagttggacgttttgcgttttaagtacgaggcgttgtagattttcgcgcgtatcgtggttcggggatttgtggcgttttttaaggtggttattattagcgttattattatcgttaagtttatcgagtttttttttattttcgtgtttttttcggttgtattttagtgtcggtcgggggcggggggtggcgggcggcgggcggcgggtaggcgggtgggggtatatttttcgtatttgttattgggatgtagattttcgatattcgagtttaagcgtaggtttttcgggcgtaggtagtttata

SEQ ID NO: 30222 - DNA, 555 bp, Artificial Sequence
  chemically treated genomic DNA (Homo sapiens) CpG-island No: 30222
tataaactacctacgcccgaaaaacctacgcttaaactcgaatatcgaaaatctacatcccaataacaaatacgaaaaatatacccccacccgcctacccgccgcccgccgcccgccaccccccgcccccgaccgacactaaaatacaaccgaaaaaaacacgaaaataaaaaaaaactcgataaacttaacgataataataacgctaataataaccaccttaaaaaacgccacaaatccccgaaccacgatacgcgcgaaaatctacaacgcctcgtacttaaaacgcaaaacgtccaactccaaccgcatactactattctcacgcgccaacttctccacctcctactacaactccacgcgctaccgctccaactcctccttctacgtcacccgcttaatacgacaactaaccgcgtaaccgcgattcttaaatatacgccgacgctacttcaaacgaatcacctcctccttaataaaaccccgcaaatactaattcaactcccgcaccgacataaacaccaactcatcatcgctaaacaccgaaacgttctc

SEQ ID NO: 30223 - DNA, 555 bp, Artificial Sequence
  chemically treated genomic DNA (Homo sapiens) CpG-island No: 30223
tgtgagttgtttgcgttcgaggggtttgcgtttggattcggatgtcgagagtttgtattttagtgataggtacgaggggtgtgtttttattcgtttgttcgtcgttcgtcgttcgttatttttcgttttcggtcggtattaggatgtagtcgagaagggtacggaggtggaggagagttcggtggatttgacgatggtgatgacgttggtggtggttattttggagggcgttataggttttcgggttacggtgcgcgcgaaggtttgtagcgtttcgtatttggagcgtagggcgtttagttttagtcgtatgttgttgtttttacgcgttagtttttttattttttgttgtagttttacgcgttgtcgttttagtttttttttttgcgttattcgtttgatgcggtagttggtcgcgtagtcgcggtttttgagtgtgcgtcgacgttgttttaggcgggttattttttttttggtgagatttcgtaggtgttggtttagttttcgtatcgatatggatattagtttattatcgttgagtatcggggcgttttt

SEQ ID NO: 30224 - DNA, 555 bp, Artificial Sequence
  chemically treated genomic DNA (Homo sapiens) CpG-island No: 30224
aaaaacgccccgatactcaacgataataaactaatatccatatcgatacgaaaactaaaccaacacctacgaaatctcaccaaaaaaaaaataacccgcctaaaacaacgtcgacgcacactcaaaaaccgcgactacgcgaccaactaccgcatcaaacgaataacgcaaaaaaaaaaactaaaacgacaacgcgtaaaactacaacaaaaaataaaaaaactaacgcgtaaaaacaacaacatacgactaaaactaaacgccctacgctccaaatacgaaacgctacaaaccttcgcgcgcaccgtaacccgaaaacctataacgccctccaaaataaccaccaccaacgtcatcaccatcgtcaaatccaccgaactctcctccacctccgtacccttctcgactacatcctaataccgaccgaaaacgaaaaataacgaacgacgaacgacgaacaaacgaataaaaacacacccctcgtacctatcactaaaatacaaactctcgacatccgaatccaaacgcaaacccctcgaacgcaaacaactcaca

SEQ ID NO: 30225 - DNA, 576 bp, Artificial Sequence
  chemically treated genomic DNA (Homo sapiens) CpG-island No: 30225
ttgttaggtcgggtagtggtttttcgtttttcggtttcgtcgtcgtttcggttttgtagtcgcggttcgggatttttacgatacgcggtgtcgaggtcggtcgggttattggggacgtagtcgttcggggaagttcgcgggtattcgcgtttattaagtcggcgtcgcgttcggaagtggttttgcgtgcgttacgcgggttcgtttcgttcgcgggtttcgtttatttttcggaagttagggtcgcggcgtttttggtttcggagatttggggttttcgggtttttgagcggttcgggtttcgcgttgtcggtagggtttgggggcgttttagagtcgaatttcgtttttttaggaaagggcgttgcgattattttcgtttcgggttttagtttttttgttgtagattttcgggatcgtcgttggtaggagttttgtttttcgtgtttgtgtttaggattttcgaagcgtcgcgtttaggaattttttagcgttgggagttcggttttgttcgattacgggttttgggttggaggcgttatcgtcgttatagcgaacgtttatttggtatcgagt

SEQ ID NO: 30226 - DNA, 576 bp, Artificial Sequence
  chemically treated genomic DNA (Homo sapiens) CpG-island No: 30226
actcgataccaaataaacgttcgctataacgacgataacgcctccaacccaaaacccgtaatcgaacaaaaccgaactcccaacgctaaaaaattcctaaacgcgacgcttcgaaaatcctaaacacaaacacgaaaaacaaaactcctaccaacgacgatcccgaaaatctacaacaaaaaaactaaaacccgaaacgaaaataatcgcaacgccctttcctaaaaaaacgaaattcgactctaaaacgcccccaaaccctaccgacaacgcgaaacccgaaccgctcaaaaacccgaaaaccccaaatctccgaaaccaaaaacgccgcgaccctaacttccgaaaaataaacgaaacccgcgaacgaaacgaacccgcgtaacgcacgcaaaaccacttccgaacgcgacgccgacttaataaacgcgaatacccgcgaacttccccgaacgactacgtccccaataacccgaccgacctcgacaccgcgtatcgtaaaaatcccgaaccgcgactacaaaaccgaaacgacgacgaaaccgaaaaacgaaaaaccactacccgacctaacaa

SEQ ID NO: 30227 - DNA, 576 bp, Artificial Sequence
  chemically treated genomic DNA (Homo sapiens) CpG-island No: 30227
attcggtgttaaataagcgttcgttgtggcgacgatgacgtttttagtttaaagttcgtggtcgagtagggtcgggtttttagcgttagggggtttttaggcgcggcgtttcgggggttttggatatagatacgggggatagagtttttattagcgacgatttcgagggtttgtagtagaggggttgaggttcgggacgggggtggtcgtagcgtttttttttgaaaaaacggggttcggttttaaggcgtttttaagttttgtcggtagcgcggaattcgagtcgtttagaagttcgggagttttaagttttcgggattagaagcgtcgcggttttgattttcggaaggtggacggaattcgcggacggggcgggttcgcgtggcgtacgtagagttattttcgggcgcggcgtcggtttggtgagcgcgggtattcgcgggttttttcgggcggttgcgtttttagtagttcggtcggtttcggtatcgcgtgtcgtgggggtttcgggtcgcggttgtagggtcggggcggcggcgaggtcgaggggcgggaagttattgttcggtttggtag

SEQ ID NO: 30228 - DNA, 576 bp, Artificial Sequence
  chemically treated genomic DNA (Homo sapiens) CpG-island No: 30228
ctaccaaaccgaacaataacttcccgcccctcgacctcgccgccgccccgaccctacaaccgcgacccgaaacccccacgacacgcgataccgaaaccgaccgaactactaaaaacgcaaccgcccgaaaaaacccgcgaatacccgcgctcaccaaaccgacgccgcgcccgaaaataactctacgtacgccacgcgaacccgccccgtccgcgaattccgtccaccttccgaaaatcaaaaccgcgacgcttctaatcccgaaaacttaaaactcccgaacttctaaacgactcgaattccgcgctaccgacaaaacttaaaaacgccttaaaaccgaaccccgttttttcaaaaaaaaacgctacgaccacccccgtcccgaacctcaacccctctactacaaaccctcgaaatcgtcgctaataaaaactctatcccccgtatctatatccaaaacccccgaaacgccgcgcctaaaaaccccctaacgctaaaaacccgaccctactcgaccacgaactttaaactaaaaacgtcatcgtcgccacaacgaacgcttatttaacaccgaat

SEQ ID NO: 30229 - DNA, 901 bp, Artificial Sequence
  chemically treated genomic DNA (Homo sapiens) CpG-island No: 30229
gtcgcggcgttgggtcggcgtatcgtggtgggtttggttcggtttattttgtttcgtttttcgcggttttcggcggttgcggcgttatttgcggaggagttagcgtgcggttatttttttatttattcgttcgttcgttcgtttattcgtttttttgtcgtacggggtttgggtttgggattcggggatagtggtttcgcgttcgttcggcggggcgatgttgtaggagttgtagggatttcgttttttagtcgttcgggagcggtttagtcgggcggtagtaggcgacgcggacgtcgggttggaggcggtagaattagaagggacggtttagaggtcgggagcggtagtcgggagaattaggcgttcgttcggtaatgaggaagcgtttaggtcgcggtttatttatttttggtttatcgcgatcggagcgtcgtcgtcgttattcggttatttcggaatcggaaatcgattttatcgttttcgaggattcgattttcggaataatcggaaggaaaatagtgcggcgggaagcgggtttagaaggaggcgcgagaggttcgcggcgtcggtttgatgtttgtagcgttttatggcggcgggaggcgggttggtcggcgtcgcgcgtatgtggttcggtttaggtgggtcggcggcgcggggtaggcgttggtttttttatttataggtggtgttggcgttgcgaagggacgtattttaggacgtacggcggggaggagtggcgttagggattcgcggatgagttaagtggtaggttttgtacgtttcggagagcgggggcggtcggggcgtaggtattggcgagggggcgtagttcggggggttttcggggagagattttgttttaaataataataataataataataatagttttatt

SEQ ID NO: 30230 - DNA, 901 bp, Artificial Sequence
  chemically treated genomic DNA (Homo sapiens) CpG-island No: 30230
aataaaactattattattattattattattatttaaaacaaaatctctccccgaaaaccccccgaactacgccccctcgccaatacctacgccccgaccgcccccgctctccgaaacgtacaaaacctaccacttaactcatccgcgaatccctaacgccactcctccccgccgtacgtcctaaaatacgtcccttcgcaacgccaacaccacctataaataaaaaaaccaacgcctaccccgcgccgccgacccacctaaaccgaaccacatacgcgcgacgccgaccaacccgcctcccgccgccataaaacgctacaaacatcaaaccgacgccgcgaacctctcgcgcctccttctaaacccgcttcccgccgcactattttccttccgattattccgaaaatcgaatcctcgaaaacgataaaatcgatttccgattccgaaataaccgaataacgacgacgacgctccgatcgcgataaaccaaaaataaataaaccgcgacctaaacgcttcctcattaccgaacgaacgcctaattctcccgactaccgctcccgacctctaaaccgtcccttctaattctaccgcctccaacccgacgtccgcgtcgcctactaccgcccgactaaaccgctcccgaacgactaaaaaacgaaatccctacaactcctacaacatcgccccgccgaacgaacgcgaaaccactatccccgaatcccaaacccaaaccccgtacgacaaaaaaacgaataaacgaacgaacgaacgaataaataaaaaaataaccgcacgctaactcctccgcaaataacgccgcaaccgccgaaaaccgcgaaaaacgaaacaaaataaaccgaaccaaacccaccacgatacgccgacccaacgccgcgac

SEQ ID NO: 30231 - DNA, 901 bp, Artificial Sequence
  chemically treated genomic DNA (Homo sapiens) CpG-island No: 30231
aataaagttattattattattattattattatttgagatagggttttttttcgggagtttttcgggttgcgttttttcgttagtgtttgcgtttcggtcgttttcgtttttcgggacgtgtagaatttgttatttgatttattcgcggatttttgacgttattttttttcgtcgtgcgttttggagtgcgttttttcgtaacgttagtattatttgtgaatggagaggttagcgtttgtttcgcgtcgtcgatttatttggatcggattatatgcgcgcggcgtcggttagttcgtttttcgtcgttatggggcgttgtaggtattaggtcggcgtcgcgggtttttcgcgtttttttttgggttcgtttttcgtcgtattgtttttttttcggttgtttcggaagtcgggttttcgagggcggtgagatcggttttcgatttcggggtggtcgggtggcggcggcggcgtttcggtcgcgatgggttagaggtaagtgagtcgcggtttgggcgtttttttattgtcgggcgagcgtttggttttttcggttatcgttttcggtttttgggtcgttttttttggttttgtcgtttttagttcggcgttcgcgtcgtttgttgtcgttcgattgagtcgttttcgggcggttgggaggcggggtttttgtagtttttgtagtatcgtttcgtcgggcgggcgcgggattattgttttcgggttttaggtttaagtttcgtgcggtaagggagcgaatgagcgagcgaacgagcgaatgagtgaaggaatgatcgtacgttggttttttcgtaggtgacgtcgtagtcgtcgggagtcgcgagggacggggtaggatgaatcgggttaagtttattacggtgcgtcggtttagcgtcgcggt

SEQ ID NO: 30232 - DNA, 901 bp, Artificial Sequence
  chemically treated genomic DNA (Homo sapiens) CpG-island No: 30232
accgcgacgctaaaccgacgcaccgtaataaacttaacccgattcatcctaccccgtccctcgcgactcccgacgactacgacgtcacctacgaaaaaaccaacgtacgatcattccttcactcattcgctcgttcgctcgctcattcgctcccttaccgcacgaaacttaaacctaaaacccgaaaacaataatcccgcgcccgcccgacgaaacgatactacaaaaactacaaaaaccccgcctcccaaccgcccgaaaacgactcaatcgaacgacaacaaacgacgcgaacgccgaactaaaaacgacaaaaccaaaaaaaacgacccaaaaaccgaaaacgataaccgaaaaaaccaaacgctcgcccgacaataaaaaaacgcccaaaccgcgactcacttacctctaacccatcgcgaccgaaacgccgccgccgccacccgaccaccccgaaatcgaaaaccgatctcaccgccctcgaaaacccgacttccgaaacaaccgaaaaaaaaacaatacgacgaaaaacgaacccaaaaaaaaacgcgaaaaacccgcgacgccgacctaatacctacaacgccccataacgacgaaaaacgaactaaccgacgccgcgcgcatataatccgatccaaataaatcgacgacgcgaaacaaacgctaacctctccattcacaaataatactaacgttacgaaaaaacgcactccaaaacgcacgacgaaaaaaaataacgtcaaaaatccgcgaataaatcaaataacaaattctacacgtcccgaaaaacgaaaacgaccgaaacgcaaacactaacgaaaaaacgcaacccgaaaaactcccgaaaaaaaaccctatctcaaataataataataataataataataactttatt

SEQ ID NO: 30233 - DNA, 673 bp, Artificial Sequence
  chemically treated genomic DNA (Homo sapiens) CpG-island No: 30233
ttggatttcgtttgtaggttgattttcgagttatacgttagagtacggcgatttttaaggtcgtagttcggtttcgtaaggtatttttttttaacgcgtcggtcgaattcgcgcgttcgcgagtagtcggattatattttttaggaagttgtgcgtcgtttagttgttttgtttttggtcgcgaaggattatattattcggtgatattttgcgggaggcggttgttagattttaagcgtataattattggtttagcgtttggcggggagttgtacggtgattggtttaggagttcgttagtttcgttcgagtttagtagagttttgttgttaagattgcgcgaggagttagagagagcggagagcgttgagtcgggtcgtattcgtcgagtcgtgtgagtaatttttattttcgtttttttcgtcgttttttcggggattagtattttcgttttttagggtggtcgggagggagtatacgtattcgggcgtttacgagagggcggggattgtgtatatacgtgttatattagattagagaagtatttttagggatatcggcggtcgagtttcgcgtacgtttttgagtatttgagttttagggcgttttttcggatttaaggagaaaaaatatatttcgaggtatacgtggatatttaggtatttatacgggg

SEQ ID NO: 30234 - DNA, 673 bp, Artificial Sequence
  chemically treated genomic DNA (Homo sapiens) CpG-island No: 30234
ccccgtataaatacctaaatatccacgtatacctcgaaatatattttttctccttaaatccgaaaaaacgccctaaaactcaaatactcaaaaacgtacgcgaaactcgaccgccgatatccctaaaaatacttctctaatctaatataacacgtatatacacaatccccgccctctcgtaaacgcccgaatacgtatactccctcccgaccaccctaaaaaacgaaaatactaatccccgaaaaaacgacgaaaaaaacgaaaataaaaattactcacacgactcgacgaatacgacccgactcaacgctctccgctctctctaactcctcgcgcaatcttaacaacaaaactctactaaactcgaacgaaactaacgaactcctaaaccaatcaccgtacaactccccgccaaacgctaaaccaataattatacgcttaaaatctaacaaccgcctcccgcaaaatatcaccgaataatataatccttcgcgaccaaaaacaaaacaactaaacgacgcacaacttcctaaaaaatataatccgactactcgcgaacgcgcgaattcgaccgacgcgttaaaaaaaaataccttacgaaaccgaactacgaccttaaaaatcgccgtactctaacgtataactcgaaaatcaacctacaaacgaaatccaa

SEQ ID NO: 30235 - DNA, 673 bp, Artificial Sequence
  chemically treated genomic DNA (Homo sapiens) CpG-island No: 30235
tttcgtgtgggtatttaggtgtttacgtgtgtttcggggtgtgttttttttttttgagttcgaggggacgttttggagtttaggtgtttaagggcgtgcgcggggttcggtcgtcggtgtttttggagatgtttttttggtttggtgtgatacgtgtgtatatagttttcgttttttcgtgagcgttcgggtgcgtgtgttttttttcgattattttgaggagcgagggtgttggttttcgagagggcggcgagaaggacggaggtagaggttatttatacggttcggcgggtgcggttcggtttagcgtttttcgttttttttagtttttcgcgtagttttaatagtaaaattttattgagttcggacgaaattggcgggtttttgggttaattatcgtgtagtttttcgttagacgttggattaatggttgtgcgtttgaggtttggtaatcgtttttcgtaagatattatcgggtaatgtagtttttcgcgattaagggtaggatagttggacggcgtatagttttttgggagatgtagttcggttgttcgcgggcgcgcgagttcgatcgacgcgttagaaggaggtgttttgcgaagtcgggttgcgattttaggggtcgtcgtgttttggcgtgtgattcgaaagttagtttgtaggcggggtttaa

SEQ ID NO: 30236 - DNA, 673 bp, Artificial Sequence
  chemically treated genomic DNA (Homo sapiens) CpG-island No: 30236
ttaaaccccgcctacaaactaactttcgaatcacacgccaaaacacgacgacccctaaaatcgcaacccgacttcgcaaaacacctccttctaacgcgtcgatcgaactcgcgcgcccgcgaacaaccgaactacatctcccaaaaaactatacgccgtccaactatcctacccttaatcgcgaaaaactacattacccgataatatcttacgaaaaacgattaccaaacctcaaacgcacaaccattaatccaacgtctaacgaaaaactacacgataattaacccaaaaacccgccaatttcgtccgaactcaataaaattttactattaaaactacgcgaaaaactaaaaaaaacgaaaaacgctaaaccgaaccgcacccgccgaaccgtataaataacctctacctccgtccttctcgccgccctctcgaaaaccaacaccctcgctcctcaaaataatcgaaaaaaaacacacgcacccgaacgctcacgaaaaaacgaaaactatatacacacgtatcacaccaaaccaaaaaaacatctccaaaaacaccgacgaccgaaccccgcgcacgcccttaaacacctaaactccaaaacgtcccctcgaactcaaaaaaaaaaaacacaccccgaaacacacgtaaacacctaaatacccacacgaaa

SEQ ID NO: 30237 - DNA, 1101 bp, Artificial Sequence
  chemically treated genomic DNA (Homo sapiens) CpG-island No: 30237
ttattgttcggcgcgttcgaggcgaagtttttttcgttagggataggcgtgggggtcgtagtcggggttattcgggtgtagcggggcggtttttgcgcgggcgcggaacgaacgtgcgtaagggaatagtcgcgtttagagtcgttcgtagcgggttcggtgggcgtgacgttatgacgtatagtacgcgggcggcgcgttggggcggggcggtcgggggcgggaggaagaagtgggaggaggaggaggggaaagcgggggttgcgggagggggaggtggtagttgcggcgttggttttcgggagtagtcgtcgagttataattgcggaggaggagttcgggaaagcggtcgtcgggatttttttttttcgtcgttttcgtttcggttgagaggcgtttcggcgtatcggagggattttttttcgcgtttttttaggttgttgtcgtcgttgttgggagatgggtttattcgttcgttattttgcgttgtcgtcgttttgaggagttaaaggtacgggcgggtattcggaggagtttgcgtttcggagcgggagagaagggggcggttttcgtttacgatttagggagttttggtcgggtcgtagttttagcgtttttgttcgggatagaaatggattcggaagttcggtgggaaaggcgttttttttagtgtttagcgtgggttcggggtcgtggtcggtttagggggttaggtttcggttagtttcgggttttttattcggtttaggcgcgggcgtttttcgggtcgcgggggtcgaggtggagcgtgggattcgttttaagttttgtttttttggtgtttgtgcggtcggcggtcggttcggcgatattatgacgggtcgaggcggcgtttttttcgagttgttttttgtttttaaagcgggggagatttaagggcggttgtcgcggggaggcggcgggggcggaacgtatttttgacgggtgaaatcggttttaacgggatcgattttcgggtttcgttgtaaatttggagtcgggatatcgtttcgtaagtcgtgttgtttggggttttagggaggggagttgtgttcggaggaaggttagttcgggattgttatt

SEQ ID NO: 30238 - DNA, 1101 bp, Artificial Sequence
  chemically treated genomic DNA (Homo sapiens) CpG-island No: 30238
aataacaatcccgaactaaccttcctccgaacacaactcccctccctaaaaccccaaacaacacgacttacgaaacgatatcccgactccaaatttacaacgaaacccgaaaatcgatcccgttaaaaccgatttcacccgtcaaaaatacgttccgcccccgccgcctccccgcgacaaccgcccttaaatctcccccgctttaaaaacaaaaaacaactcgaaaaaaacgccgcctcgacccgtcataatatcgccgaaccgaccgccgaccgcacaaacaccaaaaaaacaaaacttaaaacgaatcccacgctccacctcgacccccgcgacccgaaaaacgcccgcgcctaaaccgaataaaaaacccgaaactaaccgaaacctaaccccctaaaccgaccacgaccccgaacccacgctaaacactaaaaaaaacgcctttcccaccgaacttccgaatccatttctatcccgaacaaaaacgctaaaactacgacccgaccaaaactccctaaatcgtaaacgaaaaccgcccccttctctcccgctccgaaacgcaaactcctccgaatacccgcccgtacctttaactcctcaaaacgacgacaacgcaaaataacgaacgaataaacccatctcccaacaacgacgacaacaacctaaaaaaacgcgaaaaaaaatccctccgatacgccgaaacgcctctcaaccgaaacgaaaacgacgaaaaaaaaaaatcccgacgaccgctttcccgaactcctcctccgcaattataactcgacgactactcccgaaaaccaacgccgcaactaccacctccccctcccgcaacccccgctttcccctcctcctcctcccacttcttcctcccgcccccgaccgccccgccccaacgcgccgcccgcgtactatacgtcataacgtcacgcccaccgaacccgctacgaacgactctaaacgcgactattcccttacgcacgttcgttccgcgcccgcgcaaaaaccgccccgctacacccgaataaccccgactacgacccccacgcctatccctaacgaaaaaaacttcgcctcgaacgcgccgaacaataa

SEQ ID NO: 30239 - DNA, 1101 bp, Artificial Sequence
  chemically treated genomic DNA (Homo sapiens) CpG-island No: 30239
ggtagtagtttcggattaattttttttcgaatatagtttttttttttaaggttttaggtagtacggtttgcggggcgatgtttcggttttaaatttgtagcgaggttcggaaatcggtttcgttagagtcgattttattcgttaggaatgcgtttcgttttcgtcgttttttcgcggtaatcgtttttgggtttttttcgttttaggggtaggagatagttcgaggggagcgtcgtttcggttcgttataatatcgtcgggtcggtcgtcggtcgtataggtattaggaggatagggtttggggcggattttacgttttatttcggttttcgcggttcgggagacgttcgcgtttgggtcgggtaggggattcggagttgatcgaggtttgattttttaagtcggttacggtttcgagtttacgttggatattggaggagacgttttttttatcggattttcgaatttatttttgtttcgggtaggggcgttagggttgcggttcggttagagttttttgggtcgtaagcgagagtcgtttttttttttttcgtttcggggcgtaagttttttcgggtgttcgttcgtatttttaattttttagagcggcggtagcgtagggtggcgggcgagtaggtttattttttagtagcggcgatagtagtttgaggaagcgcgggggagggttttttcgatgcgtcgaggcgttttttaatcggggcggagacgacggaggggaggagtttcgacggtcgttttttcgaatttttttttcgtagttgtggttcgacggttgttttcgggaattagcgtcgtaattattatttttttttttcgtagttttcgtttttttttttttttttttttatttttttttttcgttttcggtcgtttcgttttagcgcgtcgttcgcgtgttgtgcgttatggcgttacgtttatcgggttcgttgcgggcggttttggacgcggttgtttttttgcgtacgttcgtttcgcgttcgcgtaggagtcgtttcgttgtattcgggtggtttcgattgcggtttttacgtttgtttttggcggaggggatttcgtttcgagcgcgtcgggtagtgg

SEQ ID NO: 30240 - DNA, 1101 bp, Artificial Sequence
  chemically treated genomic DNA (Homo sapiens) CpG-island No: 30240
ccactacccgacgcgctcgaaacgaaatcccctccgccaaaaacaaacgtaaaaaccgcaatcgaaaccacccgaatacaacgaaacgactcctacgcgaacgcgaaacgaacgtacgcaaaaaaacaaccgcgtccaaaaccgcccgcaacgaacccgataaacgtaacgccataacgcacaacacgcgaacgacgcgctaaaacgaaacgaccgaaaacgaaaaaaaaaaataaaaaaaaaaaaaaaaaaaaacgaaaactacgaaaaaaaaaaataataattacgacgctaattcccgaaaacaaccgtcgaaccacaactacgaaaaaaaaattcgaaaaaacgaccgtcgaaactcctcccctccgtcgtctccgccccgattaaaaaacgcctcgacgcatcgaaaaaaccctcccccgcgcttcctcaaactactatcgccgctactaaaaaataaacctactcgcccgccaccctacgctaccgccgctctaaaaaattaaaaatacgaacgaacacccgaaaaaacttacgccccgaaacgaaaaaaaaaaaaacgactctcgcttacgacccaaaaaactctaaccgaaccgcaaccctaacgcccctacccgaaacaaaaataaattcgaaaatccgataaaaaaaacgtctcctccaatatccaacgtaaactcgaaaccgtaaccgacttaaaaaatcaaacctcgatcaactccgaatcccctacccgacccaaacgcgaacgtctcccgaaccgcgaaaaccgaaataaaacgtaaaatccgccccaaaccctatcctcctaatacctatacgaccgacgaccgacccgacgatattataacgaaccgaaacgacgctcccctcgaactatctcctacccctaaaacgaaaaaaacccaaaaacgattaccgcgaaaaaacgacgaaaacgaaacgcattcctaacgaataaaatcgactctaacgaaaccgatttccgaacctcgctacaaatttaaaaccgaaacatcgccccgcaaaccgtactacctaaaaccttaaaaaaaaaaactatattcgaaaaaaaattaatccgaaactactacc

SEQ ID NO: 30241 - DNA, 3115 bp, Artificial Sequence
  chemically treated genomic DNA (Homo sapiens) CpG-island No: 30241
aagaaattcgtcgatatagtattcgggtgtttaagttttcgagaattaggttgcgcgggtattacggggttagaaagttcgggttaggacgggtttaggagcgagtatcgtcgggaataagcgtcgggaataagtcgggagaaagaggaagcgtcggcgttaaaggtttttcgttcgtcgcggtttttttaggattttttttgcgttcgtaagtgttacgtcgtttataggattgcgttagtcggtcggcgttttaatagagttcgtttgggagtagcgttcgtcgggagttatgacgtttgagttatcgaggtcgtcgtcgggttaggtcgaggtcgtcgttttaatagagcgcgttagggagtagcgttcgtcggtagttatgacgtttgagttatcgaggtcgtcgtcgggttaggtagaggtcgtcgttttaatagagcgcgttagggagtagcgttcgtcggtagttatgacgtttgagttatcgaggtcgtcgtcgggttaggtagaggtcgtcgttttaatagagcgcgttagggagtagcgtttatcgggagttatgacgtttgagttatttaggtcgtcgtcgggtcgggttaaggtcgtcgttttaatagagcgcgttagggagtagcgttcgtcgggagttatgacgtttgagttatggaggtcgtcgtcgggtcgggtcgaggtcgtcgttttaatagagcgcgttagggagtagcgttcgtcgggagttatgacgtttgagttatcgaggtcgtcgtcgggtcgggtcgaggtcgtcgttttaatagagcgcgttagggagtagcgttcgtcgggagttatgacgtttgagttatcgaggtcgtcgtcgggtcgggtagaggtcgtcgttttaatagagcgcgttagggagtagcgttcgtcgggagttatgacgtttgagttatcgaggtcgtcgcggggtcgggtcgaggtcgtcgttttaatagagtacgttagggagtagcgtcggtcgggagttatgacgtttgagttatcgaggtcgtcgtcgggtcgggtcgaggtcgtcgttttaatagagcgcgttagggagtagcgttcgttaggagttatgatgtttgagttatcgaggtagtcgtcgggttaggtcgaggtcgtcgtcgttcggttaggtcgaggtcgttgttttaatagagcgcgttagggagtagcgttcgtcgggagttatgatgtttgagttatcgaggtcgtcgtcgggttaggtcgaggtcgtcgtcgttcggttaggtcgaggtcgttgttttaatagagcgcgttagggagtagcgttcgtcgggagttatgacgtttgagttatcgaggtcgtcgtcgggtcgggtcgaggtcgtcgttttaatagagcgcgttagggagtagcgttcgtcgggagttatgacgtttgagttatcgaggtcgtcgcggggtcgggtcgaggtcgtcgttttaatagagtacgttagggagtagcgtcggtcgggagttatgacgtttgagttatcgaggtcgtcgtcgggtcgggtcgaggtcgtcgttttaatagagcgcgttagggagtagcgttcgtcgggagttatgatgtttgagttatcgaggtcgtcgtcgggttaggtcgaggtcgtcgtcgttcggttaggtcgaggtcgttgttttaatagagcgcgttagggagtagcgttcgtcgggaattatgatgtttgagttatcgaggtcgtcgtcgggttaggtcgaggtcgtcgtcgttcggttaggtcgaggtcgttgttttaatagagcgcgttagggagtagcgttcgtcgggagttatgacgtttgagttatcgcggtcgtcgtcgggtcgggtcgaggtcgtcgttttaatagagcgcgttagggagtagcgttcgtcgggagttatgatgtttgagttatcgaggtcgttttcgggttaggtcgaggtcgtcgtcgttcggttaggtcgaggtcgttgttttaatagagcgcgttagggagtagcgtcggtcgggaggtatgacgtttgagttatcgaggtcgtcgtcgggtcgggtcgaggtcgtcgttttaatagagcgcgttagggagtagcgttcgttaggagttatgacgtttgagttatcgaggtcgtcgtcgggttaggtttaggtcgtcgtcgtttagttaggtcgaggtcgtcgttttaatagagcgtgttagggagtagcgttcgtcgggagttatgacgtttgagttatcgaggtcgtcgtcgggttaggtcgaggtcgtcgttttaatagagcgcgttagggagtagcgttcgtcgggagttatgacgtttgagttatcgaggtcgttatcgggtcgggtcgaggttttcgttttaatagagcgcgttagggagtagcgttcgtcgggagttatgacgtttgagttatcgcggtcgcggtcgggtcgggtcgaggtcgtcgttttaatagagcgcgttagggagtagcgttcgtcgggaggtatgacgtttgagttatcgaggtcgtcgtcgggtcgggtcgaggtcgtcgttttaatagagcgcgttagggagtagcgttcgtcgggagttatgacgtttgagttatcgaggtcgtcgtcgggtcgggtcgaggtcgtcgttttaatagagcgcgttagggagtagcgtcggtcgggagttatgacgtttgagttatcgaggtcgtcgtcgggttaggtcgaggttttcgtcgttcggttaggtcgaggtcgtcggttttttcgagatttatttatttttcgaggcgacggggcggagttttgtacggaggcgacgtatcgtttttcgtaggttttgttgtaatttatcgcgttattaatttggttttcgagacgcgtgaaattagcgtttagtttcgtagtagtcgttaattttaataggaaagcgtttgaaagttattgatttcgcgtagtcggcggaggattattgtgacgaatttgtgttttgcgttaatagtgtgtggaacgttggcgatttcggcgttcgagttgtatttcgttgggtttttggtagtattttgtgttttgagggtgttttgttcgtcgggcgtcgtggtttacgttt

SEQ ID NO: 30242 - DNA, 3115 bp, Artificial Sequence
  chemically treated genomic DNA (Homo sapiens) CpG-island No: 30242
aaacgtaaaccacgacgcccgacgaacaaaacaccctcaaaacacaaaatactaccaaaaacccaacgaaatacaactcgaacgccgaaatcgccaacgttccacacactattaacgcaaaacacaaattcgtcacaataatcctccgccgactacgcgaaatcaataactttcaaacgctttcctattaaaattaacgactactacgaaactaaacgctaatttcacgcgtctcgaaaaccaaattaataacgcgataaattacaacaaaacctacgaaaaacgatacgtcgcctccgtacaaaactccgccccgtcgcctcgaaaaataaataaatctcgaaaaaaccgacgacctcgacctaaccgaacgacgaaaacctcgacctaacccgacgacgacctcgataactcaaacgtcataactcccgaccgacgctactccctaacgcgctctattaaaacgacgacctcgacccgacccgacgacgacctcgataactcaaacgtcataactcccgacgaacgctactccctaacgcgctctattaaaacgacgacctcgacccgacccgacgacgacctcgataactcaaacgtcatacctcccgacgaacgctactccctaacgcgctctattaaaacgacgacctcgacccgacccgaccgcgaccgcgataactcaaacgtcataactcccgacgaacgctactccctaacgcgctctattaaaacgaaaacctcgacccgacccgataacgacctcgataactcaaacgtcataactcccgacgaacgctactccctaacgcgctctattaaaacgacgacctcgacctaacccgacgacgacctcgataactcaaacgtcataactcccgacgaacgctactccctaacacgctctattaaaacgacgacctcgacctaactaaacgacgacgacctaaacctaacccgacgacgacctcgataactcaaacgtcataactcctaacgaacgctactccctaacgcgctctattaaaacgacgacctcgacccgacccgacgacgacctcgataactcaaacgtcatacctcccgaccgacgctactccctaacgcgctctattaaaacaacgacctcgacctaaccgaacgacgacgacctcgacctaacccgaaaacgacctcgataactcaaacatcataactcccgacgaacgctactccctaacgcgctctattaaaacgacgacctcgacccgacccgacgacgaccgcgataactcaaacgtcataactcccgacgaacgctactccctaacgcgctctattaaaacaacgacctcgacctaaccgaacgacgacgacctcgacctaacccgacgacgacctcgataactcaaacatcataattcccgacgaacgctactccctaacgcgctctattaaaacaacgacctcgacctaaccgaacgacgacgacctcgacctaacccgacgacgacctcgataactcaaacatcataactcccgacgaacgctactccctaacgcgctctattaaaacgacgacctcgacccgacccgacgacgacctcgataactcaaacgtcataactcccgaccgacgctactccctaacgtactctattaaaacgacgacctcgacccgaccccgcgacgacctcgataactcaaacgtcataactcccgacgaacgctactccctaacgcgctctattaaaacgacgacctcgacccgacccgacgacgacctcgataactcaaacgtcataactcccgacgaacgctactccctaacgcgctctattaaaacaacgacctcgacctaaccgaacgacgacgacctcgacctaacccgacgacgacctcgataactcaaacatcataactcccgacgaacgctactccctaacgcgctctattaaaacaacgacctcgacctaaccgaacgacgacgacctcgacctaacccgacgactacctcgataactcaaacatcataactcctaacgaacgctactccctaacgcgctctattaaaacgacgacctcgacccgacccgacgacgacctcgataactcaaacgtcataactcccgaccgacgctactccctaacgtactctattaaaacgacgacctcgacccgaccccgcgacgacctcgataactcaaacgtcataactcccgacgaacgctactccctaacgcgctctattaaaacgacgacctctacccgacccgacgacgacctcgataactcaaacgtcataactcccgacgaacgctactccctaacgcgctctattaaaacgacgacctcgacccgacccgacgacgacctcgataactcaaacgtcataactcccgacgaacgctactccctaacgcgctctattaaaacgacgacctcgacccgacccgacgacgacctccataactcaaacgtcataactcccgacgaacgctactccctaacgcgctctattaaaacgacgaccttaacccgacccgacgacgacctaaataactcaaacgtcataactcccgataaacgctactccctaacgcgctctattaaaacgacgacctctacctaacccgacgacgacctcgataactcaaacgtcataactaccgacgaacgctactccctaacgcgctctattaaaacgacgacctctacctaacccgacgacgacctcgataactcaaacgtcataactaccgacgaacgctactccctaacgcgctctattaaaacgacgacctcgacctaacccgacgacgacctcgataactcaaacgtcataactcccgacgaacgctactcccaaacgaactctattaaaacgccgaccgactaacgcaatcctataaacgacgtaacacttacgaacgcaaaaaaaatcctaaaaaaaccgcgacgaacgaaaaacctttaacgccgacgcttcctctttctcccgacttattcccgacgcttattcccgacgatactcgctcctaaacccgtcctaacccgaactttctaaccccgtaatacccgcgcaacctaattctcgaaaacttaaacacccgaatactatatcgacgaatttctt

SEQ ID NO: 30243 - DNA, 3115 bp, Artificial Sequence
  chemically treated genomic DNA (Homo sapiens) CpG-island No: 30243
aggcgtgagttacggcgttcggcgggtaagatatttttagagtatagggtgttgttaagagtttagcggagtgtagttcgagcgtcgaggtcgttaacgttttatatattgttgacgtaggatataagttcgttatagtggtttttcgtcggttacgcggagttagtggtttttaggcgtttttttgttggaattggcgattgttgcggggttgagcgttggttttacgcgtttcgggagttaggttggtggcgcgatgagttgtagtaaggtttacggggagcggtacgtcgttttcgtgtagggtttcgtttcgtcgtttcgaaaggtgagtggatttcgaagagatcgacggtttcgatttggtcgggcggcggaggtttcgatttggttcggcggcggtttcgatggtttaggcgttatggttttcgatcggcgttgttttttggcgcgttttgttgaggcggcggtttcgattcggttcggcggcggtttcgatggtttaggcgttatggttttcgacgggcgttgttttttggcgcgttttgttgaggcggcggtttcgattcggttcggcggcggtttcgatggtttaggcgttatgtttttcgacgggcgttgttttttggcgcgttttgttgaggcggcggtttcgattcggttcggtcgcggtcgcgatggtttaggcgttatggttttcgacgggcgttgttttttggcgcgttttgttgaggcggaggtttcgattcggttcggtggcggtttcgatggtttaggcgttatggttttcgacgggcgttgttttttggcgcgttttgttgaggcggcggtttcgatttggttcggcggcggtttcgatggtttaggcgttatggttttcgacgggcgttgttttttggtacgttttgttgaggcggcggtttcgatttggttgggcggcggcggtttggatttggttcggcggcggtttcgatggtttaggcgttatggtttttgacgggcgttgttttttggcgcgttttgttgaggcggcggtttcgattcggttcggcggcggtttcgatggtttaggcgttatgtttttcgatcggcgttgttttttggcgcgttttgttgaggtagcggtttcgatttggtcgggcggcggcggtttcgatttggttcggaggcggtttcgatggtttaggtattatggttttcgacgggcgttgttttttgacgcgttttgttgaggcggcggtttcgattcggttcggcggcggtcgcgatggtttaggcgttatggttttcgacgggcgttgttttttggcgcgttttgttgaggtagcggtttcgatttggtcgggcggcggcggtttcgatttggttcggcggcggtttcgatggtttaggtattatggttttcgacgggcgttgttttttggcgcgttttgttgaggtagcggtttcgatttggtcgggcggcggcggtttcgatttggttcggcggcggtttcgatggtttaggtattatggttttcgacgggcgttgttttttggcgcgttttgttgaggcggcggtttcgattcggttcggcggcggtttcgatggtttaggcgttatggttttcgatcggcgttgttttttggcgtgttttgttgaggcggcggtttcgattcggtttcgcggcggtttcgatggtttaggcgttatggttttcgacgggcgttgttttttggcgcgttttgttgaggcggcggtttcgattcggttcggcggcggtttcgatggtttaggcgttatggttttcgacgggcgttgttttttggcgcgttttgttgaggtagcggtttcgatttggtcgggcggcggcggtttcgatttggttcggcggcggtttcgatggtttaggtattatggttttcgacgggcgttgttttttggcgcgttttgttgaggtagcggtttcgatttggtcgggcggcggcggtttcgatttggttcggcggttgtttcgatggtttaggtattatggtttttgacgggcgttgttttttggcgcgttttgttgaggcggcggtttcgattcggttcggcggcggtttcgatggtttaggcgttatggttttcgatcggcgttgttttttggcgtgttttgttgaggcggcggtttcgattcggtttcgcggcggtttcgatggtttaggcgttatggttttcgacgggcgttgttttttggcgcgttttgttgaggcggcggtttttattcggttcggcggcggtttcgatggtttaggcgttatggttttcgacgggcgttgttttttggcgcgttttgttgaggcggcggtttcgattcggttcggcggcggtttcgatggtttaggcgttatggttttcgacgggcgttgttttttggcgcgttttgttgaggcggcggtttcgattcggttcggcggcggtttttatggtttaggcgttatggttttcgacgggcgttgttttttggcgcgttttgttgaggcggcggttttgattcggttcggcggcggtttggatggtttaggcgttatggttttcgatgggcgttgttttttggcgcgttttgttgaggcggcggtttttatttggttcggcggcggtttcgatggtttaggcgttatggttatcgacgggcgttgttttttggcgcgttttgttgaggcggcggtttttatttggttcggcggcggtttcgatggtttaggcgttatggttatcgacgggcgttgttttttggcgcgttttgttgaggcggcggtttcgatttggttcggcggcggtttcgatggtttaggcgttatggttttcgacgggcgttgtttttaggcgggttttgttgaggcgtcggtcggttggcgtagttttgtgggcggcgtggtatttgcgagcgtaggaagagttttggggggatcgcggcgggcgggagatttttggcgtcggcgttttttttttttttcggtttgttttcgacgtttgttttcgacggtgttcgtttttgggttcgttttggttcgggttttttggtttcgtagtattcgcgtagtttggttttcgggggtttaggtattcgggtgttgtatcggcgggtttttt

SEQ ID NO: 30244 - DNA, 3115 bp, Artificial Sequence
  chemically treated genomic DNA (Homo sapiens) CpG-island No: 30244
aaaaaacccgccgatacaacacccgaatacctaaacccccgaaaaccaaactacgcgaatactacgaaaccaaaaaacccgaaccaaaacgaacccaaaaacgaacaccgtcgaaaacaaacgtcgaaaacaaaccgaaaaaaaaaaaaaacgccgacgccaaaaatctcccgcccgccgcgatccccccaaaactcttcctacgctcgcaaataccacgccgcccacaaaactacgccaaccgaccgacgcctcaacaaaacccgcctaaaaacaacgcccgtcgaaaaccataacgcctaaaccatcgaaaccgccgccgaaccaaatcgaaaccgccgcctcaacaaaacgcgccaaaaaacaacgcccgtcgataaccataacgcctaaaccatcgaaaccgccgccgaaccaaataaaaaccgccgcctcaacaaaacgcgccaaaaaacaacgcccgtcgataaccataacgcctaaaccatcgaaaccgccgccgaaccaaataaaaaccgccgcctcaacaaaacgcgccaaaaaacaacgcccatcgaaaaccataacgcctaaaccatccaaaccgccgccgaaccgaatcaaaaccgccgcctcaacaaaacgcgccaaaaaacaacgcccgtcgaaaaccataacgcctaaaccataaaaaccgccgccgaaccgaatcgaaaccgccgcctcaacaaaacgcgccaaaaaacaacgcccgtcgaaaaccataacgcctaaaccatcgaaaccgccgccgaaccgaatcgaaaccgccgcctcaacaaaacgcgccaaaaaacaacgcccgtcgaaaaccataacgcctaaaccatcgaaaccgccgccgaaccgaataaaaaccgccgcctcaacaaaacgcgccaaaaaacaacgcccgtcgaaaaccataacgcctaaaccatcgaaaccgccgcgaaaccgaatcgaaaccgccgcctcaacaaaacacgccaaaaaacaacgccgatcgaaaaccataacgcctaaaccatcgaaaccgccgccgaaccgaatcgaaaccgccgcctcaacaaaacgcgccaaaaaacaacgcccgtcaaaaaccataatacctaaaccatcgaaacaaccgccgaaccaaatcgaaaccgccgccgcccgaccaaatcgaaaccgctacctcaacaaaacgcgccaaaaaacaacgcccgtcgaaaaccataatacctaaaccatcgaaaccgccgccgaaccaaatcgaaaccgccgccgcccgaccaaatcgaaaccgctacctcaacaaaacgcgccaaaaaacaacgcccgtcgaaaaccataacgcctaaaccatcgaaaccgccgccgaaccgaatcgaaaccgccgcctcaacaaaacgcgccaaaaaacaacgcccgtcgaaaaccataacgcctaaaccatcgaaaccgccgcgaaaccgaatcgaaaccgccgcctcaacaaaacacgccaaaaaacaacgccgatcgaaaaccataacgcctaaaccatcgaaaccgccgccgaaccgaatcgaaaccgccgcctcaacaaaacgcgccaaaaaacaacgcccgtcgaaaaccataatacctaaaccatcgaaaccgccgccgaaccaaatcgaaaccgccgccgcccgaccaaatcgaaaccgctacctcaacaaaacgcgccaaaaaacaacgcccgtcgaaaaccataatacctaaaccatcgaaaccgccgccgaaccaaatcgaaaccgccgccgcccgaccaaatcgaaaccgctacctcaacaaaacgcgccaaaaaacaacgcccgtcgaaaaccataacgcctaaaccatcgcgaccgccgccgaaccgaatcgaaaccgccgcctcaacaaaacgcgtcaaaaaacaacgcccgtcgaaaaccataatacctaaaccatcgaaaccgcctccgaaccaaatcgaaaccgccgccgcccgaccaaatcgaaaccgctacctcaacaaaacgcgccaaaaaacaacgccgatcgaaaaacataacgcctaaaccatcgaaaccgccgccgaaccgaatcgaaaccgccgcctcaacaaaacgcgccaaaaaacaacgcccgtcaaaaaccataacgcctaaaccatcgaaaccgccgccgaaccaaatccaaaccgccgccgcccaaccaaatcgaaaccgccgcctcaacaaaacgtaccaaaaaacaacgcccgtcgaaaaccataacgcctaaaccatcgaaaccgccgccgaaccaaatcgaaaccgccgcctcaacaaaacgcgccaaaaaacaacgcccgtcgaaaaccataacgcctaaaccatcgaaaccgccaccgaaccgaatcgaaacctccgcctcaacaaaacgcgccaaaaaacaacgcccgtcgaaaaccataacgcctaaaccatcgcgaccgcgaccgaaccgaatcgaaaccgccgcctcaacaaaacgcgccaaaaaacaacgcccgtcgaaaaacataacgcctaaaccatcgaaaccgccgccgaaccgaatcgaaaccgccgcctcaacaaaacgcgccaaaaaacaacgcccgtcgaaaaccataacgcctaaaccatcgaaaccgccgccgaaccgaatcgaaaccgccgcctcaacaaaacgcgccaaaaaacaacgccgatcgaaaaccataacgcctaaaccatcgaaaccgccgccgaaccaaatcgaaacctccgccgcccgaccaaatcgaaaccgtcgatctcttcgaaatccactcacctttcgaaacgacgaaacgaaaccctacacgaaaacgacgtaccgctccccgtaaaccttactacaactcatcgcgccaccaacctaactcccgaaacgcgtaaaaccaacgctcaaccccgcaacaatcgccaattccaacaaaaaaacgcctaaaaaccactaactccgcgtaaccgacgaaaaaccactataacgaacttatatcctacgtcaacaatatataaaacgttaacgacctcgacgctcgaactacactccgctaaactcttaacaacaccctatactctaaaaatatcttacccgccgaacgccgtaactcacgcct

SEQ ID NO: 30245 - DNA, 515 bp, Artificial Sequence
  chemically treated genomic DNA (Homo sapiens) CpG-island No: 30245
gagtaggcgtcgatgaggttaatggtgtcgtggttattgtggaaagagaatttgtagaaggtgtagagtaatttgttgttattgcggtagtattcgatgatgcggttggatgggtggtggatgtagattttttcgttttgtttttcggcgttggtgtttataaagacgtggttttgtatggttatattcgagtggaaggttttgaggtagtcgttgtataggttgaggcggtaggtgatgtagcgtttgtaagcgatgcgtttgttgcggtagatttggtagaggatgggttcggaggagcggttaaagcgttatttgaggtagtcgtgtttttgtatgtagcgtttggtgagacgttcgtgtaggtagttttcgggtagttgtattttgttgttgtagggtatgtagtgcgagcggtcgtatattgggtagatgaggatgaagaagttttcggtgatttcggcgtgtttttgtagttgtcgtaggtatttttcgtataggttgtggttgtaggg

SEQ ID NO: 30246 - DNA, 515 bp, Artificial Sequence
  chemically treated genomic DNA (Homo sapiens) CpG-island No: 30246
ccctacaaccacaacctatacgaaaaatacctacgacaactacaaaaacacgccgaaatcaccgaaaacttcttcatcctcatctacccaatatacgaccgctcgcactacataccctacaacaacaaaatacaactacccgaaaactacctacacgaacgtctcaccaaacgctacatacaaaaacacgactacctcaaataacgctttaaccgctcctccgaacccatcctctaccaaatctaccgcaacaaacgcatcgcttacaaacgctacatcacctaccgcctcaacctatacaacgactacctcaaaaccttccactcgaatataaccatacaaaaccacgtctttataaacaccaacgccgaaaaacaaaacgaaaaaatctacatccaccacccatccaaccgcatcatcgaatactaccgcaataacaacaaattactctacaccttctacaaattctctttccacaataaccacgacaccattaacctcatcgacgcctactc

SEQ ID NO: 30247 - DNA, 515 bp, Artificial Sequence
  chemically treated genomic DNA (Homo sapiens) CpG-island No: 30247
ttttgtaattatagtttgtgcgagaagtgtttgcggtagttgtagaagtacgtcgaggttatcgagaatttttttatttttatttgtttagtgtgcgatcgttcgtattgtatgttttatagtaataagatgtagttgttcgagaattatttgtacgggcgttttattaagcgttatatgtaggagtacggttattttaagtggcgttttgatcgttttttcgggtttattttttgttaggtttgtcgtaataggcgtatcgtttataagcgttgtattatttgtcgttttaatttgtgtaacgattgttttaaggttttttattcggatgtggttatgtaagattacgtttttgtggatattagcgtcgaggaataggacgagaagatttgtatttattatttatttagtcgtattatcgagtattgtcgtaatgataataaattgttttgtattttttgtaagttttttttttataatggttacgatattattagttttatcgacgtttgttt

SEQ ID NO: 30248 - DNA, 515 bp, Artificial Sequence
  chemically treated genomic DNA (Homo sapiens) CpG-island No: 30248
aaacaaacgtcgataaaactaataatatcgtaaccattataaaaaaaaaacttacaaaaaatacaaaacaatttattatcattacgacaatactcgataatacgactaaataaataataaatacaaatcttctcgtcctattcctcgacgctaatatccacaaaaacgtaatcttacataaccacatccgaataaaaaaccttaaaacaatcgttacacaaattaaaacgacaaataatacaacgcttataaacgatacgcctattacgacaaacctaacaaaaaataaacccgaaaaaacgatcaaaacgccacttaaaataaccgtactcctacatataacgcttaataaaacgcccgtacaaataattctcgaacaactacatcttattactataaaacatacaatacgaacgatcgcacactaaacaaataaaaataaaaaaattctcgataacctcgacgtacttctacaactaccgcaaacacttctcgcacaaactataattacaaaa

SEQ ID NO: 30249 - DNA, 601 bp, Artificial Sequence
  chemically treated genomic DNA (Homo sapiens) CpG-island No: 30249
ttagtcgtttcggcgttttttttttttttttacgttttatttgtttggttaagaatttgtttaatttattgcggtttttttcgtttttggttgcgattaatcgtagcggcgcggttgttatttttagtaagaagtgttttatgatttagggtttttatttcgagcggttatttgcgttttttatttcgcggttagcgtttttaagtcgtcgaggttttagtgttcgagtagttagtaattacgttcgtaggaaaggcgtttttagttttagcgtttatatcgggagaggggtattatacgtgggtgagtatacggcgtttgacgttattagttcgggacggttacgttgcgttttttcggttttagttttttagcggcggaaacgttagttttcgttgtttcgtttttttcgggagggaaatggaaataaaaatttagtcggtttggatgtaggagtgatggggattcgcgaatatagtacgtggtgggatagaaagaagagtgcgttaggtcggggaggaaagagggggcgtgtgagttttagtttatcgtgttttgtttttgttttaatatacggaaagattagatgtgagagaaaagt

SEQ ID NO: 30250 - DNA, 601 bp, Artificial Sequence
  chemically treated genomic DNA (Homo sapiens) CpG-island No: 30250
acttttctctcacatctaatctttccgtatattaaaacaaaaacaaaacacgataaactaaaactcacacgccccctctttcctccccgacctaacgcactcttctttctatcccaccacgtactatattcgcgaatccccatcactcctacatccaaaccgactaaatttttatttccatttccctcccgaaaaaaacgaaacaacgaaaactaacgtttccgccgctaaaaaactaaaaccgaaaaaacgcaacgtaaccgtcccgaactaataacgtcaaacgccgtatactcacccacgtataatacccctctcccgatataaacgctaaaactaaaaacgcctttcctacgaacgtaattactaactactcgaacactaaaacctcgacgacttaaaaacgctaaccgcgaaataaaaaacgcaaataaccgctcgaaataaaaaccctaaatcataaaacacttcttactaaaaataacaaccgcgccgctacgattaatcgcaaccaaaaacgaaaaaaaccgcaataaattaaacaaattcttaaccaaacaaataaaacgtaaaaaaaaaaaaaaaacgccgaaacgactaa

SEQ ID NO: 30251 - DNA, 601 bp, Artificial Sequence
  chemically treated genomic DNA (Homo sapiens) CpG-island No: 30251
gttttttttttatatttgattttttcgtgtgttaaggtagaagtaaggtacggtgggttgagatttatacgttttttttttttttttcggtttaacgtatttttttttttgttttattacgtgttgtgttcgcgagtttttattatttttgtatttaaatcgattagatttttgtttttatttttttttcggaaaaggcgggatagcgaagattggcgttttcgtcgttgaggggttgaggtcgggagggcgtagcgtagtcgtttcgagttgatgacgttaaacgtcgtgtgtttatttacgtgtggtgtttttttttcggtgtaggcgttggagttgaggacgttttttttgcgggcgtagttgttggttgttcgggtattgggatttcggcggtttggggacgttggtcgcgaagtagggagcgtaggtggtcgttcggggtgagggttttgggttatggagtattttttgttggaggtggtagtcgcgtcgttgcggttaatcgtagttaagaacgagaagagtcgtagtgagttgggtaggtttttggttaagtaggtaagacgtgaagggagagggaaagcgtcggaacgattgg

SEQ ID NO: 30252 - DNA, 601 bp, Artificial Sequence
  chemically treated genomic DNA (Homo sapiens) CpG-island No: 30252
ccaatcgttccgacgctttccctctcccttcacgtcttacctacttaaccaaaaacctacccaactcactacgactcttctcgttcttaactacgattaaccgcaacgacgcgactaccacctccaacaaaaaatactccataacccaaaaccctcaccccgaacgaccacctacgctccctacttcgcgaccaacgtccccaaaccgccgaaatcccaatacccgaacaaccaacaactacgcccgcaaaaaaaacgtcctcaactccaacgcctacaccgaaaaaaaaacaccacacgtaaataaacacacgacgtttaacgtcatcaactcgaaacgactacgctacgccctcccgacctcaacccctcaacgacgaaaacgccaatcttcgctatcccgccttttccgaaaaaaaaataaaaacaaaaatctaatcgatttaaatacaaaaataataaaaactcgcgaacacaacacgtaataaaacaaaaaaaaaaatacgttaaaccgaaaaaaaaaaaaaaaacgtataaatctcaacccaccgtaccttacttctaccttaacacacgaaaaaatcaaatataaaaaaaaaac

SEQ ID NO: 30253 - DNA, 555 bp, Artificial Sequence
  chemically treated genomic DNA (Homo sapiens) CpG-island No: 30253
gggagggcggcggttttggtttcgttagttttaagtttaatttggggtgcgggtgcgtgggtcgcgtgtatgtttgcgtggagtaagcgcgtcgagagcggtcggggttggcgtcggggcgttttaatttattaattcggcgagtaggagtaagttcggttttacgagggcgttcgttcgttgcgggttgtttttatcgtagacgggaagttgtttagtatcggttttagtaggatgagtgagcggtaattcgcgttttgggattcggtaggttaggtcgcgtcgggcgcgttagttcgttttttttttgggtttgtcgggagcgttttttcgggttgtggttggcgtttaagaggttagagcggagcggggagtttttattcgggaaaagtttcgttgcgatttcggggagttagtagatatttttgttttagggatcggtttttgagcgcgtttaagggttcgggatcggttgagagtcgcgtgttttttgttttttttaggttcggatgttttttaggttaggggttagacgtggtttcgtaggaagttgag

SEQ ID NO: 30254 - DNA, 555 bp, Artificial Sequence
  chemically treated genomic DNA (Homo sapiens) CpG-island No: 30254
ctcaacttcctacgaaaccacgtctaacccctaacctaaaaaacatccgaacctaaaaaaaacaaaaaacacgcgactctcaaccgatcccgaacccttaaacgcgctcaaaaaccgatccctaaaacaaaaatatctactaactccccgaaatcgcaacgaaacttttcccgaataaaaactccccgctccgctctaacctcttaaacgccaaccacaacccgaaaaaacgctcccgacaaacccaaaaaaaaaacgaactaacgcgcccgacgcgacctaacctaccgaatcccaaaacgcgaattaccgctcactcatcctactaaaaccgatactaaacaacttcccgtctacgataaaaacaacccgcaacgaacgaacgccctcgtaaaaccgaacttactcctactcgccgaattaataaattaaaacgccccgacgccaaccccgaccgctctcgacgcgcttactccacgcaaacatacacgcgacccacgcacccgcaccccaaattaaacttaaaactaacgaaaccaaaaccgccgccctccc

SEQ ID NO: 30255 - DNA, 555 bp, Artificial Sequence
  chemically treated genomic DNA (Homo sapiens) CpG-island No: 30255
tttagttttttgcggggttacgtttggtttttgatttggagagtattcgggtttggagagagtaggaggtacgcggtttttagtcgatttcgaatttttaagcgcgtttaaaggtcgatttttagagtaggggtgtttgttggtttttcggagtcgtagcgaggtttttttcgaatgggagtttttcgtttcgttttggttttttgggcgttagttatagttcgggaaggcgttttcggtagatttagagaaggagcgagttagcgcgttcggcgcggtttggtttatcgggttttagagcgcgagttgtcgtttatttattttgttgaagtcggtgttgagtagtttttcgtttgcggtgaagatagttcgtagcgggcgggcgttttcgtgaggtcgggtttgtttttgttcgtcgggttagtgggttagagcgtttcggcgttagtttcgatcgttttcggcgcgtttgttttacgtagatatgtacgcggtttacgtattcgtattttaggttagatttgaggttggcgaggttagggtcgtcgttttttt

SEQ ID NO: 30256 - DNA, 555 bp, Artificial Sequence
  chemically treated genomic DNA (Homo sapiens) CpG-island No: 30256
aaaaaaacgacgaccctaacctcgccaacctcaaatctaacctaaaatacgaatacgtaaaccgcgtacatatctacgtaaaacaaacgcgccgaaaacgatcgaaactaacgccgaaacgctctaacccactaacccgacgaacaaaaacaaacccgacctcacgaaaacgcccgcccgctacgaactatcttcaccgcaaacgaaaaactactcaacaccgacttcaacaaaataaataaacgacaactcgcgctctaaaacccgataaaccaaaccgcgccgaacgcgctaactcgctccttctctaaatctaccgaaaacgccttcccgaactataactaacgcccaaaaaaccaaaacgaaacgaaaaactcccattcgaaaaaaacctcgctacgactccgaaaaaccaacaaacacccctactctaaaaatcgacctttaaacgcgcttaaaaattcgaaatcgactaaaaaccgcgtacctcctactctctccaaacccgaatactctccaaatcaaaaaccaaacgtaaccccgcaaaaaactaaa

SEQ ID NO: 30257 - DNA, 543 bp, Artificial Sequence
  chemically treated genomic DNA (Homo sapiens) CpG-island No: 30257
cgcgaggcggtggttttagtttttagtcgtcgttttgtaggcgcgtaggtcggggtttgtttggtttttggttttgggcgtggcgcgcgtggcgttggcgagggtttcggtagggggcgttattgttcggttagtgagagttttaggatgcgttttagttttttttttttttggcgcgcgcgtcgtcgtttttttttttgtttttgcgtcgatagttttatcgttagtcgtagttgttcgtcgtagtttcggaatacgtggtcgtcggaatttggttttgagttgggtcgagggttgggtattgacgtcgggggcgtaggttggcgttgcggcgtgggcggggcgtttttgggggtggggaaggaatgtcgcgggttttcgggcgtatttatttatcggtcggggtcgggatacggcgtggaggttttagggcggttcgcggttattattttttagtggaggcggttagtttcgcggcgttttggtttttatttggtcgtggcggagtttagattttattaagtttttttcgttaatgtttgg

SEQ ID NO: 30258 - DNA, 543 bp, Artificial Sequence
  chemically treated genomic DNA (Homo sapiens) CpG-island No: 30258
ccaaacattaacgaaaaaaacttaataaaatctaaactccgccacgaccaaataaaaaccaaaacgccgcgaaactaaccgcctccactaaaaaataataaccgcgaaccgccctaaaacctccacgccgtatcccgaccccgaccgataaataaatacgcccgaaaacccgcgacattccttccccacccccaaaaacgccccgcccacgccgcaacgccaacctacgcccccgacgtcaatacccaaccctcgacccaactcaaaaccaaattccgacgaccacgtattccgaaactacgacgaacaactacgactaacgataaaactatcgacgcaaaaacaaaaaaaaaaacgacgacgcgcgcgccaaaaaaaaaaaaaactaaaacgcatcctaaaactctcactaaccgaacaataacgccccctaccgaaaccctcgccaacgccacgcgcgccacgcccaaaaccaaaaaccaaacaaaccccgacctacgcgcctacaaaacgacgactaaaaactaaaaccaccgcctcgcg

SEQ ID NO: 30259 - DNA, 543 bp, Artificial Sequence
  chemically treated genomic DNA (Homo sapiens) CpG-island No: 30259
ttaggtattgacggggagaatttggtagggtttgggtttcgttacgattaggtgggggttaggacgtcgcgggattgatcgtttttattagagggtggtggtcgcgggtcgttttggagtttttacgtcgtgtttcggtttcggtcggtgggtgggtgcgttcgggagttcgcgatattttttttttatttttaggagcgtttcgtttacgtcgtagcgttagtttgcgttttcggcgttagtgtttagttttcggtttagtttagggttaggtttcggcggttacgtgtttcggagttacgacgagtagttgcggttggcgatggaattgtcggcgtaggagtaggaggagaggcggcggcgcgcgcgttaggaggaggaggagttggagcgtattttgaggtttttattgatcgagtagtagcgttttttgtcgggattttcgttagcgttacgcgcgttacgtttagggttaggagttagataaatttcggtttgcgcgtttgtagagcggcggttggagattggagttatcgtttcgcg

SEQ ID NO: 30260 - DNA, 543 bp, Artificial Sequence
  chemically treated genomic DNA (Homo sapiens) CpG-island No: 30260
cgcgaaacgataactccaatctccaaccgccgctctacaaacgcgcaaaccgaaatttatctaactcctaaccctaaacgtaacgcgcgtaacgctaacgaaaatcccgacaaaaaacgctactactcgatcaataaaaacctcaaaatacgctccaactcctcctcctcctaacgcgcgcgccgccgcctctcctcctactcctacgccgacaattccatcgccaaccgcaactactcgtcgtaactccgaaacacgtaaccgccgaaacctaaccctaaactaaaccgaaaactaaacactaacgccgaaaacgcaaactaacgctacgacgtaaacgaaacgctcctaaaaataaaaaaaaaatatcgcgaactcccgaacgcacccacccaccgaccgaaaccgaaacacgacgtaaaaactccaaaacgacccgcgaccaccaccctctaataaaaacgatcaatcccgcgacgtcctaacccccacctaatcgtaacgaaacccaaaccctaccaaattctccccgtcaatacctaa

SEQ ID NO: 30261 - DNA, 523 bp, Artificial Sequence
  chemically treated genomic DNA (Homo sapiens) CpG-island No: 30261
gtgggcgttagtcgtggcggcgcggagtttcgtggtttcgcgcgttcgcggagacgtatttggttatatttattgttcgttttaagtaggttttgttggatggcgaattgtagtaggtcgtcgtcgtcgtttcgggtcgtcgtttttcgttggtcgtttattatgttgtagtcgcgcggggtttcgaataacgttggggagatttcgtagtcgcggtaggaggttgggggcgcgggggttgggttaggtacggtcgggcgcgttttttttatttatttcggggagagtcgaggggtaggcgttttcgcggggggttttattcgtggagttggagttgttgacgttggaggagtcgttgtttggggaaggcgtttcgttgttggggttgtttcgtatcgatggtatcggttcgtcgtagtcgttgaggttttcgaaggtgatgcgggcgttgaggatgtggaagatcgggatttttgaggatgaggaaatttttaggcgttattatttagttttttatatttta

SEQ ID NO: 30262 - DNA, 523 bp, Artificial Sequence
  chemically treated genomic DNA (Homo sapiens) CpG-island No: 30262
taaaatataaaaaactaaataataacgcctaaaaatttcctcatcctcaaaaatcccgatcttccacatcctcaacgcccgcatcaccttcgaaaacctcaacgactacgacgaaccgataccatcgatacgaaacaaccccaacaacgaaacgccttccccaaacaacgactcctccaacgtcaacaactccaactccacgaataaaaccccccgcgaaaacgcctacccctcgactctccccgaaataaataaaaaaaacgcgcccgaccgtacctaacccaacccccgcgcccccaacctcctaccgcgactacgaaatctccccaacgttattcgaaaccccgcgcgactacaacataataaacgaccaacgaaaaacgacgacccgaaacgacgacgacgacctactacaattcgccatccaacaaaacctacttaaaacgaacaataaatataaccaaatacgtctccgcgaacgcgcgaaaccacgaaactccgcgccgccacgactaacgcccac

SEQ ID NO: 30263 - DNA, 523 bp, Artificial Sequence
  chemically treated genomic DNA (Homo sapiens) CpG-island No: 30263
tgaggtgtgaggggttgagtggtggcgtttaaaggtttttttatttttagaaatttcgattttttatatttttaacgttcgtattattttcgggaattttaacggttgcgacgaatcggtgttatcggtgcgaggtagttttagtagcgagacgttttttttaggtagcgatttttttagcgttagtagttttagttttacgagtgaggtttttcgcgagaacgtttgtttttcggtttttttcggggtgggtgggaggggcgcgttcggtcgtgtttgatttagttttcgcgtttttagttttttgtcgcggttgcgagatttttttagcgttgttcgaggtttcgcgcggttatagtatgatgggcggttagcgggaggcggcgattcgggacgacgacgacgatttgttgtaattcgttatttagtagagtttgtttgaggcgggtagtgagtatgattaggtgcgttttcgcgggcgcgcggggttacgggatttcgcgtcgttacggttaacgtttat

SEQ ID NO: 30264 - DNA, 523 bp, Artificial Sequence
  chemically treated genomic DNA (Homo sapiens) CpG-island No: 30264
ataaacgttaaccgtaacgacgcgaaatcccgtaaccccgcgcgcccgcgaaaacgcacctaatcatactcactacccgcctcaaacaaactctactaaataacgaattacaacaaatcgtcgtcgtcgtcccgaatcgccgcctcccgctaaccgcccatcatactataaccgcgcgaaacctcgaacaacgctaaaaaaatctcgcaaccgcgacaaaaaactaaaaacgcgaaaactaaatcaaacacgaccgaacgcgcccctcccacccaccccgaaaaaaaccgaaaaacaaacgttctcgcgaaaaacctcactcgtaaaactaaaactactaacgctaaaaaaatcgctacctaaaaaaaacgtctcgctactaaaactacctcgcaccgataacaccgattcgtcgcaaccgttaaaattcccgaaaataatacgaacgttaaaaatataaaaaatcgaaatttctaaaaataaaaaaacctttaaacgccaccactcaacccctcacacctca

SEQ ID NO: 30265 - DNA, 887 bp, Artificial Sequence
  chemically treated genomic DNA (Homo sapiens) CpG-island No: 30265
gtttcggtcggaggggagcgggtagggttcgttttttattattttttttcggttaataagtataaaagtcgcggtcgtaaataaagacgcgtcgtaaattcgttagggaggcgggatagttcgcgtcgtattttttttttaggtcggacgggcgtgttcggtcgcggggttttcgcggcgtttcgaaggcgtttttatttggttcgcgcggatttttttttttagttcgcggtggcggttgtgttatacgaggtagtgtagcggatatttgttttcgggtttttttttggcggaggcgttggcggggattatcgttcgttttttatgtcggggtcgcggcgttcggtcggggaggagggacggcgtcggagtcggggttcggggtcgcggggcggggggtcggcgttgtttgttcgcggggttgcggttcgggtatgtgcgagcggcggcgggcgggggcggcgcgttcggcgcggtgcgggcggcgcgggcgacgggcgttttcgcgaggcggcggcggcgggcggcgcggagaggtttttattcgttttgggagggagcgggtattcggcggcgttgcgcggattcgcgttcgttttttatattttcgtatataaagacgtcgttcggcggagggagtaggcgttcgtagcgggcgcgggggcgtacgggacgcgggtttcggggacgtcgtcgtagggacgcgcgttcgtagttttcgggtttttatagttgtatagttcggtttttagttcgagcggtcggcgcgggatacggggatgtggggatgatggggagagaggaaggggattaggcgtttcgggtagagtttgttagtttagtttcgcggtattatggggtttgtagttcgtttcgtgaaattgggg

SEQ ID NO: 30266 - DNA, 887 bp, Artificial Sequence
  chemically treated genomic DNA (Homo sapiens) CpG-island No: 30266
ccccaatttcacgaaacgaactacaaaccccataataccgcgaaactaaactaacaaactctacccgaaacgcctaatccccttcctctctccccatcatccccacatccccgtatcccgcgccgaccgctcgaactaaaaaccgaactatacaactataaaaacccgaaaactacgaacgcgcgtccctacgacgacgtccccgaaacccgcgtcccgtacgcccccgcgcccgctacgaacgcctactccctccgccgaacgacgtctttatatacgaaaatataaaaaacgaacgcgaatccgcgcaacgccgccgaatacccgctccctcccaaaacgaataaaaacctctccgcgccgcccgccgccgccgcctcgcgaaaacgcccgtcgcccgcgccgcccgcaccgcgccgaacgcgccgcccccgcccgccgccgctcgcacatacccgaaccgcaaccccgcgaacaaacaacgccgaccccccgccccgcgaccccgaaccccgactccgacgccgtccctcctccccgaccgaacgccgcgaccccgacataaaaaacgaacgataatccccgccaacgcctccgccaaaaaaaaacccgaaaacaaatatccgctacactacctcgtataacacaaccgccaccgcgaactaaaaaaaaaaatccgcgcgaaccaaataaaaacgccttcgaaacgccgcgaaaaccccgcgaccgaacacgcccgtccgacctaaaaaaaaaatacgacgcgaactatcccgcctccctaacgaatttacgacgcgtctttatttacgaccgcgacttttatacttattaaccgaaaaaaaataataaaaaacgaaccctacccgctcccctccgaccgaaac

SEQ ID NO: 30267 - DNA, 887 bp, Artificial Sequence
  chemically treated genomic DNA (Homo sapiens) CpG-island No: 30267
ttttagttttacgaggcggattataaattttatgatgtcgcggggttgagttgataagttttattcggggcgtttggttttttttttttttttttattatttttatattttcgtatttcgcgtcggtcgttcgggttgagggtcgggttatgtagttgtggggattcgggggttgcgggcgcgcgtttttgcggcggcgttttcggggttcgcgtttcgtgcgttttcgcgttcgttgcgggcgtttgtttttttcgtcgagcggcgtttttgtgtgcgggggtgtgggaggcgagcgcgagttcgcgtagcgtcgtcgagtgttcgtttttttttagggcgggtgggggttttttcgcgtcgttcgtcgtcgtcgtttcgcgaggacgttcgtcgttcgcgtcgttcgtatcgcgtcgggcgcgtcgttttcgttcgtcgtcgttcgtatatgttcgagtcgtagtttcgcgagtaggtagcgtcggtttttcgtttcgcggtttcgggtttcggtttcggcgtcgtttttttttttcggtcgggcgtcgcggtttcggtatgaggagcgggcgatgattttcgttaacgttttcgttaggaaggggttcgagggtaagtattcgttgtattatttcgtgtggtataatcgttatcgcgagttggagaaggaggttcgcgcgggttaggtaggagcgttttcggggcgtcgcggggatttcgcggtcgggtacgttcgttcggtttggggagggggtgcggcgcgggttgtttcgtttttttggcgagtttgcggcgcgtttttgtttgcggtcgcggtttttgtgtttgttgatcgggaaagggtgatggggagcgggttttgttcgttttttttcggtcgggat

SEQ ID NO: 30268 - DNA, 887 bp, Artificial Sequence
  chemically treated genomic DNA (Homo sapiens) CpG-island No: 30268
atcccgaccgaaaaaaaacgaacaaaacccgctccccatcaccctttcccgatcaacaaacacaaaaaccgcgaccgcaaacaaaaacgcgccgcaaactcgccaaaaaaacgaaacaacccgcgccgcaccccctccccaaaccgaacgaacgtacccgaccgcgaaatccccgcgacgccccgaaaacgctcctacctaacccgcgcgaacctccttctccaactcgcgataacgattataccacacgaaataatacaacgaatacttaccctcgaaccccttcctaacgaaaacgttaacgaaaatcatcgcccgctcctcataccgaaaccgcgacgcccgaccgaaaaaaaaaaacgacgccgaaaccgaaacccgaaaccgcgaaacgaaaaaccgacgctacctactcgcgaaactacgactcgaacatatacgaacgacgacgaacgaaaacgacgcgcccgacgcgatacgaacgacgcgaacgacgaacgtcctcgcgaaacgacgacgacgaacgacgcgaaaaaacccccacccgccctaaaaaaaaacgaacactcgacgacgctacgcgaactcgcgctcgcctcccacacccccgcacacaaaaacgccgctcgacgaaaaaaacaaacgcccgcaacgaacgcgaaaacgcacgaaacgcgaaccccgaaaacgccgccgcaaaaacgcgcgcccgcaacccccgaatccccacaactacataacccgaccctcaacccgaacgaccgacgcgaaatacgaaaatataaaaataataaaaaaaaaaaaaaaaaaccaaacgccccgaataaaacttatcaactcaaccccgcgacatcataaaatttataatccgcctcgtaaaactaaaa

SEQ ID NO: 30269 - DNA, 672 bp, Artificial Sequence
  chemically treated genomic DNA (Homo sapiens) CpG-island No: 30269
gtaggttacgttgttcgtcggggtcgggtatttgtcgcggtttttttaagcgttttcgtttttttttgttcgcgttcgggttttttttttttagggggcgcggtcggtagcgcgcggcggggcgggggtgcggtttttttttttgtgggtagggtttgcgtcgttttttgtagaagcggtcgggagtcgcgtagggggcggagagaggagtcgcgagcggcggcggggcggcgcggggcggagggcgttcgagggcgagcgggtaggcgggtacggcgggtttcgggttagtttcggggcggacggttggtcgggcgcgcggagtttcgtcggggtttcgtcggagtcgggtcgggtagtaggggtcgtcgtcgtcgttcgggttcgtcgttcgcgttttttacgttggtttagagggttgcggtcgcgtcgtcgttgaggatgtttcgaaaggggtcgcgagcggaggtgtgtgcggattgtagcgtttcgggtaagcgcggcggggtcgggggcgggatcgtatagttaggtcgtcgtcgggcgggcgtcggggtttggtaagagcgttgtgcggggtcggagggttgggcggggcggggggttgcggtttttaggttgggttttcgtttcggttattgcggagttgcgtttttggcgggagggtcggtt

SEQ ID NO: 30270 - DNA, 672 bp, Artificial Sequence
  chemically treated genomic DNA (Homo sapiens) CpG-island No: 30270
aaccgaccctcccgccaaaaacgcaactccgcaataaccgaaacgaaaacccaacctaaaaaccgcaaccccccgccccgcccaaccctccgaccccgcacaacgctcttaccaaaccccgacgcccgcccgacgacgacctaactatacgatcccgcccccgaccccgccgcgcttacccgaaacgctacaatccgcacacacctccgctcgcgacccctttcgaaacatcctcaacgacgacgcgaccgcaaccctctaaaccaacgtaaaaaacgcgaacgacgaacccgaacgacgacgacgacccctactacccgacccgactccgacgaaaccccgacgaaactccgcgcgcccgaccaaccgtccgccccgaaactaacccgaaacccgccgtacccgcctacccgctcgccctcgaacgccctccgccccgcgccgccccgccgccgctcgcgactcctctctccgccccctacgcgactcccgaccgcttctacaaaaaacgacgcaaaccctacccacaaaaaaaaaaaccgcacccccgccccgccgcgcgctaccgaccgcgccccctaaaaaaaaaaaacccgaacgcgaacaaaaaaaaacgaaaacgcttaaaaaaaccgcgacaaatacccgaccccgacgaacaacgtaacctac

SEQ ID NO: 30271 - DNA, 672 bp, Artificial Sequence
  chemically treated genomic DNA (Homo sapiens) CpG-island No: 30271
ggtcggttttttcgttaagggcgtagtttcgtagtggtcgaggcgggggtttagtttggaggtcgtagtttttcgtttcgtttagtttttcggtttcgtatagcgtttttgttaggtttcggcgttcgttcggcggcggtttggttgtgcggtttcgttttcggtttcgtcgcgtttattcggggcgttgtagttcgtatatattttcgttcgcggtttttttcgggatatttttagcggcgacgcggtcgtagttttttgggttagcgtggggggcgcgggcggcgggttcgggcggcggcggcggtttttgttgttcggttcggtttcggcgaggtttcggcgaggtttcgcgcgttcggttaatcgttcgtttcggggttggttcggaattcgtcgtgttcgtttgttcgttcgttttcgggcgtttttcgtttcgcgtcgtttcgtcgtcgttcgcggttttttttttcgttttttgcgcggttttcggtcgtttttgtaggaagcggcgtaggttttgtttatagggggaggggtcgtattttcgtttcgtcgcgcgttgtcggtcgcgttttttagagaaaggaagttcgggcgcgggtaggagggggcgggggcgtttaaaggggtcgcggtagatgttcggtttcggcgggtagcgtggtttgt

SEQ ID NO: 30272 - DNA, 672 bp, Artificial Sequence
  chemically treated genomic DNA (Homo sapiens) CpG-island No: 30272
acaaaccacgctacccgccgaaaccgaacatctaccgcgacccctttaaacgcccccgccccctcctacccgcgcccgaacttcctttctctaaaaaacgcgaccgacaacgcgcgacgaaacgaaaatacgacccctccccctataaacaaaacctacgccgcttcctacaaaaacgaccgaaaaccgcgcaaaaaacgaaaaaaaaaaccgcgaacgacgacgaaacgacgcgaaacgaaaaacgcccgaaaacgaacgaacaaacgaacacgacgaattccgaaccaaccccgaaacgaacgattaaccgaacgcgcgaaacctcgccgaaacctcgccgaaaccgaaccgaacaacaaaaaccgccgccgccgcccgaacccgccgcccgcgccccccacgctaacccaaaaaactacgaccgcgtcgccgctaaaaatatcccgaaaaaaaccgcgaacgaaaatatatacgaactacaacgccccgaataaacgcgacgaaaccgaaaacgaaaccgcacaaccaaaccgccgccgaacgaacgccgaaacctaacaaaaacgctatacgaaaccgaaaaactaaacgaaacgaaaaactacgacctccaaactaaacccccgcctcgaccactacgaaactacgcccttaacgaaaaaaccgacc

SEQ ID NO: 30273 - DNA, 516 bp, Artificial Sequence
  chemically treated genomic DNA (Homo sapiens) CpG-island No: 30273
gtcggtttttagcgtttttgagcgtcgtagggcgcgtagtaggtattgggttagggtcgacggtttgtaaataaggttgtattttttcggtagtggttcgcgttcgtcgttgaattggttcgtcgggttttcgtcgttcgtttttttttcgtcgtttcggttttgggttttcggtagggtttttttttcgacggcgcgtttttagggttttcggagtcgcgggtcgagtaggtcgagaagggcgagtacggttaagatgagcgcgagggcggcgttttacggcggtatggcgaagttggagagtttcggcgggtagcgggcggcggggtcgtttattcggcgagtttcgcgttttgttcgcggtttcgttcgtcggcggcggttgtttagggttttttcgcgcgggcgcgttttggattggtcgtggtcgggtagaggtagttagttcgggttcggttgttttcgttcgttttttattttcgtttcggttttttgtatagtaattgtaataagtgg

SEQ ID NO: 30274 - DNA, 516 bp, Artificial Sequence
  chemically treated genomic DNA (Homo sapiens) CpG-island No: 30274
ccacttattacaattactatacaaaaaaccgaaacgaaaataaaaaacgaacgaaaacaaccgaacccgaactaactacctctacccgaccacgaccaatccaaaacgcgcccgcgcgaaaaaaccctaaacaaccgccgccgacgaacgaaaccgcgaacaaaacgcgaaactcgccgaataaacgaccccgccgcccgctacccgccgaaactctccaacttcgccataccgccgtaaaacgccgccctcgcgctcatcttaaccgtactcgcccttctcgacctactcgacccgcgactccgaaaaccctaaaaacgcgccgtcgaaaaaaaaaccctaccgaaaacccaaaaccgaaacgacgaaaaaaaaacgaacgacgaaaacccgacgaaccaattcaacgacgaacgcgaaccactaccgaaaaaatacaaccttatttacaaaccgtcgaccctaacccaatacctactacgcgccctacgacgctcaaaaacgctaaaaaccgac

SEQ ID NO: 30275 - DNA, 516 bp, Artificial Sequence
  chemically treated genomic DNA (Homo sapiens) CpG-island No: 30275
ttatttgttgtaattgttgtataaagggtcggggcgggggtggggggcgggcgagggtagtcgggttcgaattggttgtttttgttcggttacggttaatttagagcgcgttcgcgcgggagggttttgggtagtcgtcgtcggcgggcggagtcgcgggtaaagcgcggagttcgtcgagtagacggtttcgtcgttcgttgttcgtcggggttttttagtttcgttatgtcgtcgtggggcgtcgttttcgcgtttattttggtcgtgttcgtttttttcggtttgttcggttcgcggtttcggggattttgggggcgcgtcgtcggagagaggattttgtcgggggtttaagatcgagacgacggggaggaggcggacggcggaggttcggcggattagtttagcgacgggcgcgagttattgtcgggagggtgtagttttgtttgtaagtcgtcggttttggtttagtgtttgttgcgcgttttgcggcgtttagaggcgttggaggtcggt

SEQ ID NO: 30276 - DNA, 516 bp, Artificial Sequence
  chemically treated genomic DNA (Homo sapiens) CpG-island No: 30276
accgacctccaacgcctctaaacgccgcaaaacgcgcaacaaacactaaaccaaaaccgacgacttacaaacaaaactacaccctcccgacaataactcgcgcccgtcgctaaactaatccgccgaacctccgccgtccgcctcctccccgtcgtctcgatcttaaacccccgacaaaatcctctctccgacgacgcgcccccaaaatccccgaaaccgcgaaccgaacaaaccgaaaaaaacgaacacgaccaaaataaacgcgaaaacgacgccccacgacgacataacgaaactaaaaaaccccgacgaacaacgaacgacgaaaccgtctactcgacgaactccgcgctttacccgcgactccgcccgccgacgacgactacccaaaaccctcccgcgcgaacgcgctctaaattaaccgtaaccgaacaaaaacaaccaattcgaacccgactaccctcgcccgccccccacccccgccccgaccctttatacaacaattacaacaaataa

SEQ ID NO: 30277 - DNA, 824 bp, Artificial Sequence
  chemically treated genomic DNA (Homo sapiens) CpG-island No: 30277
atatcggggtcgcggtatttttcggattttgagagggagtcggtcgtcgttcgcggatcgagttttagtcggggtagaggagttggttagtagataaaggaatgaagtagaaagagacgcgattatagcggggtcggggtatagacgttgtaagtcgttggaggggcgggtttttcggtttttttcgcgggcgtttcggtttttacgttgtttcgaggcgttcggggcggtaggaggtttttagagtcggggattcgggggattcgcggcgcgttaggagggtttttttagttcgtttgtcgtttattcgggattttagtagtttcgttcggttgtagtttcgaaacggtttcggtcggttttgcgcggtcggtaaagtatatacgcgcgcgcgtatatatatatatatatatatatatatatatatatataggattaggaggacggtagatgatgcgttatcgtacgtggttttggagttggcggggtggggcgcggtttcggcgattcgagttcggtttcgtagaggttgcggcggtcgcgttttttatttttgttgtagtagtagcgatttgttaaagggaaagacgtaagaggcggcggtagtagcggcggcgttaggcgagttttacgagatttgggcggaattttcgcgtagtcgggagttttcgtttcgtttaataggtttagcgcgggaggtgaaaggggaatcgagaggaaggcggttgaggtggagttgggggttgagcgaaaaggggaaagggatttgggagcgaggggagttaagttaggtgttggggatattttgttatcgcgcggttttt

SEQ ID NO: 30278 - DNA, 824 bp, Artificial Sequence
  chemically treated genomic DNA (Homo sapiens) CpG-island No: 30278
aaaaaccgcgcgataacaaaatatccccaacacctaacttaactcccctcgctcccaaatccctttccccttttcgctcaacccccaactccacctcaaccgccttcctctcgattcccctttcacctcccgcgctaaacctattaaacgaaacgaaaactcccgactacgcgaaaattccgcccaaatctcgtaaaactcgcctaacgccgccgctactaccgccgcctcttacgtctttccctttaacaaatcgctactactacaacaaaaataaaaaacgcgaccgccgcaacctctacgaaaccgaactcgaatcgccgaaaccgcgccccaccccgccaactccaaaaccacgtacgataacgcatcatctaccgtcctcctaatcctatatatatatatatatatatatatatatatatatatacgcgcgcgcgtatatactttaccgaccgcgcaaaaccgaccgaaaccgtttcgaaactacaaccgaacgaaactactaaaatcccgaataaacgacaaacgaactaaaaaaaccctcctaacgcgccgcgaatcccccgaatccccgactctaaaaacctcctaccgccccgaacgcctcgaaacaacgtaaaaaccgaaacgcccgcgaaaaaaaccgaaaaacccgcccctccaacgacttacaacgtctataccccgaccccgctataatcgcgtctctttctacttcattcctttatctactaaccaactcctctaccccgactaaaactcgatccgcgaacgacgaccgactccctctcaaaatccgaaaaataccgcgaccccgatat

SEQ ID NO: 30279 - DNA, 824 bp, Artificial Sequence
  chemically treated genomic DNA (Homo sapiens) CpG-island No: 30279
gagggtcgcgcggtagtaaagtgtttttagtatttagtttggtttttttcgtttttaaatttttttttttttttcgtttaatttttaattttattttagtcgtttttttttcggttttttttttatttttcgcgttgggtttgttgggcggggcgagggttttcggttgcgcgagagtttcgtttaaatttcgtgagattcgtttgacgtcgtcgttgttgtcgtcgttttttacgtttttttttttgataagtcgttgttgttgtagtaaaaataaaggacgcgatcgtcgtagtttttgcggagtcgggttcgggtcgtcggagtcgcgttttatttcgttagttttagagttacgtacggtaacgtattatttatcgtttttttggttttgtgtgtgtgtgtgtgtgtgtgtgtgtgtgtgtgtgtgcgcgcgcgcgtgtgtgttttgtcggtcgcgtagggtcggtcggggtcgtttcgggattgtagtcgagcggggttgttggggtttcgggtgggcggtaggcgagttgggggagtttttttggcgcgtcgcggatttttcgggttttcggttttagaggttttttgtcgtttcgggcgtttcggagtagcgtagaagtcgaggcgttcgcggagagggtcgagagattcgtttttttagcggtttataacgtttgtgtttcggtttcgttgtggtcgcgtttttttttgttttatttttttatttgttgattagtttttttgtttcggttggggttcggttcgcgggcggcggtcgatttttttttagggttcggggagtgtcgcgatttcggtgt

SEQ ID NO: 30280 - DNA, 824 bp, Artificial Sequence
  chemically treated genomic DNA (Homo sapiens) CpG-island No: 30280
acaccgaaatcgcgacactccccgaaccctaaaaaaaaatcgaccgccgcccgcgaaccgaaccccaaccgaaacaaaaaaactaatcaacaaataaaaaaataaaacaaaaaaaaacgcgaccacaacgaaaccgaaacacaaacgttataaaccgctaaaaaaacgaatctctcgaccctctccgcgaacgcctcgacttctacgctactccgaaacgcccgaaacgacaaaaaacctctaaaaccgaaaacccgaaaaatccgcgacgcgccaaaaaaactcccccaactcgcctaccgcccacccgaaaccccaacaaccccgctcgactacaatcccgaaacgaccccgaccgaccctacgcgaccgacaaaacacacacgcgcgcgcgcacacacacacacacacacacacacacacacacacacaaaaccaaaaaaacgataaataatacgttaccgtacgtaactctaaaactaacgaaataaaacgcgactccgacgacccgaacccgactccgcaaaaactacgacgatcgcgtcctttatttttactacaacaacaacgacttatcaaaaaaaaaaacgtaaaaaacgacgacaacaacgacgacgtcaaacgaatctcacgaaatttaaacgaaactctcgcgcaaccgaaaaccctcgccccgcccaacaaacccaacgcgaaaaataaaaaaaaaaccgaaaaaaaaacgactaaaataaaattaaaaattaaacgaaaaaaaaaaaaaaatttaaaaacgaaaaaaaccaaactaaatactaaaaacactttactaccgcgcgaccctc

SEQ ID NO: 30281 - DNA, 692 bp, Artificial Sequence
  chemically treated genomic DNA (Homo sapiens) CpG-island No: 30281
atttaggttttaaattgaaaagcgcgtaagcgtggttttcgatttagagttcggcgtcgggcgagaagtcgttacgcggatcgtattacgcggagcggtattttatatacgcgagggtagggtcgagttatggcgtttttttatttttttcgtttcgtggtcgttttttttggcgtcgatgtttttagttaggtagttgagcgacgcggaagtgaggtcggggacgcgcgcgaggtgatatgcgtagtttcgtttagggattataggggcgcgttaaaggcggttttgcgtaaggttcggtttggcgagggcgtgcgaagtttttttagcggaacgttttttacgtcgtttaaatatataagagttttaaattttcgaaaaattttaatcgggttagtattaagcgatgttttttatttaggttcgagagttatcgtgcggggcgtggtcggttttattcggagttttttatatttcgttgggggcgggttattttgttcggttcgtatatcgtgtgttcgttttagttgaagagtttgcgcgcgcgtatcggacgtttacgttatcgcgtacgcgtttttattcgttcggagttcgtcgcgtaggcgtaaaaggagacgcgagtagtatttttttgattttttttttaatattaggagtttaaacggttttagagtagtagtaagattttt

SEQ ID NO: 30282 - DNA, 692 bp, Artificial Sequence
  chemically treated genomic DNA (Homo sapiens) CpG-island No: 30282
aaaaatcttactactactctaaaaccgtttaaactcctaatattaaaaaaaaaatcaaaaaaatactactcgcgtctccttttacgcctacgcgacgaactccgaacgaataaaaacgcgtacgcgataacgtaaacgtccgatacgcgcgcgcaaactcttcaactaaaacgaacacacgatatacgaaccgaacaaaataacccgcccccaacgaaatataaaaaactccgaataaaaccgaccacgccccgcacgataactctcgaacctaaataaaaaacatcgcttaatactaacccgattaaaatttttcgaaaatttaaaactcttatatatttaaacgacgtaaaaaacgttccgctaaaaaaacttcgcacgccctcgccaaaccgaaccttacgcaaaaccgcctttaacgcgcccctataatccctaaacgaaactacgcatatcacctcgcgcgcgtccccgacctcacttccgcgtcgctcaactacctaactaaaaacatcgacgccaaaaaaaacgaccacgaaacgaaaaaaataaaaaaacgccataactcgaccctaccctcgcgtatataaaataccgctccgcgtaatacgatccgcgtaacgacttctcgcccgacgccgaactctaaatcgaaaaccacgcttacgcgcttttcaatttaaaacctaaat

SEQ ID NO: 30283 - DNA, 692 bp, Artificial Sequence
  chemically treated genomic DNA (Homo sapiens) CpG-island No: 30283
aagggttttgttgttgttttggggtcgtttggatttttggtgttgggggaggggttagggaggtgttgttcgcgtttttttttgcgtttgcgcggcgggtttcgagcgggtaggagcgcgtgcgcggtgacgtggacgttcggtgcgcgcgcgtaggttttttagttggagcggatatacggtgtgcgaatcgaatagaataattcgtttttagcgggatgtgaaggatttcgggtgaggtcggttacgtttcgtacggtaattttcgggtttgggtggagggtatcgtttagtattggttcgattggagtttttcgagagtttgaagtttttgtgtatttgaacggcgtgagaaacgtttcgttgagagagtttcgtacgttttcgttaggtcgggttttgcgtagggtcgtttttggcgcgtttttgtggtttttgagcgaggttgcgtatgttatttcgcgcgcgttttcggttttattttcgcgtcgtttagttatttaattgggaatatcgacgttagagagagcggttacgaagcgggaggggtgagaaagcgttatggttcggttttgttttcgcgtgtgtggggtgtcgtttcgcgtggtacggttcgcgtgacgatttttcgttcggcgtcgggttttaggtcgagagttacgtttacgcgttttttagtttagagtttaggt

SEQ ID NO: 30284 - DNA, 692 bp, Artificial Sequence
  chemically treated genomic DNA (Homo sapiens) CpG-island No: 30284
acctaaactctaaactaaaaaacgcgtaaacgtaactctcgacctaaaacccgacgccgaacgaaaaatcgtcacgcgaaccgtaccacgcgaaacgacaccccacacacgcgaaaacaaaaccgaaccataacgctttctcacccctcccgcttcgtaaccgctctctctaacgtcgatattcccaattaaataactaaacgacgcgaaaataaaaccgaaaacgcgcgcgaaataacatacgcaacctcgctcaaaaaccacaaaaacgcgccaaaaacgaccctacgcaaaacccgacctaacgaaaacgtacgaaactctctcaacgaaacgtttctcacgccgttcaaatacacaaaaacttcaaactctcgaaaaactccaatcgaaccaatactaaacgataccctccacccaaacccgaaaattaccgtacgaaacgtaaccgacctcacccgaaatccttcacatcccgctaaaaacgaattattctattcgattcgcacaccgtatatccgctccaactaaaaaacctacgcgcgcgcaccgaacgtccacgtcaccgcgcacgcgctcctacccgctcgaaacccgccgcgcaaacgcaaaaaaaaacgcgaacaacacctccctaacccctcccccaacaccaaaaatccaaacgaccccaaaacaacaacaaaaccctt

SEQ ID NO: 30285 - DNA, 832 bp, Artificial Sequence
  chemically treated genomic DNA (Homo sapiens) CpG-island No: 30285
aacgattcggcgtcgtttcgagttcggtgttaggtgattagcgggtaggggcgggtttgcgattagtacgtgattcgaattggtagttaatgattagtcgggtggtttagtagcgcgaggatttcgggattcgcgaacggagcggcgcgtgggtcggttgcggtcggtttcggtaggtatgcgtaggcgttttgtttgttacgcgttacgttcgtttttacgcgtttggtggcgtgtttttggcgcgaagtgttaagagtttgggtgtttttgtgcgttggggcgaaggagagagtggcgggggtaggggggcgttgatgcgttacgtggacgttatagttaattttaggtcgaggcgtatttatagtttttttcggcgtttcggggtgcgacgtgtttattgaggttcgatcgggttttgacggtttgagcggtttttcgaagcgcgtgtgcggtttgtaaattttggtcgcggtttttcgtggcgttttgtttcgcggtgagtatagacgataagtttttagtaaaatggttgttggaaagagtcgttaagtagggggagtgttggggtcgcgtgaaggttatatgacgaggttggtagcgcgtgttgttggcgcggggtagggggagggtggggggcgtggcgggttacgtgttttcgattgcgtcggtttgtggttttttagcgtttttgttgcggtcggattgtttgtttttattttttttatatcgaagcgtggtaagcgtcggtgagaagttgtgtggtgtattgggatgagtcgagatttgggaattcggaggtttggggtttaggtttttggttagttttatt

SEQ ID NO: 30286 - DNA, 832 bp, Artificial Sequence
  chemically treated genomic DNA (Homo sapiens) CpG-island No: 30286
aataaaactaaccaaaaacctaaaccccaaacctccgaattcccaaatctcgactcatcccaatacaccacacaacttctcaccgacgcttaccacgcttcgatataaaaaaaataaaaacaaacaatccgaccgcaacaaaaacgctaaaaaaccacaaaccgacgcaatcgaaaacacgtaacccgccacgccccccaccctccccctaccccgcgccaacaacacgcgctaccaacctcgtcatataaccttcacgcgaccccaacactccccctacttaacgactctttccaacaaccattttactaaaaacttatcgtctatactcaccgcgaaacaaaacgccacgaaaaaccgcgaccaaaatttacaaaccgcacacgcgcttcgaaaaaccgctcaaaccgtcaaaacccgatcgaacctcaataaacacgtcgcaccccgaaacgccgaaaaaaactataaatacgcctcgacctaaaattaactataacgtccacgtaacgcatcaacgcccccctacccccgccactctctccttcgccccaacgcacaaaaacacccaaactcttaacacttcgcgccaaaaacacgccaccaaacgcgtaaaaacgaacgtaacgcgtaacaaacaaaacgcctacgcatacctaccgaaaccgaccgcaaccgacccacgcgccgctccgttcgcgaatcccgaaatcctcgcgctactaaaccacccgactaatcattaactaccaattcgaatcacgtactaatcgcaaacccgcccctacccgctaatcacctaacaccgaactcgaaacgacgccgaatcgtt

SEQ ID NO: 30287 - DNA, 832 bp, Artificial Sequence
  chemically treated genomic DNA (Homo sapiens) CpG-island No: 30287
gatgaaattagttaaaggtttggattttaggttttcgaatttttagatttcggtttattttagtatattatatagttttttatcgacgtttgttacgtttcgatgtgggaggagtaaaaataggtaattcgatcgtagtaaagacgttggaaaattataggtcggcgtagtcgaaggtacgtgattcgttacgttttttattttttttttatttcgcgttagtagtacgcgttgttaatttcgttatgtgatttttacgcggttttagtattttttttgtttggcgattttttttagtagttattttgttgagaatttgtcgtttgtgtttatcgcggagtaggacgttacgaaaagtcgcggttagaatttataggtcgtatacgcgtttcgaaagatcgtttaggtcgttagggttcggtcgaattttagtgaatacgtcgtatttcggggcgtcggggaaagttgtgggtgcgtttcggtttgagattggttgtggcgtttacgtgacgtattagcgtttttttgttttcgttattttttttttcgttttaacgtataaaaatatttagatttttaatatttcgcgttaagaatacgttattaggcgcgtggggacgggcgtagcgcgtggtaagtaaggcgtttgcgtatatttgtcggggtcgatcgtaatcgatttacgcgtcgtttcgttcgcgggtttcggaattttcgcgttgttggattattcggttagttattggttgttagttcgggttacgtgttggtcgtaagttcgtttttattcgttaattatttggtatcgagttcgaagcggcgtcgagtcgtt

SEQ ID NO: 30288 - DNA, 832 bp, Artificial Sequence
  chemically treated genomic DNA (Homo sapiens) CpG-island No: 30288
aacgactcgacgccgcttcgaactcgataccaaataattaacgaataaaaacgaacttacgaccaacacgtaacccgaactaacaaccaataactaaccgaataatccaacaacgcgaaaattccgaaacccgcgaacgaaacgacgcgtaaatcgattacgatcgaccccgacaaatatacgcaaacgccttacttaccacgcgctacgcccgtccccacgcgcctaataacgtattcttaacgcgaaatattaaaaatctaaatatttttatacgttaaaacgaaaaaaaaaataacgaaaacaaaaaaacgctaatacgtcacgtaaacgccacaaccaatctcaaaccgaaacgcacccacaactttccccgacgccccgaaatacgacgtattcactaaaattcgaccgaaccctaacgacctaaacgatctttcgaaacgcgtatacgacctataaattctaaccgcgacttttcgtaacgtcctactccgcgataaacacaaacgacaaattctcaacaaaataactactaaaaaaaatcgccaaacaaaaaaaatactaaaaccgcgtaaaaatcacataacgaaattaacaacgcgtactactaacgcgaaataaaaaaaaaataaaaaacgtaacgaatcacgtaccttcgactacgccgacctataattttccaacgtctttactacgatcgaattacctatttttactcctcccacatcgaaacgtaacaaacgtcgataaaaaactatataatatactaaaataaaccgaaatctaaaaattcgaaaacctaaaatccaaacctttaactaatttcatc

SEQ ID NO: 30289 - DNA, 636 bp, Artificial Sequence
  chemically treated genomic DNA (Homo sapiens) CpG-island No: 30289
ggggtacgtcgggggaaggcgttgggtagtagggatcgcggacgtacgaggtcgggttaaggcgtttagagtcgggtcgggtagggtttcgatgttagagtgaaggggtcgataggggagaacgaattcgggaaatttttttcggtgatattttaagtgtcgtatgatgcgttagttgattaggggtttttattttttttttttttattgatttcgtaattattgattacgtaatcgttgtttacgtcgttattttatttttttagtttttgtattgcgggatgtagtagtatttgttttcgaattggttcgtgtttacgtgtttttttattttttttgatagcgatttttataaggcgcggaataaattttgagattaatttatgtcgtttatttagtttttagcgttgttagtagcgggattcgtagtaggggtaatgttttagtcgtcgatttagtttatcgaggcggagaagttaggtcggtttttattttggagtttttttagtaacggcgtttattattggtcggatatattatcgattgattaatgggagattttgttgttttagtttcgtttttgagttttgttatggcgacgtttagtgttttagtcggtgtgaggatacgatatgt

SEQ ID NO: 30290 - DNA, 636 bp, Artificial Sequence
  chemically treated genomic DNA (Homo sapiens) CpG-island No: 30290
acatatcgtatcctcacaccgactaaaacactaaacgtcgccataacaaaactcaaaaacgaaactaaaacaacaaaatctcccattaatcaatcgataatatatccgaccaataataaacgccgttactaaaaaaactccaaaataaaaaccgacctaacttctccgcctcgataaactaaatcgacgactaaaacattacccctactacgaatcccgctactaacaacgctaaaaactaaataaacgacataaattaatctcaaaatttattccgcgccttataaaaatcgctatcaaaaaaaataaaaaaacacgtaaacacgaaccaattcgaaaacaaatactactacatcccgcaatacaaaaactaaaaaaataaaataacgacgtaaacaacgattacgtaatcaataattacgaaatcaataaaaaaaaaaaaaataaaaacccctaatcaactaacgcatcatacgacacttaaaatatcaccgaaaaaaatttcccgaattcgttctcccctatcgaccccttcactctaacatcgaaaccctacccgacccgactctaaacgccttaacccgacctcgtacgtccgcgatccctactacccaacgccttcccccgacgtacccc

SEQ ID NO: 30291 - DNA, 636 bp, Artificial Sequence
  chemically treated genomic DNA (Homo sapiens) CpG-island No: 30291
gtatatcgtgtttttatatcggttggagtattggacgtcgttatgatagagtttaggggcgggattggaatagtagagttttttattggttagtcggtgatatattcggttaatggtgagcgtcgttattagaagggttttaggatggaggtcgatttgattttttcgtttcggtgggttgggtcggcggttggagtattatttttattgcgggtttcgttgttggtagcgttggaaattgggtggacggtatgggttggttttaggatttgtttcgcgttttgtggagatcgttgttaagggaagtgaaggagtacgtgggtacggattaattcgggaataaatattattatatttcgtagtataagaattggagaggtgaggtggcggcgtgggtagcgattgcgtggttagtgattgcgaggttagtaaaggagggaaaagtgagagtttttagttaattaacgtattatgcgatatttagggtgttatcggagagaatttttcgagttcgtttttttttgtcgatttttttattttggtatcggagttttattcggttcggttttgggcgttttggttcggtttcgtgcgttcgcggtttttattatttagcgttttttttcggcgtgtttt

SEQ ID NO: 30292 - DNA, 636 bp, Artificial Sequence
  chemically treated genomic DNA (Homo sapiens) CpG-island No: 30292
aaaacacgccgaaaaaaaacgctaaataataaaaaccgcgaacgcacgaaaccgaaccaaaacgcccaaaaccgaaccgaataaaactccgataccaaaataaaaaaatcgacaaaaaaaaacgaactcgaaaaattctctccgataacaccctaaatatcgcataatacgttaattaactaaaaactctcacttttccctcctttactaacctcgcaatcactaaccacgcaatcgctacccacgccgccacctcacctctccaattcttatactacgaaatataataatatttattcccgaattaatccgtacccacgtactccttcacttcccttaacaacgatctccacaaaacgcgaaacaaatcctaaaaccaacccataccgtccacccaatttccaacgctaccaacaacgaaacccgcaataaaaataatactccaaccgccgacccaacccaccgaaacgaaaaaatcaaatcgacctccatcctaaaacccttctaataacgacgctcaccattaaccgaatatatcaccgactaaccaataaaaaactctactattccaatcccgcccctaaactctatcataacgacgtccaatactccaaccgatataaaaacacgatatac

SEQ ID NO: 30293 - DNA, 600 bp, Artificial Sequence
  chemically treated genomic DNA (Homo sapiens) CpG-island No: 30293
cgatgggcggaatcgtaatggggttcgtgaggattgtttttttagtttcgtatttttttagattcgaggataagggattggagaatgttttgattaaatttcgttttatcgggataaacggggaaaggaaggttagaaggagcggtgttcgattttaggcgtggagatagtagtcggattgaggagtcgttttagattttggtgtttgttagttcgtttgttcgtcgtcgtcgggattatcgggtagtcgcggtcgaaggtttatcgtaaggtcggattgagtttggttgtgtcgaggcgggttttttaaaacggagatcggatgggggttattaggatacgttttttaataaagcgttgaacgggaagcggtcgtttttttaatattttttatattcgggtacgtgataaatttcgcgtcggaagttgatcgcgtagagaaggaagaagtagcgatgggagaaaaagggagcggttaatagacgcggaggggcggggcgttaatcgacgggcgtggttaggcggaataaggttttattggaggggcgtgttagggaagggtaggggcggggtttttgtggtatagaaattgatttggga

SEQ ID NO: 30294 - DNA, 600 bp, Artificial Sequence
  chemically treated genomic DNA (Homo sapiens) CpG-island No: 30294
tcccaaatcaatttctataccacaaaaaccccgcccctacccttccctaacacgcccctccaataaaaccttattccgcctaaccacgcccgtcgattaacgccccgcccctccgcgtctattaaccgctccctttttctcccatcgctacttcttccttctctacgcgatcaacttccgacgcgaaatttatcacgtacccgaatataaaaaatattaaaaaaacgaccgcttcccgttcaacgctttattaaaaaacgtatcctaataacccccatccgatctccgttttaaaaaacccgcctcgacacaaccaaactcaatccgaccttacgataaaccttcgaccgcgactacccgataatcccgacgacgacgaacaaacgaactaacaaacaccaaaatctaaaacgactcctcaatccgactactatctccacgcctaaaatcgaacaccgctccttctaaccttcctttccccgtttatcccgataaaacgaaatttaatcaaaacattctccaatcccttatcctcgaatctaaaaaaatacgaaactaaaaaaacaatcctcacgaaccccattacgattccgcccatcg

SEQ ID NO: 30295 - DNA, 600 bp, Artificial Sequence
  chemically treated genomic DNA (Homo sapiens) CpG-island No: 30295
ttttaagttagtttttgtgttataaaggtttcgtttttgtttttttttgatacgtttttttaatgaggttttgtttcgtttggttacgttcgtcggttggcgtttcgttttttcgcgtttattggtcgtttttttttttttttatcgttgttttttttttttttacgcggttaattttcggcgcggagtttgttacgtgttcggatataggaagtgttgggggaacggtcgtttttcgtttaacgttttattgaggggcgtattttagtggtttttattcggttttcgttttggaagattcgtttcggtatagttaggtttagttcggttttgcggtaagttttcggtcgcggttgttcggtagtttcggcggcggcggatagacgagttgataggtattagggtttaaggcggttttttagttcggttgttgtttttacgtttggggtcgggtatcgttttttttgattttttttttttcgtttgtttcggtaagacgaagtttggttagagtattttttagttttttgttttcgggtttaggagaatgcggagttgggagggtagtttttacgggttttattacggtttcgtttatcg

SEQ ID NO: 30296 - DNA, 600 bp, Artificial Sequence
  chemically treated genomic DNA (Homo sapiens) CpG-island No: 30296
cgataaacgaaaccgtaataaaacccgtaaaaactaccctcccaactccgcattctcctaaacccgaaaacaaaaaactaaaaaatactctaaccaaacttcgtcttaccgaaacaaacgaaaaaaaaaaaatcaaaaaaaacgatacccgaccccaaacgtaaaaacaacaaccgaactaaaaaaccgccttaaaccctaatacctatcaactcgtctatccgccgccgccgaaactaccgaacaaccgcgaccgaaaacttaccgcaaaaccgaactaaacctaactataccgaaacgaatcttccaaaacgaaaaccgaataaaaaccactaaaatacgcccctcaataaaacgttaaacgaaaaacgaccgttcccccaacacttcctatatccgaacacgtaacaaactccgcgccgaaaattaaccgcgtaaaaaaaaaaaaaacaacgataaaaaaaaaaaaaaacgaccaataaacgcgaaaaaacgaaacgccaaccgacgaacgtaaccaaacgaaacaaaacctcattaaaaaaacgtatcaaaaaaaaacaaaaacgaaacctttataacacaaaaactaacttaaaa

SEQ ID NO: 30297 - DNA, 970 bp, Artificial Sequence
  chemically treated genomic DNA (Homo sapiens) CpG-island No: 30297
cgggattcgaagcgtttttttttcgttttcgttttgtttcgcggggtcgcggtcgggcgttttatcgtgatgttgtagtggagcgtgagtggcggcggtagcgagtgcgggttgttttgttgcggtattaggaattggtagtgtagttcgtttagtttttaattgacgatgcggaatcgttcgtggtttttgtcgaagatggacgttaggaattttagttcggttttgagttttgatacggatattttttttttattttcggcgggaggggcgcggaaggggagtcgggcgcggaaggggagtcgggttcggagtcgtcgttacggtcgcgatcgtttcgcggggtcggtttgggtcgcgttttcgcggtttcgtttcgtcgagcgttgttggaaaatggcgaggggcgcggaagtttcggcgtgtggcggtttgggtggcgttttttttgtaatcgattttagcggtaggaggcggcggtttcgcggtttaaaagggtaatagcgacgtcgttttcgttatcgtttgggaaagggttgtttttatttcgttttcgttttttttattttggcgcgttttgcgcgtttcggttttagcgcgtgtacgaggttagagcgcgcgcgttcggtcgtttttttttcgttttgatttagtttttttgttttcgatttatttgtttcgtttttcgtattcgcggattggaggttcggggttagttggcgttcgggttttagaagtcggggaggagtcggagattttcgcgcgttttcgttttcggtttggagtcggatacgtgcgtggcggatcgcgtcggttacgtcggcgtcgttgtagattagcgttagtttttgggggcggttttttagtttggcgttcggcgcggtattcgttaattttattggggggatttcgtgggagacgcgggtgcggtttatttagcgttattttcgttatttttattttagttcga

SEQ ID NO: 30298 - DNA, 970 bp, Artificial Sequence
  chemically treated genomic DNA (Homo sapiens) CpG-island No: 30298
tcgaactaaaataaaaataacgaaaataacgctaaataaaccgcacccgcgtctcccacgaaatccccccaataaaattaacgaataccgcgccgaacgccaaactaaaaaaccgcccccaaaaactaacgctaatctacaacgacgccgacgtaaccgacgcgatccgccacgcacgtatccgactccaaaccgaaaacgaaaacgcgcgaaaatctccgactcctccccgacttctaaaacccgaacgccaactaaccccgaacctccaatccgcgaatacgaaaaacgaaacaaataaatcgaaaacaaaaaaactaaatcaaaacgaaaaaaaaacgaccgaacgcgcgcgctctaacctcgtacacgcgctaaaaccgaaacgcgcaaaacgcgccaaaataaaaaaaacgaaaacgaaataaaaacaaccctttcccaaacgataacgaaaacgacgtcgctattacccttttaaaccgcgaaaccgccgcctcctaccgctaaaatcgattacaaaaaaaacgccacccaaaccgccacacgccgaaacttccgcgcccctcgccattttccaacaacgctcgacgaaacgaaaccgcgaaaacgcgacccaaaccgaccccgcgaaacgatcgcgaccgtaacgacgactccgaacccgactccccttccgcgcccgactccccttccgcgcccctcccgccgaaaataaaaaaaaaatatccgtatcaaaactcaaaaccgaactaaaattcctaacgtccatcttcgacaaaaaccacgaacgattccgcatcgtcaattaaaaactaaacgaactacactaccaattcctaataccgcaacaaaacaacccgcactcgctaccgccgccactcacgctccactacaacatcacgataaaacgcccgaccgcgaccccgcgaaacaaaacgaaaacgaaaaaaaaacgcttcgaatcccg

SEQ ID NO: 30299 - DNA, 970 bp, Artificial Sequence
  chemically treated genomic DNA (Homo sapiens) CpG-island No: 30299
tcggattagggtgaaagtagcggaggtaacgttgggtgagtcgtattcgcgttttttacgaggtttttttagtgaggttagcgggtgtcgcgtcgagcgttaagttgaggagtcgtttttaggggttggcgttagtttgtagcggcgtcgacgtggtcggcgcgattcgttacgtacgtgttcggttttaggtcgggggcgggggcgcgcgggggttttcggttttttttcgatttttggggttcgggcgttagttggtttcgagtttttagttcgcgggtgcgaagaacggagtagatgggtcgggaataagggagttgggttaaggcgaggagggggcggtcgggcgcgcgcgttttggtttcgtgtacgcgttgaaatcggagcgcgtagggcgcgttagggtgagggggacgggggcggggtgggggtagtttttttttaggcggtagcgggggcggcgtcgttgttgtttttttaagtcgcggggtcgtcgttttttgtcgttggagtcggttataaaggaagcgttatttaggtcgttatacgtcgaggttttcgcgtttttcgttattttttagtagcgttcgacgaggcggagtcgcgagagcgcggtttaggtcggtttcgcggggcggtcgcggtcgtgacggcggtttcgggttcggtttttttttcgcgttcggtttttttttcgcgtttttttcgtcggagatgaggggaagatgttcgtgttagggtttaaggtcgagttgaagtttttggcgtttattttcgataagaattacgagcgatttcgtatcgttagttggaagttggacgagttgtattgttagtttttggtgtcgtagtagggtagttcgtattcgttgtcgtcgttatttacgttttattgtaatattacggtgaggcgttcggtcgcggtttcgcggggtagggcgaggacggagagggggcgtttcgagtttcg

SEQ ID NO: 30300 - DNA, 970 bp, Artificial Sequence
  chemically treated genomic DNA (Homo sapiens) CpG-island No: 30300
cgaaactcgaaacgccccctctccgtcctcgccctaccccgcgaaaccgcgaccgaacgcctcaccgtaatattacaataaaacgtaaataacgacgacaacgaatacgaactaccctactacgacaccaaaaactaacaatacaactcgtccaacttccaactaacgatacgaaatcgctcgtaattcttatcgaaaataaacgccaaaaacttcaactcgaccttaaaccctaacacgaacatcttcccctcatctccgacgaaaaaaacgcgaaaaaaaaaccgaacgcgaaaaaaaaaccgaacccgaaaccgccgtcacgaccgcgaccgccccgcgaaaccgacctaaaccgcgctctcgcgactccgcctcgtcgaacgctactaaaaaataacgaaaaacgcgaaaacctcgacgtataacgacctaaataacgcttcctttataaccgactccaacgacaaaaaacgacgaccccgcgacttaaaaaaacaacaacgacgccgcccccgctaccgcctaaaaaaaaactacccccaccccgcccccgtccccctcaccctaacgcgccctacgcgctccgatttcaacgcgtacacgaaaccaaaacgcgcgcgcccgaccgccccctcctcgccttaacccaactcccttattcccgacccatctactccgttcttcgcacccgcgaactaaaaactcgaaaccaactaacgcccgaaccccaaaaatcgaaaaaaaaccgaaaacccccgcgcgcccccgcccccgacctaaaaccgaacacgtacgtaacgaatcgcgccgaccacgtcgacgccgctacaaactaacgccaacccctaaaaacgactcctcaacttaacgctcgacgcgacacccgctaacctcactaaaaaaacctcgtaaaaaacgcgaatacgactcacccaacgttacctccgctactttcaccctaatccga

SEQ ID NO: 30301 - DNA, 831 bp, Artificial Sequence
  chemically treated genomic DNA (Homo sapiens) CpG-island No: 30301
gcggtcgttcgtatgtgcgaggtggaggtaaagtttgataaatgatgattatttcgggaaggggaagaatttaggtagttaaaaattcgcgcggggtgtgttagggaagaagtcgcgttaggaagcgttacgtattttgttgcggtgttaggcgcggaggttgaggagagagtcggtggaggtggcggggcgagagtttagttttggtcgcgggttttttttcggggcgagcggagtcgtcgtcgtcgcggtcgggcgtagggtcgagcggtcgtcgtttcgttaaaggcgttgggtaacgttatttatttggttcggggaagttgggtagttttcgtcgcggtttcggtattcggcgagagtaatacgtttagtttgaattttttagttttagtttcggtaaatttatatttacgtatatacgcgcgcgcgcggatagttttttagaggcgcgcgagcgggtttcggtggttttttggtcgcgttttgttttttttttcgtttttattggcgcggaggtgattgttttatttatttatttttttttttcggttttatttttttttttcgcgttttttttttcggtttttttttttttttttttttttcggtttgcggggtcggtcgcggcggtcgttttagttgtagcgtggcggggttgcgcggcgggattcggcgggggcgtaacgggtgggggcgtttcgggcgggggcgcggggtcgggcgggcggggacgtcggggttgtcgttttggttgaggtgagggaatgtgggggaggcgaggggaggacgttgtcgtttgtcgtattgtgttgtgtcgggggtatttag

SEQ ID NO: 30302 - DNA, 831 bp, Artificial Sequence
  chemically treated genomic DNA (Homo sapiens) CpG-island No: 30302
ctaaatacccccgacacaacacaatacgacaaacgacaacgtcctcccctcgcctcccccacattccctcacctcaaccaaaacgacaaccccgacgtccccgcccgcccgaccccgcgcccccgcccgaaacgcccccacccgttacgcccccgccgaatcccgccgcgcaaccccgccacgctacaactaaaacgaccgccgcgaccgaccccgcaaaccgaaaaaaaaaaaaaaaaaaaaaaaccgaaaaaaaaaacgcgaaaaaaaaaaataaaaccgaaaaaaaaaaataaataaataaaacaatcacctccgcgccaataaaaacgaaaaaaaaaacaaaacgcgaccaaaaaaccaccgaaacccgctcgcgcgcctctaaaaaactatccgcgcgcgcgcgtatatacgtaaatataaatttaccgaaactaaaactaaaaaattcaaactaaacgtattactctcgccgaataccgaaaccgcgacgaaaactacccaacttccccgaaccaaataaataacgttacccaacgcctttaacgaaacgacgaccgctcgaccctacgcccgaccgcgacgacgacgactccgctcgccccgaaaaaaaacccgcgaccaaaactaaactctcgccccgccacctccaccgactctctcctcaacctccgcgcctaacaccgcaacaaaatacgtaacgcttcctaacgcgacttcttccctaacacaccccgcgcgaatttttaactacctaaattcttccccttcccgaaataatcatcatttatcaaactttacctccacctcgcacatacgaacgaccgc

SEQ ID NO: 30303 - DNA, 831 bp, Artificial Sequence
  chemically treated genomic DNA (Homo sapiens) CpG-island No: 30303
ttgggtgttttcggtatagtatagtgcggtaggcggtagcgtttttttttcgttttttttatatttttttattttagttaaggcggtagtttcggcgttttcgttcgttcggtttcgcgttttcgttcggagcgtttttattcgttgcgttttcgtcgggtttcgtcgcgtagtttcgttacgttgtagttggagcgatcgtcgcggtcggtttcgtagatcggggaggaggaggaggaggggaagtcggagagggaggcgcggggaggagggatggagtcgggaggaggaaataaataaataaaataattattttcgcgttaataagagcgagggagagagtaagacgcgattagagagttatcggggttcgttcgcgcgtttttgagaggttgttcgcgcgcgcgcgtgtgtgcgtgagtgtggatttgtcgggattggagttggaaagtttaaattaaacgtgttgttttcgtcgagtgtcgaggtcgcggcggaggttgtttaattttttcgggttaagtgagtggcgttgtttagcgtttttggcgaggcggcggtcgttcggttttgcgttcggtcgcggcggcggcggtttcgttcgtttcgggagggagttcgcggttagggttggattttcgtttcgttatttttatcgattttttttttagttttcgcgtttggtatcgtagtaaggtacgtggcgttttttggcgcggttttttttttagtatatttcgcgcggatttttggttgtttagatttttttttttttcggagtggttattatttgttaaattttatttttatttcgtatatgcgggcggtcgt

SEQ ID NO: 30304 - DNA, 831 bp, Artificial Sequence
  chemically treated genomic DNA (Homo sapiens) CpG-island No: 30304
acgaccgcccgcatatacgaaataaaaataaaatttaacaaataataaccactccgaaaaaaaaaaaaatctaaacaaccaaaaatccgcgcgaaatatactaaaaaaaaaaccgcgccaaaaaacgccacgtaccttactacgataccaaacgcgaaaactaaaaaaaaaatcgataaaaataacgaaacgaaaatccaaccctaaccgcgaactccctcccgaaacgaacgaaaccgccgccgccgcgaccgaacgcaaaaccgaacgaccgccgcctcgccaaaaacgctaaacaacgccactcacttaacccgaaaaaattaaacaacctccgccgcgacctcgacactcgacgaaaacaacacgtttaatttaaactttccaactccaatcccgacaaatccacactcacgcacacacgcgcgcgcgcgaacaacctctcaaaaacgcgcgaacgaaccccgataactctctaatcgcgtcttactctctccctcgctcttattaacgcgaaaataattattttatttatttatttcctcctcccgactccatccctcctccccgcgcctccctctccgacttcccctcctcctcctcctccccgatctacgaaaccgaccgcgacgatcgctccaactacaacgtaacgaaactacgcgacgaaacccgacgaaaacgcaacgaataaaaacgctccgaacgaaaacgcgaaaccgaacgaacgaaaacgccgaaactaccgccttaactaaaataaaaaaatataaaaaaaacgaaaaaaaaacgctaccgcctaccgcactatactataccgaaaacacccaa

SEQ ID NO: 30305 - DNA, 603 bp, Artificial Sequence
  chemically treated genomic DNA (Homo sapiens) CpG-island No: 30305
cgttgattcggtttttagagggcgattgggaggtcggatttgggcgtttagagttgggtgggtagcggggggcggtttggggttagggttaggtcggttcgcggttttcggaggagtcggtgggattcggggcggtttcgaagtttcgtcgatttcgtggttttcggttgcgggcgttcgcgtaggataaagacgaaagagggaagcggttcggggcgaggttttttggtgttcgcgtgggtcgtcgggtcgtttagttttttatttttgtcgtttttttcgttcggcgcgcggcggtcgttatcgttttagttacgggtagcgcgcgaaatggcgtttattaggtcgtcgcgttcggttgaggcgagcgcgggaggcgcggcgcgcgacgttttcgaggtttacggttttcgaaacggttttcgatattcggtcgttagcgttgcgtttcgcgggttttcggggttcgatttggtcgcgggttcgttttttgtttcgggttttttacgatcggggggacggaggaaaggaggaaggaaggaaagagagtcgtcgttattagtaaagtagttttgttcggttgggttcgtttgttagattagt

SEQ ID NO: 30306 - DNA, 603 bp, Artificial Sequence
  chemically treated genomic DNA (Homo sapiens) CpG-island No: 30306
actaatctaacaaacgaacccaaccgaacaaaactactttactaataacgacgactctctttccttccttcctcctttcctccgtccccccgatcgtaaaaaacccgaaacaaaaaacgaacccgcgaccaaatcgaaccccgaaaacccgcgaaacgcaacgctaacgaccgaatatcgaaaaccgtttcgaaaaccgtaaacctcgaaaacgtcgcgcgccgcgcctcccgcgctcgcctcaaccgaacgcgacgacctaataaacgccatttcgcgcgctacccgtaactaaaacgataacgaccgccgcgcgccgaacgaaaaaaacgacaaaaataaaaaactaaacgacccgacgacccacgcgaacaccaaaaaacctcgccccgaaccgcttccctctttcgtctttatcctacgcgaacgcccgcaaccgaaaaccacgaaatcgacgaaacttcgaaaccgccccgaatcccaccgactcctccgaaaaccgcgaaccgacctaaccctaaccccaaaccgccccccgctacccacccaactctaaacgcccaaatccgacctcccaatcgccctctaaaaaccgaatcaacg

SEQ ID NO: 30307 - DNA, 603 bp, Artificial Sequence
  chemically treated genomic DNA (Homo sapiens) CpG-island No: 30307
gttggtttggtaggcgggtttagtcgggtagggttgttttgttaatggcggcggttttttttttttttttttttttttttttcgttttttcggtcgtggggagttcggagtaggaggcgggttcgcggttaggtcgggtttcgagagttcgcggggcgtagcgttggcgatcgggtgtcgggggtcgtttcgggggtcgtgggtttcgggggcgtcgcgcgtcgcgtttttcgcgttcgttttagtcgggcgcggcggtttgatgggcgttatttcgcgcgttgttcgtggttggggcggtggcggtcgtcgcgcgtcgggcgggaggagcggtaggggtagggggttgggcgattcggcggtttacgcgggtattaggaggtttcgtttcggatcgtttttttttttcgtttttgttttgcgcgggcgttcgtagtcgagggttacggggtcggcggggtttcgaggtcgtttcgggttttatcggttttttcggaagtcgcggatcggtttggttttgattttaggtcgtttttcgttgtttatttagttttgggcgtttaggttcgattttttagtcgttttttgagagtcgagttagcg

SEQ ID NO: 30308 - DNA, 603 bp, Artificial Sequence
  chemically treated genomic DNA (Homo sapiens) CpG-island No: 30308
cgctaactcgactctcaaaaaacgactaaaaaatcgaacctaaacgcccaaaactaaataaacaacgaaaaacgacctaaaatcaaaaccaaaccgatccgcgacttccgaaaaaaccgataaaacccgaaacgacctcgaaaccccgccgaccccgtaaccctcgactacgaacgcccgcgcaaaacaaaaacgaaaaaaaaaaacgatccgaaacgaaacctcctaatacccgcgtaaaccgccgaatcgcccaaccccctacccctaccgctcctcccgcccgacgcgcgacgaccgccaccgccccaaccacgaacaacgcgcgaaataacgcccatcaaaccgccgcgcccgactaaaacgaacgcgaaaaacgcgacgcgcgacgcccccgaaacccacgacccccgaaacgacccccgacacccgatcgccaacgctacgccccgcgaactctcgaaacccgacctaaccgcgaacccgcctcctactccgaactccccacgaccgaaaaaacgaaaaaaaaaaaaaaaaaaaaaaaaaaaaccgccgccattaacaaaacaaccctacccgactaaacccgcctaccaaaccaac

SEQ ID NO: 30309 - DNA, 916 bp, Artificial Sequence
  chemically treated genomic DNA (Homo sapiens) CpG-island No: 30309
ttcggggttttggcggcgtagttgtcgtcgtcgggagagtgtttggggaagcggcgaggaaggagaggggaggaggaagaggaggaggaggaggaagaggaggagggtgagcgttcgggtcgggttttttagcggtgtattgtgggatgtgcggttattgggagtcgagttttcgtcgttagtcgtttttcgggtagtagtagtagtagcggcggcggtagcggtagtagtttcgggttcggtagtcgcggcggcggcgttttttttttttggttttcggttcggtcgtttcggtttcggttttttcgggggatattatgtattggttggcggcgtagggaggtcggcgttcggcggggatgtaagcgcggttcggggagggagaggtcgcggtcggtagtcgggcggtttaagttttcggtttcggttttggttcgagcgggcgagcgggcgggcgggcggcggcgtcgttaggttttgtcgttagtttcgcgttagagtcgggtcgagttagcgggtgagcgttacgtcgggcggtcgggcgggtattatgggtcggagttcgcgtttttcgggcgtttcgggtttcgttagttcgtttaggggattttcgggagtttttcgttgtcgtttcgagacggtggtcgagcgggcgggcgcgtaattttttcggaagggttattttttcgttttatttttgttttggggggagttagcgagatagtttttttcggggcgcgttggtaaggtgggagggggtgggggtttgtcgattggattttttcgcgtgtgtgtagaagcggtcgtcgtcgtcgtcgcggcggagacgataataatttgttggtttttaggttgggttaacggtatggagaatagttattttttttattattattattagtagttttcgtcgtag

SEQ ID NO: 30310 - DNA, 916 bp, Artificial Sequence
  chemically treated genomic DNA (Homo sapiens) CpG-island No: 30310
ctacgacgaaaactactaataataataataaaaaaaataactattctccataccgttaacccaacctaaaaaccaacaaattattatcgtctccgccgcgacgacgacgacgaccgcttctacacacacgcgaaaaaatccaatcgacaaacccccaccccctcccaccttaccaacgcgccccgaaaaaaactatctcgctaactccccccaaaacaaaaataaaacgaaaaaataacccttccgaaaaaattacgcgcccgcccgctcgaccaccgtctcgaaacgacaacgaaaaactcccgaaaatcccctaaacgaactaacgaaacccgaaacgcccgaaaaacgcgaactccgacccataatacccgcccgaccgcccgacgtaacgctcacccgctaactcgacccgactctaacgcgaaactaacgacaaaacctaacgacgccgccgcccgcccgcccgctcgcccgctcgaaccaaaaccgaaaccgaaaacttaaaccgcccgactaccgaccgcgacctctccctccccgaaccgcgcttacatccccgccgaacgccgacctccctacgccgccaaccaatacataatatcccccgaaaaaaccgaaaccgaaacgaccgaaccgaaaaccaaaaaaaaaaaacgccgccgccgcgactaccgaacccgaaactactaccgctaccgccgccgctactactactactacccgaaaaacgactaacgacgaaaactcgactcccaataaccgcacatcccacaatacaccgctaaaaaacccgacccgaacgctcaccctcctcctcttcctcctcctcctcctcttcctcctcccctctccttcctcgccgcttccccaaacactctcccgacgacgacaactacgccgccaaaaccccgaa

SEQ ID NO: 30311 - DNA, 916 bp, Artificial Sequence
  chemically treated genomic DNA (Homo sapiens) CpG-island No: 30311
ttgcggcgggggttgttggtggtggtggtggggggggtgattgttttttatgtcgttaatttaatttgaaaattagtaagttgttgtcgttttcgtcgcggcggcggcggcggtcgtttttatatatacgcgaaagaatttaatcggtaggtttttatttttttttattttgttagcgcgtttcgaaaggagttgtttcgttggttttttttaaaataagaatggagcgagagaataattttttcgggagaattacgcgttcgttcgttcggttatcgtttcggggcggtagcgaggggttttcgggggttttttgggcgggttggcggggttcggggcgttcggaggacgcggatttcggtttatggtgttcgttcggtcgttcggcgtggcgtttattcgttagttcggttcggttttggcgcgaggttggcggtagggtttggcggcgtcgtcgttcgttcgttcgttcgttcgttcgggttagggtcggggtcgggggtttgggtcgttcggttgtcggtcgcggttttttttttttcgagtcgcgtttatattttcgtcgggcgtcggtttttttgcgtcgttagttagtatatggtgtttttcgagggagtcgaggtcggggcggtcggatcgggggttaggaagggggggcgtcgtcgtcgcggttgtcgggttcggagttgttgtcgttgtcgtcgtcgttgttgttgttgttgttcgggaggcggttggcggcggaggttcggtttttagtagtcgtatattttataatatatcgttaaggagttcgattcgagcgtttatttttttttttttttttttttttttttttttttttttttttttttttttttcgtcgtttttttaggtattttttcggcggcggtagttgcgtcgttaaagtttcggg

SEQ ID NO: 30312 - DNA, 916 bp, Artificial Sequence
  chemically treated genomic DNA (Homo sapiens) CpG-island No: 30312
cccgaaactttaacgacgcaactaccgccgccgaaaaaatacctaaaaaaacgacgaaaaaaaaaaaaaaaaaaaaaaaaaaaaaaaaaaaaaaaaaaaaaaaaaaataaacgctcgaatcgaactccttaacgatatattataaaatatacgactactaaaaaccgaacctccgccgccaaccgcctcccgaacaacaacaacaacaacgacgacgacaacgacaacaactccgaacccgacaaccgcgacgacgacgcccccccttcctaacccccgatccgaccgccccgacctcgactccctcgaaaaacaccatatactaactaacgacgcaaaaaaaccgacgcccgacgaaaatataaacgcgactcgaaaaaaaaaaaaccgcgaccgacaaccgaacgacccaaacccccgaccccgaccctaacccgaacgaacgaacgaacgaacgaacgacgacgccgccaaaccctaccgccaacctcgcgccaaaaccgaaccgaactaacgaataaacgccacgccgaacgaccgaacgaacaccataaaccgaaatccgcgtcctccgaacgccccgaaccccgccaacccgcccaaaaaacccccgaaaacccctcgctaccgccccgaaacgataaccgaacgaacgaacgcgtaattctcccgaaaaaattattctctcgctccattcttattttaaaaaaaaccaacgaaacaactcctttcgaaacgcgctaacaaaataaaaaaaaataaaaacctaccgattaaattctttcgcgtatatataaaaacgaccgccgccgccgccgcgacgaaaacgacaacaacttactaattttcaaattaaattaacgacataaaaaacaatcaccccccccaccaccaccaccaacaacccccgccgcaa

SEQ ID NO: 30313 - DNA, 554 bp, Artificial Sequence
  chemically treated genomic DNA (Homo sapiens) CpG-island No: 30313
agggagattcgttgcggagcgtttaaattgaggtcgttttggtattttagtattttagggatttcgggtcgggttaggcgatttggggcgtttcgaatttatatttacgttttttagtacgttatagttggttttgatttgcgtttttattttttttttgcgtcgtattagtttttggacgtcgttgatagttacgacgtcggtttgcgaggagttttcgttttgtttcgttttttcgtcggatatcgtgaatttcgggtcgcgattttagagattcggttttcgggttagggacgacgttttagtcgatcgtaattacggtttcgtttatgcgttaaaatattatagtcgttcgcgaacgcgagaatagttaaggggcggggtttgggatggggtttagggcggagttgggttatcggaagtcgcgttttgtcggaatacgtgcgtttgtggtgattcggtaggagtagcgtcggaagtaatggatttttacgtaattgtatattaacgttaggggatgatttcgttttagttgatttatttttttattcgtg

SEQ ID NO: 30314 - DNA, 554 bp, Artificial Sequence
  chemically treated genomic DNA (Homo sapiens) CpG-island No: 30314
cacgaataaaaaaataaatcaactaaaacgaaatcatcccctaacgttaatatacaattacgtaaaaatccattacttccgacgctactcctaccgaatcaccacaaacgcacgtattccgacaaaacgcgacttccgataacccaactccgccctaaaccccatcccaaaccccgccccttaactattctcgcgttcgcgaacgactataatattttaacgcataaacgaaaccgtaattacgatcgactaaaacgtcgtccctaacccgaaaaccgaatctctaaaatcgcgacccgaaattcacgatatccgacgaaaaaacgaaacaaaacgaaaactcctcgcaaaccgacgtcgtaactatcaacgacgtccaaaaactaatacgacgcaaaaaaaaaataaaaacgcaaatcaaaaccaactataacgtactaaaaaacgtaaatataaattcgaaacgccccaaatcgcctaacccgacccgaaatccctaaaatactaaaataccaaaacgacctcaatttaaacgctccgcaacgaatctccct

SEQ ID NO: 30315 - DNA, 554 bp, Artificial Sequence
  chemically treated genomic DNA (Homo sapiens) CpG-island No: 30315
tacgaatgagaaaatgagttagttggggcgagattattttttagcgttggtgtgtaattgcgtggggatttattgttttcgacgttatttttgtcgggttattataggcgtacgtgtttcggtagggcgcggttttcggtgatttagtttcgttttaagttttattttaagtttcgttttttgattgttttcgcgttcgcggacggttgtggtgttttggcgtatgggcggagtcgtagttacggtcgattggggcgtcgtttttagttcgggagtcgggtttttggagtcgcggttcggggtttacgatgttcgacgaggaagcgaggtagagcggaggtttttcgtaggtcggcgtcgtgattgttagcgacgtttaggagttgatgcggcgtaaggaggagatagaagcgtagattaaggttaattatgacgtgttggaaagcgtgagtgtgggttcggggcgttttaagtcgtttaattcggttcggagtttttggggtattgggatgttagggcggttttagtttgggcgtttcgtaacggattttttt

SEQ ID NO: 30316 - DNA, 554 bp, Artificial Sequence
  chemically treated genomic DNA (Homo sapiens) CpG-island No: 30316
aaaaaaatccgttacgaaacgcccaaactaaaaccgccctaacatcccaataccccaaaaactccgaaccgaattaaacgacttaaaacgccccgaacccacactcacgctttccaacacgtcataattaaccttaatctacgcttctatctcctccttacgccgcatcaactcctaaacgtcgctaacaatcacgacgccgacctacgaaaaacctccgctctacctcgcttcctcgtcgaacatcgtaaaccccgaaccgcgactccaaaaacccgactcccgaactaaaaacgacgccccaatcgaccgtaactacgactccgcccatacgccaaaacaccacaaccgtccgcgaacgcgaaaacaatcaaaaaacgaaacttaaaataaaacttaaaacgaaactaaatcaccgaaaaccgcgccctaccgaaacacgtacgcctataataacccgacaaaaataacgtcgaaaacaataaatccccacgcaattacacaccaacgctaaaaaataatctcgccccaactaactcattttctcattcgta

SEQ ID NO: 30317 - DNA, 833 bp, Artificial Sequence
  chemically treated genomic DNA (Homo sapiens) CpG-island No: 30317
tcgttagggaatcgggatgttgttcgtttatttgaggtcgttggggttcgggttatcgtagaggtacgggtagggatacggatacgaatacgggatacggtaagggatcggatcggagttagcgttatcgtttttgcgagtagggaaggcggaagtcgcggtttagattttagggcgttgttgattttcgtttgggtcgtagggttcgcggggttggtttaaggttagtagcgtagtttcgcgcgtatttatcgggttcggacgatagggttatgtcgtcggtcgaaagggacggtcgtagggttggagtaaaggggacgcgttgggtagagcggagcggggttgttgggtattgaggttagtcggggttagggttcggttaggtcgcgtttcgtagtaggcgcgggggtcgggcgtttagagggcgtagcgttgcggattttcggttaggagggtttcgcgggaggagggagggtcgttttagtagggaggaagtcggttagtcgcgtgtagttttcgtcggtgttttatttgggcgcggagcggagtagagagagtcgagaggttatttgaagcgttcgggtcgcgtcgttaacgggaaatttgagagtagtaggggcgcggcggtcgttagggtttttggtcggaagtattcgtcgttttttgggtttcgcggggttcgcgtcgtagttcggagtagatgttagtcgggttttttagattttaattgcgttggtttcgtcgggtttttatatcgtttttcgtgtcgttcgggtttgttcgacgttttttttttttcgtataattttttttagcgcgagattttgggggtt

SEQ ID NO: 30318 - DNA, 833 bp, Artificial Sequence
  chemically treated genomic DNA (Homo sapiens) CpG-island No: 30318
aacccccaaaatctcgcgctaaaaaaaattatacgaaaaaaaaaaaacgtcgaacaaacccgaacgacacgaaaaacgatataaaaacccgacgaaaccaacgcaattaaaatctaaaaaacccgactaacatctactccgaactacgacgcgaaccccgcgaaacccaaaaaacgacgaatacttccgaccaaaaaccctaacgaccgccgcgcccctactactctcaaatttcccgttaacgacgcgacccgaacgcttcaaataacctctcgactctctctactccgctccgcgcccaaataaaacaccgacgaaaactacacgcgactaaccgacttcctccctactaaaacgaccctccctcctcccgcgaaaccctcctaaccgaaaatccgcaacgctacgccctctaaacgcccgacccccgcgcctactacgaaacgcgacctaaccgaaccctaaccccgactaacctcaatacccaacaaccccgctccgctctacccaacgcgtcccctttactccaaccctacgaccgtccctttcgaccgacgacataaccctatcgtccgaacccgataaatacgcgcgaaactacgctactaaccttaaaccaaccccgcgaaccctacgacccaaacgaaaatcaacaacgccctaaaatctaaaccgcgacttccgccttccctactcgcaaaaacgataacgctaactccgatccgatcccttaccgtatcccgtattcgtatccgtatccctacccgtacctctacgataacccgaaccccaacgacctcaaataaacgaacaacatcccgattccctaacga

SEQ ID NO: 30319 - DNA, 833 bp, Artificial Sequence
  chemically treated genomic DNA (Homo sapiens) CpG-island No: 30319
gatttttagagtttcgcgttgggaaaagttgtgcggggaggggaggacgtcgggtaagttcgggcggtacggggagcggtgtggaagttcggcggggttagcgtagttgaggtttggggagttcggttggtatttgtttcgggttgcggcgcgggtttcgcggagtttaggaggcggcgggtgttttcggttaagggttttggcggtcgtcgcgtttttgttgtttttaagtttttcgttggcggcgcggttcgggcgttttaggtagtttttcggttttttttgtttcgtttcgcgtttaggtagggtatcgacgggggttgtacgcggttggtcggttttttttttgttgaggcggtttttttttttttcgcggggtttttttggtcggggattcgtagcgttgcgttttttgaacgttcggttttcgcgtttgttgcggggcgcggtttggtcgggttttggtttcggttggttttagtgtttagtagtttcgtttcgttttgtttagcgcgttttttttgttttagttttgcggtcgtttttttcggtcggcggtatggttttgtcgttcgaattcggtgagtgcgcgcgaggttgcgttgttgattttgggttagtttcgcggattttgcggtttaggcgggaattagtagcgttttggggtttgaatcgcggttttcgttttttttgttcgtagaggcggtggcgttgatttcggttcgattttttgtcgtgtttcgtgttcgtgttcgtgtttttattcgtgtttttgcggtggttcgagttttagcggttttaggtgagcgggtagtatttcgattttttggcgg

SEQ ID NO: 30320 - DNA, 833 bp, Artificial Sequence
  chemically treated genomic DNA (Homo sapiens) CpG-island No: 30320
ccgccaaaaaatcgaaatactacccgctcacctaaaaccgctaaaactcgaaccaccgcaaaaacacgaataaaaacacgaacacgaacacgaaacacgacaaaaaatcgaaccgaaatcaacgccaccgcctctacgaacaaaaaaaacgaaaaccgcgattcaaaccccaaaacgctactaattcccgcctaaaccgcaaaatccgcgaaactaacccaaaatcaacaacgcaacctcgcgcgcactcaccgaattcgaacgacaaaaccataccgccgaccgaaaaaaacgaccgcaaaactaaaacaaaaaaaacgcgctaaacaaaacgaaacgaaactactaaacactaaaaccaaccgaaaccaaaacccgaccaaaccgcgccccgcaacaaacgcgaaaaccgaacgttcaaaaaacgcaacgctacgaatccccgaccaaaaaaaccccgcgaaaaaaaaaaaaaccgcctcaacaaaaaaaaaaccgaccaaccgcgtacaacccccgtcgataccctacctaaacgcgaaacgaaacaaaaaaaaccgaaaaactacctaaaacgcccgaaccgcgccgccaacgaaaaacttaaaaacaacaaaaacgcgacgaccgccaaaacccttaaccgaaaacacccgccgcctcctaaactccgcgaaacccgcgccgcaacccgaaacaaataccaaccgaactccccaaacctcaactacgctaaccccgccgaacttccacaccgctccccgtaccgcccgaacttacccgacgtcctcccctccccgcacaacttttcccaacgcgaaactctaaaaatc

SEQ ID NO: 30321 - DNA, 741 bp, Artificial Sequence
  chemically treated genomic DNA (Homo sapiens) CpG-island No: 30321
gttaagcgtcggtgttgagagaggcggcggtcgtcgcgttcgggaaaatgttgggtatgtacgtgtcggataggttttttttgaagttttttcgggtttaggacggtatggggttttatacggttcgtagagtgcgaaaggtgggtgattcggcggcggtttgcgcgtttttgtatttcgcgcgttttgtgtttttcggagtcgttttgtcgtagggttcggggcgcggcgggttttatttcggtcgtttttcgttcgggtcgggttaggcgttcgtgggaaggtcggggatcgcggggtacggcgggggtggtttttattcgttgcgttattcgagtaggtagcgttacgtaggtggcggcggggtgcgtttcgttgtcggtcggtttaggggcggaattgttatcggtttttttgtcgtaagatgttttttttttttttcgtaggaagtgagcgcggcgggagtttttttttttttcggttacgggtgtgagttgcgtttttgcgttggcgaaggtacgcgtgggcgggtgttttttttcgcgcgtacgttgtttcgttgtcgtttttttttttttaggatgaattaatgtggttagaaacgtttaattttttatgcggggatgggaggagtagtttagagcgtcgttttacgtaggtcgtagaattttatttatacgtttaggatttttttttttttttttggaatgtattatatgtgtttttagggaggtgttaatt

SEQ ID NO: 30322 - DNA, 741 bp, Artificial Sequence
  chemically treated genomic DNA (Homo sapiens) CpG-island No: 30322
aattaacacctccctaaaaacacatataatacattccaaaaaaaaaaaaaaaaatcctaaacgtataaataaaattctacgacctacgtaaaacgacgctctaaactactcctcccatccccgcataaaaaattaaacgtttctaaccacattaattcatcctaaaaaaaaaaaaacgacaacgaaacaacgtacgcgcgaaaaaaaacacccgcccacgcgtaccttcgccaacgcaaaaacgcaactcacacccgtaaccgaaaaaaaaaaaaactcccgccgcgctcacttcctacgaaaaaaaaaaaaaacatcttacgacaaaaaaaccgataacaattccgcccctaaaccgaccgacaacgaaacgcaccccgccgccacctacgtaacgctacctactcgaataacgcaacgaataaaaaccacccccgccgtaccccgcgatccccgaccttcccacgaacgcctaacccgacccgaacgaaaaacgaccgaaataaaacccgccgcgccccgaaccctacgacaaaacgactccgaaaaacacaaaacgcgcgaaatacaaaaacgcgcaaaccgccgccgaatcacccacctttcgcactctacgaaccgtataaaaccccataccgtcctaaacccgaaaaaacttcaaaaaaaacctatccgacacgtacatacccaacattttcccgaacgcgacgaccgccgcctctctcaacaccgacgcttaac

SEQ ID NO: 30323 - DNA, 741 bp, Artificial Sequence
  chemically treated genomic DNA (Homo sapiens) CpG-island No: 30323
ggttggtatttttttgaaggtatatataatatattttagaaggagggaaggaaattttgggcgtatgaatgagattttacggtttgcgtggagcggcgttttgggttgttttttttattttcgtatggaaagttaggcgtttttagttatattaatttattttaaaggaaaagaggcgatagcggagtagcgtgcgcgcgggggaaaatattcgtttacgcgtgttttcgttaacgtaaagacgtagtttatattcgtaatcgaggaagagggaggttttcgtcgcgtttattttttgcgggagagaggaaagatattttgcggtagggaggtcggtggtagtttcgtttttggatcggtcggtagcggagcgtatttcgtcgttatttacgtggcgttgtttgttcgggtggcgtagcgagtaaaggttattttcgtcgtgtttcgcggttttcggtttttttacggacgtttggttcggttcgggcgaggggcgatcggggtgaagttcgtcgcgtttcgggttttgcggtagggcgatttcgggaggtatagggcgcgcgaggtgtaggggcgcgtaggtcgtcgtcgggttatttatttttcgtattttgcgggtcgtgtagagttttatgtcgttttgaattcgggaggattttagggagaatttgttcggtacgtatatgtttagtattttttcgggcgcggcggtcgtcgttttttttaatatcggcgtttagt

SEQ ID NO: 30324 - DNA, 741 bp, Artificial Sequence
  chemically treated genomic DNA (Homo sapiens) CpG-island No: 30324
actaaacgccgatattaaaaaaaacgacgaccgccgcgcccgaaaaaatactaaacatatacgtaccgaacaaattctccctaaaatcctcccgaattcaaaacgacataaaactctacacgacccgcaaaatacgaaaaataaataacccgacgacgacctacgcgcccctacacctcgcgcgccctatacctcccgaaatcgccctaccgcaaaacccgaaacgcgacgaacttcaccccgatcgcccctcgcccgaaccgaaccaaacgtccgtaaaaaaaccgaaaaccgcgaaacacgacgaaaataacctttactcgctacgccacccgaacaaacaacgccacgtaaataacgacgaaatacgctccgctaccgaccgatccaaaaacgaaactaccaccgacctccctaccgcaaaatatctttcctctctcccgcaaaaaataaacgcgacgaaaacctccctcttcctcgattacgaatataaactacgtctttacgttaacgaaaacacgcgtaaacgaatattttcccccgcgcgcacgctactccgctatcgcctcttttcctttaaaataaattaatataactaaaaacgcctaactttccatacgaaaataaaaaaaacaacccaaaacgccgctccacgcaaaccgtaaaatctcattcatacgcccaaaatttccttccctccttctaaaatatattatatataccttcaaaaaaataccaacc

SEQ ID NO: 30325 - DNA, 557 bp, Artificial Sequence
  chemically treated genomic DNA (Homo sapiens) CpG-island No: 30325
tgcggggcgaggcggggcgcggggtagtcggtcgggtaggttttagtcggtcgttatcggcgtcggttgtagtttcggttttgtaatcggtttttgtttcgtatggttcggtcgcggagtcgtagcggttcggtttttttttcggttcgcgcgtttcgtttttcgtttgacgcgtagtttgtcgtaaagtcgcgatcgcgacgagttcgcggcgagcgcgtaatttatttcgttcggttgttttcgttcgggagcgggaaggcgaggttaggagggagtgatagcggtaatcggttaatgggaacgcgcggggttgagggggcgtcgcgtagtttcgtttttggggttggttgtatcgtgcgattttttaggagagggttggaggacgatgttgttgcgtttttgtattgtagagagcgggttgtagtttaggggcgggggcggcgggcgtgggagtcgtagtttcggttttagtttgagggattttgtcgaggagggttcgtttaggattttttttatttattcgttttatttggcgagaaggagtataagaggga

SEQ ID NO: 30326 - DNA, 557 bp, Artificial Sequence
  chemically treated genomic DNA (Homo sapiens) CpG-island No: 30326
tccctcttatactccttctcgccaaataaaacgaataaataaaaaaaatcctaaacgaaccctcctcgacaaaatccctcaaactaaaaccgaaactacgactcccacgcccgccgcccccgcccctaaactacaacccgctctctacaatacaaaaacgcaacaacatcgtcctccaaccctctcctaaaaaatcgcacgatacaaccaaccccaaaaacgaaactacgcgacgccccctcaaccccgcgcgttcccattaaccgattaccgctatcactccctcctaacctcgccttcccgctcccgaacgaaaacaaccgaacgaaataaattacgcgctcgccgcgaactcgtcgcgatcgcgactttacgacaaactacgcgtcaaacgaaaaacgaaacgcgcgaaccgaaaaaaaaaccgaaccgctacgactccgcgaccgaaccatacgaaacaaaaaccgattacaaaaccgaaactacaaccgacgccgataacgaccgactaaaacctacccgaccgactaccccgcgccccgcctcgccccgca

SEQ ID NO: 30327 - DNA, 557 bp, Artificial Sequence
  chemically treated genomic DNA (Homo sapiens) CpG-island No: 30327
ttttttttgtgttttttttcgttaaataaagcgaatgggtggaggaaattttgggcgagtttttttcggtagggttttttaagttggagtcgaaattgcgatttttacgttcgtcgttttcgtttttgaattgtagttcgttttttgtaatgtaaaaacgtagtagtatcgttttttagtttttttttgggggatcgtacggtgtaattaattttaaaaacgaagttgcgcgacgtttttttagtttcgcgcgtttttattggtcggttgtcgttgttatttttttttagtttcgttttttcgttttcgggcggaggtagtcgggcggggtaggttgcgcgttcgtcgcgggttcgtcgcggtcgcggttttgcggtaggttgcgcgttaggcggggagcggggcgcgcgggtcggggagggggtcgggtcgttgcggtttcgcggtcggattatgcggggtaggggtcggttgtagggtcggggttgtagtcggcgtcgatggcggtcgattaggatttgttcggtcggttgtttcgcgtttcgtttcgtttcgta

SEQ ID NO: 30328 - DNA, 557 bp, Artificial Sequence
  chemically treated genomic DNA (Homo sapiens) CpG-island No: 30328
tacgaaacgaaacgaaacgcgaaacaaccgaccgaacaaatcctaatcgaccgccatcgacgccgactacaaccccgaccctacaaccgacccctaccccgcataatccgaccgcgaaaccgcaacgacccgaccccctccccgacccgcgcgccccgctccccgcctaacgcgcaacctaccgcaaaaccgcgaccgcgacgaacccgcgacgaacgcgcaacctaccccgcccgactacctccgcccgaaaacgaaaaaacgaaactaaaaaaaaataacaacgacaaccgaccaataaaaacgcgcgaaactaaaaaaacgtcgcgcaacttcgtttttaaaattaattacaccgtacgatcccccaaaaaaaaactaaaaaacgatactactacgtttttacattacaaaaaacgaactacaattcaaaaacgaaaacgacgaacgtaaaaatcgcaatttcgactccaacttaaaaaaccctaccgaaaaaaactcgcccaaaatttcctccacccattcgctttatttaacgaaaaaaaacacaaaaaaaa

SEQ ID NO: 30329 - DNA, 541 bp, Artificial Sequence
  chemically treated genomic DNA (Homo sapiens) CpG-island No: 30329
gtagtttgcgtttttaaagtatagcgcggacgcgggtttttttttttcgaaaggttcggttaacgcgtatagttttggcgtttttttaattttttttgttttgcgtcgcgttacgttcggaaaatttattttttagattgtagttcgggttaggcggttcgcggtttttaagcgaaaatagagcgagtcgaagttagcgtcgagagataagatttgcgcgcgaagcgcggtttggggcgcgttaatttgttttaaaaaagcgcgtacgtagtgttttacggcgcgtgcgcggacgtagtagtttcggtgaatgagcggtgcgcggcgcgtcgcgttcggaattagtaacggcggtaaaggggttttgtacgtattcgcgcgcggttagggaacgtttgttgagggcgttgttgtcgttggtgttttgtatcgcgtttgttcgacgtttacgggttcgggggtttatggttagaagagatttaggaatggtagtttgttacggttgtgagttcgtttttggttagtatatattttacggatt

SEQ ID NO: 30330 - DNA, 541 bp, Artificial Sequence
  chemically treated genomic DNA (Homo sapiens) CpG-island No: 30330
aatccgtaaaatatatactaaccaaaaacgaactcacaaccgtaacaaactaccattcctaaatctcttctaaccataaacccccgaacccgtaaacgtcgaacaaacgcgatacaaaacaccaacgacaacaacgccctcaacaaacgttccctaaccgcgcgcgaatacgtacaaaacccctttaccgccgttactaattccgaacgcgacgcgccgcgcaccgctcattcaccgaaactactacgtccgcgcacgcgccgtaaaacactacgtacgcgcttttttaaaacaaattaacgcgccccaaaccgcgcttcgcgcgcaaatcttatctctcgacgctaacttcgactcgctctattttcgcttaaaaaccgcgaaccgcctaacccgaactacaatctaaaaaataaattttccgaacgtaacgcgacgcaaaacaaaaaaaattaaaaaaacgccaaaactatacgcgttaaccgaacctttcgaaaaaaaaaaacccgcgtccgcgctatactttaaaaacgcaaactac

SEQ ID NO: 30331 - DNA, 541 bp, Artificial Sequence
  chemically treated genomic DNA (Homo sapiens) CpG-island No: 30331
ggttcgtgaggtgtgtgttaattaagggcgggtttataatcgtgatagattgttatttttgagttttttttggttatgggttttcggattcgtgagcgtcgggtaggcgcggtatagaatattaacgatagtagcgtttttagtaagcgttttttggtcgcgcgcgggtacgtgtaggatttttttgtcgtcgttgttggtttcgggcgcggcgcgtcgcgtatcgtttatttatcgaggttattacgttcgcgtacgcgtcgtgaggtattgcgtgcgcgtttttttggagtagattggcgcgttttaggtcgcgtttcgcgcgtagattttgtttttcggcgttggtttcgattcgttttattttcgtttaaaaatcgcgggtcgtttggttcgggttgtagtttgggaggtggatttttcggacgtggcgcggcgtaaagtagaaaggattggagagacgttagagttgtgcgcgttaatcgggtttttcgagaggggggagttcgcgttcgcgttgtgttttgagagcgtagattat

SEQ ID NO: 30332 - DNA, 541 bp, Artificial Sequence
  chemically treated genomic DNA (Homo sapiens) CpG-island No: 30332
ataatctacgctctcaaaacacaacgcgaacgcgaactcccccctctcgaaaaacccgattaacgcgcacaactctaacgtctctccaatcctttctactttacgccgcgccacgtccgaaaaatccacctcccaaactacaacccgaaccaaacgacccgcgatttttaaacgaaaataaaacgaatcgaaaccaacgccgaaaaacaaaatctacgcgcgaaacgcgacctaaaacgcgccaatctactccaaaaaaacgcgcacgcaatacctcacgacgcgtacgcgaacgtaataacctcgataaataaacgatacgcgacgcgccgcgcccgaaaccaacaacgacgacaaaaaaatcctacacgtacccgcgcgcgaccaaaaaacgcttactaaaaacgctactatcgttaatattctataccgcgcctacccgacgctcacgaatccgaaaacccataaccaaaaaaaactcaaaaataacaatctatcacgattataaacccgcccttaattaacacacacctcacgaacc

SEQ ID NO: 30333 - DNA, 724 bp, Artificial Sequence
  chemically treated genomic DNA (Homo sapiens) CpG-island No: 30333
gtttaggtcggttttcgggtcggtttaggcgaatttagtttttttttgttttttttagaaggtttagtttcgttcgggcggtgttcgggcggcgtcggtcgggtttttcgtcgttttaggttcgtttataggttcggaatattatagttcgtttagatttggttggcgtcgagtcgggggtggagttagcgggttttcgttaaaatcgcgtagttggtttttttttcgcgggttacgtcgcgttttttttttttttttaaattcggagttgtattgggattggtggattgggtatttacgtggttaacggtcgcgggaagtcgcggagttcgaatttgagattggatttgaggagattttagtttcggtgttcgggtcgtttcgtttttgtcggaaagttcgcgtcgtcgttgtcgttatcgttcgtagttcgagcgtttcggagtcgtagtgtcgtcgcgtagagacgtcgcggttgcgattaggcgcgtttagtcgtacgtggcgattcgtttttaggttcgtagtgttttggatttcgtaggttttcgtttttttgttttcggtttcgtttttagggtcgcgatgagttttttgagtcgatagtagtcgtcgttatttcgtcgcgtcgggcggtttgtattttgcggtagaagttgattttttcgttttgtagcgattgtgaggaggaggaagaagaggaggaggaggagggtagcggtta

SEQ ID NO: 30334 - DNA, 724 bp, Artificial Sequence
  chemically treated genomic DNA (Homo sapiens) CpG-island No: 30334
taaccgctaccctcctcctcctcctcttcttcctcctcctcacaatcgctacaaaacgaaaaaatcaacttctaccgcaaaatacaaaccgcccgacgcgacgaaataacgacgactactatcgactcaaaaaactcatcgcgaccctaaaaacgaaaccgaaaacaaaaaaacgaaaacctacgaaatccaaaacactacgaacctaaaaacgaatcgccacgtacgactaaacgcgcctaatcgcaaccgcgacgtctctacgcgacgacactacgactccgaaacgctcgaactacgaacgataacgacaacgacgacgcgaactttccgacaaaaacgaaacgacccgaacaccgaaactaaaatctcctcaaatccaatctcaaattcgaactccgcgacttcccgcgaccgttaaccacgtaaatacccaatccaccaatcccaatacaactccgaatttaaaaaaaaaaaaaaaacgcgacgtaacccgcgaaaaaaaaaccaactacgcgattttaacgaaaacccgctaactccacccccgactcgacgccaaccaaatctaaacgaactataatattccgaacctataaacgaacctaaaacgacgaaaaacccgaccgacgccgcccgaacaccgcccgaacgaaactaaaccttctaaaaaaaacaaaaaaaaactaaattcgcctaaaccgacccgaaaaccgacctaaac

SEQ ID NO: 30335 - DNA, 724 bp, Artificial Sequence
  chemically treated genomic DNA (Homo sapiens) CpG-island No: 30335
tggtcgttgttttttttttttttttttttttttttttttttatagtcgttgtagggcgagaagattagtttttgtcgtaaggtgtaggtcgttcggcgcggcggggtggcggcggttgttgtcggtttaggaagtttatcgcggttttggggacggggtcgaggataggagagcggaggtttgcggggtttaggatattgcgggtttgggggcgggtcgttacgtgcggttgggcgcgtttagtcgtagtcgcggcgtttttgcgcggcggtattgcggtttcggggcgttcgggttgcggacggtggcggtagcggcggcgcggatttttcggtagaggcggggcggttcgagtatcgaggttgaggtttttttaggtttagttttaggttcgggtttcgcggtttttcgcgatcgttaattacgtgagtgtttagtttattaattttagtgtagtttcgggtttgaaaaaaaaaggagggcgcgacgtagttcgcgggggaaggattagttacgcgattttggcgggaattcgttggttttattttcggttcggcgttagttaagtttgggcgggttgtggtgtttcgggtttatgagcgagtttggggcggcggggggttcggtcggcgtcgttcgaatatcgttcggacggggttgggttttttgggaggggtaaaagagagttggattcgtttaagtcgattcgaaagtcggtttggat

SEQ ID NO: 30336 - DNA, 724 bp, Artificial Sequence
  chemically treated genomic DNA (Homo sapiens) CpG-island No: 30336
atccaaaccgactttcgaatcgacttaaacgaatccaactctcttttacccctcccaaaaaacccaaccccgtccgaacgatattcgaacgacgccgaccgaaccccccgccgccccaaactcgctcataaacccgaaacaccacaacccgcccaaacttaactaacgccgaaccgaaaataaaaccaacgaattcccgccaaaatcgcgtaactaatccttcccccgcgaactacgtcgcgccctcctttttttttcaaacccgaaactacactaaaattaataaactaaacactcacgtaattaacgatcgcgaaaaaccgcgaaacccgaacctaaaactaaacctaaaaaaacctcaacctcgatactcgaaccgccccgcctctaccgaaaaatccgcgccgccgctaccgccaccgtccgcaacccgaacgccccgaaaccgcaataccgccgcgcaaaaacgccgcgactacgactaaacgcgcccaaccgcacgtaacgacccgcccccaaacccgcaatatcctaaaccccgcaaacctccgctctcctatcctcgaccccgtccccaaaaccgcgataaacttcctaaaccgacaacaaccgccgccaccccgccgcgccgaacgacctacaccttacgacaaaaactaatcttctcgccctacaacgactataaaaaaaaaaaaaaaaaaaaaaaaaaaaaaaacaacgacca

SEQ ID NO: 30337 - DNA, 609 bp, Artificial Sequence
  chemically treated genomic DNA (Homo sapiens) CpG-island No: 30337
  misc_feature (312)..(312): n is either a, c, g or t
tcgattcgtcgttgtcgttcgcgcggagttttacggagttcgggttcgagcgtcgtcgttcgttcgggtcggttttcgggagtttcggcgagttggaggaggatttgttgttgttcggcgtttgttcgggcgcggacgaggcgggcggtggggcggagggcgattcgtgggaggaggagggtttcggtttttcgtcgtcggttaagtcgtcggcggttttttattttttgggtagttttttttcgtcggtgcgttgcggcggtttaggagatgcgtcgtcgcggggttgcggggcgcgtcgggcgggcgaanaggcgcgtcgtcgcggtcggattattcgggtatttcgttatataagatttttcgtaagttgcgatttttcgatatttcgtatacgtttaaggtgagagcggcgggcgcgggtattcggcggtcggggtcgcggcgtcggaggggttagcgtcgttgtttgggttcggttatagaagcggtcggtcgtttttttttcgtttttttgcgtcgttttttaaagttggtagtttttgtgtttggttttgtttcgaggttgttcgttgagattatgtaattgaataatgggtttcgtttgga

SEQ ID NO: 30338 - DNA, 609 bp, Artificial Sequence
  chemically treated genomic DNA (Homo sapiens) CpG-island No: 30338
  misc_feature (298)..(298): n is either a, c, g or t
tccaaacgaaacccattattcaattacataatctcaacgaacaacctcgaaacaaaaccaaacacaaaaactaccaactttaaaaaacgacgcaaaaaaacgaaaaaaaaacgaccgaccgcttctataaccgaacccaaacaacgacgctaacccctccgacgccgcgaccccgaccgccgaatacccgcgcccgccgctctcaccttaaacgtatacgaaatatcgaaaaatcgcaacttacgaaaaatcttatataacgaaatacccgaataatccgaccgcgacgacgcgcctnttcgcccgcccgacgcgccccgcaaccccgcgacgacgcatctcctaaaccgccgcaacgcaccgacgaaaaaaaactacccaaaaaataaaaaaccgccgacgacttaaccgacgacgaaaaaccgaaaccctcctcctcccacgaatcgccctccgccccaccgcccgcctcgtccgcgcccgaacaaacgccgaacaacaacaaatcctcctccaactcgccgaaactcccgaaaaccgacccgaacgaacgacgacgctcgaacccgaactccgtaaaactccgcgcgaacgacaacgacgaatcga

SEQ ID NO: 30339 - DNA, 609 bp, Artificial Sequence
  chemically treated genomic DNA (Homo sapiens) CpG-island No: 30339
  misc_feature (298)..(298): n is either a, c, g or t
tttagacgaggtttattgtttagttatataattttaacggataatttcggggtagggttaaatataagggttgttaattttggggggcggcgtaggaaagcgaggggggagcggtcggtcgtttttgtaatcgaatttaggtagcggcgttggttttttcggcgtcgcggtttcggtcgtcgggtgttcgcgttcgtcgtttttattttgggcgtgtgcggggtgtcgaagagtcgtagtttgcggaaggttttgtgtggcggggtgttcgggtggttcggtcgcggcgacgcgtttnttcgttcgttcggcgcgtttcgtaatttcgcggcgacgtattttttgggtcgtcgtagcgtatcggcgagaaagagttatttaggaagtagggggtcgtcggcgatttgatcggcgacgaggagtcgaagtttttttttttttacgagtcgtttttcgttttatcgttcgtttcgttcgcgttcgggtaggcgtcgggtagtaataggtttttttttagttcgtcggggttttcgggggtcggttcgggcgagcggcggcgttcgggttcgggtttcgtggggtttcgcgcgggcggtagcggcgagtcgg

SEQ ID NO: 30340 - DNA, 609 bp, Artificial Sequence
  chemically treated genomic DNA (Homo sapiens) CpG-island No: 30340
  misc_feature (312)..(312): n is either a, c, g or t
ccgactcgccgctaccgcccgcgcgaaaccccacgaaacccgaacccgaacgccgccgctcgcccgaaccgacccccgaaaaccccgacgaactaaaaaaaaacctattactacccgacgcctacccgaacgcgaacgaaacgaacgataaaacgaaaaacgactcgtaaaaaaaaaaaaacttcgactcctcgtcgccgatcaaatcgccgacgaccccctacttcctaaataactctttctcgccgatacgctacgacgacccaaaaaatacgtcgccgcgaaattacgaaacgcgccgaacgaacgaanaaacgcgtcgccgcgaccgaaccacccgaacaccccgccacacaaaaccttccgcaaactacgactcttcgacaccccgcacacgcccaaaataaaaacgacgaacgcgaacacccgacgaccgaaaccgcgacgccgaaaaaaccaacgccgctacctaaattcgattacaaaaacgaccgaccgctcccccctcgctttcctacgccgccccccaaaattaacaacccttatatttaaccctaccccgaaattatccgttaaaattatataactaaacaataaacctcgtctaaa

SEQ ID NO: 30341 - DNA, 643 bp, Artificial Sequence
  chemically treated genomic DNA (Homo sapiens) CpG-island No: 30341
ggcggaaaatgtcgtcggtgttttgacggtttcgtttttttagtagttgcgggggagttgttttgtcggcgcggttggagtttttgatttttagggttcggtggttggaagatgttttagagagacgaggttgcggcggaggaggtggcggcggcgaatcggtaacggcgttagggtggagagaaggcggtatcggcggcggcggcggcgtgaggggtcggcggtgtaaatagttcggatgcgcggttcgagatttcgaggggaatgcggcggttgagttagggtcgcgttttcgttggaaatttgggttgagtatcgcggcgggttagcgaggcgttacgatatttttttttttttttgttttaggtaaggtcgttcgtattttcgtcgagggtaacgcggttgatcggtttcgtcggaaggatgttcgtcgtttgtatagttttttagggtgtgtcgaaacgtattcggcgttcgtgttgttttaaatagtcgttggtgttatatcgtgttgaggagttagtgtatcgggaggttcggcgtcgggggtacgtatttcgtatttcgttatatgtgatgacgttgtgttttatgacgtaatttatattttttttttatattcgttttttatttaattaagcgg

SEQ ID NO: 30342 - DNA, 643 bp, Artificial Sequence
  chemically treated genomic DNA (Homo sapiens) CpG-island No: 30342
ccgcttaattaaataaaaaacgaatataaaaaaaaaatataaattacgtcataaaacacaacgtcatcacatataacgaaatacgaaatacgtacccccgacgccgaacctcccgatacactaactcctcaacacgatataacaccaacgactatttaaaacaacacgaacgccgaatacgtttcgacacaccctaaaaaactatacaaacgacgaacatccttccgacgaaaccgatcaaccgcgttaccctcgacgaaaatacgaacgaccttacctaaaacaaaaaaaaaaaaaaatatcgtaacgcctcgctaacccgccgcgatactcaacccaaatttccaacgaaaacgcgaccctaactcaaccgccgcattcccctcgaaatctcgaaccgcgcatccgaactatttacaccgccgacccctcacgccgccgccgccgccgataccgccttctctccaccctaacgccgttaccgattcgccgccgccacctcctccgccgcaacctcgtctctctaaaacatcttccaaccaccgaaccctaaaaatcaaaaactccaaccgcgccgacaaaacaactcccccgcaactactaaaaaaacgaaaccgtcaaaacaccgacgacattttccgcc

SEQ ID NO: 30343 - DNA, 643 bp, Artificial Sequence
  chemically treated genomic DNA (Homo sapiens) CpG-island No: 30343
tcgtttggttaggtgggagacgaatgtgggagaggagtataaattgcgttataggatatagcgttattatatatgacggaatgcgaggtacgtattttcgacgtcgggtttttcgatgtattagttttttagtacgatgtaatattagcgattatttgaaataatacgagcgtcggatgcgtttcgatatattttagaaaattgtgtaagcggcgggtattttttcggcgaggtcggttagtcgcgttgttttcggcggggatgcgggcggttttatttgaggtaagggagggagaagatgtcgtagcgtttcgttggttcgtcgcggtatttagtttaagtttttaacggaggcgcgattttgatttagtcgtcgtatttttttcggggtttcgaatcgcgtattcgggttgtttatatcgtcggttttttacgtcgtcgtcgtcgtcgatgtcgttttttttttattttagcgtcgttgtcgattcgtcgtcgttatttttttcgtcgtagtttcgtttttttggagtattttttaattatcgaattttgagaattagagattttagtcgcgtcggtaggataattttttcgtaattgttaggggaacgaggtcgttagagtatcggcggtatttttcgtt

SEQ ID NO: 30344 - DNA, 643 bp, Artificial Sequence
  chemically treated genomic DNA (Homo sapiens) CpG-island No: 30344
aacgaaaaataccgccgatactctaacgacctcgttcccctaacaattacgaaaaaattatcctaccgacgcgactaaaatctctaattctcaaaattcgataattaaaaaatactccaaaaaaacgaaactacgacgaaaaaaataacgacgacgaatcgacaacgacgctaaaataaaaaaaaaacgacatcgacgacgacgacgacgtaaaaaaccgacgatataaacaacccgaatacgcgattcgaaaccccgaaaaaaatacgacgactaaatcaaaatcgcgcctccgttaaaaacttaaactaaataccgcgacgaaccaacgaaacgctacgacatcttctccctcccttacctcaaataaaaccgcccgcatccccgccgaaaacaacgcgactaaccgacctcgccgaaaaaatacccgccgcttacacaattttctaaaatatatcgaaacgcatccgacgctcgtattatttcaaataatcgctaatattacatcgtactaaaaaactaatacatcgaaaaacccgacgtcgaaaatacgtacctcgcattccgtcatatataataacgctatatcctataacgcaatttatactcctctcccacattcgtctcccacctaaccaaacga

SEQ ID NO: 30345 - DNA, 699 bp, Artificial Sequence
  chemically treated genomic DNA (Homo sapiens) CpG-island No: 30345
tattcgcgcggtttcggttttttttttggacggtcgggtttaggacgtgttttggaatttgtaggaggtttttcgcgagagttttttggggcgcggaggtagttttaggtcgtgttttttgtttaggattaggagcgcgttcgggtttaggcgtaggaggtcgcggacgtgggtttcgttcgtttttaggaagtcgtgcggaattattttgagtttcgcgaggatgcgggtcgcgagttgttggtttcggtaattcgcgcgtttcgttttttgtttcgtttggcgtttgtcggggcgcgattcgcgttgggagttcgtttcgtcgagtgtttgttgttggtaggggacgcggcgggcgttcgggttatgtgcgagcgtttgttgcggttcgtacgttttgaggattttgcggggatcgtgtaggggatcgcgtattttttttggttttgcgcggtttttgcgtttgtacgtcggggattcgcggcgcgttatggaggatttttagacggtagtggagtagggggcgtcgtatcgggggggttgtgtgcgcgcgttgtggcgtcggggattgttgcgggtgttggcgggtagtttgtttttgggtacgttggattatgttatcgtttgtaggttgcggttcgaggaggcgttgttggtcgttaagttggtcgtgttttggaattagcgggggttgttgtt

SEQ ID NO: 30346 - DNA, 699 bp, Artificial Sequence
  chemically treated genomic DNA (Homo sapiens) CpG-island No: 30346
aacaacaacccccgctaattccaaaacacgaccaacttaacgaccaacaacgcctcctcgaaccgcaacctacaaacgataacataatccaacgtacccaaaaacaaactacccgccaacacccgcaacaatccccgacgccacaacgcgcgcacacaacccccccgatacgacgccccctactccactaccgtctaaaaatcctccataacgcgccgcgaatccccgacgtacaaacgcaaaaaccgcgcaaaaccaaaaaaaatacgcgatcccctacacgatccccgcaaaatcctcaaaacgtacgaaccgcaacaaacgctcgcacataacccgaacgcccgccgcgtcccctaccaacaacaaacactcgacgaaacgaactcccaacgcgaatcgcgccccgacaaacgccaaacgaaacaaaaaacgaaacgcgcgaattaccgaaaccaacaactcgcgacccgcatcctcgcgaaactcaaaataattccgcacgacttcctaaaaacgaacgaaacccacgtccgcgacctcctacgcctaaacccgaacgcgctcctaatcctaaacaaaaaacacgacctaaaactacctccgcgccccaaaaaactctcgcgaaaaacctcctacaaattccaaaacacgtcctaaacccgaccgtccaaaaaaaaaaccgaaaccgcgcgaata

SEQ ID NO: 30347 - DNA, 699 bp, Artificial Sequence
  chemically treated genomic DNA (Homo sapiens) CpG-island No: 30347
agtagtagttttcgttggttttagggtacgattagtttggcggttagtagcgttttttcgggtcgtagtttgtaggcggtgatatagtttagcgtgtttaggaataggttgttcgttagtattcgtagtagttttcggcgttatagcgcgcgtatatagttttttcggtgcggcgttttttgttttattatcgtttggaagttttttatggcgcgtcgcgagttttcggcgtgtaggcgtagaagtcgcgtagagttaggagaggtgcgcggttttttgtacggttttcgtagggtttttagggcgtgcgggtcgtagtaggcgttcgtatatggttcgggcgttcgtcgcgttttttgttagtagtaggtattcggcgaggcgggtttttagcgcgggtcgcgtttcggtaggcgttaggcgaagtaggagacggagcgcgcgggttatcggggttagtagttcgcggttcgtattttcgcggagtttagggtggtttcgtacggttttttggaagcgggcgaagtttacgttcgcggttttttgcgtttgagttcggacgcgtttttggttttggatagagaatacggtttggaattgttttcgcgttttagagggttttcgcggaaggttttttgtaggttttaaaatacgttttgggttcggtcgtttaggaagaaggtcgaggtcgcgcgggtg

SEQ ID NO: 30348 - DNA, 699 bp, Artificial Sequence
  chemically treated genomic DNA (Homo sapiens) CpG-island No: 30348
cacccgcgcgacctcgaccttcttcctaaacgaccgaacccaaaacgtattttaaaacctacaaaaaaccttccgcgaaaaccctctaaaacgcgaaaacaattccaaaccgtattctctatccaaaaccaaaaacgcgtccgaactcaaacgcaaaaaaccgcgaacgtaaacttcgcccgcttccaaaaaaccgtacgaaaccaccctaaactccgcgaaaatacgaaccgcgaactactaaccccgataacccgcgcgctccgtctcctacttcgcctaacgcctaccgaaacgcgacccgcgctaaaaacccgcctcgccgaatacctactactaacaaaaaacgcgacgaacgcccgaaccatatacgaacgcctactacgacccgcacgccctaaaaaccctacgaaaaccgtacaaaaaaccgcgcacctctcctaactctacgcgacttctacgcctacacgccgaaaactcgcgacgcgccataaaaaacttccaaacgataataaaacaaaaaacgccgcaccgaaaaaactatatacgcgcgctataacgccgaaaactactacgaatactaacgaacaacctattcctaaacacgctaaactatatcaccgcctacaaactacgacccgaaaaaacgctactaaccgccaaactaatcgtaccctaaaaccaacgaaaactactact

SEQ ID NO: 30349 - DNA, 1084 bp, Artificial Sequence
  chemically treated genomic DNA (Homo sapiens) CpG-island No: 30349
tgcgggttcgtttttgaagggtaaatttcgggttttgggtggcgcggcggttggaggaggagtcgcggttgtttcgtcggggcggtagtaggaggcgtcgttttggtttttaaggaagattttcgttttttagcgtttagggtcgttttggtggagtaggacgcgtcgatcgttcgggacgttttcgttggttattacggtgatggattttatttacgtgtttattttgttttttaattacgttttattggtagttcgtattcggtagttgttggaagacgaaagttacgacggcggggtcggggttgttagcgtttttgtttcgtcgcggagtttattttgtgtttcgtttatttcggtcgttgtaggcgattttttcgattgcgcgtattcgttcgacgtcgagtttaaggacgacgcgtattttttttatagcgatttttagtcgttcgttttaaagataaaggaggaggaggaaggcgcggaggttttcgcgttttttcgcgtttttattttgtggtcggtgttaatttcgtagttttttcggatttttcgttgggttatcgttttcgttgtcgtcgcgagcgattttatttagattcggggaagcggcggtgacggtcgtattcgttagtgttttagtttcgtttgcgtttttttcggggtcgattttggagtgtattttgtataaagcggagggcgcgtcgttagtagggtcgcgttcgcgtcgtcgttttgtaagcgtcgggcgagcggttgtttgttttcgcgggacggtttgttttttattttcgtttttatcgtcgtcgtcgggcggttttcgcgttttattttgtattcggttttaacgggttttcgtagttcggttattaggtcgtcgtgtttaaggagggtttgtcgtaggtttattcgttttattttaattatttgaggtgagggttcgggacggggtacgtttagcgcgttcgggagtagcggtttcgttggcggcggtcgttaatttttagttttagttttagcgtatcgttgcgtttttcggggcggtcggagagggtgggtagcgggatatagtataggggtagtt

SEQ ID NO: 30350 - DNA, 1084 bp, Artificial Sequence
  chemically treated genomic DNA (Homo sapiens) CpG-island No: 30350
aactacccctatactatatcccgctacccaccctctccgaccgccccgaaaaacgcaacgatacgctaaaactaaaactaaaaattaacgaccgccgccaacgaaaccgctactcccgaacgcgctaaacgtaccccgtcccgaaccctcacctcaaataattaaaataaaacgaataaacctacgacaaaccctccttaaacacgacgacctaataaccgaactacgaaaacccgttaaaaccgaatacaaaataaaacgcgaaaaccgcccgacgacgacgataaaaacgaaaataaaaaacaaaccgtcccgcgaaaacaaacaaccgctcgcccgacgcttacaaaacgacgacgcgaacgcgaccctactaacgacgcgccctccgctttatacaaaatacactccaaaatcgaccccgaaaaaaacgcaaacgaaactaaaacactaacgaatacgaccgtcaccgccgcttccccgaatctaaataaaatcgctcgcgacgacaacgaaaacgataacccaacgaaaaatccgaaaaaactacgaaattaacaccgaccacaaaataaaaacgcgaaaaaacgcgaaaacctccgcgccttcctcctcctcctttatctttaaaacgaacgactaaaaatcgctataaaaaaaatacgcgtcgtccttaaactcgacgtcgaacgaatacgcgcaatcgaaaaaatcgcctacaacgaccgaaataaacgaaacacaaaataaactccgcgacgaaacaaaaacgctaacaaccccgaccccgccgtcgtaactttcgtcttccaacaactaccgaatacgaactaccaataaaacgtaattaaaaaacaaaataaacacgtaaataaaatccatcaccgtaataaccaacgaaaacgtcccgaacgatcgacgcgtcctactccaccaaaacgaccctaaacgctaaaaaacgaaaatcttccttaaaaaccaaaacgacgcctcctactaccgccccgacgaaacaaccgcgactcctcctccaaccgccgcgccacccaaaacccgaaatttacccttcaaaaacgaacccgca

SEQ ID NO: 30351 - DNA, 1084 bp, Artificial Sequence
  chemically treated genomic DNA (Homo sapiens) CpG-island No: 30351
aattgtttttgtgttgtgtttcgttgtttatttttttcggtcgtttcggggagcgtagcggtgcgttggggttggggttgagggttggcggtcgtcgttaacggaatcgttattttcggacgcgttgggcgtgtttcgtttcgggtttttattttaggtagttgagatagggcgggtagatttgcggtaggttttttttgagtacggcggtttggtagtcgagttgcgggagttcgttgaggtcgagtgtagggtagagcgcgggggtcgttcggcggcggcggtagaggcggaggtggagggtaggtcgtttcgcgggagtaggtagtcgttcgttcggcgtttgtagggcggcggcgcgaacgcggttttgttggcggcgcgtttttcgttttgtataggatgtattttagggtcgatttcgaggaggacgtagacgagattgaggtattggcgggtgcggtcgttatcgtcgttttttcgggtttggatggggtcgttcgcggcggtagcgggggcggtggtttaacgggaaattcgggaaggttgcggggttggtatcggttataaggtaggaacgcggggaggcgcggaggttttcgcgttttttttttttttttttatttttagagcgggcggttggaagtcgttatagagagggtacgcgtcgtttttgggttcggcgtcgggcgggtacgcgtagtcggggaagtcgtttatagcgatcggggtggacgaggtatagggtgaatttcgcggcggggtaaaggcgttggtagtttcggtttcgtcgtcgtaattttcgttttttagtagttgtcgagtgcgggttgttaataaggcgtgattgagaggtaggataggtacgtggatgaaatttattatcgtggtggttagcggggacgtttcggacgatcggcgcgttttgttttattagggcgattttgggcgttgagaagcgggaattttttttggggattagggcgacgttttttgttgtcgtttcggcgggatagtcgcggttttttttttagtcgtcgcgttatttagagttcgaggtttgttttttagaagcggattcgta

SEQ ID NO: 30352 - DNA, 1084 bp, Artificial Sequence
  chemically treated genomic DNA (Homo sapiens) CpG-island No: 30352
tacgaatccgcttctaaaaaacaaacctcgaactctaaataacgcgacgactaaaaaaaaaaccgcgactatcccgccgaaacgacaacaaaaaacgtcgccctaatccccaaaaaaaattcccgcttctcaacgcccaaaatcgccctaataaaacaaaacgcgccgatcgtccgaaacgtccccgctaaccaccacgataataaatttcatccacgtacctatcctacctctcaatcacgccttattaacaacccgcactcgacaactactaaaaaacgaaaattacgacgacgaaaccgaaactaccaacgcctttaccccgccgcgaaattcaccctatacctcgtccaccccgatcgctataaacgacttccccgactacgcgtacccgcccgacgccgaacccaaaaacgacgcgtaccctctctataacgacttccaaccgcccgctctaaaaataaaaaaaaaaaaaaaaaacgcgaaaacctccgcgcctccccgcgttcctaccttataaccgataccaaccccgcaaccttcccgaatttcccgttaaaccaccgcccccgctaccgccgcgaacgaccccatccaaacccgaaaaaacgacgataacgaccgcacccgccaatacctcaatctcgtctacgtcctcctcgaaatcgaccctaaaatacatcctatacaaaacgaaaaacgcgccgccaacaaaaccgcgttcgcgccgccgccctacaaacgccgaacgaacgactacctactcccgcgaaacgacctaccctccacctccgcctctaccgccgccgccgaacgacccccgcgctctaccctacactcgacctcaacgaactcccgcaactcgactaccaaaccgccgtactcaaaaaaaacctaccgcaaatctacccgccctatctcaactacctaaaataaaaacccgaaacgaaacacgcccaacgcgtccgaaaataacgattccgttaacgacgaccgccaaccctcaaccccaaccccaacgcaccgctacgctccccgaaacgaccgaaaaaaataaacaacgaaacacaacacaaaaacaatt

SEQ ID NO: 30353 - DNA, 847 bp, Artificial Sequence
  chemically treated genomic DNA (Homo sapiens) CpG-island No: 30353
cgcgcggtacggggtttttgtcggtgttttttttttcggtcgtcgcgttttcgtaggcgtttttggttttcggtacggcgtaggtcgagattcgggtttgggcgcgtcgaggggtcgcggggttcgtatcgggtcgtttcgcgttttatttgttcggtagttcgtcggtagtttgtaattcgggagtttcggttttttgcgttttttacgtttttaacgtcgcgtcggcgtttcggttcgcggtcgggggttatgaatgggcgtagcggaagtatcgtttttttcggacgtgacgttcggttaatggtagcgcgggttgcgtggatggatgaggttagcgttgtcgtgtcgggaatggaatgtgtaagtgtaatatttagaatcgggtaatattcggcgatcgaacgcggcggtcggtagcgttcgcgcgggggtttgcgaagcgttgttcggggtcggtattgttcgcggggaggacgcgtcgtcgtcgttatttagcgtcgtcgtcgtcgtcgtttttagtcgggtcgtcgcgcgtttcgggggtcggtttcgcgagcgtaggagtaaatatcgtcggagttttggagtcgttgtagaagggaataaagagagatgtagggatttgtgaggttacggcgttttagttgtaagatgtattagtcggttgaattcgggatcggttgatttgttggaatcggagtgttttgtacggagagtggtggatgagttgaagttgttttttcggggtttattttttacgttgtcgagaggaattcgagaggtaaggtaattatttcgttttgttattgattgggtatcgggagtttttttttttttttttttt

SEQ ID NO: 30354 - DNA, 847 bp, Artificial Sequence
  chemically treated genomic DNA (Homo sapiens) CpG-island No: 30354
aaaaaaaaaaaaaaaaaaaactcccgatacccaatcaataacaaaacgaaataattaccttacctctcgaattcctctcgacaacgtaaaaaataaaccccgaaaaaacaacttcaactcatccaccactctccgtacaaaacactccgattccaacaaatcaaccgatcccgaattcaaccgactaatacatcttacaactaaaacgccgtaacctcacaaatccctacatctctctttattcccttctacaacgactccaaaactccgacgatatttactcctacgctcgcgaaaccgacccccgaaacgcgcgacgacccgactaaaaacgacgacgacgacgacgctaaataacgacgacgacgcgtcctccccgcgaacaataccgaccccgaacaacgcttcgcaaacccccgcgcgaacgctaccgaccgccgcgttcgatcgccgaatattacccgattctaaatattacacttacacattccattcccgacacgacaacgctaacctcatccatccacgcaacccgcgctaccattaaccgaacgtcacgtccgaaaaaaacgatacttccgctacgcccattcataacccccgaccgcgaaccgaaacgccgacgcgacgttaaaaacgtaaaaaacgcaaaaaaccgaaactcccgaattacaaactaccgacgaactaccgaacaaataaaacgcgaaacgacccgatacgaaccccgcgacccctcgacgcgcccaaacccgaatctcgacctacgccgtaccgaaaaccaaaaacgcctacgaaaacgcgacgaccgaaaaaaaaaacaccgacaaaaaccccgtaccgcgcg

SEQ ID NO: 30355 - DNA, 847 bp, Artificial Sequence
  chemically treated genomic DNA (Homo sapiens) CpG-island No: 30355
gagaggggagaaaaaaaaagttttcgatatttaattaatggtaagacgaagtgattgttttgtttttcggatttttttcggtagcgtggaaaatgagtttcgggaaggtaattttaatttatttattatttttcgtgtagagtatttcggttttaataagttagtcgatttcgggtttagtcggttagtgtattttgtagttggggcgtcgtaattttataaatttttgtatttttttttatttttttttgtagcggttttaagatttcggcggtgtttatttttgcgttcgcggggtcggttttcgggacgcgcggcggttcggttggaggcggcggcggcggcggcgttgggtggcggcggcggcgcgtttttttcgcgggtagtgtcggtttcgagtagcgtttcgtaggttttcgcgcgaacgttgtcgatcgtcgcgttcggtcgtcgaatgttattcggttttgaatgttatatttatatattttattttcgatacgatagcgttgattttatttatttacgtagttcgcgttgttattggtcgagcgttacgttcggggggggcggtgttttcgttgcgtttatttataattttcggtcgcgggtcgaggcgtcggcgcggcgttgggggcgtagggggcgtagggagtcggggttttcgggttgtaagttgtcggcgggttgtcgggtaggtggagcgcgggacggttcggtgcgagtttcgcggtttttcggcgcgtttaggttcggatttcggtttgcgtcgtgtcggggattagaggcgtttgcggaaacgcggcggtcggggaaggaggtatcggtaggggtttcgtgtcgcgcg

SEQ ID NO: 30356 - DNA, 847 bp, Artificial Sequence
  chemically treated genomic DNA (Homo sapiens) CpG-island No: 30356
cgcgcgacacgaaacccctaccgatacctccttccccgaccgccgcgtttccgcaaacgcctctaatccccgacacgacgcaaaccgaaatccgaacctaaacgcgccgaaaaaccgcgaaactcgcaccgaaccgtcccgcgctccacctacccgacaacccgccgacaacttacaacccgaaaaccccgactccctacgccccctacgcccccaacgccgcgccgacgcctcgacccgcgaccgaaaattataaataaacgcaacgaaaacaccgccccccccgaacgtaacgctcgaccaataacaacgcgaactacgtaaataaataaaatcaacgctatcgtatcgaaaataaaatatataaatataacattcaaaaccgaataacattcgacgaccgaacgcgacgatcgacaacgttcgcgcgaaaacctacgaaacgctactcgaaaccgacactacccgcgaaaaaaacgcgccgccgccgccacccaacgccgccgccgccgccgcctccaaccgaaccgccgcgcgtcccgaaaaccgaccccgcgaacgcaaaaataaacaccgccgaaatcttaaaaccgctacaaaaaaaaataaaaaaaaatacaaaaatttataaaattacgacgccccaactacaaaatacactaaccgactaaacccgaaatcgactaacttattaaaaccgaaatactctacacgaaaaataataaataaattaaaattaccttcccgaaactcattttccacgctaccgaaaaaaatccgaaaaacaaaacaatcacttcgtcttaccattaattaaatatcgaaaactttttttttctcccctctc

SEQ ID NO: 30357 - DNA, 525 bp, Artificial Sequence
  chemically treated genomic DNA (Homo sapiens) CpG-island No: 30357
tagcgcggtcgggaggcgttttcgttaagggtcgtgggggcgcgcggcgcgggtcgtttatttgttttttcgggatttcggttcggagcgcggtcgttcgttttttgttcggcgttcggttcggttcggcgtttgcgtcgttgtagttcggagcgggggaggcgtagggagcgtttgtaaagagcgaggagtttaataatgagttagggatcggagtaggaagcgtcgttttatttagtcgtcggtgtgttcgttagttcggaggttttcggcggttttggttagattcgttgtgatttttagtttgtatatagatgtgtcgtaggtttgtgtttgtatttgtacgtttacgagttatatacgtagttagtattttgtgtggtcgtagatattatttatattaggattatatacgcgtatgtacgtgggcgcgtatatataggtatataaacggttgtttttatatagatttagttagattattttatgtggttgtagatattatttagacgaggtttcggatat

SEQ ID NO: 30358 - DNA, 525 bp, Artificial Sequence
  chemically treated genomic DNA (Homo sapiens) CpG-island No: 30358
atatccgaaacctcgtctaaataatatctacaaccacataaaataatctaactaaatctatataaaaacaaccgtttatatacctatatatacgcgcccacgtacatacgcgtatataatcctaatataaataatatctacgaccacacaaaatactaactacgtatataactcgtaaacgtacaaatacaaacacaaacctacgacacatctatatacaaactaaaaatcacaacgaatctaaccaaaaccgccgaaaacctccgaactaacgaacacaccgacgactaaataaaacgacgcttcctactccgatccctaactcattattaaactcctcgctctttacaaacgctccctacgcctcccccgctccgaactacaacgacgcaaacgccgaaccgaaccgaacgccgaacaaaaaacgaacgaccgcgctccgaaccgaaatcccgaaaaaacaaataaacgacccgcgccgcgcgcccccacgacccttaacgaaaacgcctcccgaccgcgcta

SEQ ID NO: 30359 - DNA, 525 bp, Artificial Sequence
  chemically treated genomic DNA (Homo sapiens) CpG-island No: 30359
gtgttcgggatttcgtttaggtaatgtttgtagttatataggatgatttgattgaatttgtgtgaggataatcgtttgtgtgtttgtgtgtgcgcgtttacgtgtatgcgcgtgtgtggttttagtgtaggtgatgtttgcggttatataggatgttgattgcgtgtgtgattcgtgggcgtgtagatgtaagtataggtttacgatatatttgtgtataggttgaagattataacgggtttggttagggtcgtcgagggttttcgagttggcgagtatatcgacggttggatggggcgacgttttttgtttcggtttttaatttattattaagtttttcgttttttgtagacgttttttgcgtttttttcgtttcgggttgtagcggcgtaggcgtcgggtcgagtcgagcgtcgagtagggagcgggcggtcgcgtttcgggtcggggtttcgggggagtaggtgagcgattcgcgtcgcgcgtttttacggtttttggcgaaggcgtttttcggtcgcgttg

SEQ ID NO: 30360 - DNA, 525 bp, Artificial Sequence
  chemically treated genomic DNA (Homo sapiens) CpG-island No: 30360
caacgcgaccgaaaaacgccttcgccaaaaaccgtaaaaacgcgcgacgcgaatcgctcacctactcccccgaaaccccgacccgaaacgcgaccgcccgctccctactcgacgctcgactcgacccgacgcctacgccgctacaacccgaaacgaaaaaaacgcaaaaaacgtctacaaaaaacgaaaaacttaataataaattaaaaaccgaaacaaaaaacgtcgccccatccaaccgtcgatatactcgccaactcgaaaaccctcgacgaccctaaccaaacccgttataatcttcaacctatacacaaatatatcgtaaacctatacttacatctacacgcccacgaatcacacacgcaatcaacatcctatataaccgcaaacatcacctacactaaaaccacacacgcgcatacacgtaaacgcgcacacacaaacacacaaacgattatcctcacacaaattcaatcaaatcatcctatataactacaaacattacctaaacgaaatcccgaacac

SEQ ID NO: 30361 - DNA, 577 bp, Artificial Sequence
  chemically treated genomic DNA (Homo sapiens) CpG-island No: 30361
  misc_feature (38)..(38): n is either a, c, g or t
agttttggtgttacgcgggggttcgagtcgcgggggancggaggcgtttagagaggagcgtttcgggcggtcgtagtttcgaataagatgtagcgggtcggaggcggtagcgtttttgggggtaacggcgggggcggcggcgggggttcggtattgttttttttatcgattttttaatcgggtcgtcgtcgtcgcgtttcggttatttgttgtatatcggttattttatgtttatgttttatcggtcgttcgtgttgtcgtaggcgttggtttttgcgtcgttgttcgttggtttttcgtttttcgtttcgttagtttttttcgtcggtcgttttattaatattttttgcgcggggttgggttaggttgtgtttcgatggtggcgttgattatcgcgttgtttagtttcgcgagcgttcgacgttttttacgggttttaggagttcgtcgtcgtcgttgtcgtcgtcgtcgttattgtcgttcgaaataatttcgagttaggcgtcgacgttagagggtgggttggaagttgatgagttgttgtcggttcgggagaaagtggtagagtttttattat

SEQ ID NO: 30362 - DNA, 577 bp, Artificial Sequence
  chemically treated genomic DNA (Homo sapiens) CpG-island No: 30362
  misc_feature (540)..(540): n is either a, c, g or t
ataataaaaactctaccactttctcccgaaccgacaacaactcatcaacttccaacccaccctctaacgtcgacgcctaactcgaaattatttcgaacgacaataacgacgacgacgacaacgacgacgacgaactcctaaaacccgtaaaaaacgtcgaacgctcgcgaaactaaacaacgcgataatcaacgccaccatcgaaacacaacctaacccaaccccgcgcaaaaaatattaataaaacgaccgacgaaaaaaactaacgaaacgaaaaacgaaaaaccaacgaacaacgacgcaaaaaccaacgcctacgacaacacgaacgaccgataaaacataaacataaaataaccgatatacaacaaataaccgaaacgcgacgacgacgacccgattaaaaaatcgataaaaaaaacaataccgaacccccgccgccgcccccgccgttacccccaaaaacgctaccgcctccgacccgctacatcttattcgaaactacgaccgcccgaaacgctcctctctaaacgcctccgntcccccgcgactcgaacccccgcgtaacaccaaaact

SEQ ID NO: 30363 - DNA, 577 bp, Artificial Sequence
  chemically treated genomic DNA (Homo sapiens) CpG-island No: 30363
  misc_feature (540)..(540): n is either a, c, g or t
gtggtgggggttttgttattttttttcgggtcggtagtagtttattagtttttagtttattttttggcgtcggcgtttggttcggggttgtttcgggcggtagtggcggcggcggcggtagcggcggcggcgagtttttggggttcgtagaaagcgtcgggcgttcgcgaagttgggtagcgcggtggttagcgttattatcgaggtatagtttgatttagtttcgcgtagaaggtgttggtaaggcggtcggcgaaagaggttagcggggcgaggggcgggaggttagcgggtagcggcgtaggggttagcgtttgcggtagtacgagcggtcggtagggtatgaatatggggtagtcggtgtatagtaagtggtcggagcgcggcggcggcggttcgattagggagtcgatggagaaggtagtgtcgggttttcgtcgtcgttttcgtcgttgtttttaggggcgttatcgttttcggttcgttgtattttgttcggagttgcggtcgttcggggcgtttttttttgggcgttttcgntttttcgcggttcgggttttcgcgtgatattagggtt

SEQ ID NO: 30364 - DNA, 577 bp, Artificial Sequence
  chemically treated genomic DNA (Homo sapiens) CpG-island No: 30364
  misc_feature (38)..(38): n is either a, c, g or t
aaccctaatatcacgcgaaaacccgaaccgcgaaaaancgaaaacgcccaaaaaaaaacgccccgaacgaccgcaactccgaacaaaatacaacgaaccgaaaacgataacgcccctaaaaacaacgacgaaaacgacgacgaaaacccgacactaccttctccatcgactccctaatcgaaccgccgccgccgcgctccgaccacttactatacaccgactaccccatattcataccctaccgaccgctcgtactaccgcaaacgctaacccctacgccgctacccgctaacctcccgcccctcgccccgctaacctctttcgccgaccgccttaccaacaccttctacgcgaaactaaatcaaactatacctcgataataacgctaaccaccgcgctacccaacttcgcgaacgcccgacgctttctacgaaccccaaaaactcgccgccgccgctaccgccgccgccgccactaccgcccgaaacaaccccgaaccaaacgccgacgccaaaaaataaactaaaaactaataaactactaccgacccgaaaaaaaataacaaaacccccaccac

SEQ ID NO: 30365 - DNA, 943 bp, Artificial Sequence
  chemically treated genomic DNA (Homo sapiens) CpG-island No: 30365
  misc_feature (519)..(519): n is either a, c, g or t
ttgggggtagtttttggagaacggttttagagtttcggagacgttcgttattcgtagtttgttcgcggtgggtttgtcgtcggatttcggtatttttttttttttttttttcgaattatgatcgagatgagcgagaaggagaacgaatcggatgacgcggttatttatagttttttagggatcgttttcgttttttaggaaattaaggtaatttggggggcgtaaggtttgttcgcgttcgggttcggcgtttttttttcggcgggtttttttgtgggttcgggcgttttagggtcgcggtcgtaggttcgcgtgattattgaggtttcgcgtcgttttcgggggtaggagtgggttggcgacgaggggttataaggagttttcgattatatcggtatcgtacgttcgcgcgcgttatcgcgattttttggggaggcggttattggttttcgttggagagatgggcgtagcgaggtcggagggcgcgcgtggaacggtgcgggcggggtacgcgttcgnttgtgcgtgcgaggcgtattttttagcggtcgtcgggttttagtttcgggtttagttcgcgtttttattttcgttcgtgtttttgaatttgtttttataatttgcgtgtttgtgttttggtgtttttgtgtgcgttttttttcgtttttttcggcgttttcgggtgtttattttcgcgttttagggcgtttttttttgttttttcgtagttttgtatttttcgtttttagttttgttgggttcggggacgcgaggtcgcggtcgggggtgcgtagttgcggagttcgcgagggggtttgtagtagcgtcggtcgtcggttacgggcgaggacgggggtttgcggttgtggttttagattagaaagataggtagtttcgcgttttattacgggagcgggattagaggagggggagcgggtagaag

SEQ ID NO: 30366 - DNA, 943 bp, Artificial Sequence
  chemically treated genomic DNA (Homo sapiens) CpG-island No: 30366
  misc_feature (425)..(425): n is either a, c, g or t
cttctacccgctccccctcctctaatcccgctcccgtaataaaacgcgaaactacctatctttctaatctaaaaccacaaccgcaaacccccgtcctcgcccgtaaccgacgaccgacgctactacaaaccccctcgcgaactccgcaactacgcacccccgaccgcgacctcgcgtccccgaacccaacaaaactaaaaacgaaaaatacaaaactacgaaaaaacaaaaaaaaacgccctaaaacgcgaaaataaacacccgaaaacgccgaaaaaaacgaaaaaaaacgcacacaaaaacaccaaaacacaaacacgcaaattataaaaacaaattcaaaaacacgaacgaaaataaaaacgcgaactaaacccgaaactaaaacccgacgaccgctaaaaaatacgcctcgcacgcacaancgaacgcgtaccccgcccgcaccgttccacgcgcgccctccgacctcgctacgcccatctctccaacgaaaaccaataaccgcctccccaaaaaatcgcgataacgcgcgcgaacgtacgataccgatataatcgaaaactccttataacccctcgtcgccaacccactcctacccccgaaaacgacgcgaaacctcaataatcacgcgaacctacgaccgcgaccctaaaacgcccgaacccacaaaaaaacccgccgaaaaaaaaacgccgaacccgaacgcgaacaaaccttacgccccccaaattaccttaatttcctaaaaaacgaaaacgatccctaaaaaactataaataaccgcgtcatccgattcgttctccttctcgctcatctcgatcataattcgaaaaaaaaaaaaaaaaaaataccgaaatccgacgacaaacccaccgcgaacaaactacgaataacgaacgtctccgaaactctaaaaccgttctccaaaaactacccccaa

SEQ ID NO: 30367 - DNA, 943 bp, Artificial Sequence
  chemically treated genomic DNA (Homo sapiens) CpG-island No: 30367
  misc_feature (425)..(425): n is either a, c, g or t
tttttattcgtttttttttttttggtttcgttttcgtggtggggcgcggggttgtttgtttttttggtttggagttataatcgtaggttttcgttttcgttcgtgatcgacggtcggcgttgttgtaggttttttcgcggatttcgtagttgcgtattttcggtcgcggtttcgcgttttcgagtttaatagggttaggagcggggaatgtaggattgcggaggggtagggagagacgttttgagacgcggagataaatattcggagacgtcgggagagacggggagagacgtatatagagatattaagatatagatacgtaggttgtagagataaatttagagatacgagcgaggatagaggcgcggattgagttcgggattgggattcggcggtcgttggagggtgcgtttcgtacgtatagncgggcgcgtatttcgttcgtatcgttttacgcgcgtttttcggtttcgttgcgtttatttttttaacgaagattagtggtcgtttttttagaaggtcgcgatggcgcgcgcgggcgtgcggtgtcggtgtgatcgggggttttttgtggtttttcgtcgttaatttatttttattttcgggagcggcgcggagttttagtggttacgcgggtttgcgatcgcgattttaggacgttcgggtttataggaggattcgtcgggaagagggcgtcgggttcgggcgcggataggttttgcgttttttaagttattttggttttttggagggcggagacggtttttggggggttgtgggtggtcgcgttattcggttcgttttttttttcgtttatttcggttatggttcggggagaggggaggagagggtgtcgagattcgacggtaggtttatcgcgggtaggttgcgggtggcgggcgttttcgggattttgaagtcgttttttagaggttgtttttag

SEQ ID NO: 30368 - DNA, 943 bp, Artificial Sequence
  chemically treated genomic DNA (Homo sapiens) CpG-island No: 30368
  misc_feature (519)..(519): n is either a, c, g or t
ctaaaaacaacctctaaaaaacgacttcaaaatcccgaaaacgcccgccacccgcaacctacccgcgataaacctaccgtcgaatctcgacaccctctcctcccctctccccgaaccataaccgaaataaacgaaaaaaaaaacgaaccgaataacgcgaccacccacaaccccccaaaaaccgtctccgccctccaaaaaaccaaaataacttaaaaaacgcaaaacctatccgcgcccgaacccgacgccctcttcccgacgaatcctcctataaacccgaacgtcctaaaatcgcgatcgcaaacccgcgtaaccactaaaactccgcgccgctcccgaaaataaaaataaattaacgacgaaaaaccacaaaaaacccccgatcacaccgacaccgcacgcccgcgcgcgccatcgcgaccttctaaaaaaacgaccactaatcttcgttaaaaaaataaacgcaacgaaaccgaaaaacgcgcgtaaaacgatacgaacgaaatacgcgcccgnctatacgtacgaaacgcaccctccaacgaccgccgaatcccaatcccgaactcaatccgcgcctctatcctcgctcgtatctctaaatttatctctacaacctacgtatctatatcttaatatctctatatacgtctctccccgtctctcccgacgtctccgaatatttatctccgcgtctcaaaacgtctctccctacccctccgcaatcctacattccccgctcctaaccctattaaactcgaaaacgcgaaaccgcgaccgaaaatacgcaactacgaaatccgcgaaaaaacctacaacaacgccgaccgtcgatcacgaacgaaaacgaaaacctacgattataactccaaaccaaaaaaacaaacaaccccgcgccccaccacgaaaacgaaaccaaaaaaaaaaaaacgaataaaaa

SEQ ID NO: 30369 - DNA, 554 bp, Artificial Sequence
  chemically treated genomic DNA (Homo sapiens) CpG-island No: 30369
taacgggcggacgtatttggcgaggattttcggtagtcggattttgcgttagtgtagcgttcgtcggatttttttagtattcgtcgtcgttttttttttttagttagggttatttttacgtttcgttttaacgtggtagtcgtagtcgtagttacgttttgcgtttaatattttcgggagcgatattttttttcgtttattcgacgtatagttcgttacggtattttcgggatcggcggtagtttgggaggcggggtacgtttcgttggttggtggtttttgcggttatcggtttcggcgatcgtagaaatttttttttgaggggcggcgcgtagaatgtggatggggtagttaggattagtgggtaaaggattagtgtagagggtgttttcgtttggtcgaataatcgtcgtggttcgtaggaacgttacgtagtattagttttgtgaggcgtcggtagtttttggcgatattgttcgcgttaaattaggtggaaaatcgggttgtaagggttttattgtaatttgtgattgagtttttaaaattatttattt

SEQ ID NO: 30370 - DNA, 554 bp, Artificial Sequence
  chemically treated genomic DNA (Homo sapiens) CpG-island No: 30370
aaataaataattttaaaaactcaatcacaaattacaataaaacccttacaacccgattttccacctaatttaacgcgaacaatatcgccaaaaactaccgacgcctcacaaaactaatactacgtaacgttcctacgaaccacgacgattattcgaccaaacgaaaacaccctctacactaatcctttacccactaatcctaactaccccatccacattctacgcgccgcccctcaaaaaaaaatttctacgatcgccgaaaccgataaccgcaaaaaccaccaaccaacgaaacgtaccccgcctcccaaactaccgccgatcccgaaaataccgtaacgaactatacgtcgaataaacgaaaaaaaatatcgctcccgaaaatattaaacgcaaaacgtaactacgactacgactaccacgttaaaacgaaacgtaaaaataaccctaactaaaaaaaaaaaacgacgacgaatactaaaaaaatccgacgaacgctacactaacgcaaaatccgactaccgaaaatcctcgccaaatacgtccgcccgtta

SEQ ID NO: 30371 - DNA, 554 bp, Artificial Sequence
  chemically treated genomic DNA (Homo sapiens) CpG-island No: 30371
aagtgggtaattttaagaatttagttataaattataataaagtttttgtagttcgattttttatttggtttggcgcgggtagtgtcgttaggggttgtcgacgttttataggattagtgttacgtggcgtttttgcgggttacggcggttattcggttagacggggatattttttgtattagttttttatttattagttttggttattttatttatattttgcgcgtcgttttttagaaaagggtttttacgatcgtcggggtcgatgatcgtagaggttattaattagcggagcgtatttcgttttttaggttatcgtcggtttcggaagtgtcgtggcgggttgtgcgtcgggtgggcggggaaagatgtcgttttcggaagtgttgggcgtagggcgtggttgcggttgcggttgttacgttggaacggaacgtggaggtggttttggttggggaggaggggcggcggcgaatgttgggagagttcgacgagcgttgtattaacgtaggattcggttgtcgaaggttttcgttaggtgcgttcgttcgttg

SEQ ID NO: 30372 - DNA, 554 bp, Artificial Sequence
  chemically treated genomic DNA (Homo sapiens) CpG-island No: 30372
caacgaacgaacgcacctaacgaaaaccttcgacaaccgaatcctacgttaatacaacgctcgtcgaactctcccaacattcgccgccgcccctcctccccaaccaaaaccacctccacgttccgttccaacgtaacaaccgcaaccgcaaccacgccctacgcccaacacttccgaaaacgacatctttccccgcccacccgacgcacaacccgccacgacacttccgaaaccgacgataacctaaaaaacgaaatacgctccgctaattaataacctctacgatcatcgaccccgacgatcgtaaaaacccttttctaaaaaacgacgcgcaaaatataaataaaataaccaaaactaataaataaaaaactaatacaaaaaatatccccgtctaaccgaataaccgccgtaacccgcaaaaacgccacgtaacactaatcctataaaacgtcgacaacccctaacgacactacccgcgccaaaccaaataaaaaatcgaactacaaaaactttattataatttataactaaattcttaaaattacccactt

SEQ ID NO: 30373 - DNA, 626 bp, Artificial Sequence
  chemically treated genomic DNA (Homo sapiens) CpG-island No: 30373
cgggaagagagagaattttaatttttatagtgttttaatttcgtttttacgtttcgacgttgcgtacgttacgtcgcgttatatacgcggcgcgatttatagtgcggttcggtttcgttttacgttacgttacggttcgtcggcgtcgtagggagttcgaaggtttcgaggttgtttttatacgtattggtggaaggagaggtcgcgttttcggttgagtacggtgttacgggtgttgtagtttattgcggagtaatttcgggttatttttttgttacgtggggttttattttcggggttttcgcgatagtatgaattacgattattttagtttcgttcgttgattttgcggttacgatttttatttgttacgaaaggcgggttttagaggcgcgggatttttatatttttttttcgaaggttttgcgtcggtgtcgtagttaatgataggttacgttgtgttttagtagttaatcggaagggtttgagtttgaagacgtgtatttgatcgttttttttttcgcgttggaggcggaatagtgggttttgttgtaatcggtttattttttttttgtttttatttattttggtataatttggcgttatcgttttttttgtgaggttaa

SEQ ID NO: 30374 - DNA, 626 bp, Artificial Sequence
  chemically treated genomic DNA (Homo sapiens) CpG-island No: 30374
ttaacctcacaaaaaaaacgataacgccaaattataccaaaataaataaaaacaaaaaaaaaataaaccgattacaacaaaacccactattccgcctccaacgcgaaaaaaaaaacgatcaaatacacgtcttcaaactcaaacccttccgattaactactaaaacacaacgtaacctatcattaactacgacaccgacgcaaaaccttcgaaaaaaaaatataaaaatcccgcgcctctaaaacccgcctttcgtaacaaataaaaatcgtaaccgcaaaatcaacgaacgaaactaaaataatcgtaattcatactatcgcgaaaaccccgaaaataaaaccccacgtaacaaaaaaataacccgaaattactccgcaataaactacaacacccgtaacaccgtactcaaccgaaaacgcgacctctccttccaccaatacgtataaaaacaacctcgaaaccttcgaactccctacgacgccgacgaaccgtaacgtaacgtaaaacgaaaccgaaccgcactataaatcgcgccgcgtatataacgcgacgtaacgtacgcaacgtcgaaacgtaaaaacgaaattaaaacactataaaaattaaaattctctctcttcccg

SEQ ID NO: 30375 - DNA, 626 bp, Artificial Sequence
  chemically treated genomic DNA (Homo sapiens) CpG-island No: 30375
ttggttttataagaaggacgatggcgttagattgtgttagaatgggtgaaaatagaaggaaaataaatcggttgtagtaaaatttattatttcgtttttaacgcggagggaggagcggttaaatgtacgtttttaggtttaggttttttcgattggttgttgggatataacgtggtttgttattggttacggtatcggcgtagggttttcggagaggaagtgtggaagtttcgcgtttttaaagttcgtttttcgtgataaataaaggtcgtagtcgtagagttaacgggcggagttaaagtggtcgtgatttatgttgtcgcgggaatttcgaaggtggggttttacgtaataagaagatgattcgaagttgtttcgtagtgggttgtagtattcgtgatatcgtgtttagtcgggagcgcggtttttttttttattagtgcgtatgggagtagtttcgaagttttcgaattttttgcggcgtcggcgggtcgtggcgtggcgtggggcggggtcgggtcgtattgtgggtcgcgtcgcgtgtgtgacgcgacgtgacgtgcgtagcgtcggggcgtgggagcggaattggggtattgtgagaattgagatttttttttttttcg

SEQ ID NO: 30376 - DNA, 626 bp, Artificial Sequence
  chemically treated genomic DNA (Homo sapiens) CpG-island No: 30376
cgaaaaaaaaaaaaatctcaattctcacaataccccaattccgctcccacgccccgacgctacgcacgtcacgtcgcgtcacacacgcgacgcgacccacaatacgacccgaccccgccccacgccacgccacgacccgccgacgccgcaaaaaattcgaaaacttcgaaactactcccatacgcactaataaaaaaaaaaaccgcgctcccgactaaacacgatatcacgaatactacaacccactacgaaacaacttcgaatcatcttcttattacgtaaaaccccaccttcgaaattcccgcgacaacataaatcacgaccactttaactccgcccgttaactctacgactacgacctttatttatcacgaaaaacgaactttaaaaacgcgaaacttccacacttcctctccgaaaaccctacgccgataccgtaaccaataacaaaccacgttatatcccaacaaccaatcgaaaaaacctaaacctaaaaacgtacatttaaccgctcctccctccgcgttaaaaacgaaataataaattttactacaaccgatttattttccttctattttcacccattctaacacaatctaacgccatcgtccttcttataaaaccaa

SEQ ID NO: 30377 - DNA, 974 bp, Artificial Sequence
  chemically treated genomic DNA (Homo sapiens) CpG-island No: 30377
gttttttgcgcgtttaggggacgaggaggatgcgcgggcgcgatcgcgatagttttgtttgtttttttcgggagaaagcgttttaggtagttttttgagtttcggttttcgacgtagtaaaagagttcgggcgtttacgtcgttttcggggttttttattgttatcgggataaagttttgggaggagttttcgttttcgcgagtcggatagggcggaggttttttcgtcgcgcgcgttttatcgttttttagtttcggattcgtcgtttgcgtttttttttggcgcgttttacggtgtagcgggcggcggtttcgcgcgtttgcgggaggcgtttcgggatgttttcgtttggttttttttttcgtttttcgcgttgattttattcgtttttcgttttttgttcggagtcgtcgttacgcgggaagggagggagtcggtttcgagattgtattatttcgtatcggttgttgtagggttagagggagtaggtggagcgagagagcgagtcgcgagtcggagcgcgttagatttagggcgagattgtagtgacgcggttcgggagatatggcggacgggcgtttttgaataagtagaattcggagtttttcgttattcgcggtcgtcgtagttcgggttatgtcgtacggttgttgatcgtacgtaggggtcggtttcgaggatatatgcggcggtttttgtcgtttcgtttttgattttttgttttgttttttatgttgtatttttcgttagtttttcgggcggtgtagttgtcgttgttattagagtcggcggggtatcgcgttgtttatttattcggtcgtattttttttttcgtttttatttatttttttttattttttttttttttttttcgttagtttcgtatttattttttttatttcgtaatttttttttgtttttatttatcggggttatggtcgtagaagaggtattgtagacggtggattattat

SEQ ID NO: 30378 - DNA, 974 bp, Artificial Sequence
  chemically treated genomic DNA (Homo sapiens) CpG-island No: 30378
ataataatccaccgtctacaatacctcttctacgaccataaccccgataaataaaaacaaaaaaaaattacgaaataaaaaaaataaatacgaaactaacgaaaaaaaaaaaaaaaaaataaaaaaaaataaataaaaacgaaaaaaaaaatacgaccgaataaataaacaacgcgataccccgccgactctaataacaacgacaactacaccgcccgaaaaactaacgaaaaatacaacataaaaaacaaaacaaaaaatcaaaaacgaaacgacaaaaaccgccgcatatatcctcgaaaccgacccctacgtacgatcaacaaccgtacgacataacccgaactacgacgaccgcgaataacgaaaaactccgaattctacttattcaaaaacgcccgtccgccatatctcccgaaccgcgtcactacaatctcgccctaaatctaacgcgctccgactcgcgactcgctctctcgctccacctactccctctaaccctacaacaaccgatacgaaataatacaatctcgaaaccgactccctcccttcccgcgtaacgacgactccgaacaaaaaacgaaaaacgaataaaatcaacgcgaaaaacgaaaaaaaaaaccaaacgaaaacatcccgaaacgcctcccgcaaacgcgcgaaaccgccgcccgctacaccgtaaaacgcgccaaaaaaaaacgcaaacgacgaatccgaaactaaaaaacgataaaacgcgcgcgacgaaaaaacctccgccctatccgactcgcgaaaacgaaaactcctcccaaaactttatcccgataacaataaaaaaccccgaaaacgacgtaaacgcccgaactcttttactacgtcgaaaaccgaaactcaaaaaactacctaaaacgctttctcccgaaaaaaacaaacaaaactatcgcgatcgcgcccgcgcatcctcctcgtcccctaaacgcgcaaaaaac

SEQ ID NO: 30379 - DNA, 974 bp, Artificial Sequence
  chemically treated genomic DNA (Homo sapiens) CpG-island No: 30379
ataatggtttatcgtttgtaatattttttttgcggttatagtttcggtggatggaggtaggagggggttacggggtgggggagatggatgcgaagttggcggggaaagggagaaggaaatgggaagggatgggtggaaacggaaaagaaagtgcggtcggatgaatgagtagcgcgatgtttcgtcggttttggtggtagcggtagttatatcgttcgagaaattgacgagaaatgtaatatggagaatagggtagagggttaggggcgaggcggtaaaggtcgtcgtatgtgttttcggggtcggtttttgcgtgcggttagtagtcgtgcggtatggttcgggttgcggcggtcgcgggtagcgaggggtttcggattttgtttatttagagacgttcgttcgttatgtttttcgggtcgcgttattgtagtttcgttttgggtttggcgcgtttcggttcgcggttcgttttttcgttttatttgttttttttggttttgtagtagtcggtgcggaatgatgtagtttcggggtcggtttttttttttttcgcgtggcggcggtttcgagtagggggcggggagcggatggagttagcgcggggggcggagggaaggattagacggaaatatttcgaggcgtttttcgtaggcgcgcggggtcgtcgttcgttgtatcgtgaggcgcgttaggaggaggcgtaggcgacgggttcgggattgggaagcggtggggcgcgcgcggcgggggagttttcgttttgttcggttcgcgggggcgggagttttttttagggttttgtttcggtggtagtagaagatttcgagagcggcgtgggcgttcgggtttttttgttacgtcgagggtcgaagtttaggaaattgtttggaacgttttttttcgagaaaagtaaataaaattatcgcggtcgcgttcgcgtatttttttcgttttttgggcgcgtagaaggt

SEQ ID NO: 30380 - DNA, 974 bp, Artificial Sequence
  chemically treated genomic DNA (Homo sapiens) CpG-island No: 30380
accttctacgcgcccaaaaaacgaaaaaaatacgcgaacgcgaccgcgataattttatttacttttctcgaaaaaaaacgttccaaacaatttcctaaacttcgaccctcgacgtaacaaaaaaacccgaacgcccacgccgctctcgaaatcttctactaccaccgaaacaaaaccctaaaaaaaactcccgcccccgcgaaccgaacaaaacgaaaactcccccgccgcgcgcgccccaccgcttcccaatcccgaacccgtcgcctacgcctcctcctaacgcgcctcacgatacaacgaacgacgaccccgcgcgcctacgaaaaacgcctcgaaatatttccgtctaatccttccctccgccccccgcgctaactccatccgctccccgccccctactcgaaaccgccgccacgcgaaaaaaaaaaaaaccgaccccgaaactacatcattccgcaccgactactacaaaaccaaaaaaaacaaataaaacgaaaaaacgaaccgcgaaccgaaacgcgccaaacccaaaacgaaactacaataacgcgacccgaaaaacataacgaacgaacgtctctaaataaacaaaatccgaaacccctcgctacccgcgaccgccgcaacccgaaccataccgcacgactactaaccgcacgcaaaaaccgaccccgaaaacacatacgacgacctttaccgcctcgcccctaaccctctaccctattctccatattacatttctcgtcaatttctcgaacgatataactaccgctaccaccaaaaccgacgaaacatcgcgctactcattcatccgaccgcactttcttttccgtttccacccatcccttcccatttccttctccctttccccgccaacttcgcatccatctcccccaccccgtaaccccctcctacctccatccaccgaaactataaccgcaaaaaaaatattacaaacgataaaccattat

SEQ ID NO: 30381 - DNA, 789 bp, Artificial Sequence
  chemically treated genomic DNA (Homo sapiens) CpG-island No: 30381
gaagagaagtaaagcggcgcgtattttgtttagcgattcgtttcgttcgttcggtgaatttgcgtttgtagaacgcgttattgaaggttttttagcgttggttggttttttttttttcgtttcgttttttttttttagggattagtcgtagttttcgtcgtcgtcgattcgttaaggtttcgggtcgtagtatttagatcgtcgtggcgaacgatttttcgggggatgcggttaatttttaagttttttgggtcgtaattttcgagttttttagggcgtcggtttgaggaatcgttaatttttcggtttcgtgggtttttcggtagcgttgtggataagtgcgaatgagattttgtgttcgttggcgttcgcgtaggtggtagtggtgtttggtgcgcgcgtcggggaggtggtggtgggggggcgtcgcgtcgttatcgttgcggggtcgggtttcgcgttgtcgttgtcgtcgtttcgcgtcgttaaggtgtcgcgcgaggtggggggaggggaaatcgttcgtcgggagcgtgtaaatggggtcgcgcggcgttacgacgagaatttgttggggggggatataaacgcgtcggggcggaggagaggatagcggtgtcgttatttatattttttcgttcggattcgtggtcgaagtcgggtttcgggttcggtttcgcggtgtttttaacgtttcgaagaggtgttatttttttgtcggagatcggggcgcggggatgagagttggtgtatatgagtcgtgatcgggttcgcgattagttttggtag

SEQ ID NO: 30382 - DNA, 789 bp, Artificial Sequence
  chemically treated genomic DNA (Homo sapiens) CpG-island No: 30382
ctaccaaaactaatcgcgaacccgatcacgactcatatacaccaactctcatccccgcgccccgatctccgacaaaaaaataacacctcttcgaaacgttaaaaacaccgcgaaaccgaacccgaaacccgacttcgaccacgaatccgaacgaaaaaatataaataacgacaccgctatcctctcctccgccccgacgcgtttatatccccccccaacaaattctcgtcgtaacgccgcgcgaccccatttacacgctcccgacgaacgatttcccctccccccacctcgcgcgacaccttaacgacgcgaaacgacgacaacgacaacgcgaaacccgaccccgcaacgataacgacgcgacgcccccccaccaccacctccccgacgcgcgcaccaaacaccactaccacctacgcgaacgccaacgaacacaaaatctcattcgcacttatccacaacgctaccgaaaaacccacgaaaccgaaaaattaacgattcctcaaaccgacgccctaaaaaactcgaaaattacgacccaaaaaacttaaaaattaaccgcatcccccgaaaaatcgttcgccacgacgatctaaatactacgacccgaaaccttaacgaatcgacgacgacgaaaactacgactaatccctaaaaaaaaaaaacgaaacgaaaaaaaaaaaaccaaccaacgctaaaaaaccttcaataacgcgttctacaaacgcaaattcaccgaacgaacgaaacgaatcgctaaacaaaatacgcgccgctttacttctcttc

SEQ ID NO: 30383 - DNA, 789 bp, Artificial Sequence
  chemically treated genomic DNA (Homo sapiens) CpG-island No: 30383
ttgttaaagttgatcgcgagttcggttacggtttatatatattagtttttattttcgcgtttcgattttcgatagaaaggtggtattttttcggggcgttggagatatcgcgagatcgagttcgagattcggtttcgattacgaattcgggcgggggggtgtgggtaacggtatcgttgttttttttttcgtttcggcgcgtttgtatttttttttagtaggttttcgtcgtagcgtcgcgcggttttatttatacgttttcggcgagcggttttttttttttttatttcgcgcggtattttagcggcgcgaggcggcggtagcggtagcgcgagattcggtttcgtagcggtggcggcgcggcgtttttttattattattttttcggcgcgcgtattaaatattattgttatttgcgcgagcgttagcgggtatagggttttattcgtatttatttatagcgttgtcgggggatttacggggtcgagggattagcgattttttaggtcggcgttttgggaggttcggaagttgcggtttagggagtttggagattggtcgtatttttcggagagtcgttcgttacgacgatttagatgttgcggttcgggattttgacgaatcggcggcgacgaaagttgcgattagtttttgaggaaaaggggcggggcggaggggaggaggttagttagcgttggggaatttttagtggcgcgttttgtagacgtagatttatcgggcgggcggggcgaatcgttggataggatgcgcgtcgttttgttttttttt

SEQ ID NO: 30384 - DNA, 789 bp, Artificial Sequence
  chemically treated genomic DNA (Homo sapiens) CpG-island No: 30384
aaaaaaaaacaaaacgacgcgcatcctatccaacgattcgccccgcccgcccgataaatctacgtctacaaaacgcgccactaaaaattccccaacgctaactaacctcctcccctccgccccgccccttttcctcaaaaactaatcgcaactttcgtcgccgccgattcgtcaaaatcccgaaccgcaacatctaaatcgtcgtaacgaacgactctccgaaaaatacgaccaatctccaaactccctaaaccgcaacttccgaacctcccaaaacgccgacctaaaaaatcgctaatccctcgaccccgtaaatcccccgacaacgctataaataaatacgaataaaaccctatacccgctaacgctcgcgcaaataacaataatatttaatacgcgcgccgaaaaaataataataaaaaaacgccgcgccgccaccgctacgaaaccgaatctcgcgctaccgctaccgccgcctcgcgccgctaaaataccgcgcgaaataaaaaaaaaaaaaaccgctcgccgaaaacgtataaataaaaccgcgcgacgctacgacgaaaacctactaaaaaaaaatacaaacgcgccgaaacgaaaaaaaaaacaacgataccgttacccacacccccccgcccgaattcgtaatcgaaaccgaatctcgaactcgatctcgcgatatctccaacgccccgaaaaaataccacctttctatcgaaaatcgaaacgcgaaaataaaaactaatatatataaaccgtaaccgaactcgcgatcaactttaacaa

SEQ ID NO: 30385 - DNA, 680 bp, Artificial Sequence
  chemically treated genomic DNA (Homo sapiens) CpG-island No: 30385
tcggttttcgttttttattattttgggtatttcgttcgtttgtggtttcgaaattttttttattagtggcgtacggtttgacgggagttgtagtttttcggttttcgtttattattttaagtcgagataatggaaggggatggggcggggttatcggtaaagatggcggttgtagggtcggggcgattgcgatatgggatgtgtagtttaggcgtttggttttttttttgcggaaatgagggagaggattacgaaaaagatggcgatttcgtttttcgatttttgcgtcggtgtttgttgggaaatgtagttttttgtcgagtttaatagagaaaggacgtcgttgttgaaatgtgaatttcggcggatacgttaaattgcgaggcgacggaaacggaaagatttttttttttttttttcgttatcggtttttgaatagtttggcgggaaatgtagttttaagtttttattcgcgagtggaggggaaggatttatcgttatagtgggattagtgcgggtgggggagaaaacgtcgtgcgattcgggaataaagaatgtttgtttttatggagcgaggatttcgcgttttaggggagggtttttaaaggaggtagtaggaattagttttgtcgataggggggcgtgttttcgtcgagagttatttatattttggtttttag

SEQ ID NO: 30386 - DNA, 680 bp, Artificial Sequence
  chemically treated genomic DNA (Homo sapiens) CpG-island No: 30386
ctaaaaaccaaaatataaataactctcgacgaaaacacgcccccctatcgacaaaactaattcctactacctcctttaaaaaccctcccctaaaacgcgaaatcctcgctccataaaaacaaacattctttattcccgaatcgcacgacgttttctcccccacccgcactaatcccactataacgataaatccttcccctccactcgcgaataaaaacttaaaactacatttcccgccaaactattcaaaaaccgataacgaaaaaaaaaaaaaaaaatctttccgtttccgtcgcctcgcaatttaacgtatccgccgaaattcacatttcaacaacgacgtcctttctctattaaactcgacaaaaaactacatttcccaacaaacaccgacgcaaaaatcgaaaaacgaaatcgccatctttttcgtaatcctctccctcatttccgcaaaaaaaaaaccaaacgcctaaactacacatcccatatcgcaatcgccccgaccctacaaccgccatctttaccgataaccccgccccatccccttccattatctcgacttaaaataataaacgaaaaccgaaaaactacaactcccgtcaaaccgtacgccactaataaaaaaaatttcgaaaccacaaacgaacgaaatacccaaaataataaaaaacgaaaaccga

SEQ ID NO: 30387 - DNA, 680 bp, Artificial Sequence
  chemically treated genomic DNA (Homo sapiens) CpG-island No: 30387
ttagggattagagtgtgaatgattttcgacgagaatacgtttttttgtcgataagattgatttttgttgttttttttaagggtttttttttgaaacgcgaagttttcgttttatgagagtagatattttttattttcggatcgtacgacgtttttttttttattcgtattgattttattgtgacgataaattttttttttttattcgcgagtgaaagtttgggattatatttttcgttaggttgtttagaagtcggtggcggagagaggagaaaagagttttttcgttttcgtcgtttcgtaatttggcgtgttcgtcgggatttatattttaatagcgacgttttttttttgttggattcggtaaggaattatattttttagtaggtatcggcgtagaggtcgaggggcgaggtcgttatttttttcgtagtttttttttttattttcgtagggaagaggttagacgtttggattatatattttatgtcgtagtcgtttcggttttgtagtcgttatttttgtcggtggtttcgttttatttttttttattgtttcgatttgagatgatagacgggagtcgggagattgtaattttcgttaggtcgtgcgttattggtgggggggatttcgagattataggcgggcgaggtgtttaaggtggtggaaagcggagatcgg

SEQ ID NO: 30388 - DNA, 680 bp, Artificial Sequence
  chemically treated genomic DNA (Homo sapiens) CpG-island No: 30388
ccgatctccgctttccaccaccttaaacacctcgcccgcctataatctcgaaatcccccccaccaataacgcacgacctaacgaaaattacaatctcccgactcccgtctatcatctcaaatcgaaacaataaaaaaaaataaaacgaaaccaccgacaaaaataacgactacaaaaccgaaacgactacgacataaaatatataatccaaacgtctaacctcttccctacgaaaataaaaaaaaaaactacgaaaaaaataacgacctcgcccctcgacctctacgccgatacctactaaaaaatataattccttaccgaatccaacaaaaaaaaaacgtcgctattaaaatataaatcccgacgaacacgccaaattacgaaacgacgaaaacgaaaaaactcttttctcctctctccgccaccgacttctaaacaacctaacgaaaaatataatcccaaactttcactcgcgaataaaaaaaaaaaatttatcgtcacaataaaatcaatacgaataaaaaaaaaaacgtcgtacgatccgaaaataaaaaatatctactctcataaaacgaaaacttcgcgtttcaaaaaaaaacccttaaaaaaaacaacaaaaatcaatcttatcgacaaaaaaacgtattctcgtcgaaaatcattcacactctaatccctaa

SEQ ID NO: 30389 - DNA, 690 bp, Artificial Sequence
  chemically treated genomic DNA (Homo sapiens) CpG-island No: 30389
gcggatatttatcgcggtttacgtagcgtaggatatagattttgtcgcgtatttcgcgtttacgtggtttgaatatacggtttcggttttgtttcgcgcgttcggtcgtaattttcgtttttcgtttttaattcgcgcgttcgtttttaattttcgttttcggcggcgggtagggggcgttgagcgtttaggcgttttaagggggcgggttcgggtcggggcggggtcggtcgggtttttaggtttgggttttggtcgttcgcgttatcgggtcgtttcggggataggtcggggcggggcgcggcggtaggaaacggggcggggatttgcggaggcgttggggacgagagagggcgcgttaattttaggggggacgtaggtcgagagcgcggcgttcggtttggcgcggagtttgagtcgtcggacgggaggcggttttcgcgcggttcggtttcggttttagtttcgttagtatggtcggtcggattgtacgggtcgagattcggagtcgggttaaggatgatattaagaaggtgatggcgattatcgagaaggttcggagatggtgagcgttgttcgggggttagggacgggatatagcgggattattagtattaaaggcgtttacgttgttttcgttagttttgggtttcgggtgttcggtgtatttttatttattagttttgtttt

SEQ ID NO: 30390 - DNA, 690 bp, Artificial Sequence
  chemically treated genomic DNA (Homo sapiens) CpG-island No: 30390
aaaacaaaactaataaataaaaatacaccgaacacccgaaacccaaaactaacgaaaacaacgtaaacgcctttaatactaataatcccgctatatcccgtccctaacccccgaacaacgctcaccatctccgaaccttctcgataatcgccatcaccttcttaatatcatccttaacccgactccgaatctcgacccgtacaatccgaccgaccatactaacgaaactaaaaccgaaaccgaaccgcgcgaaaaccgcctcccgtccgacgactcaaactccgcgccaaaccgaacgccgcgctctcgacctacgtcccccctaaaattaacgcgccctctctcgtccccaacgcctccgcaaatccccgccccgtttcctaccgccgcgccccgccccgacctatccccgaaacgacccgataacgcgaacgaccaaaacccaaacctaaaaacccgaccgaccccgccccgacccgaacccgcccccttaaaacgcctaaacgctcaacgccccctacccgccgccgaaaacgaaaattaaaaacgaacgcgcgaattaaaaacgaaaaacgaaaattacgaccgaacgcgcgaaacaaaaccgaaaccgtatattcaaaccacgtaaacgcgaaatacgcgacaaaatctatatcctacgctacgtaaaccgcgataaatatccgc

SEQ ID NO: 30391 - DNA, 690 bp, Artificial Sequence
  chemically treated genomic DNA (Homo sapiens) CpG-island No: 30391
agggtaaagttagtgggtggagatatatcgaatattcggggtttagagttggcgagggtagcgtagacgtttttggtgttggtggtttcgttgtgtttcgtttttggttttcgagtagcgtttattattttcggattttttcgatggtcgttattatttttttgatgttatttttggttcggtttcgggtttcggttcgtatagttcggtcggttatgttggcggggttggggtcggggtcgagtcgcgcggaggtcgtttttcgttcggcggtttaggtttcgcgttaggtcgggcgtcgcgttttcggtttgcgttttttttggagttggcgcgttttttttcgtttttaacgttttcgtaagttttcgtttcgttttttgtcgtcgcgtttcgtttcggtttgttttcggagcggttcggtggcgcgggcggttagagtttaggtttggaagttcggtcggtttcgtttcgattcgggttcgtttttttggagcgtttggacgtttagcgttttttgttcgtcgtcgagagcgggagttggggacggacgcgcgagttggggacggagagcgggagttgcgatcggacgcgcgaggtagggtcgaggtcgtgtgtttagattacgtgggcgcggggtgcgcgatagggtttgtgttttgcgttgcgtgagtcgcggtgggtgttcgt

SEQ ID NO: 30392 - DNA, 690 bp, Artificial Sequence
  chemically treated genomic DNA (Homo sapiens) CpG-island No: 30392
acgaacacccaccgcgactcacgcaacgcaaaacacaaaccctatcgcgcaccccgcgcccacgtaatctaaacacacgacctcgaccctacctcgcgcgtccgatcgcaactcccgctctccgtccccaactcgcgcgtccgtccccaactcccgctctcgacgacgaacaaaaaacgctaaacgtccaaacgctccaaaaaaacgaacccgaatcgaaacgaaaccgaccgaacttccaaacctaaactctaaccgcccgcgccaccgaaccgctccgaaaacaaaccgaaacgaaacgcgacgacaaaaaacgaaacgaaaacttacgaaaacgttaaaaacgaaaaaaaacgcgccaactccaaaaaaaacgcaaaccgaaaacgcgacgcccgacctaacgcgaaacctaaaccgccgaacgaaaaacgacctccgcgcgactcgaccccgaccccaaccccgccaacataaccgaccgaactatacgaaccgaaacccgaaaccgaaccaaaaataacatcaaaaaaataataacgaccatcgaaaaaatccgaaaataataaacgctactcgaaaaccaaaaacgaaacacaacgaaaccaccaacaccaaaaacgtctacgctaccctcgccaactctaaaccccgaatattcgatatatctccacccactaactttaccct

SEQ ID NO: 30393 - DNA, 561 bp, Artificial Sequence
  chemically treated genomic DNA (Homo sapiens) CpG-island No: 30393
gagagacggaatttagcgggaggaggcggggcgagttgtttcgcggcgtttaggtcgagttttcgggtagtagttggtttaggtcgttttcggtgcggtttagttattcgcggtagaggtcgtaaacgcggagttttagtattttggcggggaagatttcggtggcggaggcggttgaggcggtggcggcggggggttcggtcggggttcgcggttggcgcgtttagcgcgttagtaaggttttacggcggcgtttagggttcgggttttggcgtcgcgttttttaggcggcgtaggtcggcgcgcgcgggtttagttcggtttggcggcgatatattgcgtttagtagcgggggtagcgcggttatcgtcgcgtttagtcgtagtcgttcgtgtattggtagtttcgcgtggttcggagtcggggcgtttaggtcggttatcggtagtcgcggcggcgagaagttgggtagttcgaaggggtttttttggagttgtatttgcggagatacggtcggcgggttagcggggtttcggagtacgggtagggggttgttaattg

SEQ ID NO: 30394 - DNA, 561 bp, Artificial Sequence
  chemically treated genomic DNA (Homo sapiens) CpG-island No: 30394
caattaacaaccccctacccgtactccgaaaccccgctaacccgccgaccgtatctccgcaaatacaactccaaaaaaaccccttcgaactacccaacttctcgccgccgcgactaccgataaccgacctaaacgccccgactccgaaccacgcgaaactaccaatacacgaacgactacgactaaacgcgacgataaccgcgctacccccgctactaaacgcaatatatcgccgccaaaccgaactaaacccgcgcgcgccgacctacgccgcctaaaaaacgcgacgccaaaacccgaaccctaaacgccgccgtaaaaccttactaacgcgctaaacgcgccaaccgcgaaccccgaccgaaccccccgccgccaccgcctcaaccgcctccgccaccgaaatcttccccgccaaaatactaaaactccgcgtttacgacctctaccgcgaataactaaaccgcaccgaaaacgacctaaaccaactactacccgaaaactcgacctaaacgccgcgaaacaactcgccccgcctcctcccgctaaattccgtctctc

SEQ ID NO: 30395 - DNA, 561 bp, Artificial Sequence
  chemically treated genomic DNA (Homo sapiens) CpG-island No: 30395
tagttaatagttttttgttcgtgtttcggggtttcgttgattcgtcggtcgtgttttcgtaggtgtagttttagggagattttttcgggttgtttagtttttcgtcgtcgcggttgtcggtggtcggtttgagcgtttcggtttcgagttacgcggggttgttagtgtacgagcggttgcggttggacgcggcggtggtcgcgttgttttcgttgttggacgtagtgtgtcgtcgttaggtcgagttgaattcgcgcgcgtcggtttgcgtcgtttggaggacgcggcgttaaggttcgggttttgggcgtcgtcgtggagttttgttggcgcgttgggcgcgttaatcgcgggtttcggtcgagtttttcgtcgttatcgttttagtcgttttcgttatcggggtttttttcgttaaggtgttggggtttcgcgtttgcggtttttatcgcgagtggttgagtcgtatcgagggcgatttgggttagttgttgttcgggggttcggtttgagcgtcgcggggtagttcgtttcgttttttttcgttgggtttcgtttttt

SEQ ID NO: 30396 - DNA, 561 bp, Artificial Sequence
  chemically treated genomic DNA (Homo sapiens) CpG-island No: 30396
aaaaaacgaaacccaacgaaaaaaaacgaaacgaactaccccgcgacgctcaaaccgaacccccgaacaacaactaacccaaatcgccctcgatacgactcaaccactcgcgataaaaaccgcaaacgcgaaaccccaacaccttaacgaaaaaaaccccgataacgaaaacgactaaaacgataacgacgaaaaactcgaccgaaacccgcgattaacgcgcccaacgcgccaacaaaactccacgacgacgcccaaaacccgaaccttaacgccgcgtcctccaaacgacgcaaaccgacgcgcgcgaattcaactcgacctaacgacgacacactacgtccaacaacgaaaacaacgcgaccaccgccgcgtccaaccgcaaccgctcgtacactaacaaccccgcgtaactcgaaaccgaaacgctcaaaccgaccaccgacaaccgcgacgacgaaaaactaaacaacccgaaaaaatctccctaaaactacacctacgaaaacacgaccgacgaatcaacgaaaccccgaaacacgaacaaaaaactattaacta

SEQ ID NO: 30397 - DNA, 747 bp, Artificial Sequence
  chemically treated genomic DNA (Homo sapiens) CpG-island No: 30397
gtttcgcggagataaaggtcggcggcgtagttttgggaagggttaaggttatagacgtagttttgcgcgtgttagagcggtcggtggcggattttcggttggggcgcgggcgcgcgtcgcgtgttttcgattcgtcgaggttgagatttcgggtaattttagtagtgcgtagggttgtattgttttcgtttgcggtttgtagtaagcgggtaggggatatgtcgcgtggtttcgtttggtttgcggcgggaaattcgtatttaggttagattttttcgtagggttcgtattcgcgatttgggttgtgggtagtatcgtggtttttcggggcgttataggggcgtgaggatttcgggcgagttgggggcgggcggtttttttagtttttttgcgttatggaatttattgtatgttcgttatgtagttaggaaagttgaggtcgggaaggagggcgttacgttgtaatttcggagattagttgtttttcgcgttgtcgtagtcggtagaggcgtggtcggagttattttcggtttttagtgcggttgtaagagcgggcgttcgagggcgttttgtttcgggtttttattcgcgagttgatcgtgttaggcgcgttatatacggcgttttttattttttttttatttcgcgaggtagaagttgtcgttttcgtgttatagatagaaaaatagtttggggtgatttattcggagttaagatttaggtttgtggtttagtcgggaaggatag

SEQ ID NO: 30398 - DNA, 747 bp, Artificial Sequence
  chemically treated genomic DNA (Homo sapiens) CpG-island No: 30398
ctatccttcccgactaaaccacaaacctaaatcttaactccgaataaatcaccccaaactatttttctatctataacacgaaaacgacaacttctacctcgcgaaataaaaaaaaaataaaaaacgccgtatataacgcgcctaacacgatcaactcgcgaataaaaacccgaaacaaaacgccctcgaacgcccgctcttacaaccgcactaaaaaccgaaaataactccgaccacgcctctaccgactacgacaacgcgaaaaacaactaatctccgaaattacaacgtaacgccctccttcccgacctcaactttcctaactacataacgaacatacaataaattccataacgcaaaaaaactaaaaaaaccgcccgcccccaactcgcccgaaatcctcacgcccctataacgccccgaaaaaccacgatactacccacaacccaaatcgcgaatacgaaccctacgaaaaaatctaacctaaatacgaatttcccgccgcaaaccaaacgaaaccacgcgacatatcccctacccgcttactacaaaccgcaaacgaaaacaatacaaccctacgcactactaaaattacccgaaatctcaacctcgacgaatcgaaaacacgcgacgcgcgcccgcgccccaaccgaaaatccgccaccgaccgctctaacacgcgcaaaactacgtctataaccttaacccttcccaaaactacgccgccgacctttatctccgcgaaac

SEQ ID NO: 30399 - DNA, 747 bp, Artificial Sequence
  chemically treated genomic DNA (Homo sapiens) CpG-island No: 30399
ttatttttttcgattgagttatagatttgagttttgatttcggataaattattttagattgtttttttgtttgtgatacgggaacggtagtttttgtttcgcgaggtggagagagaatgagaagcgtcgtgtgtggcgcgtttgatacggttagttcgcgggtggaggttcggagtagaacgttttcgggcgttcgtttttgtagtcgtattggagatcgggaatggtttcggttacgtttttgtcgattgcggtaacgcgagggatagttggttttcggggttgtagcgtaacgttttttttttcggttttagtttttttgattgtataacgggtatatagtgggttttatggcgtaagggagttgaagaagtcgttcgtttttagttcgttcgggatttttacgtttttataacgtttcgaggggttacgatgttgtttatagtttagatcgcgagtgcggattttgcgggagggtttggtttagatgcgagtttttcgtcgtagattaggcgaggttacgcgatatattttttattcgtttattgtaggtcgtagacggagatagtgtagttttgcgtattgttgaggttgttcgaggttttagtttcggcgggtcgggaatacgcggcgcgcgttcgcgttttaatcggaagttcgttatcggtcgttttagtacgcgtagggttgcgtttgtggttttaattttttttaaggttgcgtcgtcggtttttgttttcgcggagt

SEQ ID NO: 30400 - DNA, 747 bp, Artificial Sequence
  chemically treated genomic DNA (Homo sapiens) CpG-island No: 30400
actccgcgaaaacaaaaaccgacgacgcaaccttaaaaaaaattaaaaccacaaacgcaaccctacgcgtactaaaacgaccgataacgaacttccgattaaaacgcgaacgcgcgccgcgtattcccgacccgccgaaactaaaacctcgaacaacctcaacaatacgcaaaactacactatctccgtctacgacctacaataaacgaataaaaaatatatcgcgtaacctcgcctaatctacgacgaaaaactcgcatctaaaccaaaccctcccgcaaaatccgcactcgcgatctaaactataaacaacatcgtaacccctcgaaacgttataaaaacgtaaaaatcccgaacgaactaaaaacgaacgacttcttcaactcccttacgccataaaacccactatatacccgttatacaatcaaaaaaactaaaaccgaaaaaaaaaacgttacgctacaaccccgaaaaccaactatccctcgcgttaccgcaatcgacaaaaacgtaaccgaaaccattcccgatctccaatacgactacaaaaacgaacgcccgaaaacgttctactccgaacctccacccgcgaactaaccgtatcaaacgcgccacacacgacgcttctcattctctctccacctcgcgaaacaaaaactaccgttcccgtatcacaaacaaaaaaacaatctaaaataatttatccgaaatcaaaactcaaatctataactcaatcgaaaaaaataa

SEQ ID NO: 30401 - DNA, 515 bp, Artificial Sequence
  chemically treated genomic DNA (Homo sapiens) CpG-island No: 30401
cgggcggtttgggggcggcgcggaatagttgtatttcgcgtttagttttagttcgtttgttttttatggcgtcgattgttcggttcggttttttcgcggcgttttcgatagttcgttgtttttcggttttttcggttttttttgtgcgtcgggcgtcgttttcgcgatattcgacgtttcggggtagcgtcgcgggtttatttgggggatagcggggagcggtcgtagtttcggtgttcgcggcgagggcgtagggcgagttagcgagcgattttagtagtttcgagtttcgtttcgtttagagttagacgggaggagagcgtttcgttcgtcgttcgcgtattttttcgttttcgtcgttttaattcgtgattttattttcggttcgggttttcgtcgcgttttgtcgggggtcgttttttaggagtataggtgggacgtaggaggtcgttcggaggaagtcggcgttgtgttcgttttttgttatttttattttattattttttttatttttt

SEQ ID NO: 30402 - DNA, 515 bp, Artificial Sequence
  chemically treated genomic DNA (Homo sapiens) CpG-island No: 30402
aaaaaataaaaaaaataataaaataaaaataacaaaaaacgaacacaacgccgacttcctccgaacgacctcctacgtcccacctatactcctaaaaaacgacccccgacaaaacgcgacgaaaacccgaaccgaaaataaaatcacgaattaaaacgacgaaaacgaaaaaatacgcgaacgacgaacgaaacgctctcctcccgtctaactctaaacgaaacgaaactcgaaactactaaaatcgctcgctaactcgccctacgccctcgccgcgaacaccgaaactacgaccgctccccgctatcccccaaataaacccgcgacgctaccccgaaacgtcgaatatcgcgaaaacgacgcccgacgcacaaaaaaaaccgaaaaaaccgaaaaacaacgaactatcgaaaacgccgcgaaaaaaccgaaccgaacaatcgacgccataaaaaacaaacgaactaaaactaaacgcgaaatacaactattccgcgccgcccccaaaccgcccg

SEQ ID NO: 30403 - DNA, 515 bp, Artificial Sequence
  chemically treated genomic DNA (Homo sapiens) CpG-island No: 30403
agaaaatgaagggagtgatagggtgggggtggtagggaacgggtataacgtcggtttttttcggacggttttttgcgttttatttgtgtttttgaaaagcggttttcgatagggcgcggcgggaattcgagtcgggagtagggttacgagttaaagcggcgggggcgggaggatgcgcgggcggcggacggggcgtttttttttcgtttgattttgggcggagcggggttcgaggttgttggagtcgttcgttgattcgttttgcgttttcgtcgcggatatcggagttgcggtcgtttttcgttgttttttaggtgagttcgcggcgttgtttcggggcgtcgggtgtcgcgggaacggcgttcggcgtatagggagggtcggggaggtcgggaggtagcgagttgtcggggacgtcgcgggaaggtcgggtcgggtagtcggcgttatggagggtaggcgggttggagttgggcgcgagatgtagttgtttcgcgtcgtttttaagtcgttcg

SEQ ID NO: 30404 - DNA, 515 bp, Artificial Sequence
  chemically treated genomic DNA (Homo sapiens) CpG-island No: 30404
cgaacgacttaaaaacgacgcgaaacaactacatctcgcgcccaactccaacccgcctaccctccataacgccgactacccgacccgaccttcccgcgacgtccccgacaactcgctacctcccgacctccccgaccctccctatacgccgaacgccgttcccgcgacacccgacgccccgaaacaacgccgcgaactcacctaaaaaacaacgaaaaacgaccgcaactccgatatccgcgacgaaaacgcaaaacgaatcaacgaacgactccaacaacctcgaaccccgctccgcccaaaatcaaacgaaaaaaaaacgccccgtccgccgcccgcgcatcctcccgcccccgccgctttaactcgtaaccctactcccgactcgaattcccgccgcgccctatcgaaaaccgcttttcaaaaacacaaataaaacgcaaaaaaccgtccgaaaaaaaccgacgttatacccgttccctaccacccccaccctatcactcccttcattttct

SEQ ID NO: 30405 - DNA, 527 bp, Artificial Sequence
  chemically treated genomic DNA (Homo sapiens) CpG-island No: 30405
cgggggacgtcgtttcgttttcgtttttttaggttcgggcgtagattgcgagtcgtcgggtaggttttcgtagtagtcggcgtcgtagtcgttttcgtttttgtcgttttttttttttttttcgttgttttcggagtttttcggggagtgcggaggggcgtgagcgagtttatggttttggggggcggttttttgttcgtcgcgcgtcgaggttcgagcgtttttaattgtttcgggtgtttttcggggattcgcgtttcgggattttacgttttaggtgacggcgagggttgttgtaggtttcgttcgtgtttttcggcgtgtttacgtgggagggtgtttgcggtattttaggcgtttttcgcggttgtcgaagaggtcgttatcgtagttgcgttgtcgttcggagttttagtttttcggtgtcgcggggatttcgtttttttcggagtttggatagcgttttttttagagggttcgttattttttttgttttagtcgcgaggtttattttcgttagggggaga

SEQ ID NO: 30406 - DNA, 527 bp, Artificial Sequence
  chemically treated genomic DNA (Homo sapiens) CpG-island No: 30406
tctccccctaacgaaaataaacctcgcgactaaaacaaaaaaaataacgaaccctctaaaaaaaacgctatccaaactccgaaaaaaacgaaatccccgcgacaccgaaaaactaaaactccgaacgacaacgcaactacgataacgacctcttcgacaaccgcgaaaaacgcctaaaataccgcaaacaccctcccacgtaaacacgccgaaaaacacgaacgaaacctacaacaaccctcgccgtcacctaaaacgtaaaatcccgaaacgcgaatccccgaaaaacacccgaaacaattaaaaacgctcgaacctcgacgcgcgacgaacaaaaaaccgccccccaaaaccataaactcgctcacgcccctccgcactccccgaaaaactccgaaaacaacgaaaaaaaaaaaaaaaacgacaaaaacgaaaacgactacgacgccgactactacgaaaacctacccgacgactcgcaatctacgcccgaacctaaaaaaacgaaaacgaaacgacgtcccccg

SEQ ID NO: 30407 - DNA, 527 bp, Artificial Sequence
  chemically treated genomic DNA (Homo sapiens) CpG-island No: 30407
tttttttttggcgggggtgagtttcgcggttaaggtagaggggatggcggattttttgaggaggacgttgtttaggtttcggggaaggcggggttttcgcggtatcggggggttagggtttcgggcggtagcgtagttgcggtggcggttttttcggtagtcgcgggagacgtttggggtgtcgtagatatttttttacgtgagtacgtcgggggatacgggcggagtttatagtagttttcgtcgttatttgaggcgtggggtttcggggcgcgggttttcggagggtattcggagtagttgggggcgttcgggtttcggcgcgcggcgggtaggaggtcgttttttagagttatgggttcgtttacgttttttcgtatttttcggagggtttcgaggatagcggagaggaggaggaagacgataaggacgaagacgattacgacgtcgattattacgaaaatttgttcggcggttcgtagtttgcgttcgagtttgagggggcggaggcggaacggcgtttttcg

SEQ ID NO: 30408 - DNA, 527 bp, Artificial Sequence
  chemically treated genomic DNA (Homo sapiens) CpG-island No: 30408
cgaaaaacgccgttccgcctccgccccctcaaactcgaacgcaaactacgaaccgccgaacaaattttcgtaataatcgacgtcgtaatcgtcttcgtccttatcgtcttcctcctcctctccgctatcctcgaaaccctccgaaaaatacgaaaaaacgtaaacgaacccataactctaaaaaacgacctcctacccgccgcgcgccgaaacccgaacgcccccaactactccgaataccctccgaaaacccgcgccccgaaaccccacgcctcaaataacgacgaaaactactataaactccgcccgtatcccccgacgtactcacgtaaaaaaatatctacgacaccccaaacgtctcccgcgactaccgaaaaaaccgccaccgcaactacgctaccgcccgaaaccctaaccccccgataccgcgaaaaccccgccttccccgaaacctaaacaacgtcctcctcaaaaaatccgccatcccctctaccttaaccgcgaaactcacccccgccaaaaaaaaa

SEQ ID NO: 30409 - DNA, 1355 bp, Artificial Sequence
  chemically treated genomic DNA (Homo sapiens) CpG-island No: 30409
cgtttcggttcgtatcggagtttcgtcgttttcgttttttttcgcggtttttttaattttcggttttgcgtattcgtttttttcgtagcggggatgtttagggtgcgatttcgaagtataattattgatggaattttgatattcgaagaggacgatttttttaatagtttatacgttttcgcgggtattttttttatttattgaaatttttacgaaagcggttaacgtatttagagcgggttttttcggtttacggacgtaggtaaatagcgttatttaaaaaaatgtcgttcgcgattcggttttaggcggtagagggagtagcgggcggtttggcgcgggagttttttcggggttcgtagtattttttgtcgcgcgcgaaggtcggggtcgcgtttatttggtaataaaggcgaagttcgtcgttcgtaggtgggaggtcggagtcgaggtttcggtgtcgcgcgagggagcgtacggggttcgcgcggggtcgtttttggagaaagtttagtcgcggatttcggcgggagaggagcgttttggtattgtttcgggggagggcgggcgggcgttcgggggtattgggttttcggaggaggtggcggcgcgcgggcgggttgggggttgggtcggtcgaggcggacggtcgtttttagtagtttcgacgttttttatttggtttttgcggcggttgaggtagttcgatttttagcgttaagtattgcgttaagtagggacgggcgggggagggcgcgttagattcgtcgtagagtcggattttcggcgtcgtatcgtcgtttcgttttgtcgcggatttcgttgttcgttcgtagttcgcgttttttcggcgggcgaaggagacgatttttcggcgttcgtcggtttttatttcgatgtagtcggttagcgttaaggtaggcgcgtggagtttattagtagtagaagtaggagtttgttcgtggttgcggcggtcgcggtttcggtggtcgtatttttcgtcgggtcgttttagcgcgcggtttttaagtttatatattcggatttttcgtttagtatatcgcgatttagaagtatttaaagcgagttcgtcgtcgcgttaggggttttatattaatcggaattgattttatattattacgtcgtttttttgcggattttaatgtcggcgcgtagaacgttttaatgatcggcgtttttgcggttcgagattaattaggagatggaagatgttgttgattacgaacgggttaaacgcgcgtttatcgatcgttgtcgtattagttcgcgtatggtttgattaggttgcgggatattgtagcgttagtcggtgggagtttttcgggagagtttgg

SEQ ID NO: 30410 - DNA, 1355 bp, Artificial Sequence
  chemically treated genomic DNA (Homo sapiens) CpG-island No: 30410
ccaaactctcccgaaaaactcccaccgactaacgctacaatatcccgcaacctaatcaaaccatacgcgaactaatacgacaacgatcgataaacgcgcgtttaacccgttcgtaatcaacaacatcttccatctcctaattaatctcgaaccgcaaaaacgccgatcattaaaacgttctacgcgccgacattaaaatccgcaaaaaaacgacgtaataatataaaatcaattccgattaatataaaacccctaacgcgacgacgaactcgctttaaatacttctaaatcgcgatatactaaacgaaaaatccgaatatataaacttaaaaaccgcgcgctaaaacgacccgacgaaaaatacgaccaccgaaaccgcgaccgccgcaaccacgaacaaactcctacttctactactaataaactccacgcgcctaccttaacgctaaccgactacatcgaaataaaaaccgacgaacgccgaaaaatcgtctccttcgcccgccgaaaaaacgcgaactacgaacgaacaacgaaatccgcgacaaaacgaaacgacgatacgacgccgaaaatccgactctacgacgaatctaacgcgccctcccccgcccgtccctacttaacgcaatacttaacgctaaaaatcgaactacctcaaccgccgcaaaaaccaaataaaaaacgtcgaaactactaaaaacgaccgtccgcctcgaccgacccaacccccaacccgcccgcgcgccgccacctcctccgaaaacccaatacccccgaacgcccgcccgccctcccccgaaacaataccaaaacgctcctctcccgccgaaatccgcgactaaactttctccaaaaacgaccccgcgcgaaccccgtacgctccctcgcgcgacaccgaaacctcgactccgacctcccacctacgaacgacgaacttcgcctttattaccaaataaacgcgaccccgaccttcgcgcgcgacaaaaaatactacgaaccccgaaaaaactcccgcgccaaaccgcccgctactccctctaccgcctaaaaccgaatcgcgaacgacatttttttaaataacgctatttacctacgtccgtaaaccgaaaaaacccgctctaaatacgttaaccgctttcgtaaaaatttcaataaataaaaaaaatacccgcgaaaacgtataaactattaaaaaaatcgtcctcttcgaatatcaaaattccatcaataattatacttcgaaatcgcaccctaaacatccccgctacgaaaaaaacgaatacgcaaaaccgaaaattaaaaaaaccgcgaaaaaaaacgaaaacgacgaaactccgatacgaaccgaaacg

SEQ ID NO: 30411 - DNA, 1355 bp, Artificial Sequence
  chemically treated genomic DNA (Homo sapiens) CpG-island No: 30411
ttagattttttcgggggatttttatcggttagcgttataatgtttcgtagtttgattaggttatacgcggattagtgcggtaacgatcggtgagcgcgcgtttgattcgttcgtgattagtagtattttttattttttgattggtttcgagtcgtaagggcgtcggttattgaggcgttttgcgcgtcggtattgagattcgtagaaggacggcgtggtaatatgaagttagtttcggttggtgtaaaatttttggcgcggcggcgaattcgttttagatgtttttgggtcgcggtgtgttaagcgaggagttcgagtgtgtgagtttgagagtcgcgcgttagagcgattcggcgagggatgcggttatcgggatcgcggtcgtcgtagttacgggtaggtttttgtttttgttgttggtgggttttacgcgtttgttttggcgttggtcggttatatcgaggtggggatcggcgaacgtcggagagtcgtttttttcgttcgtcggaggagcgcggattgcgggcgggtagcggggttcgcggtagggcggagcggcggtgcggcgtcgggggttcggttttgcggcgggtttggcgcgttttttttcgttcgtttttgtttggcgtagtgtttagcgttggaggtcgggttgttttagtcgtcgtagaggttaaatgaaaggcgtcggggttgttgggggcggtcgttcgtttcggtcgatttagtttttaattcgttcgcgcgtcgttatttttttcggggatttagtgttttcgggcgttcgttcgttttttttcgggataatgttagggcgtttttttttcgtcggagttcgcggttgggttttttttaggggcggtttcgcgcggatttcgtacgttttttcgcgcggtatcggggtttcggtttcggttttttatttgcgagcggcgggtttcgtttttgttgttaggtggacgcggtttcggttttcgcgcgcggtaagggatgttgcgagtttcgggggagttttcgcgttaggtcgttcgttgttttttttgtcgtttggggtcgggtcgcggacgatatttttttaagtggcgttgtttgtttgcgttcgtagatcgaggaaattcgttttgggtgcgttgatcgttttcgtgagggttttagtgagtagggaaggtgttcgcgaaggcgtgtaaattgttggaaaaatcgtttttttcgggtgttagaattttattagtggttgtgtttcgaggtcgtattttgagtattttcgttgcgagaaaggcgaatgcgtagggtcgggggttggggaggtcgcgggagggggcgggggcggcggggtttcggtgcgggtcggagcg

SEQ ID NO: 30412 - DNA, 1355 bp, Artificial Sequence
  chemically treated genomic DNA (Homo sapiens) CpG-island No: 30412
cgctccgacccgcaccgaaaccccgccgcccccgccccctcccgcgacctccccaacccccgaccctacgcattcgcctttctcgcaacgaaaatactcaaaatacgacctcgaaacacaaccactaataaaattctaacacccgaaaaaaacgatttttccaacaatttacacgccttcgcgaacaccttccctactcactaaaaccctcacgaaaacgatcaacgcacccaaaacgaatttcctcgatctacgaacgcaaacaaacaacgccacttaaaaaaatatcgtccgcgacccgaccccaaacgacaaaaaaaacaacgaacgacctaacgcgaaaactcccccgaaactcgcaacatcccttaccgcgcgcgaaaaccgaaaccgcgtccacctaacaacaaaaacgaaacccgccgctcgcaaataaaaaaccgaaaccgaaaccccgataccgcgcgaaaaaacgtacgaaatccgcgcgaaaccgcccctaaaaaaaacccaaccgcgaactccgacgaaaaaaaaacgccctaacattatcccgaaaaaaaacgaacgaacgcccgaaaacactaaatccccgaaaaaaataacgacgcgcgaacgaattaaaaactaaatcgaccgaaacgaacgaccgcccccaacaaccccgacgcctttcatttaacctctacgacgactaaaacaacccgacctccaacgctaaacactacgccaaacaaaaacgaacgaaaaaaaacgcgccaaacccgccgcaaaaccgaacccccgacgccgcaccgccgctccgccctaccgcgaaccccgctacccgcccgcaatccgcgctcctccgacgaacgaaaaaaacgactctccgacgttcgccgatccccacctcgatataaccgaccaacgccaaaacaaacgcgtaaaacccaccaacaacaaaaacaaaaacctacccgtaactacgacgaccgcgatcccgataaccgcatccctcgccgaatcgctctaacgcgcgactctcaaactcacacactcgaactcctcgcttaacacaccgcgacccaaaaacatctaaaacgaattcgccgccgcgccaaaaattttacaccaaccgaaactaacttcatattaccacgccgtccttctacgaatctcaataccgacgcgcaaaacgcctcaataaccgacgcccttacgactcgaaaccaatcaaaaaataaaaaatactactaatcacgaacgaatcaaacgcgcgctcaccgatcgttaccgcactaatccgcgtataacctaatcaaactacgaaacattataacgctaaccgataaaaatcccccgaaaaaatctaa

SEQ ID NO: 30413 - DNA, 622 bp, Artificial Sequence
  chemically treated genomic DNA (Homo sapiens) CpG-island No: 30413
tcggcgtggggtagcggtcgtggggtttatagatattatttttacgtagatttcgcgaatgtcgtggaattttattttcgggaggcgttttgtttttgaggaagatggagaggagtcgggagaagcgtttagaaatcgtattgatttagatattaattttggtcggtttttttcgtttgtcgagttgcggggtcgcgtcgtttcgttttcgagaagcggatttagggtacgtcgggtttcgtcgagcgggtaaagggagcggtttgcgtcgttatttcgcgttcgcggtttcgacgtcgtagtcgttacgttaatatcgatttttcgtggttaataggtttttcgtagtttttcgagtcggtagcgtcgttcgcgttttttttttagtcgggtcggcgggacgtttttagagtttgtgttttttcgaggtcgtcgagtttattgagttcggtcggggcgttggttcgcgtgggtcgcggggaataggtttcgtttttttaacgattacggtttcggcggttgcgaaacggttattttcgatttttgagttcgttagagtcgtttttttttttatatttgtaagtaaaataatatacgtaatagtgatatcgaggtatttttt

SEQ ID NO: 30414 - DNA, 622 bp, Artificial Sequence
  chemically treated genomic DNA (Homo sapiens) CpG-island No: 30414
aaaaaatacctcgatatcactattacgtatattattttacttacaaatataaaaaaaaaaacgactctaacgaactcaaaaatcgaaaataaccgtttcgcaaccgccgaaaccgtaatcgttaaaaaaacgaaacctattccccgcgacccacgcgaaccaacgccccgaccgaactcaataaactcgacgacctcgaaaaaacacaaactctaaaaacgtcccgccgacccgactaaaaaaaaaacgcgaacgacgctaccgactcgaaaaactacgaaaaacctattaaccacgaaaaatcgatattaacgtaacgactacgacgtcgaaaccgcgaacgcgaaataacgacgcaaaccgctccctttacccgctcgacgaaacccgacgtaccctaaatccgcttctcgaaaacgaaacgacgcgaccccgcaactcgacaaacgaaaaaaaccgaccaaaattaatatctaaatcaatacgatttctaaacgcttctcccgactcctctccatcttcctcaaaaacaaaacgcctcccgaaaataaaattccacgacattcgcgaaatctacgtaaaaataatatctataaaccccacgaccgctaccccacgccga

SEQ ID NO: 30415 - DNA, 622 bp, Artificial Sequence
  chemically treated genomic DNA (Homo sapiens) CpG-island No: 30415
gaaaagtgtttcgatgttattattacgtatgttgttttgtttgtaaatgtgaaagggagagcgattttggcggatttaagggtcggaggtggtcgtttcgtagtcgtcggggtcgtggtcgttggagaagcgggatttgtttttcgcggtttacgcgaattagcgtttcggtcgggtttagtgggttcggcggtttcgagagagtataagttttgagggcgtttcgtcggttcggttggaagagggacgcgggcggcgttgtcgattcggagggttgcgagaaatttgttggttacgaggaatcggtgttggcgtggcggttgcggcgtcgaggtcgcgggcgcggggtggcggcgtaggtcgttttttttgttcgttcggcggagttcggcgtattttaggttcgtttttcggggacggggcggcgcggtttcgtagttcggtaggcggagggagtcggttaggattgatgtttaaattaatgcggtttttaggcgtttttttcgatttttttttattttttttaaaggtaaagcgtttttcgaggatggagttttacgatattcgcgaagtttgcgtgaggatggtgtttgtgggttttacggtcgttgttttacgtcgg

SEQ ID NO: 30416 - DNA, 622 bp, Artificial Sequence
  chemically treated genomic DNA (Homo sapiens) CpG-island No: 30416
ccgacgtaaaacaacgaccgtaaaacccacaaacaccatcctcacgcaaacttcgcgaatatcgtaaaactccatcctcgaaaaacgctttacctttaaaaaaaataaaaaaaaatcgaaaaaaacgcctaaaaaccgcattaatttaaacatcaatcctaaccgactccctccgcctaccgaactacgaaaccgcgccgccccgtccccgaaaaacgaacctaaaatacgccgaactccgccgaacgaacaaaaaaaacgacctacgccgccaccccgcgcccgcgacctcgacgccgcaaccgccacgccaacaccgattcctcgtaaccaacaaatttctcgcaaccctccgaatcgacaacgccgcccgcgtccctcttccaaccgaaccgacgaaacgccctcaaaacttatactctctcgaaaccgccgaacccactaaacccgaccgaaacgctaattcgcgtaaaccgcgaaaaacaaatcccgcttctccaacgaccacgaccccgacgactacgaaacgaccacctccgacccttaaatccgccaaaatcgctctccctttcacatttacaaacaaaacaacatacgtaataataacatcgaaacacttttc

SEQ ID NO: 30417 - DNA, 525 bp, Artificial Sequence
  chemically treated genomic DNA (Homo sapiens) CpG-island No: 30417
gttcgtttttcggggtagttgcggtttcggagtggttgcgtttggcgttcgtcgggcgtggtttcgttttaggttcgggagggtaggttggttgtttcggcgagcggtagagtttttttggatagttttcgtttatttaaatagaagacgtcggcgtcggagcgggttcggatatggcgaggttgcgagtcggttcgagcggcggggttcggtgattttttttttttttttcgtttttttttttttttcgtacgtacgtttcgttcgtttttatttcgtttttatttcgggcgagttcgttcgtagttcggggcgtatattcgtacgcgtatttttttttatttattttcgcgttcgtttttattttcgtagtcgagtttcgttacgcgcgttttgttcgttcgtcggtcgttttcgtcgttttcgtcgttttcgggttttgatggattgaatgaaggttgtttatatcgtttatcgatgttttattaaagatttagaaggttgcgttatgaattcggagttgat

SEQ ID NO: 30418 - DNA, 525 bp, Artificial Sequence
  chemically treated genomic DNA (Homo sapiens) CpG-island No: 30418
atcaactccgaattcataacgcaaccttctaaatctttaataaaacatcgataaacgatataaacaaccttcattcaatccatcaaaacccgaaaacgacgaaaacgacgaaaacgaccgacgaacgaacaaaacgcgcgtaacgaaactcgactacgaaaataaaaacgaacgcgaaaataaataaaaaaaaatacgcgtacgaatatacgccccgaactacgaacgaactcgcccgaaataaaaacgaaataaaaacgaacgaaacgtacgtacgaaaaaaaaaaaaaaacgaaaaaaaaaaaaaaaatcaccgaaccccgccgctcgaaccgactcgcaacctcgccatatccgaacccgctccgacgccgacgtcttctatttaaataaacgaaaactatccaaaaaaactctaccgctcgccgaaacaaccaacctaccctcccgaacctaaaacgaaaccacgcccgacgaacgccaaacgcaaccactccgaaaccgcaactaccccgaaaaacgaac

SEQ ID NO: 30419 - DNA, 525 bp, Artificial Sequence
  chemically treated genomic DNA (Homo sapiens) CpG-island No: 30419
gttagtttcgggtttatggcgtagttttttaggtttttggtgaggtatcgataggcggtgtaggtagtttttatttagtttattagggttcgggggcggcgggggcggcgggggcggtcggcgggcgggtaaggcgcgcgtggcggggttcggttgcgggagtgggggcgggcgcgggagtgagtggagaggagtgcgcgtgcgggtgtgcgtttcgggttgcgggcgggttcgttcggggtgggggcggggtgggggcggacggggcgtgcgtgcgggagaggggaggggacggggagggagggagggattatcgggtttcgtcgttcgggtcggttcgtagtttcgttatgttcgagttcgtttcggcgtcgacgttttttgtttgggtgagcgggagttgtttagaagggttttgtcgttcgtcggggtagttaatttattttttcggatttggggcggggttacgttcgacgggcgttaagcgtaattatttcgaggtcgtagttgtttcgggaggcgggt

SEQ ID NO: 30420 - DNA, 525 bp, Artificial Sequence
  chemically treated genomic DNA (Homo sapiens) CpG-island No: 30420
acccgcctcccgaaacaactacgacctcgaaataattacgcttaacgcccgtcgaacgtaaccccgccccaaatccgaaaaaataaattaactaccccgacgaacgacaaaacccttctaaacaactcccgctcacccaaacaaaaaacgtcgacgccgaaacgaactcgaacataacgaaactacgaaccgacccgaacgacgaaacccgataatccctccctccctccccgtcccctcccctctcccgcacgcacgccccgtccgcccccaccccgcccccaccccgaacgaacccgcccgcaacccgaaacgcacacccgcacgcgcactcctctccactcactcccgcgcccgcccccactcccgcaaccgaaccccgccacgcgcgccttacccgcccgccgaccgcccccgccgcccccgccgcccccgaaccctaataaactaaataaaaactacctacaccgcctatcgatacctcaccaaaaacctaaaaaactacgccataaacccgaaactaac

SEQ ID NO: 30421 - DNA, 1072 bp, Artificial Sequence
  chemically treated genomic DNA (Homo sapiens) CpG-island No: 30421
tacgggtcggtcggcggcggtagtggcgggggcggcggcgggggcggcgggggcggcggcgggggttcgggttatgagtaggagttgttggttagttttagtttttattacgcgggtcgcggcgtcgttggttcgttgcggggtttttcgtcgtttttaatcgcgtattaggagttgggtacggcggtagcggcggtagcggcggcgtcgcgttcggttatggttattagtatggtttcgattttggacggcggcgattatcggttcgagttttttatttcgttgtattacgttatgagtatgttttgcgattcgttttcgtttggtatgggtatgagtaatatttatattacgttgatatcgttttagtcgttgttatttatttttatcgtgtttgataagttttattatttttattcgtattattattcgtattattattattattattattattagcgtttgttcggtaacgttagcggtagttttatttttatgcgcgacgagcgcgggttttcggttatgaataatttttatagtttttataaggagatgttcggtatgagttagagtttgttttcgttggtcgttacgtcgttgggtaacgggttaggcggtttttataacgcgtagtagagtttgtttaattacggttcgtcgggttacgataaaatgtttagttttaatttcgacgcgtattatattgttatgttgattcgcggtgagtaatatttgtttcgcggtttgggtattttatttgcggttatgatgtcgtatttgaacggtttgtattattcgggttatatttagttttacgggtcggtgttggtatttagtcgcgagcggttattttcgtttttatcgggttcgtaggtggttacgtcgggttagttggaagaaattaatattaaagaggtggtttagcgtattatagcggagttgaagcgttatagtattttttaggcgatttttgcgtagagggtgttgtgtcggttttaggggatttttttcgatttgtttcggaatttaaaatcgtggagtaaatttaaatttggtagggagatttttcgta

SEQ ID NO: 30422 - DNA, 1072 bp, Artificial Sequence
  chemically treated genomic DNA (Homo sapiens) CpG-island No: 30422
tacgaaaaatctccctaccaaatttaaatttactccacgattttaaattccgaaacaaatcgaaaaaaatcccctaaaaccgacacaacaccctctacgcaaaaatcgcctaaaaaatactataacgcttcaactccgctataatacgctaaaccacctctttaatattaatttcttccaactaacccgacgtaaccacctacgaacccgataaaaacgaaaataaccgctcgcgactaaataccaacaccgacccgtaaaactaaatataacccgaataatacaaaccgttcaaatacgacatcataaccgcaaataaaatacccaaaccgcgaaacaaatattactcaccgcgaatcaacataacaatataatacgcgtcgaaattaaaactaaacattttatcgtaacccgacgaaccgtaattaaacaaactctactacgcgttataaaaaccgcctaacccgttacccaacgacgtaacgaccaacgaaaacaaactctaactcataccgaacatctccttataaaaactataaaaattattcataaccgaaaacccgcgctcgtcgcgcataaaaataaaactaccgctaacgttaccgaacaaacgctaataataataataataataataatacgaataataatacgaataaaaataataaaacttatcaaacacgataaaaataaataacaacgactaaaacgatatcaacgtaatataaatattactcatacccataccaaacgaaaacgaatcgcaaaacatactcataacgtaatacaacgaaataaaaaactcgaaccgataatcgccgccgtccaaaatcgaaaccatactaataaccataaccgaacgcgacgccgccgctaccgccgctaccgccgtacccaactcctaatacgcgattaaaaacgacgaaaaaccccgcaacgaaccaacgacgccgcgacccgcgtaataaaaactaaaactaaccaacaactcctactcataacccgaacccccgccgccgcccccgccgcccccgccgccgcccccgccactaccgccgccgaccgacccgta

SEQ ID NO: 30423 - DNA, 1072 bp, Artificial Sequence
  chemically treated genomic DNA (Homo sapiens) CpG-island No: 30423
tgcggaaggtttttttgttagatttgagtttattttacggttttggatttcggagtaggtcggagagagttttttgagatcggtatagtattttttgcgtaaagatcgtttgggggatattgtagcgttttagtttcgttgtgatgcgttgggttatttttttggtgttgattttttttagttggttcgacgtggttatttgcgagttcgatgaggacgagggtggtcgttcgcgattgggtgttagtatcggttcgtgagattgagtgtggttcgggtggtgtaggtcgtttaggtgcgatattatggtcgtaggtggggtgtttaggtcgcgggataggtgttgtttatcgcgggttagtatggtagtgtggtgcgcgtcgaagttggggttgagtattttgtcgtggttcggcggatcgtagttgggtagattttgttgcgcgttgtggaggtcgtttagttcgttgtttagcggcgtggcggttagcggggataggttttggtttatgtcgggtatttttttgtagggattgtagaggttgtttatggtcgggagttcgcgttcgtcgcgtatgagggtgaagttgtcgttgacgttgtcggataggcgttggtggtggtggtggtggtggtggtgcggatggtggtgcgggtgagggtggtggaatttgttagatacggtggagatgggtggtagcggttggagcggtgttagcgtggtgtaggtgttgtttatgtttatgttaggcggagacgagtcgtaggatatgtttatggcgtggtgtagcgggatggagagttcgggtcggtagtcgtcgtcgtttaggatcgaggttatgttggtgattatggtcgagcgcgacgtcgtcgttgtcgtcgttgtcgtcgtgtttagtttttggtgcgcggttggaggcggcggagggtttcgtagcgagttagcggcgtcgcggttcgcgtggtgggggttggggttggttagtagtttttgtttatggttcgggttttcgtcgtcgttttcgtcgttttcgtcgtcgttttcgttattgtcgtcgtcggtcggttcgtg

SEQ ID NO: 30424 - DNA, 1072 bp, Artificial Sequence
  chemically treated genomic DNA (Homo sapiens) CpG-island No: 30424
cacgaaccgaccgacgacgacaataacgaaaacgacgacgaaaacgacgaaaacgacgacgaaaacccgaaccataaacaaaaactactaaccaaccccaacccccaccacgcgaaccgcgacgccgctaactcgctacgaaaccctccgccgcctccaaccgcgcaccaaaaactaaacacgacgacaacgacgacaacgacgacgtcgcgctcgaccataatcaccaacataacctcgatcctaaacgacgacgactaccgacccgaactctccatcccgctacaccacgccataaacatatcctacgactcgtctccgcctaacataaacataaacaacacctacaccacgctaacaccgctccaaccgctaccacccatctccaccgtatctaacaaattccaccaccctcacccgcaccaccatccgcaccaccaccaccaccaccaccaccaacgcctatccgacaacgtcaacgacaacttcaccctcatacgcgacgaacgcgaactcccgaccataaacaacctctacaatccctacaaaaaaatacccgacataaaccaaaacctatccccgctaaccgccacgccgctaaacaacgaactaaacgacctccacaacgcgcaacaaaatctacccaactacgatccgccgaaccacgacaaaatactcaaccccaacttcgacgcgcaccacactaccatactaacccgcgataaacaacacctatcccgcgacctaaacaccccacctacgaccataatatcgcacctaaacgacctacaccacccgaaccacactcaatctcacgaaccgatactaacacccaatcgcgaacgaccaccctcgtcctcatcgaactcgcaaataaccacgtcgaaccaactaaaaaaaatcaacaccaaaaaaataacccaacgcatcacaacgaaactaaaacgctacaatatcccccaaacgatctttacgcaaaaaatactataccgatctcaaaaaactctctccgacctactccgaaatccaaaaccgtaaaataaactcaaatctaacaaaaaaaccttccgca

SEQ ID NO: 30425 - DNA, 507 bp, Artificial Sequence
  chemically treated genomic DNA (Homo sapiens) CpG-island No: 30425
cggtcggcgttatgacgcgtttcgacgttcgtcggaagtgtacggaggagtttcgggggttaggcggtcgtcgcgagtttggtattttgagtttcgtgagttgagcgttgttgtttcgcggtggagttatcgtatcgttttcgggattatggtgttttattttattagtagtagcggtgagtgggcgttacgtttttttggattttgttggatagcgggtttcgaagtcgggattcgtagttcgtcgttgcgtttgattttcgttttaaaatgttttttggatgcgagtgttttttttcgcggtttttcggttttttagtatattcgttttttttacggttgtaggatttttttcggcgttttttcgttatggcgtggggggcgcggaggggcgatgttattgttatgtttgtatcggggagttttcgttttttaatcggaaagacgtttcgttattttttgggattgggtagagtttgtgggtttttttatatattttattttaag

SEQ ID NO: 30426 - DNA, 507 bp, Artificial Sequence
  chemically treated genomic DNA (Homo sapiens) CpG-island No: 30426
cttaaaataaaatatataaaaaaacccacaaactctacccaatcccaaaaaataacgaaacgtctttccgattaaaaaacgaaaactccccgatacaaacataacaataacatcgcccctccgcgccccccacgccataacgaaaaaacgccgaaaaaaatcctacaaccgtaaaaaaaacgaatatactaaaaaaccgaaaaaccgcgaaaaaaaacactcgcatccaaaaaacattttaaaacgaaaatcaaacgcaacgacgaactacgaatcccgacttcgaaacccgctatccaacaaaatccaaaaaaacgtaacgcccactcaccgctactactaataaaataaaacaccataatcccgaaaacgatacgataactccaccgcgaaacaacaacgctcaactcacgaaactcaaaataccaaactcgcgacgaccgcctaacccccgaaactcctccgtacacttccgacgaacgtcgaaacgcgtcataacgccgaccg

SEQ ID NO: 30427 - DNA, 507 bp, Artificial Sequence
  chemically treated genomic DNA (Homo sapiens) CpG-island No: 30427
tttgggataaggtgtgtggaggagtttataggttttgtttaattttagggagtgacgggacgttttttcgattaggggacgagaatttttcgatataaatatagtagtggtatcgttttttcgcgttttttacgttatgacgaggggacgtcgggggaaattttgtagtcgtgggagggacggatgtgttgggggatcgagaggtcgcgggaagaggtattcgtatttagaaggtattttagagcgagggttaggcgtagcggcggattgcgggtttcggtttcggagttcgttgtttagtagggtttaggaggacgtggcgtttatttatcgttgttgttggtgaagtagaatattatgatttcgggagcggtgcggtgattttatcgcggagtagtagcgtttaatttacgaagtttaggatattagattcgcggcggtcgtttggttttcggaattttttcgtgtattttcggcggacgtcggggcgcgttataacgtcggtcg

SEQ ID NO: 30428 - DNA, 507 bp, Artificial Sequence
  chemically treated genomic DNA (Homo sapiens) CpG-island No: 30428
cgaccgacgttataacgcgccccgacgtccgccgaaaatacacgaaaaaattccgaaaaccaaacgaccgccgcgaatctaatatcctaaacttcgtaaattaaacgctactactccgcgataaaatcaccgcaccgctcccgaaatcataatattctacttcaccaacaacaacgataaataaacgccacgtcctcctaaaccctactaaacaacgaactccgaaaccgaaacccgcaatccgccgctacgcctaaccctcgctctaaaataccttctaaatacgaatacctcttcccgcgacctctcgatcccccaacacatccgtccctcccacgactacaaaatttcccccgacgtcccctcgtcataacgtaaaaaacgcgaaaaaacgataccactactatatttatatcgaaaaattctcgtcccctaatcgaaaaaacgtcccgtcactccctaaaattaaacaaaacctataaactcctccacacaccttatcccaaa

SEQ ID NO: 30429 - DNA, 1135 bp, Artificial Sequence
  chemically treated genomic DNA (Homo sapiens) CpG-island No: 30429
cgcgttttcgtgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaaggggaaaggtttcgcgcgtttttaagttaataggtcggaaaggtagatagaaggggaaaggtttcgcgcgtttttatgttaataggtcggaaaggtagatagaaggggaaaggtttcgcgcgtttttatgttaataggtcggaaaggaagatagaagggaaaacgtttcgcgcgttttcgtgttaagaggtcggaaaggtagatagaagggaaaaggtttcgcgcgtttttgtgtttagaggtcggaaaggtagatagaagggaaaaggtttcgcgcgtttttgtgttaagaggttagaaaggaagatagaagagaaaacgttttgtatgttacggggttggggtgtgtagttagggttttttttttta

SEQ ID NO: 30430 - DNA, 1135 bp, Artificial Sequence
  chemically treated genomic DNA (Homo sapiens) CpG-island No: 30430
taaaaaaaaaaaccctaactacacaccccaaccccgtaacatacaaaacgttttctcttctatcttcctttctaacctcttaacacaaaaacgcgcgaaaccttttcccttctatctacctttccgacctctaaacacaaaaacgcgcgaaaccttttcccttctatctacctttccgacctcttaacacgaaaacgcgcgaaacgttttcccttctatcttcctttccgacctattaacataaaaacgcgcgaaacctttccccttctatctacctttccgacctattaacataaaaacgcgcgaaacctttccccttctatctacctttccgacctattaacttaaaaacgcgcgaaacctttccccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacacgaaaacgcg

SEQ ID NO: 30431 - DNA, 1135 bp, Artificial Sequence
  chemically treated genomic DNA (Homo sapiens) CpG-island No: 30431
tggaaaggaaaattttgattgtatattttagtttcgtaatatgtagagcgtttttttttttgtttttttttttggttttttgatatagaaacgcgcggggtttttttttttttgtttgttttttcggtttttggatatagaaacgcgcggggtttttttttttttgtttgttttttcggttttttgatacggaaacgcgcggagcgtttttttttttgttttttttttcggtttgttgatatggaaacgcgcggagtttttttttttttgtttgttttttcggtttgttgatatggagacgcgcggggtttttttttttttgtttgttttttcggtttgttgatttggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgatacggagacgcg

SEQ ID NO: 30432 - DNA, 1135 bp, Artificial Sequence
  chemically treated genomic DNA (Homo sapiens) CpG-island No: 30432
cgcgtctccgtatcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccaaatcaacaaaccgaaaaaacaaacaaaaaaaaaaaaaccccgcgcgtctccatatcaacaaaccgaaaaaacaaacaaaaaaaaaaaaactccgcgcgtttccatatcaacaaaccgaaaaaaaaaacaaaaaaaaaaacgctccgcgcgtttccgtatcaaaaaaccgaaaaaacaaacaaaaaaaaaaaaaccccgcgcgtttctatatccaaaaaccgaaaaaacaaacaaaaaaaaaaaaaccccgcgcgtttctatatcaaaaaaccaaaaaaaaaaacaaaaaaaaaaacgctctacatattacgaaactaaaatatacaatcaaaattttcctttcca

SEQ ID NO: 30433 - DNA, 523 bp, Artificial Sequence
  chemically treated genomic DNA (Homo sapiens) CpG-island No: 30433
ggaggcggggtttttgttggggtttttgtagttcgcgttgggttttcgaattttcgcgttgtaagtcggaattttaggttagcgggcgtcgcggcgggttcggagatcggtgtaggacgtacggtttagttagaattataattttcgacgtgcgcggcggttaacgttggttttatttttgtttgttgttttttttttttttttcgttttttgcgacggagattgttgtttaggaagtgcgtagtagtgattttagagaggttggaagtttttttggcgacgttggggtcgcgaagggtttacgtaatgatttttatttttggtgagcgtaggcgttgcggaatttatcgttttataggacgtgttttcgggggtatattaattgtggttggacgtagtggcgcggtagtttaatttttcggcggttgtagattgacgggacgagatggttttggtagggtttattaggaaattcggtaattgttagtttgtttttcgtttaaggtatttttcgcgttttggt

SEQ ID NO: 30434 - DNA, 523 bp, Artificial Sequence
  chemically treated genomic DNA (Homo sapiens) CpG-island No: 30434
accaaaacgcgaaaaataccttaaacgaaaaacaaactaacaattaccgaatttcctaataaaccctaccaaaaccatctcgtcccgtcaatctacaaccgccgaaaaattaaactaccgcgccactacgtccaaccacaattaatatacccccgaaaacacgtcctataaaacgataaattccgcaacgcctacgctcaccaaaaataaaaatcattacgtaaacccttcgcgaccccaacgtcgccaaaaaaacttccaacctctctaaaatcactactacgcacttcctaaacaacaatctccgtcgcaaaaaacgaaaaaaaaaaaaaaaacaacaaacaaaaataaaaccaacgttaaccgccgcgcacgtcgaaaattataattctaactaaaccgtacgtcctacaccgatctccgaacccgccgcgacgcccgctaacctaaaattccgacttacaacgcgaaaattcgaaaacccaacgcgaactacaaaaaccccaacaaaaaccccgcctcc

SEQ ID NO: 30435 - DNA, 523 bp, Artificial Sequence
  chemically treated genomic DNA (Homo sapiens) CpG-island No: 30435
gttagagcgcggggggtgttttgggcgaggggtaagttgatagttatcgagttttttgatgagttttgttaggattatttcgtttcgttaatttgtagtcgtcggagaattaaattgtcgcgttattgcgtttagttataattaatgtattttcggaaatacgttttgtgggacggtgagtttcgtaacgtttgcgtttattaggagtaggagttattacgtgagtttttcgcggttttagcgtcgttaggagagtttttagtttttttagaattattattgcgtattttttggatagtagttttcgtcgtaagaagcggagggaaaaaaaaaagtaataagtagggatagaattagcgttggtcgtcgcgtacgtcgggagttgtagttttggttaggtcgtgcgttttgtatcgattttcgggttcgtcgcggcgttcgttggtttggggtttcggtttatagcgcgggaattcgggaatttagcgcgggttgtagaggttttagtaggagtttcgttttt

SEQ ID NO: 30436 - DNA, 523 bp, Artificial Sequence
  chemically treated genomic DNA (Homo sapiens) CpG-island No: 30436
aaaaacgaaactcctactaaaacctctacaacccgcgctaaattcccgaattcccgcgctataaaccgaaaccccaaaccaacgaacgccgcgacgaacccgaaaatcgatacaaaacgcacgacctaaccaaaactacaactcccgacgtacgcgacgaccaacgctaattctatccctacttattacttttttttttccctccgcttcttacgacgaaaactactatccaaaaaatacgcaataataattctaaaaaaactaaaaactctcctaacgacgctaaaaccgcgaaaaactcacgtaataactcctactcctaataaacgcaaacgttacgaaactcaccgtcccacaaaacgtatttccgaaaatacattaattataactaaacgcaataacgcgacaatttaattctccgacgactacaaattaacgaaacgaaataatcctaacaaaactcatcaaaaaactcgataactatcaacttacccctcgcccaaaacaccccccgcgctctaac

SEQ ID NO: 30437 - DNA, 1581 bp, Artificial Sequence
  chemically treated genomic DNA (Homo sapiens) CpG-island No: 30437
gagataattacggaagtttaacggttaaggtcgtatttattttgtcgtagttcggcggtttttataggataagcgaggggatttcgttggtttttaggagcgagcgtagtagggtattttggtttacggttttgttttgttcgaagtaattttgtagcgtgttaggacgtatcgtgtcggttagcggtttgttttgtagtatttgtcggattttttcggtagttagcgttcgggggtgcgggcggttttcgttattggtttcgaaggcggtggcggtttcggtagcgttcgcgttttagtgtttcgggtcgttttcgtcgttcgcgttcgcgttttcgtcgttatcgtcgtcgtttacggtttttttttttttttgcgttttcgtttcgttttagttgcgcggagacgcgtttttcgtcgcggcggcggtcgtcggtttttttttcgatttttttttttcggggttgttggagcgggttatcgggaagtcggggataaggcgggcgtcgttgggtgtgggcggcgcgtcgtagttttcgcggttttcggtttcgtcgtcgtcgtcgttttttttattttcgttttcgttgttttcggttgtcgtcggggtggttggttgttttagcgtcgagtttttcgatagtcgtcgttttttggcgtcgggcggcgagggttttttggttcgtttttcggcgcggtgcgattcggtcgcgggtttcgcgtgtttcgtcgggtggagtagtagatagcggtttaggtgcgagttgatgtgcgcggcgggtattatttgttggtatacggggtattgtatttggtgtagttgcgaaaggaaggggtcgtttttcggttcgtttatttttatggcggtcgtcgtttttttcggcgttcggcgcggtcgtagtaattcgtgcgtacgcggaggttttcgatgtttttcgttaggtttcgcgtcgcgagattttcgttcggggaattagtaggacgttcgcgggtcggaggagggcgtcgtttatgttttacgttcgtagttttcgcgttcgttcgttttcggtcggtcgttggtagcgttttacgcggcgtgtcgggaagtgtagttcgtggtcgtttgtttcggcggcggaggcgtttcgcgcggtatgtaagtaagtgtagttcgtggtcgtttgttttaattatcgtcgagaatatttcgcgcggtatttcgggaagtgtagttcgcggttattcgttttagttgtcgtgcgtttattttcgattttgagaatagttttgcgggggcgggggaggggcgggggggggggttgcgaggcgagcgtggtgcgcgtgcgcgaggttgcgcggtggcggacgtagtttttcgtttaggtatgcgagtcgcgcgagggtagggaggagttacggattgcgcgaggttgttggagcggcgagcgtcgttttttcggtttttcgtgttgggttgttgaatgggtttgtggggataagtaggaggcggtcgtagcgggtcgtttgtaacgaaagggaaatgggggaaaaaatttaaaagtttttaatagaaaattagtgttttattggacgtgaata

SEQ ID NO: 30438 - DNA, 1581 bp, Artificial Sequence
  chemically treated genomic DNA (Homo sapiens) CpG-island No: 30438
tattcacgtccaataaaacactaattttctattaaaaacttttaaattttttcccccatttccctttcgttacaaacgacccgctacgaccgcctcctacttatccccacaaacccattcaacaacccaacacgaaaaaccgaaaaaacgacgctcgccgctccaacaacctcgcgcaatccgtaactcctccctaccctcgcgcgactcgcatacctaaacgaaaaactacgtccgccaccgcgcaacctcgcgcacgcgcaccacgctcgcctcgcaacccccccccccgcccctcccccgcccccgcaaaactattctcaaaatcgaaaataaacgcacgacaactaaaacgaataaccgcgaactacacttcccgaaataccgcgcgaaatattctcgacgataattaaaacaaacgaccacgaactacacttacttacataccgcgcgaaacgcctccgccgccgaaacaaacgaccacgaactacacttcccgacacgccgcgtaaaacgctaccaacgaccgaccgaaaacgaacgaacgcgaaaactacgaacgtaaaacataaacgacgccctcctccgacccgcgaacgtcctactaattccccgaacgaaaatctcgcgacgcgaaacctaacgaaaaacatcgaaaacctccgcgtacgcacgaattactacgaccgcgccgaacgccgaaaaaaacgacgaccgccataaaaataaacgaaccgaaaaacgaccccttcctttcgcaactacaccaaatacaataccccgtataccaacaaataatacccgccgcgcacatcaactcgcacctaaaccgctatctactactccacccgacgaaacacgcgaaacccgcgaccgaatcgcaccgcgccgaaaaacgaaccaaaaaaccctcgccgcccgacgccaaaaaacgacgactatcgaaaaactcgacgctaaaacaaccaaccaccccgacgacaaccgaaaacaacgaaaacgaaaataaaaaaaacgacgacgacgacgaaaccgaaaaccgcgaaaactacgacgcgccgcccacacccaacgacgcccgccttatccccgacttcccgataacccgctccaacaaccccgaaaaaaaaaaatcgaaaaaaaaaccgacgaccgccgccgcgacgaaaaacgcgtctccgcgcaactaaaacgaaacgaaaacgcaaaaaaaaaaaaaaaccgtaaacgacgacgataacgacgaaaacgcgaacgcgaacgacgaaaacgacccgaaacactaaaacgcgaacgctaccgaaaccgccaccgccttcgaaaccaataacgaaaaccgcccgcacccccgaacgctaactaccgaaaaaatccgacaaatactacaaaacaaaccgctaaccgacacgatacgtcctaacacgctacaaaattacttcgaacaaaacaaaaccgtaaaccaaaataccctactacgctcgctcctaaaaaccaacgaaatcccctcgcttatcctataaaaaccgccgaactacgacaaaataaatacgaccttaaccgttaaacttccgtaattatctc

SEQ ID NO: 30439 - DNA, 1581 bp, Artificial Sequence
  chemically treated genomic DNA (Homo sapiens) CpG-island No: 30439
tgtttacgtttaatagaatattggttttttattggaggtttttgggtttttttttttatttttttttcgttataaacgattcgttgcggtcgttttttgtttgtttttataggtttatttaatagtttagtacggaaggtcgggaaagcggcgttcgtcgttttaataatttcgcgtagttcgtggtttttttttgttttcgcgcgattcgtatgtttgggcggagggttgcgttcgttatcgcgtaatttcgcgtacgcgtattacgttcgtttcgtaattttttttttcgtttttttttcgttttcgtaaggttgtttttagagtcggaaatggacgtacggtagttggggcgaatggtcgcggattatatttttcgaagtgtcgcgcgaggtattttcggcggtgattggggtaaacggttacggattatatttatttatatgtcgcgcgaggcgttttcgtcgtcggggtaaacggttacgaattatatttttcgatacgtcgcgtgaggcgttgttagcggtcggtcgagggcgggcggacgcgggagttgcggacgtgaggtatgagcggcgttttttttcggttcgcgagcgttttgttggtttttcgagcgagggtttcgcggcgcggggtttagcggagggtatcgaaggttttcgcgtgcgtacgggttgttgcggtcgcgtcgggcgtcggggagggcggcggtcgttatggaggtgagcgggtcggaagacgatttttttttttcgtagttgtattaggtgtagtgtttcgtgtgttagtagatgatgttcgtcgcgtatattaattcgtatttggatcgttgtttgttgttttattcggcggggtacgcggagttcgcggtcgggtcgtatcgcgtcggggagcgggttaaggggttttcgtcgttcggcgttaagaggcggcggttgtcggagagttcggcgttgaagtagttagttatttcgacggtagtcgagagtagcgagggcgagggtgaggagggcgacgacggcggcgagatcgagagtcgcgagagttacgacgcgtcgtttatatttagcggcgttcgttttattttcgatttttcggtggttcgttttagtagtttcgggaggaaggggtcggggaagaggtcggcggtcgtcgtcgcggcggggagcgcgttttcgcgtagttgggacgaggcggaggcgtaggaggaggaggaggtcgtgggcgacggcgatggcgacggggacgcggacgcggacggcgaggacgattcggggtattgggacgcggacgttgtcgaagtcgttatcgttttcggggttagtggcgggggtcgttcgtattttcgggcgttggttgtcgaggagattcgatagatgttatagggtaagtcgttggtcgatacgatgcgttttgatacgttgtaggattatttcgggtagagtaaggtcgtgggttaggatattttgttgcgttcgtttttggagattaacgaaattttttcgtttattttgtgggggtcgtcgggttgcggtaaggtgagtgcggttttggtcgttgggttttcgtagttatttt

SEQ ID NO: 30440 - DNA, 1581 bp, Artificial Sequence
  chemically treated genomic DNA (Homo sapiens) CpG-island No: 30440
aaaataactacgaaaacccaacgaccaaaaccgcactcaccttaccgcaacccgacgacccccacaaaataaacgaaaaaatttcgttaatctccaaaaacgaacgcaacaaaatatcctaacccacgaccttactctacccgaaataatcctacaacgtatcaaaacgcatcgtatcgaccaacgacttaccctataacatctatcgaatctcctcgacaaccaacgcccgaaaatacgaacgacccccgccactaaccccgaaaacgataacgacttcgacaacgtccgcgtcccaataccccgaatcgtcctcgccgtccgcgtccgcgtccccgtcgccatcgccgtcgcccacgacctcctcctcctcctacgcctccgcctcgtcccaactacgcgaaaacgcgctccccgccgcgacgacgaccgccgacctcttccccgaccccttcctcccgaaactactaaaacgaaccaccgaaaaatcgaaaataaaacgaacgccgctaaatataaacgacgcgtcgtaactctcgcgactctcgatctcgccgccgtcgtcgccctcctcaccctcgccctcgctactctcgactaccgtcgaaataactaactacttcaacgccgaactctccgacaaccgccgcctcttaacgccgaacgacgaaaaccccttaacccgctccccgacgcgatacgacccgaccgcgaactccgcgtaccccgccgaataaaacaacaaacaacgatccaaatacgaattaatatacgcgacgaacatcatctactaacacacgaaacactacacctaatacaactacgaaaaaaaaaaatcgtcttccgacccgctcacctccataacgaccgccgccctccccgacgcccgacgcgaccgcaacaacccgtacgcacgcgaaaaccttcgataccctccgctaaaccccgcgccgcgaaaccctcgctcgaaaaaccaacaaaacgctcgcgaaccgaaaaaaaacgccgctcatacctcacgtccgcaactcccgcgtccgcccgccctcgaccgaccgctaacaacgcctcacgcgacgtatcgaaaaatataattcgtaaccgtttaccccgacgacgaaaacgcctcgcgcgacatataaataaatataatccgtaaccgtttaccccaatcaccgccgaaaatacctcgcgcgacacttcgaaaaatataatccgcgaccattcgccccaactaccgtacgtccatttccgactctaaaaacaaccttacgaaaacgaaaaaaaaacgaaaaaaaaaattacgaaacgaacgtaatacgcgtacgcgaaattacgcgataacgaacgcaaccctccgcccaaacatacgaatcgcgcgaaaacaaaaaaaaaccacgaactacgcgaaattattaaaacgacgaacgccgctttcccgaccttccgtactaaactattaaataaacctataaaaacaaacaaaaaacgaccgcaacgaatcgtttataacgaaaaaaaaataaaaaaaaaaacccaaaaacctccaataaaaaaccaatattctattaaacgtaaaca

SEQ ID NO: 30441 - DNA, 603 bp, Artificial Sequence
  chemically treated genomic DNA (Homo sapiens) CpG-island No: 30441
  misc_feature (2)..(2): n is either a, c, g or t
  misc_feature (105)..(105): n is either a, c, g or t
  misc_feature (132)..(132): n is either a, c, g or t
  misc_feature (140)..(140): n is either a, c, g or t
  misc_feature (142)..(142): n is either a, c, g or t
  misc_feature (148)..(148): n is either a, c, g or t
  misc_feature (159)..(159): n is either a, c, g or t
  misc_feature (165)..(165): n is either a, c, g or t
  misc_feature (171)..(171): n is either a, c, g or t
  misc_feature (182)..(182): n is either a, c, g or t
  misc_feature (195)..(195): n is either a, c, g or t
  misc_feature (220)..(220): n is either a, c, g or t
  misc_feature (222)..(222): n is either a, c, g or t
  misc_feature (263)..(263): n is either a, c, g or t
  misc_feature (281)..(281): n is either a, c, g or t
  misc_feature (292)..(292): n is either a, c, g or t
  misc_feature (296)..(296): n is either a, c, g or t
  misc_feature (325)..(325): n is either a, c, g or t
  misc_feature (339)..(339): n is either a, c, g or t
  misc_feature (354)..(354): n is either a, c, g or t
  misc_feature (384)..(384): n is either a, c, g or t
  misc_feature (387)..(387): n is either a, c, g or t
  misc_feature (419)..(419): n is either a, c, g or t
  misc_feature (473)..(473): n is either a, c, g or t
  misc_feature (489)..(489): n is either a, c, g or t
  misc_feature (546)..(546): n is either a, c, g or t
  misc_feature (570)..(570): n is either a, c, g or t
gntttttttatattattcgttttcgcgtatatttgtgttttcgatttttttatatattttattttcgtatttattttcgttcgtattttacgtatttcgtcgttntcgcgtcgtttacgcgtatatacgttngtattcgngntttttntgtttacgcgnttattnggacgngtatttttttncgagtttatacgntcggtcggattatattcgagtattntntaattttttttatatttttcgtatttatttcgtgtattttnacggtttacgtatcgcgngtatattattnattnttttcgcgtatttcgtatatattattgtncgtatatttcgcgnattttacgcgttcgntcgcgttttattagtttattttttacgatnttngtacgcggtgattatttatttttcgtacgcgnatatttacgtttacgtatatatatttttttattttgtagtttcgatacgtattnatattgttgttcgatngtatatatttatttatattcgtattatgacgtaatcgatatatattgagtattatancgttgttgttattttttagattancgtgttacgttacgtttttatagtatttttcga

SEQ ID NO: 30442 - DNA, 603 bp, Artificial Sequence
  chemically treated genomic DNA (Homo sapiens) CpG-island No: 30442
  misc_feature (34)..(34): n is either a, c, g or t
  misc_feature (58)..(58): n is either a, c, g or t
  misc_feature (115)..(115): n is either a, c, g or t
  misc_feature (131)..(131): n is either a, c, g or t
  misc_feature (185)..(185): n is either a, c, g or t
  misc_feature (217)..(217): n is either a, c, g or t
  misc_feature (220)..(220): n is either a, c, g or t
  misc_feature (250)..(250): n is either a, c, g or t
  misc_feature (265)..(265): n is either a, c, g or t
  misc_feature (279)..(279): n is either a, c, g or t
  misc_feature (308)..(308): n is either a, c, g or t
  misc_feature (312)..(312): n is either a, c, g or t
  misc_feature (323)..(323): n is either a, c, g or t
  misc_feature (341)..(341): n is either a, c, g or t
  misc_feature (382)..(382): n is either a, c, g or t
  misc_feature (384)..(384): n is either a, c, g or t
  misc_feature (409)..(409): n is either a, c, g or t
  misc_feature (422)..(422): n is either a, c, g or t
  misc_feature (433)..(433): n is either a, c, g or t
  misc_feature (439)..(439): n is either a, c, g or t
  misc_feature (445)..(445): n is either a, c, g or t
  misc_feature (456)..(456): n is either a, c, g or t
  misc_feature (462)..(462): n is either a, c, g or t
  misc_feature (464)..(464): n is either a, c, g or t
  misc_feature (472)..(472): n is either a, c, g or t
  misc_feature (499)..(499): n is either a, c, g or t
  misc_feature (602)..(602): n is either a, c, g or t
tcgaaaaatactataaaaacgtaacgtaacacgntaatctaaaaaataacaacaacgntataatactcaatatatatcgattacgtcataatacgaatataaataaatatatacnatcgaacaacaatatnaatacgtatcgaaactacaaaataaaaaaatatatatacgtaaacgtaaatatncgcgtacgaaaaataaataatcaccgcgtacnaanatcgtaaaaaataaactaataaaacgcgancgaacgcgtaaaatncgcgaaatatacgnacaataatatatacgaaatacgcgaaaanaatnaataatatacncgcgatacgtaaaccgtnaaaatacacgaaataaatacgaaaaatataaaaaaaattananaatactcgaatataatccgaccgancgtataaactcgnaaaaaaatacncgtccnaataancgcgtaaacanaaaaancncgaatacnaacgtatatacgcgtaaacgacgcganaacgacgaaatacgtaaaatacgaacgaaaataaatacgaaaataaaatatataaaaaaatcgaaaacacaaatatacgcgaaaacgaataatataaaaaaanc

SEQ ID NO: 30443 - DNA, 603 bp, Artificial Sequence
  chemically treated genomic DNA (Homo sapiens) CpG-island No: 30443
  misc_feature (34)..(34): n is either a, c, g or t
  misc_feature (58)..(58): n is either a, c, g or t
  misc_feature (115)..(115): n is either a, c, g or t
  misc_feature (131)..(131): n is either a, c, g or t
  misc_feature (185)..(185): n is either a, c, g or t
  misc_feature (217)..(217): n is either a, c, g or t
  misc_feature (220)..(220): n is either a, c, g or t
  misc_feature (250)..(250): n is either a, c, g or t
  misc_feature (265)..(265): n is either a, c, g or t
  misc_feature (279)..(279): n is either a, c, g or t
  misc_feature (308)..(308): n is either a, c, g or t
  misc_feature (312)..(312): n is either a, c, g or t
  misc_feature (323)..(323): n is either a, c, g or t
  misc_feature (341)..(341): n is either a, c, g or t
  misc_feature (382)..(382): n is either a, c, g or t
  misc_feature (384)..(384): n is either a, c, g or t
  misc_feature (409)..(409): n is either a, c, g or t
  misc_feature (422)..(422): n is either a, c, g or t
  misc_feature (433)..(433): n is either a, c, g or t
  misc_feature (439)..(439): n is either a, c, g or t
  misc_feature (445)..(445): n is either a, c, g or t
  misc_feature (456)..(456): n is either a, c, g or t
  misc_feature (462)..(462): n is either a, c, g or t
  misc_feature (464)..(464): n is either a, c, g or t
  misc_feature (472)..(472): n is either a, c, g or t
  misc_feature (499)..(499): n is either a, c, g or t
  misc_feature (602)..(602): n is either a, c, g or t
tcgagagatattgtgaaagcgtagcgtagtacgntgatttagagagtgatagtagcgntgtggtgtttagtgtgtgtcggttacgttatagtgcgagtgtgagtgagtgtgtgtngtcgagtaatagtgtnagtgcgtgtcgagattatagagtgagagagtgtgtgtacgtgagcgtgagtgtncgcgtgcgaaaggtaagtggttatcgcgtgtnagnatcgtgagaggtgagttagtggagcgcgancgagcgcgtagggtncgcgaggtgtgcgnatagtgatgtgtgcggagtgcgcgagagnagtnagtagtgtgtncgcggtacgtgagtcgtnaaagtgtacgaggtgggtgcgagaggtgtgagagaggttananagtattcgagtgtgattcgatcgancgtgtgggttcgngagagagtgtncgtttnagtgancgcgtgagtanagagantncgagtgtnagcgtgtgtgcgcgtgagcggcgcganagcggcgaggtgcgtggagtgcgagcgagagtgagtgcgagagtgaggtgtgtgaggaggtcgagagtataagtgtgcgcgagagcgagtggtgtggagagant

SEQ ID NO: 30444 - DNA, 603 bp, Artificial Sequence
  chemically treated genomic DNA (Homo sapiens) CpG-island No: 30444
  misc_feature (2)..(2): n is either a, c, g or t
  misc_feature (105)..(105): n is either a, c, g or t
  misc_feature (132)..(132): n is either a, c, g or t
  misc_feature (140)..(140): n is either a, c, g or t
  misc_feature (142)..(142): n is either a, c, g or t
  misc_feature (148)..(148): n is either a, c, g or t
  misc_feature (159)..(159): n is either a, c, g or t
  misc_feature (165)..(165): n is either a, c, g or t
  misc_feature (171)..(171): n is either a, c, g or t
  misc_feature (182)..(182): n is either a, c, g or t
  misc_feature (195)..(195): n is either a, c, g or t
  misc_feature (220)..(220): n is either a, c, g or t
  misc_feature (222)..(222): n is either a, c, g or t
  misc_feature (263)..(263): n is either a, c, g or t
  misc_feature (281)..(281): n is either a, c, g or t
  misc_feature (292)..(292): n is either a, c, g or t
  misc_feature (296)..(296): n is either a, c, g or t
  misc_feature (325)..(325): n is either a, c, g or t
  misc_feature (339)..(339): n is either a, c, g or t
  misc_feature (354)..(354): n is either a, c, g or t
  misc_feature (384)..(384): n is either a, c, g or t
  misc_feature (387)..(387): n is either a, c, g or t
  misc_feature (419)..(419): n is either a, c, g or t
  misc_feature (473)..(473): n is either a, c, g or t
  misc_feature (489)..(489): n is either a, c, g or t
  misc_feature (546)..(546): n is either a, c, g or t
  misc_feature (570)..(570): n is either a, c, g or t
antctctccacaccactcgctctcgcgcacacttatactctcgacctcctcacacacctcactctcgcactcactctcgctcgcactccacgcacctcgccgctntcgcgccgctcacgcgcacacacgctnacactcgnantctctntactcacgcgntcactnaaacgnacactctctcncgaacccacacgntcgatcgaatcacactcgaatactntntaacctctctcacacctctcgcacccacctcgtacactttnacgactcacgtaccgcgnacacactactnactnctctcgcgcactccgcacacatcactatncgcacacctcgcgnaccctacgcgctcgntcgcgctccactaactcacctctcacgatnctnacacgcgataaccacttacctttcgcacgcgnacactcacgctcacgtacacacactctctcactctataatctcgacacgcactnacactattactcgacnacacacactcactcacactcgcactataacgtaaccgacacacactaaacaccacancgctactatcactctctaaatcancgtactacgctacgctttcacaatatctctcga

SEQ ID NO: 30445 - DNA, 505 bp, Artificial Sequence
  chemically treated genomic DNA (Homo sapiens) CpG-island No: 30445
gggttattagttttagtcgttcgggttgtacgcgtaggcggtttattcggggggcggcggcggcggtttggtcgggatgttggcggcgggcggtggcggcgcggggtcgggtttgtattacgcgttgtacgaggatggttacgaggcgtagttggagtcgtcgtcgtcgtcgtatttgggcgtttacggatacgtatacggatatgtatacgcgggcggtttgtacgcggcggcggcgtatttgtattcgggcgcgggcggcggcggtttatcggtgggcgagtattcggacgaggatgcgtttagttcggacgatttggagtagttcgttaagtagtttaagtagcggcgtattaagttgggttttacgtaggtcgacgtggggttggcgttgggtacgttttacggtaacgtgttttcgtagattattatttgtcgtttcgaggttttgtagttgagttttaagaatatgtgtaagtttaagtcgttgtttaataagtggttg

SEQ ID NO: 30446 - DNA, 505 bp, Artificial Sequence
  chemically treated genomic DNA (Homo sapiens) CpG-island No: 30446
caaccacttattaaacaacgacttaaacttacacatattcttaaaactcaactacaaaacctcgaaacgacaaataataatctacgaaaacacgttaccgtaaaacgtacccaacgccaaccccacgtcgacctacgtaaaacccaacttaatacgccgctacttaaactacttaacgaactactccaaatcgtccgaactaaacgcatcctcgtccgaatactcgcccaccgataaaccgccgccgcccgcgcccgaatacaaatacgccgccgccgcgtacaaaccgcccgcgtatacatatccgtatacgtatccgtaaacgcccaaatacgacgacgacgacgactccaactacgcctcgtaaccatcctcgtacaacgcgtaatacaaacccgaccccgcgccgccaccgcccgccgccaacatcccgaccaaaccgccgccgccgccccccgaataaaccgcctacgcgtacaacccgaacgactaaaactaataaccc

SEQ ID NO: 30447 - DNA, 505 bp, Artificial Sequence
  chemically treated genomic DNA (Homo sapiens) CpG-island No: 30447
tagttatttgttgagtagcggtttgagtttgtatatgtttttgaagtttagttgtagggtttcgaagcggtagatggtggtttgcgagaatacgttatcgtagagcgtgtttagcgttagttttacgtcggtttgcgtaaagtttagtttgatgcgtcgttgtttgaattgtttggcgaattgttttaggtcgttcgagttgggcgtattttcgttcgagtgttcgtttatcgatgagtcgtcgtcgttcgcgttcgggtgtaggtgcgtcgtcgtcgcgtgtaggtcgttcgcgtgtgtatgttcgtgtgcgtgttcgtgggcgtttagatgcggcggcggcgacggttttagttgcgtttcgtggttattttcgtgtagcgcgtggtgtaggttcggtttcgcgtcgttatcgttcgtcgttagtatttcggttaggtcgtcgtcgtcgtttttcgggtaggtcgtttgcgcgtatagttcgagcggttggggttggtggttt

SEQ ID NO: 30448 - DNA, 505 bp, Artificial Sequence
  chemically treated genomic DNA (Homo sapiens) CpG-island No: 30448
aaaccaccaaccccaaccgctcgaactatacgcgcaaacgacctacccgaaaaacgacgacgacgacctaaccgaaatactaacgacgaacgataacgacgcgaaaccgaacctacaccacgcgctacacgaaaataaccacgaaacgcaactaaaaccgtcgccgccgccgcatctaaacgcccacgaacacgcacacgaacatacacacgcgaacgacctacacgcgacgacgacgcacctacacccgaacgcgaacgacgacgactcatcgataaacgaacactcgaacgaaaatacgcccaactcgaacgacctaaaacaattcgccaaacaattcaaacaacgacgcatcaaactaaactttacgcaaaccgacgtaaaactaacgctaaacacgctctacgataacgtattctcgcaaaccaccatctaccgcttcgaaaccctacaactaaacttcaaaaacatatacaaactcaaaccgctactcaacaaataacta

SEQ ID NO: 30449 - DNA, 765 bp, Artificial Sequence
  chemically treated genomic DNA (Homo sapiens) CpG-island No: 30449
gaaggcggaagtcgcggtttagattttagggcgttgttgattttcgtttgggtcgtagggttcgcggggttggtttaaggttagtagcgtagtttcgcgcgtatttatcgggttcggacgatagggttatgtcgtcggtcgaaagggacggtcgtagggttggagtaaaggggacgcgttgggtagagcggagcggggttgttgggtattgaggttagtcggggttagggttcggttaggtcgcgtttcgtagtaggcgcgggggtcgggcgtttagagggcgtagcgttgcggattttcggttaggagggtttcgcgggaggagggagggtcgttttagtagggaggaagtcggttagtcgcgtgtagttttcgtcggtgttttatttgggcgcggagcggagtagagagagtcgagaggttatttgaagcgttcgggtcgcgtcgttaacgggaaatttgagagtagtaggggcgcggcggtcgttagggtttttggtcggaagtattcgtcgttttttgggtttcgcggggttcgcgtcgtagttcggagtagatgttagtcgggttttttagattttaattgcgttggtttcgtcgggtttttatatcgtttttcgtgtcgttcgggtttgttcgacgttttttttttttcgtataattttttttagcgcgagattttgggggtttcggtttcgtataggtgatttgttttttgtagttgtagtaattcgtaagtattggttttttttaggcgtttttttg

SEQ ID NO: 30450 - DNA, 765 bp, Artificial Sequence
  chemically treated genomic DNA (Homo sapiens) CpG-island No: 30450
caaaaaaacgcctaaaaaaaaccaatacttacgaattactacaactacaaaaaacaaatcacctatacgaaaccgaaacccccaaaatctcgcgctaaaaaaaattatacgaaaaaaaaaaaacgtcgaacaaacccgaacgacacgaaaaacgatataaaaacccgacgaaaccaacgcaattaaaatctaaaaaacccgactaacatctactccgaactacgacgcgaaccccgcgaaacccaaaaaacgacgaatacttccgaccaaaaaccctaacgaccgccgcgcccctactactctcaaatttcccgttaacgacgcgacccgaacgcttcaaataacctctcgactctctctactccgctccgcgcccaaataaaacaccgacgaaaactacacgcgactaaccgacttcctccctactaaaacgaccctccctcctcccgcgaaaccctcctaaccgaaaatccgcaacgctacgccctctaaacgcccgacccccgcgcctactacgaaacgcgacctaaccgaaccctaaccccgactaacctcaatacccaacaaccccgctccgctctacccaacgcgtcccctttactccaaccctacgaccgtccctttcgaccgacgacataaccctatcgtccgaacccgataaatacgcgcgaaactacgctactaaccttaaaccaaccccgcgaaccctacgacccaaacgaaaatcaacaacgccctaaaatctaaaccgcgacttccgccttc

SEQ ID NO: 30451 - DNA, 765 bp, Artificial Sequence
  chemically treated genomic DNA (Homo sapiens) CpG-island No: 30451
tagaaggacgtttggaagaaattaatgtttgcgggttgttgtaattatagggagtaagttatttgtgcggggtcgagatttttagagtttcgcgttgggaaaagttgtgcggggaggggaggacgtcgggtaagttcgggcggtacggggagcggtgtggaagttcggcggggttagcgtagttgaggtttggggagttcggttggtatttgtttcgggttgcggcgcgggtttcgcggagtttaggaggcggcgggtgttttcggttaagggttttggcggtcgtcgcgtttttgttgtttttaagtttttcgttggcggcgcggttcgggcgttttaggtagtttttcggttttttttgtttcgtttcgcgtttaggtagggtatcgacgggggttgtacgcggttggtcggttttttttttgttgaggcggtttttttttttttcgcggggtttttttggtcggggattcgtagcgttgcgttttttgaacgttcggttttcgcgtttgttgcggggcgcggtttggtcgggttttggtttcggttggttttagtgtttagtagtttcgtttcgttttgtttagcgcgttttttttgttttagttttgcggtcgtttttttcggtcggcggtatggttttgtcgttcgaattcggtgagtgcgcgcgaggttgcgttgttgattttgggttagtttcgcggattttgcggtttaggcgggaattagtagcgttttggggtttgaatcgcggttttcgttttt

SEQ ID NO: 30452 - DNA, 765 bp, Artificial Sequence
  chemically treated genomic DNA (Homo sapiens) CpG-island No: 30452
aaaaacgaaaaccgcgattcaaaccccaaaacgctactaattcccgcctaaaccgcaaaatccgcgaaactaacccaaaatcaacaacgcaacctcgcgcgcactcaccgaattcgaacgacaaaaccataccgccgaccgaaaaaaacgaccgcaaaactaaaacaaaaaaaacgcgctaaacaaaacgaaacgaaactactaaacactaaaaccaaccgaaaccaaaacccgaccaaaccgcgccccgcaacaaacgcgaaaaccgaacgttcaaaaaacgcaacgctacgaatccccgaccaaaaaaaccccgcgaaaaaaaaaaaaaccgcctcaacaaaaaaaaaaccgaccaaccgcgtacaacccccgtcgataccctacctaaacgcgaaacgaaacaaaaaaaaccgaaaaactacctaaaacgcccgaaccgcgccgccaacgaaaaacttaaaaacaacaaaaacgcgacgaccgccaaaacccttaaccgaaaacacccgccgcctcctaaactccgcgaaacccgcgccgcaacccgaaacaaataccaaccgaactccccaaacctcaactacgctaaccccgccgaacttccacaccgctccccgtaccgcccgaacttacccgacgtcctcccctccccgcacaacttttcccaacgcgaaactctaaaaatctcgaccccgcacaaataacttactccctataattacaacaacccgcaaacattaatttcttccaaacgtccttcta

SEQ ID NO: 30453 - DNA, 838 bp, Artificial Sequence
  chemically treated genomic DNA (Homo sapiens) CpG-island No: 30453
gcgagcgcggtggcggcgaagggaaacgagtaggagagtggttatcgcgggtggagtttggattcgaattttttttcgttcggattcgaattttttttcgttttttttacgagttattgttttttcgcgggttttttataatttttgttcggaggtcgaggttcgggcgcgtatcgggtcggagtcgggttcggtaggtttcgggagcgcgcgtttttttttcgaggtttcgggtagttgtagatacggggagagtaggagagtcgggaaagaggaggggaaggggcgggggcggtcgtcggcggcgggcggggaggagtcgtcgcgcgcgggttttggttaggggaggaggtagtggcggcggcggcggcggtagaggaggaggaggaggcggtgttcgcgtcgggcggtagagcggcgttgggatttatgcggtcgtgattttcggttttttagaggtttagcgtagtcgtagcggataaaggagtatgttcgcgtcggggaaggttcgtttttcggtcgttataaggtttcggtcgtcgttgggttcgcgtcgcgtttttgttcgttcgggtttcggggcggttcgttaggttagtgcgtcgtcgttcgtttcgtaggtttcggttcgtagtatggagttattcggacgtcggggggtcgcgggtagtcgtcgttggtgttgtcgttttcgttgttagcgttgttcgcgttgttggaagtcggcggcgtcggcggcgtcgcggcgttgttcgtcggttgtaagtacgatgggcggtttcgaggggttggtagggcggcgggcgtgaatttagggggtggagtttgtagtgagtcg

SEQ ID NO: 30454 - DNA, 838 bp, Artificial Sequence
  chemically treated genomic DNA (Homo sapiens) CpG-island No: 30454
cgactcactacaaactccaccccctaaattcacgcccgccgccctaccaacccctcgaaaccgcccatcgtacttacaaccgacgaacaacgccgcgacgccgccgacgccgccgacttccaacaacgcgaacaacgctaacaacgaaaacgacaacaccaacgacgactacccgcgaccccccgacgtccgaataactccatactacgaaccgaaacctacgaaacgaacgacgacgcactaacctaacgaaccgccccgaaacccgaacgaacaaaaacgcgacgcgaacccaacgacgaccgaaaccttataacgaccgaaaaacgaaccttccccgacgcgaacatactcctttatccgctacgactacgctaaacctctaaaaaaccgaaaatcacgaccgcataaatcccaacgccgctctaccgcccgacgcgaacaccgcctcctcctcctcctctaccgccgccgccgccgccactacctcctcccctaaccaaaacccgcgcgcgacgactcctccccgcccgccgccgacgaccgcccccgccccttcccctcctctttcccgactctcctactctccccgtatctacaactacccgaaacctcgaaaaaaaaacgcgcgctcccgaaacctaccgaacccgactccgacccgatacgcgcccgaacctcgacctccgaacaaaaattataaaaaacccgcgaaaaaacaataactcgtaaaaaaaacgaaaaaaaattcgaatccgaacgaaaaaaaattcgaatccaaactccacccgcgataaccactctcctactcgtttcccttcgccgccaccgcgctcgc

SEQ ID NO: 30455 - DNA, 838 bp, Artificial Sequence
  chemically treated genomic DNA (Homo sapiens) CpG-island No: 30455
cggtttattgtaagttttattttttgggtttacgttcgtcgttttgttagtttttcggggtcgtttatcgtgtttgtagtcggcgggtagcgtcgcggcgtcgtcggcgtcgtcggtttttagtagcgcgagtagcgttaatagcgagagcggtagtattagcggcggttgttcgcggtttttcggcgttcgggtggttttatgttgcgggtcggggtttgcggggcgagcggcggcgtattggtttagcgggtcgtttcggagttcgggcgggtaggagcgcggcgcgggtttagcggcgatcggagttttatggcggtcggaggacgggtttttttcggcgcggatatgtttttttgttcgttgcggttgcgttgggtttttagggagtcgggggttacggtcgtatgggttttagcgtcgttttatcgttcggcgcgagtatcgtttttttttttttttttgtcgtcgtcgtcgtcgttattgtttttttttttggttaggattcgcgcgcggcggttttttttcgttcgtcgtcggcggtcgttttcgttttttttttttttttttttcggtttttttgtttttttcgtgtttgtagttgttcgggatttcggggaggaggcgcgcgttttcgggatttgtcgagttcgatttcgattcggtgcgcgttcgggtttcggttttcgggtaggagttgtggggagttcgcgggaaggtagtaattcgtagagagaacggaggaaagttcgagttcgaacggaggaaagttcgagtttaaattttattcgcggtggttatttttttgttcgttttttttcgtcgttatcgcgttcgt

SEQ ID NO: 30456 - DNA, 838 bp, Artificial Sequence
  chemically treated genomic DNA (Homo sapiens) CpG-island No: 30456
acgaacgcgataacgacgaaaaaaaacgaacaaaaaaataaccaccgcgaataaaatttaaactcgaactttcctccgttcgaactcgaactttcctccgttctctctacgaattactaccttcccgcgaactccccacaactcctacccgaaaaccgaaacccgaacgcgcaccgaatcgaaatcgaactcgacaaatcccgaaaacgcgcgcctcctccccgaaatcccgaacaactacaaacacgaaaaaaacaaaaaaaccgaaaaaaaaaaaaaaaaaaaacgaaaacgaccgccgacgacgaacgaaaaaaaaccgccgcgcgcgaatcctaaccaaaaaaaaaaacaataacgacgacgacgacgacaaaaaaaaaaaaaaaaacgatactcgcgccgaacgataaaacgacgctaaaacccatacgaccgtaacccccgactccctaaaaacccaacgcaaccgcaacgaacaaaaaaacatatccgcgccgaaaaaaacccgtcctccgaccgccataaaactccgatcgccgctaaacccgcgccgcgctcctacccgcccgaactccgaaacgacccgctaaaccaatacgccgccgctcgccccgcaaaccccgacccgcaacataaaaccacccgaacgccgaaaaaccgcgaacaaccgccgctaatactaccgctctcgctattaacgctactcgcgctactaaaaaccgacgacgccgacgacgccgcgacgctacccgccgactacaaacacgataaacgaccccgaaaaactaacaaaacgacgaacgtaaacccaaaaaataaaacttacaataaaccg

SEQ ID NO: 30457 - DNA, 949 bp, Artificial Sequence
  chemically treated genomic DNA (Homo sapiens) CpG-island No: 30457
gtcgtttttgtgtttttcggttaggcggttggatcgtagcgtgtatagtagcgtcgggattttacgtattgagtagagcggtacgagtatcgcggtcgatcgggtcgcgcgcggagtcgggtcgtggtttttgttagtagtcggcggtagcgtagttcgttttcggtcgataggtagtcgggtagtatgttaagttttgcgcggtcgggatattgagggcgcgggatcgggcgagggaagaggcggggcgaggcggggcggggcgtttagttcgggttttttcgaaagttgagagggagaaggggtagttcgcgcgacgcgtttcgtttggggggttgtagagcggtagcggcgtcggggggttttagtggggtgggtttgttcgtgggcggggttttttcggagacggggtttcggtgggattgggtttgttcgggggcggggtttgtttgaaggcgggttttcggtgggatagggtttattagggggcggggtttgtttgaagcggggtttcggtgggacgcgttgagtttttcggatgggagggacggagggcggcggggcggggcggggcggggtttgcgcgggagtcggattcggacgttattgttaaagggcgcggggtttagtaggtaatcgaggttggggcgggttggggcggggtttggatcggagtttttgttacgaaggattggggggcgtggttaggaggattgtgttttcgtagggtcgggcgtggtcgggggtgtggtcgcggggagggagatgggcgcggagttgtaggattgtcggttgtgtttttcgagattttgaaattacgcgaatcgtgaagcgttcggcgatcgttttcggttcgttgggttttggcgttggggtgtttgatgaagtttcgtcggtttttattggttcgttttttttttaggggttttaggatgtacggagtcgggat

SEQ ID NO: 30458 - DNA, 949 bp, Artificial Sequence
  chemically treated genomic DNA (Homo sapiens) CpG-island No: 30458
atcccgactccgtacatcctaaaacccctaaaaaaaaaacgaaccaataaaaaccgacgaaacttcatcaaacaccccaacgccaaaacccaacgaaccgaaaacgatcgccgaacgcttcacgattcgcgtaatttcaaaatctcgaaaaacacaaccgacaatcctacaactccgcgcccatctccctccccgcgaccacacccccgaccacgcccgaccctacgaaaacacaatcctcctaaccacgccccccaatccttcgtaacaaaaactccgatccaaaccccgccccaacccgccccaacctcgattacctactaaaccccgcgccctttaacaataacgtccgaatccgactcccgcgcaaaccccgccccgccccgccccgccgccctccgtccctcccatccgaaaaactcaacgcgtcccaccgaaaccccgcttcaaacaaaccccgccccctaataaaccctatcccaccgaaaacccgccttcaaacaaaccccgcccccgaacaaacccaatcccaccgaaaccccgtctccgaaaaaaccccgcccacgaacaaacccaccccactaaaaccccccgacgccgctaccgctctacaaccccccaaacgaaacgcgtcgcgcgaactaccccttctccctctcaactttcgaaaaaacccgaactaaacgccccgccccgcctcgccccgcctcttccctcgcccgatcccgcgccctcaatatcccgaccgcgcaaaacttaacatactacccgactacctatcgaccgaaaacgaactacgctaccgccgactactaacaaaaaccacgacccgactccgcgcgcgacccgatcgaccgcgatactcgtaccgctctactcaatacgtaaaatcccgacgctactatacacgctacgatccaaccgcctaaccgaaaaacacaaaaacgac

SEQ ID NO: 30459 - DNA, 949 bp, Artificial Sequence
  chemically treated genomic DNA (Homo sapiens) CpG-island No: 30459
atttcggtttcgtatattttggagtttttaggggagggacggattagtgggggtcggcggggttttattagatattttaacgttaggatttaacggatcgaggacggtcgtcgggcgttttacggttcgcgtggttttaggatttcggagaatataatcggtagttttgtagtttcgcgtttattttttttttcgcggttatattttcggttacgttcggttttgcgaaagtatagtttttttggttacgttttttagtttttcgtagtaaaagtttcggtttaggtttcgttttagttcgttttaatttcgattgtttattaggtttcgcgttttttggtagtaacgttcgagttcggttttcgcgtaggtttcgtttcgtttcgtttcgtcgtttttcgttttttttattcgggggatttaacgcgttttatcgaggtttcgttttaaataggtttcgttttttaatggattttgttttatcgaggattcgtttttaaataggtttcgttttcgaatagatttagttttatcgaggtttcgttttcgggaaggtttcgtttacgaatagatttattttattgaggtttttcgacgtcgttgtcgttttgtagttttttaggcgggacgcgtcgcgcgggttgtttttttttttttttagttttcggagggattcgggttgagcgtttcgtttcgtttcgtttcgttttttttttcgttcgatttcgcgtttttagtgtttcggtcgcgtaggatttgatatgttgttcgattgtttgtcggtcgagggcgagttgcgttgtcgtcggttgttggtaggggttacggttcggtttcgcgcgcggttcggtcggtcgcggtgttcgtgtcgttttgtttagtgcgtggggtttcggcgttgttgtatacgttgcggtttagtcgtttgatcgggaggtataagggcgat

SEQ ID NO: 30460 - DNA, 949 bp, Artificial Sequence
  chemically treated genomic DNA (Homo sapiens) CpG-island No: 30460
atcgcccttatacctcccgatcaaacgactaaaccgcaacgtatacaacaacgccgaaaccccacgcactaaacaaaacgacacgaacaccgcgaccgaccgaaccgcgcgcgaaaccgaaccgtaacccctaccaacaaccgacgacaacgcaactcgccctcgaccgacaaacaatcgaacaacatatcaaatcctacgcgaccgaaacactaaaaacgcgaaatcgaacgaaaaaaaaaacgaaacgaaacgaaacgaaacgctcaacccgaatccctccgaaaactaaaaaaaaaaaaaaacaacccgcgcgacgcgtcccgcctaaaaaactacaaaacgacaacgacgtcgaaaaacctcaataaaataaatctattcgtaaacgaaaccttcccgaaaacgaaacctcgataaaactaaatctattcgaaaacgaaacctatttaaaaacgaatcctcgataaaacaaaatccattaaaaaacgaaacctatttaaaacgaaacctcgataaaacgcgttaaatcccccgaataaaaaaaacgaaaaacgacgaaacgaaacgaaacgaaacctacgcgaaaaccgaactcgaacgttactaccaaaaaacgcgaaacctaataaacaatcgaaattaaaacgaactaaaacgaaacctaaaccgaaacttttactacgaaaaactaaaaaacgtaaccaaaaaaactatactttcgcaaaaccgaacgtaaccgaaaatataaccgcgaaaaaaaaaataaacgcgaaactacaaaactaccgattatattctccgaaatcctaaaaccacgcgaaccgtaaaacgcccgacgaccgtcctcgatccgttaaatcctaacgttaaaatatctaataaaaccccgccgacccccactaatccgtccctcccctaaaaactccaaaatatacgaaaccgaaat

SEQ ID NO: 30461 - DNA, 829 bp, Artificial Sequence
  chemically treated genomic DNA (Homo sapiens) CpG-island No: 30461
tgcggggtcgtttagtcgcgttttgattggtaagcgggttgtacgtttttggtaaatagaggtttggtcggaagggcgagcgggtacgaatgtttttttattttcgattggtgcgcgaagatgttattcgagtttttttattggtcgagatttgttttagtaggtcgtaatcgtcgtcgattggttttcgtttttcggatttcgtatttgtttgtttcggattgggcggtggtatcgtcgcgtaattggcgagttcgttgttcgggcgcgcgtttttaattcgattagttttaggttttagaggcggggtttgggaacgggattcgggttgggttgtcgttcgttcgaggggtttttcgggcgcggcgtattttcgcgtttattcgcgttgttttagacgtttgttcgttttgtttagtttcggtttagtagggttgttgtcgtagttgtcgtcgtcgttgttatcggtgttttgcgcgttttttcgttttgggggtcgaaggacgtagggttttgacgtttcgagttttgcgttttatttcgtgcgtttttacgttattttttatcggtttaatattcgtttttcgatttgcgtatgcgttcgttcgaggtttgcgtttgtttttatggtaataggttttttatggatgtcgttacgtatcgttttttttgcggtttggttcgtttttaggtttaagggcgattttaaagatttttttattcgtatttttaaggtttcgcgttgttgtttaagttagtgataatggtcgtagggtaaattttcgggattatttgcgtgtcgggtttcggattaaattggttaagagta

SEQ ID NO: 30462 - DNA, 829 bp, Artificial Sequence
  chemically treated genomic DNA (Homo sapiens) CpG-island No: 30462
tactcttaaccaatttaatccgaaacccgacacgcaaataatcccgaaaatttaccctacgaccattatcactaacttaaacaacaacgcgaaaccttaaaaatacgaataaaaaaatctttaaaatcgcccttaaacctaaaaacgaaccaaaccgcaaaaaaaacgatacgtaacgacatccataaaaaacctattaccataaaaacaaacgcaaacctcgaacgaacgcatacgcaaatcgaaaaacgaatattaaaccgataaaaaataacgtaaaaacgcacgaaataaaacgcaaaactcgaaacgtcaaaaccctacgtccttcgacccccaaaacgaaaaaacgcgcaaaacaccgataacaacgacgacgacaactacgacaacaaccctactaaaccgaaactaaacaaaacgaacaaacgtctaaaacaacgcgaataaacgcgaaaatacgccgcgcccgaaaaacccctcgaacgaacgacaacccaacccgaatcccgttcccaaaccccgcctctaaaacctaaaactaatcgaattaaaaacgcgcgcccgaacaacgaactcgccaattacgcgacgataccaccgcccaatccgaaacaaacaaatacgaaatccgaaaaacgaaaaccaatcgacgacgattacgacctactaaaacaaatctcgaccaataaaaaaactcgaataacatcttcgcgcaccaatcgaaaataaaaaaacattcgtacccgctcgcccttccgaccaaacctctatttaccaaaaacgtacaacccgcttaccaatcaaaacgcgactaaacgaccccgca

SEQ ID NO: 30463 - DNA, 829 bp, Artificial Sequence
  chemically treated genomic DNA (Homo sapiens) CpG-island No: 30463
tgtttttgattagtttggttcggggttcggtacgtaagtaatttcgaaggtttgttttacggttattgttattaatttaggtagtagcgcggggttttgggggtgcgggtaaaggggtttttgaggtcgtttttagatttgaggacgagttaagtcgtaggaagaacggtacgtggcggtatttatgaggggtttgttgttatgggaataaacgtaggtttcgggcgggcgtatgcgtagatcggggagcgggtgttgaatcggtgaaaggtgacgtaaaagcgtacggggtggggcgtagggttcgggacgttaaagttttgcgtttttcggtttttagagcggagaagcgcgtaaggtatcggtggtagcggcgacggtagttgcgatagtaattttgttgggtcgaaattgggtagagcgagtagacgtttgaagtagcgcgagtgagcgcgagggtacgtcgcgttcggaagatttttcgggcgaacggtagtttagttcgggtttcgtttttaagtttcgtttttagggtttgggattaatcggattgagagcgcgcgttcgggtagcgaattcgttaattgcgcgacggtgttatcgtttaattcggagtagataggtgcgaggttcggaaggcggaggttaatcggcggcggttgcgatttgttggggtaggtttcggttaataaggaggttcgagtgatattttcgcgtattaatcgggagtgagggagtattcgtgttcgttcgttttttcggttagatttttatttattaggggcgtgtagttcgtttgttaattagagcgcggttgagcggtttcgta

SEQ ID NO: 30464 - DNA, 829 bp, Artificial Sequence
  chemically treated genomic DNA (Homo sapiens) CpG-island No: 30464
tacgaaaccgctcaaccgcgctctaattaacaaacgaactacacgcccctaataaataaaaatctaaccgaaaaaacgaacgaacacgaatactccctcactcccgattaatacgcgaaaatatcactcgaacctccttattaaccgaaacctaccccaacaaatcgcaaccgccgccgattaacctccgccttccgaacctcgcacctatctactccgaattaaacgataacaccgtcgcgcaattaacgaattcgctacccgaacgcgcgctctcaatccgattaatcccaaaccctaaaaacgaaacttaaaaacgaaacccgaactaaactaccgttcgcccgaaaaatcttccgaacgcgacgtaccctcgcgctcactcgcgctacttcaaacgtctactcgctctacccaatttcgacccaacaaaattactatcgcaactaccgtcgccgctaccaccgataccttacgcgcttctccgctctaaaaaccgaaaaacgcaaaactttaacgtcccgaaccctacgccccaccccgtacgcttttacgtcacctttcaccgattcaacacccgctccccgatctacgcatacgcccgcccgaaacctacgtttattcccataacaacaaacccctcataaataccgccacgtaccgttcttcctacgacttaactcgtcctcaaatctaaaaacgacctcaaaaacccctttacccgcacccccaaaaccccgcgctactacctaaattaataacaataaccgtaaaacaaaccttcgaaattacttacgtaccgaaccccgaaccaaactaatcaaaaaca

SEQ ID NO: 30465 - DNA, 621 bp, Artificial Sequence
  chemically treated genomic DNA (Homo sapiens) CpG-island No: 30465
gggggtcgatcggttgggcggtttagtaggtgtttgtggggtttcggtatcggtttcgggtcggttaatttgcgttttagtttttttgttttgttttttcggtttagtttttttcgttcggttcggtattttcggtttttcgtttagtttcggcggttcgaattcgttgacgttataggatttattcgttgttttttcgagttaagtcgattttggtttcggtttcgtttttttttggcgttttgatttcgtttttcggattttatttttgttttttttcgggattttattttcgtttttttttaggattttaaggtcgtttttgttaaagaattttgtttttttcgttttcggcgttaagtacgttttttaaggtttagttacgttttttttgttttcgagtagtttttacgtttcgttttttgtttatcggtcgtttcgttaaggttttgttacgtttttttcggttttttcggttattttcgtttttattagtttcgtttttattagtttcgtttttcgttttagtcggagttttttcggttttttagtttagttcgttttggtttttgttttatttatagttcgaattttgtttttttttgtttgttcgggtttttt

SEQ ID NO: 30466 - DNA, 621 bp, Artificial Sequence
  chemically treated genomic DNA (Homo sapiens) CpG-island No: 30466
aaaaaacccgaacaaacaaaaaaaaacaaaattcgaactataaataaaacaaaaaccaaaacgaactaaactaaaaaaccgaaaaaactccgactaaaacgaaaaacgaaactaataaaaacgaaactaataaaaacgaaaataaccgaaaaaaccgaaaaaaacgtaacaaaaccttaacgaaacgaccgataaacaaaaaacgaaacgtaaaaactactcgaaaacaaaaaaaacgtaactaaaccttaaaaaacgtacttaacgccgaaaacgaaaaaaacaaaattctttaacaaaaacgaccttaaaatcctaaaaaaaaacgaaaataaaatcccgaaaaaaaacaaaaataaaatccgaaaaacgaaatcaaaacgccaaaaaaaaacgaaaccgaaaccaaaatcgacttaactcgaaaaaacaacgaataaatcctataacgtcaacgaattcgaaccgccgaaactaaacgaaaaaccgaaaataccgaaccgaacgaaaaaaactaaaccgaaaaaacaaaacaaaaaaactaaaacgcaaattaaccgacccgaaaccgataccgaaaccccacaaacacctactaaaccgcccaaccgatcgaccccc

SEQ ID NO: 30467 - DNA, 621 bp, Artificial Sequence
  chemically treated genomic DNA (Homo sapiens) CpG-island No: 30467
agaggattcgggtaggtaggaaagggtaggattcgaattgtgggtgggatagaggttaggacggattgagttaagagatcgagagaatttcggttagggcgaggggcggggttggtggaggcggggttggtgggggcggagatggtcggaagggtcgaaaggggcgtggtaagattttggcgaggcggtcggtaggtagggggcggggcgtgggaattattcgggagtagagggggcgtggttagattttagggggcgtgtttaacgtcgggagcgaaggagatagaattttttggtaggggcgattttagaattttggggaggagcgagaatggaatttcggggaggaataggggtggaattcggggggcggggttagaacgttaggagggggcggggtcggagttagggtcggtttgattcgggggagtagcgggtggattttgtgacgttagcgggttcgaatcgtcggagttgagcgagaggtcgggggtgtcgagtcgggcggggagagttgggtcgggagagtagaatagggaggttagagcgtaggttaatcggttcggagtcgatgtcggagttttataggtatttattaaatcgtttagtcgatcggttttt

SEQ ID NO: 30468 - DNA, 621 bp, Artificial Sequence
  chemically treated genomic DNA (Homo sapiens) CpG-island No: 30468
aaaaaccgatcgactaaacgatttaataaatacctataaaactccgacatcgactccgaaccgattaacctacgctctaacctccctattctactctcccgacccaactctccccgcccgactcgacacccccgacctctcgctcaactccgacgattcgaacccgctaacgtcacaaaatccacccgctactcccccgaatcaaaccgaccctaactccgaccccgccccctcctaacgttctaaccccgccccccgaattccacccctattcctccccgaaattccattctcgctcctccccaaaattctaaaatcgcccctaccaaaaaattctatctccttcgctcccgacgttaaacacgccccctaaaatctaaccacgccccctctactcccgaataattcccacgccccgccccctacctaccgaccgcctcgccaaaatcttaccacgcccctttcgacccttccgaccatctccgcccccaccaaccccgcctccaccaaccccgcccctcgccctaaccgaaattctctcgatctcttaactcaatccgtcctaacctctatcccacccacaattcgaatcctaccctttcctacctacccgaatcctct

SEQ ID NO: 30469 - DNA, 653 bp, Artificial Sequence
  chemically treated genomic DNA (Homo sapiens) CpG-island No: 30469
ttttagaacggtaggttttttttttttaggattttagttttcgcggttaaggttgtcgttgcgggggtttcgcgcgggattggttaggtttttttattaattttgtttggttcggtcgatttcgtcgcgattcgagcgtttttcggtttcgtagtatagggcgtttaggattcgttattttcgtcgttcgttttttttttcggagagttcggcggggtcgttaggttgtcgagataaagggtatcgcggcgttagaggtcgaggtttagtcgcgtttgtttttttttttttttcgtttattgttaatttttagtcgttcgtagaattttcgttgtttcggcgcgattttatcgttatttcggggttgtcgttcgggatcggtaagtcgggtagtcgcgaggcggtcgcggtatgttagggtcgaggagggggcggcggtcgttattatgtttgttcgttttttttagaagtagtgtgtttagcggataaagcgtagcggcggcgcgggcgtttaggtcgatttcgtcgattttcgcggaataagcggggttaggagtttcggaaattcggcgttttaatgtaataaataggaaatcgcggggatgatttgggtttcgggggaagtggaattattttttattagcgaagagatt

SEQ ID NO: 30470 - DNA, 653 bp, Artificial Sequence
  chemically treated genomic DNA (Homo sapiens) CpG-island No: 30470
aatctcttcgctaataaaaaataattccacttcccccgaaacccaaatcatccccgcgatttcctatttattacattaaaacgccgaatttccgaaactcctaaccccgcttattccgcgaaaatcgacgaaatcgacctaaacgcccgcgccgccgctacgctttatccgctaaacacactacttctaaaaaaaacgaacaaacataataacgaccgccgccccctcctcgaccctaacataccgcgaccgcctcgcgactacccgacttaccgatcccgaacgacaaccccgaaataacgataaaatcgcgccgaaacaacgaaaattctacgaacgactaaaaattaacaataaacgaaaaaaaaaaaaaaacaaacgcgactaaacctcgacctctaacgccgcgataccctttatctcgacaacctaacgaccccgccgaactctccgaaaaaaaaaacgaacgacgaaaataacgaatcctaaacgccctatactacgaaaccgaaaaacgctcgaatcgcgacgaaatcgaccgaaccaaacaaaattaataaaaaaacctaaccaatcccgcgcgaaacccccgcaacgacaaccttaaccgcgaaaactaaaatcctaaaaaaaaaaaacctaccgttctaaaa

SEQ ID NO: 30471 - DNA, 653 bp, Artificial Sequence
  chemically treated genomic DNA (Homo sapiens) CpG-island No: 30471
gattttttcgttggtaaaaaataattttatttttttcggaatttagattattttcgcgattttttgtttattgtattaaggcgtcgggttttcggggtttttggtttcgtttatttcgcgggggtcggcggggtcggtttgggcgttcgcgtcgtcgttgcgttttgttcgttgggtatattgtttttgggaggggcgggtagatatggtggcggtcgtcgtttttttttcggttttagtatgtcgcggtcgtttcgcggttattcggtttgtcggtttcgagcggtagtttcggggtggcgatggggtcgcgtcgaggtagcggaggttttgcgggcgattggaggttggtagtgggcgggagaaagaggaaggtaggcgcggttgggtttcggtttttggcgtcgcggtattttttgtttcggtagtttgacggtttcgtcgggtttttcggagaggggaacgggcggcgagggtggcgggttttgggcgttttgtgttgcggggtcgagaggcgttcgggtcgcggcgggatcggtcggattagatagggttaatggaagagtttggttagtttcgcgcggggttttcgtagcgatagttttggtcgcggggattggagttttgagggggagaagtttgtcgttttgaag

SEQ ID NO: 30472 - DNA, 653 bp, Artificial Sequence
  chemically treated genomic DNA (Homo sapiens) CpG-island No: 30472
cttcaaaacgacaaacttctccccctcaaaactccaatccccgcgaccaaaactatcgctacgaaaaccccgcgcgaaactaaccaaactcttccattaaccctatctaatccgaccgatcccgccgcgacccgaacgcctctcgaccccgcaacacaaaacgcccaaaacccgccaccctcgccgcccgttcccctctccgaaaaacccgacgaaaccgtcaaactaccgaaacaaaaaataccgcgacgccaaaaaccgaaacccaaccgcgcctaccttcctctttctcccgcccactaccaacctccaatcgcccgcaaaacctccgctacctcgacgcgaccccatcgccaccccgaaactaccgctcgaaaccgacaaaccgaataaccgcgaaacgaccgcgacatactaaaaccgaaaaaaaaacgacgaccgccaccatatctacccgcccctcccaaaaacaatatacccaacgaacaaaacgcaacgacgacgcgaacgcccaaaccgaccccgccgacccccgcgaaataaacgaaaccaaaaaccccgaaaacccgacgccttaatacaataaacaaaaaatcgcgaaaataatctaaattccgaaaaaaataaaattattttttaccaacgaaaaaatc

SEQ ID NO: 30473 - DNA, 659 bp, Artificial Sequence
  chemically treated genomic DNA (Homo sapiens) CpG-island No: 30473
taggtgcggatatttcgttagttagttagttagcgatgtttgcgggtaaaattcgatataggttttatcggtaattataatcgttttatcgcgggttaattttagtagggtgcgaaaattttgcggattgattagttgttcggtcgggttattggggttgtaaatataaattatttttacgtcgtttagtttgtcggaaatgttttgtaagtttagttgttagatgtatagcgttggtattgtgcggtattttacgttaatcgttttggcgttgacgttgtatatgtcgtacgttggcgggtagtagaggatggcgtttttattcggttcgtaaaaagcgcgaattagtagtttaatattttcgttcgcgttacggttgattagtatttgtttcggttttacgtttgtatattgcgcgtaatttttaattatcgttttcggttggtatttcgggtagcggttgagcgtttgttgagtaagttgaaattttacggtagtggggtattcgttggcgtttagttagatatcgtcgttatcgtttagacgacgcgtcgattgatacggcgttaggttgcggacgtttttacgcgttaaatcggtaatagttacggtgtttatgtttgttttttaagggcgttaatacgtaaagtaacggtatt

SEQ ID NO: 30474 - DNA, 659 bp, Artificial Sequence
  chemically treated genomic DNA (Homo sapiens) CpG-island No: 30474
aataccgttactttacgtattaacgcccttaaaaaacaaacataaacaccgtaactattaccgatttaacgcgtaaaaacgtccgcaacctaacgccgtatcaatcgacgcgtcgtctaaacgataacgacgatatctaactaaacgccaacgaataccccactaccgtaaaatttcaacttactcaacaaacgctcaaccgctacccgaaataccaaccgaaaacgataattaaaaattacgcgcaatatacaaacgtaaaaccgaaacaaatactaatcaaccgtaacgcgaacgaaaatattaaactactaattcgcgctttttacgaaccgaataaaaacgccatcctctactacccgccaacgtacgacatatacaacgtcaacgccaaaacgattaacgtaaaataccgcacaataccaacgctatacatctaacaactaaacttacaaaacatttccgacaaactaaacgacgtaaaaataatttatatttacaaccccaataacccgaccgaacaactaatcaatccgcaaaattttcgcaccctactaaaattaacccgcgataaaacgattataattaccgataaaacctatatcgaattttacccgcaaacatcgctaactaactaactaacgaaatatccgcaccta

SEQ ID NO: 30475 - DNA, 659 bp, Artificial Sequence
  chemically treated genomic DNA (Homo sapiens) CpG-island No: 30475
aatgtcgttattttgcgtgttaacgtttttaaggagtaagtatgagtatcgtgattattatcgatttagcgcgtgaaaacgttcgtaatttgacgtcgtattagtcggcgcgtcgtttgggcggtaacggcgatgtttggttgaacgttaacgaatattttattgtcgtggagttttagtttatttagtaaacgtttaatcgttattcggaatgttagtcgaaagcggtgattgaaaattacgcgtaatatgtaggcgtaaaatcggagtaggtgttggttagtcgtggcgcggacgaaggtattgaattgttgattcgcgttttttgcgaatcgggtaaagacgttattttttattgttcgttaacgtacggtatgtatagcgttagcgttaaaacgattggcgtggagtgtcgtatagtgttaacgttgtatatttggtaattgaatttatagggtattttcgataagttggacggcgtaaaagtggtttatgtttgtagttttaataattcgatcgggtaattgattaattcgtaggattttcgtattttgttggagttaattcgcggtaaggcgattgtggttgtcgatgaagtttatatcgagttttgttcgtaggtatcgttggttggttggttggcggaatattcgtatttg

SEQ ID NO: 30476 - DNA, 659 bp, Artificial Sequence
  chemically treated genomic DNA (Homo sapiens) CpG-island No: 30476
caaatacgaatattccgccaaccaaccaaccaacgatacctacgaacaaaactcgatataaacttcatcgacaaccacaatcgccttaccgcgaattaactccaacaaaatacgaaaatcctacgaattaatcaattacccgatcgaattattaaaactacaaacataaaccacttttacgccgtccaacttatcgaaaataccctataaattcaattaccaaatatacaacgttaacactatacgacactccacgccaatcgttttaacgctaacgctatacataccgtacgttaacgaacaataaaaaataacgtctttacccgattcgcaaaaaacgcgaatcaacaattcaataccttcgtccgcgccacgactaaccaacacctactccgattttacgcctacatattacgcgtaattttcaatcaccgctttcgactaacattccgaataacgattaaacgtttactaaataaactaaaactccacgacaataaaatattcgttaacgttcaaccaaacatcgccgttaccgcccaaacgacgcgccgactaatacgacgtcaaattacgaacgttttcacgcgctaaatcgataataatcacgatactcatacttactccttaaaaacgttaacacgcaaaataacgacatt

SEQ ID NO: 30477 - DNA, 535 bp, Artificial Sequence
  chemically treated genomic DNA (Homo sapiens) CpG-island No: 30477
gggcggttaggcgttcggcggcggttagtgtttttatggttgaagttagcgcggagaatttttttttcgatagtttttgtacggttatgcgtttttggaaatttgttagttcgaggttggaataggtggcggtgtaatcgtaagtcggtagaacgtggttggtgtcggaggcgtaattatttgtcgatttcggtgattagttattaagaaatatcgaatcggcgttggtgatgttatcgattagtttacgggcgttgtcgggtttgaatgattaggtgtttcgggtcgtattggttggagattttaagtattgcgttaaatttttagttattattaaagcggtttgcgtttaatgtttggcgggtcgggttcggtacgtcggtagttttgttatttggcgttcgacgggtttggaaacgcgacgcgttttattaatagcgggtcgtagtaaaaataatttgttaattcggggtcgggtttatttggaagagttaattagaattttcgaaattcggggtaacggttttgtaaataa

SEQ ID NO: 30478 - DNA, 535 bp, Artificial Sequence
  chemically treated genomic DNA (Homo sapiens) CpG-island No: 30478
ttatttacaaaaccgttaccccgaatttcgaaaattctaattaactcttccaaataaacccgaccccgaattaacaaattatttttactacgacccgctattaataaaacgcgtcgcgtttccaaacccgtcgaacgccaaataacaaaactaccgacgtaccgaacccgacccgccaaacattaaacgcaaaccgctttaataataactaaaaatttaacgcaatacttaaaatctccaaccaatacgacccgaaacacctaatcattcaaacccgacaacgcccgtaaactaatcgataacatcaccaacgccgattcgatatttcttaataactaatcaccgaaatcgacaaataattacgcctccgacaccaaccacgttctaccgacttacgattacaccgccacctattccaacctcgaactaacaaatttccaaaaacgcataaccgtacaaaaactatcgaaaaaaaaattctccgcgctaacttcaaccataaaaacactaaccgccgccgaacgcctaaccgccc

SEQ ID NO: 30479 - DNA, 535 bp, Artificial Sequence
  chemically treated genomic DNA (Homo sapiens) CpG-island No: 30479
ttgtttataaggtcgttatttcggatttcgggggttttgattggtttttttaggtgaattcggtttcggattaataagttatttttattacggttcgttgttaatagggcgcgtcgcgtttttaagttcgtcgaacgttaaatggtaaaattgtcggcgtgtcgaattcggttcgttaggtattgaacgtaagtcgttttaatggtgattaaagatttagcgtagtgtttggaatttttaattagtacggttcggagtatttgattatttagattcggtaacgttcgtgaattggtcgatagtattattagcgtcggttcggtattttttggtgattggttatcggaatcggtaggtgattacgttttcggtattaattacgttttatcgatttacggttatatcgttatttgttttagtttcgggttggtagatttttagaagcgtatgatcgtataggaattgtcgaaagaggggtttttcgcgttggttttaattatagaaatattggtcgtcgtcgagcgtttgatcgttt

SEQ ID NO: 30480 - DNA, 535 bp, Artificial Sequence
  chemically treated genomic DNA (Homo sapiens) CpG-island No: 30480
aaacgatcaaacgctcgacgacgaccaatatttctataattaaaaccaacgcgaaaaacccctctttcgacaattcctatacgatcatacgcttctaaaaatctaccaacccgaaactaaaacaaataacgatataaccgtaaatcgataaaacgtaattaataccgaaaacgtaatcacctaccgattccgataaccaatcaccaaaaaataccgaaccgacgctaataatactatcgaccaattcacgaacgttaccgaatctaaataatcaaatactccgaaccgtactaattaaaaattccaaacactacgctaaatctttaatcaccattaaaacgacttacgttcaatacctaacgaaccgaattcgacacgccgacaattttaccatttaacgttcgacgaacttaaaaacgcgacgcgccctattaacaacgaaccgtaataaaaataacttattaatccgaaaccgaattcacctaaaaaaaccaatcaaaacccccgaaatccgaaataacgaccttataaacaa

SEQ ID NO: 30481 - DNA, 684 bp, Artificial Sequence
  chemically treated genomic DNA (Homo sapiens) CpG-island No: 30481
gcgttcgatattttgttgttcggcgggtcgtagttcgtacggtcgcgatggatgtagttatttttcggtggtggcggtagcgggtcgttttttatgaagcggtcgagaacgttttttattagtcgcgagatgttgtttttcgtcggatcgtcgttgttttacggtagcgaatcgtagaacgcgatcgagttgaaggcgaagtagtcgtcgtcgttgggcgtttcgtgataggcgatgtcggagcgtattcgcgggtgttgcgtgtcgtttagattttgttggttgaagtcgtagttttttattattagtagatagttttcggtgtggcgatcggttgacgtggcgattattagcgtgtgcggcggcgaatcgagtatcgtgtcgacgatgtcgagtttagtgttcgcggcgtcgtcgtttacgaggtcgaagttgtcgagtttttcgtcgtagtcgatgttttcgaaggtttacgcgacgcgcgggtcgttgtttttcggtgttcgcgagtagtagttcgagatgtcgaaattttcggacgatatgtcggtgtcggttatcgtgttaggttacggttagaaagcggttaatggtattaaattatcgtgattggtgaaaatacgttcgaacggatttagattggattttattgaaagggtattcggtaaaattcggttaaatgtt

SEQ ID NO: 30482 - DNA, 684 bp, Artificial Sequence
  chemically treated genomic DNA (Homo sapiens) CpG-island No: 30482
aacatttaaccgaattttaccgaataccctttcaataaaatccaatctaaatccgttcgaacgtattttcaccaatcacgataatttaataccattaaccgctttctaaccgtaacctaacacgataaccgacaccgacatatcgtccgaaaatttcgacatctcgaactactactcgcgaacaccgaaaaacaacgacccgcgcgtcgcgtaaaccttcgaaaacatcgactacgacgaaaaactcgacaacttcgacctcgtaaacgacgacgccgcgaacactaaactcgacatcgtcgacacgatactcgattcgccgccgcacacgctaataatcgccacgtcaaccgatcgccacaccgaaaactatctactaataataaaaaactacgacttcaaccaacaaaatctaaacgacacgcaacacccgcgaatacgctccgacatcgcctatcacgaaacgcccaacgacgacgactacttcgccttcaactcgatcgcgttctacgattcgctaccgtaaaacaacgacgatccgacgaaaaacaacatctcgcgactaataaaaaacgttctcgaccgcttcataaaaaacgacccgctaccgccaccaccgaaaaataactacatccatcgcgaccgtacgaactacgacccgccgaacaacaaaatatcgaacgc

SEQ ID NO: 30483 - DNA, 684 bp, Artificial Sequence
  chemically treated genomic DNA (Homo sapiens) CpG-island No: 30483
aatatttggtcggattttatcggatgtttttttaatgggatttaatttgggttcgttcgggcgtatttttattagttacggtgatttggtgttattggtcgttttttggtcgtaatttgatacggtagtcggtatcggtatgtcgttcgaaggtttcgatatttcgagttattattcgcggatatcggagagtaacgattcgcgcgtcgcgtgggttttcgaaggtatcggttacgacgagaagttcggtaatttcggtttcgtgggcggcggcgtcgcgggtattgaattcgatatcgtcgatacgatgttcggttcgtcgtcgtatacgttggtggtcgttacgttagtcggtcgttatatcgaaggttatttgttggtgatggaggattacggttttaattagtagggtttggacggtacgtagtattcgcgagtgcgtttcgatatcgtttattacgagacgtttaacggcggcggttgtttcgtttttagttcgatcgcgttttgcggttcgttgtcgtggaataacggcgattcggcgaagaataatatttcgcggttggtgaagaacgttttcgatcgttttatgaaggacggttcgttgtcgttattatcgaaggatggttatatttatcgcggtcgtgcggattacgattcgtcgggtaataaggtgtcgaacgt

SEQ ID NO: 30484 - DNA, 684 bp, Artificial Sequence
  chemically treated genomic DNA (Homo sapiens) CpG-island No: 30484
acgttcgacaccttattacccgacgaatcgtaatccgcacgaccgcgataaatataaccatccttcgataataacgacaacgaaccgtccttcataaaacgatcgaaaacgttcttcaccaaccgcgaaatattattcttcgccgaatcgccgttattccacgacaacgaaccgcaaaacgcgatcgaactaaaaacgaaacaaccgccgccgttaaacgtctcgtaataaacgatatcgaaacgcactcgcgaatactacgtaccgtccaaaccctactaattaaaaccgtaatcctccatcaccaacaaataaccttcgatataacgaccgactaacgtaacgaccaccaacgtatacgacgacgaaccgaacatcgtatcgacgatatcgaattcaatacccgcgacgccgccgcccacgaaaccgaaattaccgaacttctcgtcgtaaccgataccttcgaaaacccacgcgacgcgcgaatcgttactctccgatatccgcgaataataactcgaaatatcgaaaccttcgaacgacataccgataccgactaccgtatcaaattacgaccaaaaaacgaccaataacaccaaatcaccgtaactaataaaaatacgcccgaacgaacccaaattaaatcccattaaaaaaacatccgataaaatccgaccaaatatt

SEQ ID NO: 30485 - DNA, 709 bp, Artificial Sequence
  chemically treated genomic DNA (Homo sapiens) CpG-island No: 30485
tagtatcgttttttttttataaaagcgtttaggcgcgggtagggggatgcgtttcgaagagaagttggtttttaggttttttttttgaataaaattaaagggaatttcgcgcggttcgataaggtttgggaggacgtagtgtacgcgcgaggattcggcgtgggttatatcgaattcggcggttcgagttcggttcgtattatatcggtgcgcgttaggtcgggtcgttttcgggtattcgcggtcggattcgagcggcggggatagggagtgcggtaagggggttcgcgcggtatttacgcggcggttcggtggcggcggcggtagttgtaaggtgtttcggtttgagtttttttggtcgttcgcgtttttttttttcgcgtttttcgttggttcgttcgttttttcgtttttcgttcgcgcggttcgcgtttttttttttcgttcggcgtcgttgtcgagtgaattggaattagttttcgcggtcggttttttataatgtatagcgcgtcgttcgttatattttttcgcggtttcgagcgttcggttttcgcgttcgtgtcgttcggcgtttcggttttgatttcgggttcgcgttttattcgttgacgtcggtcgttttgcgtttaggtattagttcgtatttcggacgcgaggtttgatttatgatttcggggacgtttagagtttagtttttgggaagggttag

SEQ ID NO: 30486 - DNA, 709 bp, Artificial Sequence
  chemically treated genomic DNA (Homo sapiens) CpG-island No: 30486
ctaacccttcccaaaaactaaactctaaacgtccccgaaatcataaatcaaacctcgcgtccgaaatacgaactaatacctaaacgcaaaacgaccgacgtcaacgaataaaacgcgaacccgaaatcaaaaccgaaacgccgaacgacacgaacgcgaaaaccgaacgctcgaaaccgcgaaaaaatataacgaacgacgcgctatacattataaaaaaccgaccgcgaaaactaattccaattcactcgacaacgacgccgaacgaaaaaaaaaaacgcgaaccgcgcgaacgaaaaacgaaaaaacgaacgaaccaacgaaaaacgcgaaaaaaaaaaacgcgaacgaccaaaaaaactcaaaccgaaacaccttacaactaccgccgccgccaccgaaccgccgcgtaaataccgcgcgaacccccttaccgcactccctatccccgccgctcgaatccgaccgcgaatacccgaaaacgacccgacctaacgcgcaccgatataatacgaaccgaactcgaaccgccgaattcgatataacccacgccgaatcctcgcgcgtacactacgtcctcccaaaccttatcgaaccgcgcgaaattccctttaattttattcaaaaaaaaaacctaaaaaccaacttctcttcgaaacgcatccccctacccgcgcctaaacgcttttataaaaaaaaaacgatacta

SEQ ID NO: 30487 - DNA, 709 bp, Artificial Sequence
  chemically treated genomic DNA (Homo sapiens) CpG-island No: 30487
ttggttttttttaaggattgggttttgggcgttttcggggttatgggttagatttcgcgttcggggtgcgggttggtgtttgggcgtagagcggtcggcgttaacgggtagggcgcgggttcggggttaaggtcggggcgtcgggcggtacgggcgcggaggtcggacgttcggggtcgcgaagggatgtgacgagcggcgcgttgtgtattgtgggaagtcggtcgcgaggattggttttagtttattcggtagcggcgtcgggcggagggggagagcgcgggtcgcgcgggcgggaagcgaagaggcgggcgggttagcgaggagcgcggagagaaaaggcgcgagcggttaggagggtttaggtcgagatattttgtagttgtcgtcgtcgttatcgagtcgtcgcgtaagtgtcgcgcgggtttttttgtcgtattttttgttttcgtcgttcgggttcggtcgcgggtgttcgggagcggttcggtttggcgcgtatcggtgtggtgcgggtcgggttcgggtcgtcgggttcggtgtggtttacgtcgggttttcgcgcgtgtattacgtttttttaggttttgtcgggtcgcgcgggattttttttggttttgtttaaaaaagaaatttggaaattaattttttttcgaaacgtatttttttgttcgcgtttgggcgtttttgtgggaaaaaagcggtgttg

SEQ ID NO: 30488 - DNA, 709 bp, Artificial Sequence
  chemically treated genomic DNA (Homo sapiens) CpG-island No: 30488
caacaccgcttttttcccacaaaaacgcccaaacgcgaacaaaaaaatacgtttcgaaaaaaaattaatttccaaatttcttttttaaacaaaaccaaaaaaaatcccgcgcgacccgacaaaacctaaaaaaacgtaatacacgcgcgaaaacccgacgtaaaccacaccgaacccgacgacccgaacccgacccgcaccacaccgatacgcgccaaaccgaaccgctcccgaacacccgcgaccgaacccgaacgacgaaaacaaaaaatacgacaaaaaaacccgcgcgacacttacgcgacgactcgataacgacgacgacaactacaaaatatctcgacctaaaccctcctaaccgctcgcgccttttctctccgcgctcctcgctaacccgcccgcctcttcgcttcccgcccgcgcgacccgcgctctccccctccgcccgacgccgctaccgaataaactaaaaccaatcctcgcgaccgacttcccacaatacacaacgcgccgctcgtcacatcccttcgcgaccccgaacgtccgacctccgcgcccgtaccgcccgacgccccgaccttaaccccgaacccgcgccctacccgttaacgccgaccgctctacgcccaaacaccaacccgcaccccgaacgcgaaatctaacccataaccccgaaaacgcccaaaacccaatccttaaaaaaaaccaa

SEQ ID NO: 30489 - DNA, 770 bp, Artificial Sequence
  chemically treated genomic DNA (Homo sapiens) CpG-island No: 30489
ggacgatttttgggtggtcggtagtttcgggggggttttttcgcgtggtagtaatgtttggcgtcgcggagaagagggtggtttcgtcgggtgatgcggttggtaagggagtgtcgtaggtgagtttagtgtagtggcgtaggtgagatcgtttagtggtaggattttggggcggtggtttagcggatggtgcgttttttttcggttttttcgataggcgatttgttcgggttagagagatcgcgggttcgaataaattttttcgtgaggtagtagtttttacgttttgttttcggaaggatcgggttttagttagttttatgtatatatgataaagtcgggaattgaacgcgggtgatgatacgagtataggattttatttttacggggtcgttcgttttagggtcgggggtgcgtatcgagtttggcgtggttgacggggaggttggggatttgagatgttagtcgttcgaggagttgtaggatggttaggattgtgatatattcgaggacgttgatattttattagtgtgtcggtggtgataagttagcgcgttaggtaggagtagcgttaagacggtagatataagtatttcgttattgtaaggttcgtttatgtgcgttttatttttagggttttggcgttaatatttgttttggcgatacgggtcggattcgagtcgacgggtgttttttttttcgtttgatatattttttagttttgttcggtaaatggagggtattgtgtatgtataatggtcgagttatag

SEQ ID NO: 30490 - DNA, 770 bp, Artificial Sequence
  chemically treated genomic DNA (Homo sapiens) CpG-island No: 30490
ctataactcgaccattatacatacacaataccctccatttaccgaacaaaactaaaaaatatatcaaacgaaaaaaaaaacacccgtcgactcgaatccgacccgtatcgccaaaacaaatattaacgccaaaaccctaaaaataaaacgcacataaacgaaccttacaataacgaaatacttatatctaccgtcttaacgctactcctacctaacgcgctaacttatcaccaccgacacactaataaaatatcaacgtcctcgaatatatcacaatcctaaccatcctacaactcctcgaacgactaacatctcaaatccccaacctccccgtcaaccacgccaaactcgatacgcacccccgaccctaaaacgaacgaccccgtaaaaataaaatcctatactcgtatcatcacccgcgttcaattcccgactttatcatatatacataaaactaactaaaacccgatccttccgaaaacaaaacgtaaaaactactacctcacgaaaaaatttattcgaacccgcgatctctctaacccgaacaaatcgcctatcgaaaaaaccgaaaaaaaacgcaccatccgctaaaccaccgccccaaaatcctaccactaaacgatctcacctacgccactacactaaactcacctacgacactcccttaccaaccgcatcacccgacgaaaccaccctcttctccgcgacgccaaacattactaccacgcgaaaaaacccccccgaaactaccgaccacccaaaaatcgtcc

SEQ ID NO: 30491 - DNA, 770 bp, Artificial Sequence
  chemically treated genomic DNA (Homo sapiens) CpG-island No: 30491
ttgtaattcggttattgtatatgtataatattttttatttatcggatagaattagggagtatattagacggaaaggagggtattcgtcgattcgaattcgattcgtgtcgttaaaataagtgttggcgttaggattttggagatagggcgtatatgagcggattttgtagtggcgagatatttgtatttatcgttttagcgttatttttgtttgacgcgttgatttgttattatcggtatattagtgaggtgttaacgttttcgagtatattatagttttggttattttgtaatttttcgggcgattagtattttaaatttttagttttttcgttaattacgttaggttcgatacgtattttcggttttggaacgaacggtttcgtggaaatgaggttttgtgttcgtgttattattcgcgtttaattttcggttttattatgtatgtataaggttggttggaattcggttttttcgggggtaagacgtggaagttgttgttttacgaaaagatttattcgagttcgcgatttttttaattcggatagatcgtttgtcgaagaaatcgaaaaagagcgtattattcgttggattatcgttttaaaattttgttattaggcgattttatttgcgttattgtattgagtttatttgcggtatttttttattaatcgtattattcggcggggttattttttttttcgcggcgttaaatattgttgttacgcgggaaaattttttcggaattatcggttatttaaagatcgttt

SEQ ID NO: 30492 - DNA, 770 bp, Artificial Sequence
  chemically treated genomic DNA (Homo sapiens) CpG-island No: 30492
aaacgatctttaaataaccgataattccgaaaaaattttcccgcgtaacaacaatatttaacgccgcgaaaaaaaaaataaccccgccgaataatacgattaataaaaaaataccgcaaataaactcaatacaataacgcaaataaaatcgcctaataacaaaattttaaaacgataatccaacgaataatacgctctttttcgatttcttcgacaaacgatctatccgaattaaaaaaatcgcgaactcgaataaatcttttcgtaaaacaacaacttccacgtcttacccccgaaaaaaccgaattccaaccaaccttatacatacataataaaaccgaaaattaaacgcgaataataacacgaacacaaaacctcatttccacgaaaccgttcgttccaaaaccgaaaatacgtatcgaacctaacgtaattaacgaaaaaactaaaaatttaaaatactaatcgcccgaaaaattacaaaataaccaaaactataatatactcgaaaacgttaacacctcactaatataccgataataacaaatcaacgcgtcaaacaaaaataacgctaaaacgataaatacaaatatctcgccactacaaaatccgctcatatacgccctatctccaaaatcctaacgccaacacttattttaacgacacgaatcgaattcgaatcgacgaataccctcctttccgtctaatatactccctaattctatccgataaataaaaaatattatacatatacaataaccgaattacaa

SEQ ID NO: 30493 - DNA, 976 bp, Artificial Sequence
  chemically treated genomic DNA (Homo sapiens) CpG-island No: 30493
tagtacgtttgtttgattatttgaattatttgtcgttataggattttgtttcgattttgtttttcgtaattatttttatttatcgttgttcgttttagtttcgcgttacgttatttttttttacgggttattcgagtatcgtaatttcgttaatttattggtttattagtttgttttttcgttgttgtaaatttgtttattttcgttattataattttttattattatatattacgtagttcggtaacgtattaatacgttgttaatacgttatggcgcgttgattttatattgtagttgtatatttatatttttattattttaaatatgtcgttttgtcgttttttatttggtttcgtttttttttttacgtttcggcgtaatatttttgttttcggtggtttaggtcgtgttatttttaattgtatattcgcgttttatatcgtcggtcgcgcggtacgtacggtcgcgtttttttgtcggttattttgggcgttcgtttttttttttttcgtttttttttttttcgtttttttattttgaatttttcgttttgacgttttttcgggtttcgttttcgcgttttgttcggtcgtacgtcgggttattttacgtttttaatttttatatagcgttcggcgttaatttacgcggttttatttttattacgtatattttacgggtcgtattaattcgttagcgtaaaagtaaataattgttgtacgttatataaagggtttacggttattatagggttttaaggtaaattcgtttaaaaatagggtttcgcgaatcgtttttggtcgtttttaatttaataagggtttcgcgttttaattatgaacgaagttatttataattaaatttaacgtttttacgtttattaacgtgcgcgaaaaatttttattaggattttttatattattatttatttcgttattttttttataaaaatattttatcgttatagtttttt

SEQ ID NO: 30494 - DNA, 976 bp, Artificial Sequence
  chemically treated genomic DNA (Homo sapiens) CpG-island No: 30494
aaaaaactataacgataaaatatttttataaaaaaaataacgaaataaataataatataaaaaatcctaataaaaatttttcgcgcacgttaataaacgtaaaaacgttaaatttaattataaataacttcgttcataattaaaacgcgaaacccttattaaattaaaaacgaccaaaaacgattcgcgaaaccctatttttaaacgaatttaccttaaaaccctataataaccgtaaaccctttatataacgtacaacaattatttacttttacgctaacgaattaatacgacccgtaaaatatacgtaataaaaataaaaccgcgtaaattaacgccgaacgctatataaaaattaaaaacgtaaaataacccgacgtacgaccgaacaaaacgcgaaaacgaaacccgaaaaaacgtcaaaacgaaaaattcaaaataaaaaaacgaaaaaaaaaaaaacgaaaaaaaaaaaaacgaacgcccaaaataaccgacaaaaaaacgcgaccgtacgtaccgcgcgaccgacgatataaaacgcgaatatacaattaaaaataacacgacctaaaccaccgaaaacaaaaatattacgccgaaacgtaaaaaaaaaaacgaaaccaaataaaaaacgacaaaacgacatatttaaaataataaaaatataaatatacaactacaatataaaatcaacgcgccataacgtattaacaacgtattaatacgttaccgaactacgtaatatataataataaaaaattataataacgaaaataaacaaatttacaacaacgaaaaaacaaactaataaaccaataaattaacgaaattacgatactcgaataacccgtaaaaaaaaataacgtaacgcgaaactaaaacgaacaacgataaataaaaataattacgaaaaacaaaatcgaaacaaaatcctataacgacaaataattcaaataatcaaacaaacgtacta

SEQ ID NO: 30495 - DNA, 976 bp, Artificial Sequence
  chemically treated genomic DNA (Homo sapiens) CpG-island No: 30495
aaggggttgtagcgatggaatgtttttataggggggatagcggggtgggtagtggtgtagaaggttttggtgggggtttttcgcgtacgttggtgagcgtggaggcgttagatttggttgtgaatggtttcgtttatggttggggcgcgaggtttttattgggttaggagcggttaggggcgattcgcggggttttgtttttaggcgggtttgttttgggattttgtggtggtcgtgggttttttgtgtggcgtgtagtagttgtttgtttttgcgttggcgggttagtgcggttcgtggagtgtgcgtggtgggaataaagtcgcgtgagttagcgtcgggcgttgtgtgaaagttgagggcgtggagtagttcggcgtgcggtcgggtagggcgcgagagcggagttcggaggggcgttagggcggagggtttagggtggaggggcggaggggagaggggcggagagagggagggcgggcgtttagagtagtcggtagagaggcgcggtcgtgcgtgtcgcgcggtcggcggtgtggggcgcgagtgtgtagttgagagtggtacggtttgggttatcggaggtaggggtgttgcgtcggagcgtgggagaaggggcggggttaggtggagggcggtagagcggtatatttagagtggtggaggtgtaggtgtgtagttgtagtgtagggttagcgcgttatggcgtgttagtagcgtgttagtgcgttgtcgggttgcgtagtgtgtggtggtggaaggttgtgatggcgggagtaagtaagtttgtagtagcgggaaagtaggttagtgagttagtgagttagcgaagttgcgatgttcgggtagttcgtgaaaagaggtggcgtggcgcgaagttgaagcgagtagcggtgggtgggagtagttgcggaaggtagggtcgaggtaaagttttgtagcggtaggtggtttaagtagttaagtaaacgtgttg

SEQ ID NO: 30496 - DNA, 976 bp, Artificial Sequence
  chemically treated genomic DNA (Homo sapiens) CpG-island No: 30496
caacacgtttacttaactacttaaaccacctaccgctacaaaactttacctcgaccctaccttccgcaactactcccacccaccgctactcgcttcaacttcgcgccacgccacctcttttcacgaactacccgaacatcgcaacttcgctaactcactaactcactaacctactttcccgctactacaaacttacttactcccgccatcacaaccttccaccaccacacactacgcaacccgacaacgcactaacacgctactaacacgccataacgcgctaaccctacactacaactacacacctacacctccaccactctaaatataccgctctaccgccctccacctaaccccgccccttctcccacgctccgacgcaacacccctacctccgataacccaaaccgtaccactctcaactacacactcgcgccccacaccgccgaccgcgcgacacgcacgaccgcgcctctctaccgactactctaaacgcccgccctccctctctccgcccctctcccctccgcccctccaccctaaaccctccgccctaacgcccctccgaactccgctctcgcgccctacccgaccgcacgccgaactactccacgccctcaactttcacacaacgcccgacgctaactcacgcgactttattcccaccacgcacactccacgaaccgcactaacccgccaacgcaaaaacaaacaactactacacgccacacaaaaaacccacgaccaccacaaaatcccaaaacaaacccgcctaaaaacaaaaccccgcgaatcgcccctaaccgctcctaacccaataaaaacctcgcgccccaaccataaacgaaaccattcacaaccaaatctaacgcctccacgctcaccaacgtacgcgaaaaacccccaccaaaaccttctacaccactacccaccccgctatcccccctataaaaacattccatcgctacaacccctt

SEQ ID NO: 30497 - DNA, 527 bp, Artificial Sequence
  chemically treated genomic DNA (Homo sapiens) CpG-island No: 30497
tgcggtgaaacgcgatttggaagggacgtcgtagtcgagacgtttagtttcgggtagcgatttcgggttggcggttgggacggcgtggcgtggtagggtgtcgtcgagaggaagttcgttacgcgggaggtaggtcgtttttggttcgttgtagacgtcgttgcgtaggggagtcgcgggtcgcgtggtcggtggcgggcgcgttcgggtgggttcgcggtagaggtcggaggggttagtggcgtgtgattgcgtttttcgagatcgaggggaatgtgtgatgagcgggttgcgcgcgcgggtgtgtgtgtgtgtgtgtgtgtgtgtgtgtgtgtatacgtcgcggttcggggcggtcgggcgcgtattttatttttgacgaaattggcggtggagttttcgtcgtcgtcgtcgggtttcgttatacgtttcgcgtcggtgtttgcgtcgaaggtaggttttagttttagtatttttagagtcgatagtttggggttagcgggtattgagtgcgggaggaggggtag

SEQ ID NO: 30498 - DNA, 527 bp, Artificial Sequence
  chemically treated genomic DNA (Homo sapiens) CpG-island No: 30498
ctacccctcctcccgcactcaatacccgctaaccccaaactatcgactctaaaaatactaaaactaaaacctaccttcgacgcaaacaccgacgcgaaacgtataacgaaacccgacgacgacgacgaaaactccaccgccaatttcgtcaaaaataaaatacgcgcccgaccgccccgaaccgcgacgtatacacacacacacacacacacacacacacacacacccgcgcgcgcaacccgctcatcacacattcccctcgatctcgaaaaacgcaatcacacgccactaacccctccgacctctaccgcgaacccacccgaacgcgcccgccaccgaccacgcgacccgcgactcccctacgcaacgacgtctacaacgaaccaaaaacgacctacctcccgcgtaacgaacttcctctcgacgacaccctaccacgccacgccgtcccaaccgccaacccgaaatcgctacccgaaactaaacgtctcgactacgacgtcccttccaaatcgcgtttcaccgca

SEQ ID NO: 30499 - DNA, 527 bp, Artificial Sequence
  chemically treated genomic DNA (Homo sapiens) CpG-island No: 30499
ttgttttttttttcgtatttagtgttcgttagttttaagttgtcggttttgggggtattgaggttgggatttgttttcggcgtagatatcggcgcggggcgtgtgacggagttcggcgacgacggcgggagttttatcgttagtttcgttagaggtaaggtacgcgttcggtcgtttcgggtcgcggcgtgtgtatatatatatatatatatatatatatatatattcgcgcgcgtaattcgtttattatatatttttttcgatttcgagaagcgtaattatacgttattagttttttcggtttttgtcgcgaatttattcgagcgcgttcgttatcgattacgcggttcgcggtttttttacgtagcggcgtttgtagcgggttaggggcggtttgtttttcgcgtggcgggttttttttcggcgatattttgttacgttacgtcgttttagtcgttagttcgaagtcgttgttcggagttgaacgtttcggttgcggcgttttttttaagtcgcgttttatcgta

SEQ ID NO: 30500 - DNA, 527 bp, Artificial Sequence
  chemically treated genomic DNA (Homo sapiens) CpG-island No: 30500
tacgataaaacgcgacttaaaaaaaacgccgcaaccgaaacgttcaactccgaacaacgacttcgaactaacgactaaaacgacgtaacgtaacaaaatatcgccgaaaaaaaacccgccacgcgaaaaacaaaccgcccctaacccgctacaaacgccgctacgtaaaaaaaccgcgaaccgcgtaatcgataacgaacgcgctcgaataaattcgcgacaaaaaccgaaaaaactaataacgtataattacgcttctcgaaatcgaaaaaaatatataataaacgaattacgcgcgcgaatatatatatatatatatatatatatatatatacacacgccgcgacccgaaacgaccgaacgcgtaccttacctctaacgaaactaacgataaaactcccgccgtcgtcgccgaactccgtcacacgccccgcgccgatatctacgccgaaaacaaatcccaacctcaatacccccaaaaccgacaacttaaaactaacgaacactaaatacgaaaaaaaaaacaa

SEQ ID NO: 30501 - DNA, 538 bp, Artificial Sequence
  chemically treated genomic DNA (Homo sapiens) CpG-island No: 30501
gaatagcggtagattttttagcgttaggttttcggtgacggtgattttgaagtttatatcggaaagacgtttgatcgcggtgatgttcgtttcgttttacgttacgtttgcggtttgcgcgttacggttgcggtgataaattatttgtttaatgtttgtatcgtagttattgttgcgtttgtttttaggtttagtaatcggttagttcgatttgtacgtcgtcgttaaatttttttgttacgtttagcgcgtttttggcggtgttgatattcgtatagtaaattatcgttatttagttagcgttggtttcgaagtatatacgcgaaaggattttgtttgtatcggtaattttggcgtttgttagtacgattttgtgcgggtagagcgtttttaggttacgaatcgtacgtacgttttcgtttacgtatagaatggtgtttatttcgataatgtcgattttttcggtaattaggcgagtggtttcgtaggcgttatttatagtttggttgtttagcgcgatttgtaatatcggtaatga

SEQ ID NO: 30502 - DNA, 538 bp, Artificial Sequence
  chemically treated genomic DNA (Homo sapiens) CpG-island No: 30502
tcattaccgatattacaaatcgcgctaaacaaccaaactataaataacgcctacgaaaccactcgcctaattaccgaaaaaatcgacattatcgaaataaacaccattctatacgtaaacgaaaacgtacgtacgattcgtaacctaaaaacgctctacccgcacaaaatcgtactaacaaacgccaaaattaccgatacaaacaaaatcctttcgcgtatatacttcgaaaccaacgctaactaaataacgataatttactatacgaatatcaacaccgccaaaaacgcgctaaacgtaacaaaaaaatttaacgacgacgtacaaatcgaactaaccgattactaaacctaaaaacaaacgcaacaataactacgatacaaacattaaacaaataatttatcaccgcaaccgtaacgcgcaaaccgcaaacgtaacgtaaaacgaaacgaacatcaccgcgatcaaacgtctttccgatataaacttcaaaatcaccgtcaccgaaaacctaacgctaaaaaatctaccgctattc

SEQ ID NO: 30503 - DNA, 538 bp, Artificial Sequence
  chemically treated genomic DNA (Homo sapiens) CpG-island No: 30503
ttattatcgatgttgtaagtcgcgttggataattagattatggatagcgtttacgaaattattcgtttgattgtcgaagaagtcgatattatcgaagtgggtattattttgtgcgtgggcgaaggcgtgcgtgcggttcgtgatttgaaagcgttttattcgtataaaatcgtattggtagacgttaaaattgtcgatgtaggtaaaattttttcgcgtatgtgtttcgaagttaacgttgattgggtgacggtaatttgttgtgcggatattaatatcgttaaaggcgcgttggacgtggtaaaagagtttaacggcgacgtgtagatcgaattgatcggttattggatttgggaataggcgtaatagtggttgcgatgtaggtattgggtaggtggtttattatcgtagtcgtgacgcgtaggtcgtaggcgtggcgtggggcgaagcggatattatcgcgattaaacgttttttcgatatgggttttaaagttatcgttatcggaggtttggcgttggaagatttgtcgttgttt

SEQ ID NO: 30504 - DNA, 538 bp, Artificial Sequence
  chemically treated genomic DNA (Homo sapiens) CpG-island No: 30504
aaacaacgacaaatcttccaacgccaaacctccgataacgataactttaaaacccatatcgaaaaaacgtttaatcgcgataatatccgcttcgccccacgccacgcctacgacctacgcgtcacgactacgataataaaccacctacccaatacctacatcgcaaccactattacgcctattcccaaatccaataaccgatcaattcgatctacacgtcgccgttaaactcttttaccacgtccaacgcgcctttaacgatattaatatccgcacaacaaattaccgtcacccaatcaacgttaacttcgaaacacatacgcgaaaaaattttacctacatcgacaattttaacgtctaccaatacgattttatacgaataaaacgctttcaaatcacgaaccgcacgcacgccttcgcccacgcacaaaataatacccacttcgataatatcgacttcttcgacaatcaaacgaataatttcgtaaacgctatccataatctaattatccaacgcgacttacaacatcgataataa

SEQ ID NO: 30505 - DNA, 506 bp, Artificial Sequence
  chemically treated genomic DNA (Homo sapiens) CpG-island No: 30505
gttttgcggatacggtaatggcggtatttaacgatattttcggttttcgtaaaaattagtttgaagtgatgcgcgaataagacgcgtcgattattgtcgattagttgttggtattttgtgatggtgaacgtatcgaagaaggtatgcgcgttaatattcgcgtggttgtgtagtatatcgaagcgtggatttttggtaacggttgtgtgtcgatttatggtttgatggaagatgcggcgacggttgaaatttttcgtatttcgatttggtagtggatttattattaaaaaacgttgagtaatggtaaatcggtgattaaagttttgtttcgttagatgttgggcgaagagatgaaagttattgttagcgaattgggcgaagaacgttttttttaggggcgttttgacgatgtcgtacgtttgatggaatagattattattttcgatgagttaattgattttttgattttgttaggttatcgtttgttagcgtaaattattatataa

SEQ ID NO: 30506 - DNA, 506 bp, Artificial Sequence
  chemically treated genomic DNA (Homo sapiens) CpG-island No: 30506
ttatataataatttacgctaacaaacgataacctaacaaaatcaaaaaatcaattaactcatcgaaaataataatctattccatcaaacgtacgacatcgtcaaaacgcccctaaaaaaaacgttcttcgcccaattcgctaacaataactttcatctcttcgcccaacatctaacgaaacaaaactttaatcaccgatttaccattactcaacgttttttaataataaatccactaccaaatcgaaatacgaaaaatttcaaccgtcgccgcatcttccatcaaaccataaatcgacacacaaccgttaccaaaaatccacgcttcgatatactacacaaccacgcgaatattaacgcgcataccttcttcgatacgttcaccatcacaaaataccaacaactaatcgacaataatcgacgcgtcttattcgcgcatcacttcaaactaatttttacgaaaaccgaaaatatcgttaaataccgccattaccgtatccgcaaaac

SEQ ID NO: 30507 - DNA, 506 bp, Artificial Sequence
  chemically treated genomic DNA (Homo sapiens) CpG-island No: 30507
ttatgtggtggtttacgttaataggcggtagtttggtagggttaggaaattaattaatttatcggaagtggtgatttgttttattaagcgtgcggtatcgttaaaacgtttttgggagaaacgtttttcgtttagttcgttggtaatgatttttattttttcgtttagtatttggcggaataaggttttggttatcggtttgttattgtttaacgttttttgatgatggatttattgttagatcgaggtacgggaaattttagtcgtcgtcgtattttttattaggttataaatcggtatatagtcgttgttagagatttacgtttcgatgtattgtatagttacgcgaatgttggcgcgtatatttttttcggtgcgtttattattataaggtgttagtagttgatcggtagtaatcggcgcgttttgttcgcgtattattttaagttgatttttacgggagtcgagaatgtcgttgaatatcgttattgtcgtgttcgtaaggt

SEQ ID NO: 30508 - DNA, 506 bp, Artificial Sequence
  chemically treated genomic DNA (Homo sapiens) CpG-island No: 30508
accttacgaacacgacaataacgatattcaacgacattctcgactcccgtaaaaatcaacttaaaataatacgcgaacaaaacgcgccgattactaccgatcaactactaacaccttataataataaacgcaccgaaaaaaatatacgcgccaacattcgcgtaactatacaatacatcgaaacgtaaatctctaacaacgactatataccgatttataacctaataaaaaatacgacgacgactaaaatttcccgtacctcgatctaacaataaatccatcatcaaaaaacgttaaacaataacaaaccgataaccaaaaccttattccgccaaatactaaacgaaaaaataaaaatcattaccaacgaactaaacgaaaaacgtttctcccaaaaacgttttaacgataccgcacgcttaataaaacaaatcaccacttccgataaattaattaatttcctaaccctaccaaactaccgcctattaacgtaaaccaccacataa

SEQ ID NO: 30509 - DNA, 835 bp, Artificial Sequence
  chemically treated genomic DNA (Homo sapiens) CpG-island No: 30509
  misc_feature (381)..(381): n is either a, c, g or t
ggtattatatcggaataatggtttgataacgtttaacgcgacgttggcgggatattcgttttatcgataagatgaacgtgaaaggcgatatttaagggaatattcgcgttcgggttgataatattggcggcgtcgtgtataaacggttaacggtattgaatttattgaggttggcggtaattttgtaggtaatttcgcgttgattatcggaattgtcgaagttggggtttacgtttatacgttggttaaagggaaggggaatgacgagaaaaattggtatttgattagtaaatgggacggcgtaacgttagcggatatattcgattttattaataatttttttgttgtggattcggaagtttattagtttatcgttcgagntcggaagttatattagtaatatgtcgtagttaattcgttgtttagttatcgtttatacgatcgtttgggtgagtcgtagtatatagatttattgtatttttaggggtcggtaagtagtatgtgatgcgttatgtcggagggtacgaacgtttaagggtcggtgacggttagttaaatatttaggttaatcgttatgtattgtagttaggcggcgatttggcgtagtggagtagtaacgcgtaggatcgttggtattttggcgtgatggtaggttacgttaattagtatagtaatatttagagtaatcgtgtgggttataaatcggatgggcgtattagcggttatagcgttgggttgtacgcgatttggtattagaacgatgcgaataagatcggcgtttatgttgatagttgggcgttgtataattggtttgataatagcgttagtttcgata

SEQ ID NO: 30510 - DNA, 835 bp, Artificial Sequence
  chemically treated genomic DNA (Homo sapiens) CpG-island No: 30510
  misc_feature (455)..(455): n is either a, c, g or t
tatcgaaactaacgctattatcaaaccaattatacaacgcccaactatcaacataaacgccgatcttattcgcatcgttctaataccaaatcgcgtacaacccaacgctataaccgctaatacgcccatccgatttataacccacacgattactctaaatattactatactaattaacgtaacctaccatcacgccaaaataccaacgatcctacgcgttactactccactacgccaaatcgccgcctaactacaatacataacgattaacctaaatatttaactaaccgtcaccgacccttaaacgttcgtaccctccgacataacgcatcacatactacttaccgacccctaaaaatacaataaatctatatactacgactcacccaaacgatcgtataaacgataactaaacaacgaattaactacgacatattactaatataacttccganctcgaacgataaactaataaacttccgaatccacaacaaaaaaattattaataaaatcgaatatatccgctaacgttacgccgtcccatttactaatcaaataccaatttttctcgtcattccccttccctttaaccaacgtataaacgtaaaccccaacttcgacaattccgataatcaacgcgaaattacctacaaaattaccgccaacctcaataaattcaataccgttaaccgtttatacacgacgccgccaatattatcaacccgaacgcgaatattcccttaaatatcgcctttcacgttcatcttatcgataaaacgaatatcccgccaacgtcgcgttaaacgttatcaaaccattattccgatataatacc

SEQ ID NO: 30511 - DNA, 835 bp, Artificial Sequence
  chemically treated genomic DNA (Homo sapiens) CpG-island No: 30511
  misc_feature (455)..(455): n is either a, c, g or t
tatcggaattgacgttgttattaaattagttatatagcgtttagttgttaatataagcgtcggttttattcgtatcgttttgatattaggtcgcgtatagtttagcgttgtaatcgttgatgcgtttattcgatttataatttatacgattattttgagtattattgtgttgattggcgtagtttgttattacgttaagatgttagcgattttgcgcgttgttattttattgcgttaaatcgtcgtttagttgtaatatatagcggttagtttgagtatttagttgatcgttatcggtttttgaacgttcgtgtttttcgatatgacgtattatatattgtttgtcgatttttgagaatgtagtgaatttgtatattgcggtttatttagacggtcgtgtaaacgatggttaaatagcgagttggttgcggtatgttgttgatatagttttcggnttcgggcgataaattgatgggttttcggatttataatagggggattattgatgggatcgggtgtattcgttggcgttacgtcgttttatttattggttagatattagtttttttcgttattttttttttttttagttagcgtgtagacgtaagttttagtttcgatagtttcggtggttagcgcgaagttatttgtagaattatcgttaattttaatgagtttaatatcgttgatcgtttgtgtacgacgtcgttaatgttattaattcgaacgcgagtgtttttttgggtatcgttttttacgtttattttatcggtggggcgaatatttcgttagcgtcgcgttgaacgttattaggttattgtttcggtatagtgtt

SEQ ID NO: 30512 - DNA, 835 bp, Artificial Sequence
  chemically treated genomic DNA (Homo sapiens) CpG-island No: 30512
  misc_feature (381)..(381): n is either a, c, g or t
aacactataccgaaacaataacctaataacgttcaacgcgacgctaacgaaatattcgccccaccgataaaataaacgtaaaaaacgatacccaaaaaaacactcgcgttcgaattaataacattaacgacgtcgtacacaaacgatcaacgatattaaactcattaaaattaacgataattctacaaataacttcgcgctaaccaccgaaactatcgaaactaaaacttacgtctacacgctaactaaaaaaaaaaaaaataacgaaaaaaactaatatctaaccaataaataaaacgacgtaacgccaacgaatacacccgatcccatcaataatccccctattataaatccgaaaacccatcaatttatcgcccgaanccgaaaactatatcaacaacataccgcaaccaactcgctatttaaccatcgtttacacgaccgtctaaataaaccgcaatatacaaattcactacattctcaaaaatcgacaaacaatatataatacgtcatatcgaaaaacacgaacgttcaaaaaccgataacgatcaactaaatactcaaactaaccgctatatattacaactaaacgacgatttaacgcaataaaataacaacgcgcaaaatcgctaacatcttaacgtaataacaaactacgccaatcaacacaataatactcaaaataatcgtataaattataaatcgaataaacgcatcaacgattacaacgctaaactatacgcgacctaatatcaaaacgatacgaataaaaccgacgcttatattaacaactaaacgctatataactaatttaataacaacgtcaattccgata

SEQ ID NO: 30513 - DNA, 875 bp, Artificial Sequence
  chemically treated genomic DNA (Homo sapiens) CpG-island No: 30513
tcgggagaggagcggtgggtaacgtgtttgtgttcggtcgaatgcgtatattttagttaggtcgttggttcggatttagaaatgttttcgttttttttagtgtttgtttcgtttaggtttcgttttttgggtttcgttcgacggttcgggagcgcgcgcggtcgcgtgcgggagggggcgggtggggaaggatcgtaggcgagattacgaggcgaggttcgcgcgttcgttttcgttttggtttttagtgtttattcggtcggttcgggtatagttatgattaaggcgattttaatttttaataattacgggaagtcgcggttttttaagttttattagttttacgtgagtatttagtcgtcgttgattcgggcgagggggagtcgttggcgacgggtagcgtttagcgcggtttttttagagcgatttttttcggcgcgttgcggtttttgtttcgtttcggtcgtttggcgttcgttagttgttagttttttggtgggtgtggatagggtgtttatttttttgtcgcgcggttagttatcgacgtggttttgttcgggcggttttttcgttcgtcggtgggttgtatgtttttttggttgcgcgggcgaggttttggagatttttcggggttcggttttcgtcgatcgggtagtcgtagtttagtcgcgtcgcggagttttgcgtttagtttttaagagtttatttcgcgcggttgtttttttgtcgttcgcggttgtagttagttcgggaggaggaagacggcgtggaattcgtttttttcgttttttttcgtcgatttttattttttttaggtggatttttttttgttttttggatagatgggttatcgttttttattgtggtttttttat

SEQ ID NO: 30514 - DNA, 875 bp, Artificial Sequence
  chemically treated genomic DNA (Homo sapiens) CpG-island No: 30514
ataaaaaaaccacaataaaaaacgataacccatctatccaaaaaacaaaaaaaaatccacctaaaaaaaataaaaatcgacgaaaaaaaacgaaaaaaacgaattccacgccgtcttcctcctcccgaactaactacaaccgcgaacgacaaaaaaacaaccgcgcgaaataaactcttaaaaactaaacgcaaaactccgcgacgcgactaaactacgactacccgatcgacgaaaaccgaaccccgaaaaatctccaaaacctcgcccgcgcaaccaaaaaaacatacaacccaccgacgaacgaaaaaaccgcccgaacaaaaccacgtcgataactaaccgcgcgacaaaaaaataaacaccctatccacacccaccaaaaaactaacaactaacgaacgccaaacgaccgaaacgaaacaaaaaccgcaacgcgccgaaaaaaatcgctctaaaaaaaccgcgctaaacgctacccgtcgccaacgactccccctcgcccgaatcaacgacgactaaatactcacgtaaaactaataaaacttaaaaaaccgcgacttcccgtaattattaaaaattaaaatcgccttaatcataactatacccgaaccgaccgaataaacactaaaaaccaaaacgaaaacgaacgcgcgaacctcgcctcgtaatctcgcctacgatccttccccacccgccccctcccgcacgcgaccgcgcgcgctcccgaaccgtcgaacgaaacccaaaaaacgaaacctaaacgaaacaaacactaaaaaaaacgaaaacatttctaaatccgaaccaacgacctaactaaaatatacgcattcgaccgaacacaaacacgttacccaccgctcctctcccga

SEQ ID NO: 30515 - DNA, 875 bp, Artificial Sequence
  chemically treated genomic DNA (Homo sapiens) CpG-island No: 30515
atgagaggattatagtgaaaaacggtagtttatttgtttaaagaatagaaagaagtttatttggaaaggatgggagtcggcggaggggggcgagaagaacgagttttacgtcgttttttttttttcgggttaattgtagtcgcgggcggtaggaaggtagtcgcgcggggtgggtttttggggattgggcgtagggtttcgcggcgcggttgggttgcggttgttcgatcggcgagggtcgggtttcgggaagtttttagggtttcgttcgcgtagttaggaaagtatgtagtttatcgacgggcggaggaatcgttcgggtaaagttacgtcggtggttgatcgcgcggtagggaggtgggtattttgtttatatttattaggaggttgatagttggcgagcgttaggcggtcgggacgggataagggtcgtagcgcgtcggagggggtcgttttgagaaagtcgcgttgggcgttgttcgtcgttaacgattttttttcgttcggattagcggcggttggatatttacgtagggttggtagaatttggagagtcgcggtttttcgtggttgttgaagattaggatcgttttgattatggttgtgttcgggtcgatcgggtgggtattgggggttagggcgggggcgggcgcgcgagtttcgtttcgtaatttcgtttgcgatttttttttattcgttttttttcgtacgcgatcgcgcgcgttttcgagtcgtcgggcggggtttaaggggcggggtttgggcggggtaggtattaaggaaagcggaaatatttttaggttcgagttagcggtttaattggagtgtgcgtattcgatcgagtatagatacgttgtttatcgtttttttttcga

SEQ ID NO: 30516 - DNA, 875 bp, Artificial Sequence
  chemically treated genomic DNA (Homo sapiens) CpG-island No: 30516
tcgaaaaaaaaacgataaacaacgtatctatactcgatcgaatacgcacactccaattaaaccgctaactcgaacctaaaaatatttccgctttccttaatacctaccccgcccaaaccccgccccttaaaccccgcccgacgactcgaaaacgcgcgcgatcgcgtacgaaaaaaaacgaataaaaaaaaatcgcaaacgaaattacgaaacgaaactcgcgcgcccgcccccgccctaacccccaatacccacccgatcgacccgaacacaaccataatcaaaacgatcctaatcttcaacaaccacgaaaaaccgcgactctccaaattctaccaaccctacgtaaatatccaaccgccgctaatccgaacgaaaaaaaatcgttaacgacgaacaacgcccaacgcgactttctcaaaacgaccccctccgacgcgctacgacccttatcccgtcccgaccgcctaacgctcgccaactatcaacctcctaataaatataaacaaaatacccacctccctaccgcgcgatcaaccaccgacgtaactttacccgaacgattcctccgcccgtcgataaactacatactttcctaactacgcgaacgaaaccctaaaaacttcccgaaacccgaccctcgccgatcgaacaaccgcaacccaaccgcgccgcgaaaccctacgcccaatccccaaaaacccaccccgcgcgactaccttcctaccgcccgcgactacaattaacccgaaaaaaaaaaaacgacgtaaaactcgttcttctcgcccccctccgccgactcccatcctttccaaataaacttctttctattctttaaacaaataaactaccgtttttcactataatcctctcat

SEQ ID NO: 30517 - DNA, 569 bp, Artificial Sequence
  chemically treated genomic DNA (Homo sapiens) CpG-island No: 30517
ttcgttcgcggtattttcgtagtttagttttattttttagcgcgggatatttattaagcgtgatcgagcggtagtagaggaaagggagtgagttacgaaaggatagttcgcggcgtttttttttcgttattagttttatagtcgttaatttattcgatttcggtatcgtcgagagtcgttgggaggcgggacggtggtttttatagttaatcgcggtcggtagagttgttcggtagcgttcgttttttagttcggtttttattaattaaaaggaaattagaggcgatgattcgttaggattttttttcgtggttggaagggcggggagaagaggcggggataaagttttagggtcgaggaagtggtgtgagagattgacgtgaggtggtacgagagtttagttgttaatgacggagttgcgagatacggcgagagttaacgggagcggagtgagaggtttttcgattaattgggattaagtgagaggagatgcgggttaatgggtatttcgcgttttatcgttggagagatggttaaatgtgggaggcgaggtggttttagtttgggag

SEQ ID NO: 30518 - DNA, 569 bp, Artificial Sequence
  chemically treated genomic DNA (Homo sapiens) CpG-island No: 30518
ctcccaaactaaaaccacctcgcctcccacatttaaccatctctccaacgataaaacgcgaaatacccattaacccgcatctcctctcacttaatcccaattaatcgaaaaacctctcactccgctcccgttaactctcgccgtatctcgcaactccgtcattaacaactaaactctcgtaccacctcacgtcaatctctcacaccacttcctcgaccctaaaactttatccccgcctcttctccccgcccttccaaccacgaaaaaaaatcctaacgaatcatcgcctctaatttccttttaattaataaaaaccgaactaaaaaacgaacgctaccgaacaactctaccgaccgcgattaactataaaaaccaccgtcccgcctcccaacgactctcgacgataccgaaatcgaataaattaacgactataaaactaataacgaaaaaaaaacgccgcgaactatcctttcgtaactcactccctttcctctactaccgctcgatcacgcttaataaatatcccgcgctaaaaaataaaactaaactacgaaaataccgcgaacgaa

SEQ ID NO: 30519 - DNA, 569 bp, Artificial Sequence
  chemically treated genomic DNA (Homo sapiens) CpG-island No: 30519
tttttaagttgggattatttcgttttttatatttgattatttttttagcggtgggacgcggagtatttattggttcgtatttttttttatttagttttaattggtcggagaattttttatttcgttttcgttggttttcgtcgtatttcgtagtttcgttattggtaattgggttttcgtgttattttacgttagttttttatattattttttcggttttgagattttgttttcgtttttttttttcgtttttttagttacgagggaaaattttagcgagttatcgtttttagtttttttttgattggtagaagtcggattggggggcgggcgttgtcgggtaattttatcggtcgcgattggttgtgggagttatcgtttcgttttttagcgattttcggcggtgtcggagtcgggtgggttggcggttataaagttggtggcgaaggggaggcgtcgcggattgttttttcgtggtttatttttttttttttgttgtcgttcggttacgtttggtgagtgtttcgcgttggggagtagaattgggttgcggaggtgtcgcgggcggg

SEQ ID NO: 30520 - DNA, 569 bp, Artificial Sequence
  chemically treated genomic DNA (Homo sapiens) CpG-island No: 30520
cccgcccgcgacacctccgcaacccaattctactccccaacgcgaaacactcaccaaacgtaaccgaacgacaacaaaaaaaaaaaaataaaccacgaaaaaacaatccgcgacgcctccccttcgccaccaactttataaccgccaacccacccgactccgacaccgccgaaaatcgctaaaaaacgaaacgataactcccacaaccaatcgcgaccgataaaattacccgacaacgcccgccccccaatccgacttctaccaatcaaaaaaaaactaaaaacgataactcgctaaaattttccctcgtaactaaaaaaacgaaaaaaaaaaacgaaaacaaaatctcaaaaccgaaaaaataatataaaaaactaacgtaaaataacacgaaaacccaattaccaataacgaaactacgaaatacgacgaaaaccaacgaaaacgaaataaaaaattctccgaccaattaaaactaaataaaaaaaaatacgaaccaataaatactccgcgtcccaccgctaaaaaaataatcaaatataaaaaacgaaataatcccaacttaaaaa

SEQ ID NO: 30521 - DNA, 580 bp, Artificial Sequence
  chemically treated genomic DNA (Homo sapiens) CpG-island No: 30521
tttatttgtcgttcggttaataataattattgcgcggtttgcgttttatcgtcgattttttttagtaggcgttcgtatagtggattgtcggtggttttacgtagataggcgatgcgtaattcgtggatattgttacggatacgatcgcgtaattttgtcgtggtagtttcggtaaaggtgattattagtagttttttaacggttagcgggcggggaaaggcggcggaatcgtttagtttaagtaataggcgtaaatagagcgtcgtaatcgtaaaggttttgtttgtgtcggtagaggttttaattaggcgtttattttgtaagggtaagcgtaaaggatttagtgtttcggcgatattatttattttttttatttattaggggtattgtttgttgtaacgcgttgacgtttttttatattttttagtttttagggtgtatatattcggttttttcgttttggttgtcggaaatttgcgatagaatagttatgttttggcggttcgatatcgttgatggaagaaattagtaagtttttgcggcgttagttagtttatttgggtacgattttttacgcgaa

SEQ ID NO: 30522 - DNA, 580 bp, Artificial Sequence
  chemically treated genomic DNA (Homo sapiens) CpG-island No: 30522
ttcgcgtaaaaaatcgtacccaaataaactaactaacgccgcaaaaacttactaatttcttccatcaacgatatcgaaccgccaaaacataactattctatcgcaaatttccgacaaccaaaacgaaaaaaccgaatatatacaccctaaaaactaaaaaatataaaaaaacgtcaacgcgttacaacaaacaatacccctaataaataaaaaaaataaataatatcgccgaaacactaaatcctttacgcttacccttacaaaataaacgcctaattaaaacctctaccgacacaaacaaaacctttacgattacgacgctctatttacgcctattacttaaactaaacgattccgccgcctttccccgcccgctaaccgttaaaaaactactaataatcacctttaccgaaactaccacgacaaaattacgcgatcgtatccgtaacaatatccacgaattacgcatcgcctatctacgtaaaaccaccgacaatccactatacgaacgcctactaaaaaaaatcgacgataaaacgcaaaccgcgcaataattattattaaccgaacgacaaataaa

SEQ ID NO: 30523 - DNA, 580 bp, Artificial Sequence
  chemically treated genomic DNA (Homo sapiens) CpG-island No: 30523
ttcgcgtaaaaaatcgtgtttagataaattggttgacgtcgtaaaaatttgttgattttttttattagcggtgtcgagtcgttaaggtatggttattttgtcgtagattttcggtagttagaacgggaaagtcgaatatgtatattttgaaggttggaaagtgtgggagaacgttagcgcgttgtagtaaataatgtttttgatgagtgaaaagaatgagtgatgtcgtcgagatattagattttttgcgtttgtttttatagggtgagcgtttgattgaagtttttgtcggtataggtaaaatttttacgattgcggcgttttatttgcgtttgttatttggattaggcggtttcgtcgttttttttcgttcgttgatcgttgaagaattgttggtggttatttttatcgaggttgttacggtagaattgcgcggtcgtattcgtagtaatatttacgagttgcgtatcgtttgtttgcgtgaaattatcgataatttattgtacgaacgtttgttggaagagatcgacgataaagcgtaagtcgcgtagtggttgttgttagtcgaacggtagatgga

SEQ ID NO: 30524 - DNA, 580 bp, Artificial Sequence
  chemically treated genomic DNA (Homo sapiens) CpG-island No: 30524
tccatctaccgttcgactaacaacaaccactacgcgacttacgctttatcgtcgatctcttccaacaaacgttcgtacaataaattatcgataatttcacgcaaacaaacgatacgcaactcgtaaatattactacgaatacgaccgcgcaattctaccgtaacaacctcgataaaaataaccaccaacaattcttcaacgatcaacgaacgaaaaaaaacgacgaaaccgcctaatccaaataacaaacgcaaataaaacgccgcaatcgtaaaaattttacctataccgacaaaaacttcaatcaaacgctcaccctataaaaacaaacgcaaaaaatctaatatctcgacgacatcactcattcttttcactcatcaaaaacattatttactacaacgcgctaacgttctcccacactttccaaccttcaaaatatacatattcgactttcccgttctaactaccgaaaatctacgacaaaataaccataccttaacgactcgacaccgctaataaaaaaaatcaacaaatttttacgacgtcaaccaatttatctaaacacgattttttacgcgaa

SEQ ID NO: 30525 - DNA, 600 bp, Artificial Sequence
  chemically treated genomic DNA (Homo sapiens) CpG-island No: 30525
tgttgttgttttttttcggttgtaggtcgataatggttatcggtttggattgttcgcgtataaagcgtgagacgtcggtgatagtgtcggtcgtttttatgttggagataaaatgagtgatgcgttcgtcggtttgttgttagattttcggtttagtggtggtgtaatgcgtataagggttatcgggattattgaattgatcgagtagttttttttcgttacgattcgttatttttagcgttagatcgcgcgtattttttatgttttgttttttggtgataagaattagtttcgtattataagtacgtatcgtcgtacggcgtttttggtttatgttgtcgggtattagtaattttatgcgatagttttttagcgcggtaattattgttagcgtaatgtcggtgttattattggtggtttcgattaagatattattcggtttaattttttcgcgttttttcgtttcgacgattatcgaaagtgtcgtacgattttttatcgaatttgtcgggttattgttttttagttttaattatattttattgtcgttattcggttttattcgttgtaattttattagaggcgtattgtttattgttt

SEQ ID NO: 30526 - DNA, 600 bp, Artificial Sequence
  chemically treated genomic DNA (Homo sapiens) CpG-island No: 30526
aaacaataaacaatacgcctctaataaaattacaacgaataaaaccgaataacgacaataaaatataattaaaactaaaaaacaataacccgacaaattcgataaaaaatcgtacgacactttcgataatcgtcgaaacgaaaaaacgcgaaaaaattaaaccgaataatatcttaatcgaaaccaccaataataacaccgacattacgctaacaataattaccgcgctaaaaaactatcgcataaaattactaatacccgacaacataaaccaaaaacgccgtacgacgatacgtacttataatacgaaactaattcttatcaccaaaaaacaaaacataaaaaatacgcgcgatctaacgctaaaaataacgaatcgtaacgaaaaaaaactactcgatcaattcaataatcccgataacccttatacgcattacaccaccactaaaccgaaaatctaacaacaaaccgacgaacgcatcactcattttatctccaacataaaaacgaccgacactatcaccgacgtctcacgctttatacgcgaacaatccaaaccgataaccattatcgacctacaaccgaaaaaaaacaacaaca

SEQ ID NO: 30527 - DNA, 600 bp, Artificial Sequence
  chemically treated genomic DNA (Homo sapiens) CpG-island No: 30527
aaataataggtaatacgtttttggtgaagttgtagcgaatggggtcggataacggtagtgaagtgtggttaaaattggaaggtaataattcggtaggttcggtgaaagatcgtgcggtattttcgatgatcgtcgaggcggaaaagcgcggggaaattaaatcgggtgatgttttaatcgaagttattagtggtaatatcggtattgcgttggtaatgattgtcgcgttgaaaggttatcgtatgaaattgttgatgttcgataatatgagttaggaacgtcgtgcggcgatgcgtgtttatggtgcggaattgatttttgttattaaagagtagggtatggaaggtgcgcgcgatttggcgttggagatggcgaatcgtggcgaaggaaagttgttcgattagtttaataatttcgataatttttatgcgtattatattattattgggtcggaaatttggtagtaaatcggcgggcgtattatttattttgtttttagtatggggacgatcggtattattatcggcgttttacgttttatgcgcgaataatttaaatcggtgattattgtcggtttgtaatcggaagagggtagtagta

SEQ ID NO: 30528 - DNA, 600 bp, Artificial Sequence
  chemically treated genomic DNA (Homo sapiens) CpG-island No: 30528
tactactaccctcttccgattacaaaccgacaataatcaccgatttaaattattcgcgcataaaacgtaaaacgccgataataataccgatcgtccccatactaaaaacaaaataaataatacgcccgccgatttactaccaaatttccgacccaataataatataatacgcataaaaattatcgaaattattaaactaatcgaacaactttccttcgccacgattcgccatctccaacgccaaatcgcgcgcaccttccataccctactctttaataacaaaaatcaattccgcaccataaacacgcatcgccgcacgacgttcctaactcatattatcgaacatcaacaatttcatacgataacctttcaacgcgacaatcattaccaacgcaataccgatattaccactaataacttcgattaaaacatcacccgatttaatttccccgcgcttttccgcctcgacgatcatcgaaaataccgcacgatctttcaccgaacctaccgaattattaccttccaattttaaccacacttcactaccgttatccgaccccattcgctacaacttcaccaaaaacgtattacctattattt

SEQ ID NO: 30529 - DNA, 614 bp, Artificial Sequence
  chemically treated genomic DNA (Homo sapiens) CpG-island No: 30529
ggtaggacggttatttcgtacgtttaacgcgtttgattttgtcggtacgtttaatatacggaggacgacgtgaattttgaaattgtaacgtgttaacgttttttaatagtcggatattgtggttttcgcggatgttttgcgagagttttcgtgataatatatcgtttcgtattattttttgagggtagcgggagcgaatatattacgggcgtcggtgttttagtggattttcgtgtgttgatttttcggtttatttagcgaagaaatttcgtttttgtggttttgaaatcgggtgattatataggagcgaaattggttggtgcgagtaagtatttgttacggtgattcgtgtagagtcgtttaatacgataagggttggggtcgattgagacgtaggtcgtgatatagcgcgtgggatatatcgttttatattagagcgaggcgatatcgtaagatcgatatgagtggaagaagtatcgcggtacgcgcggataggtatattcggttgtttatatatttagagaatgaacggtcgcgtttgatacgataagttgtttcgcgcgattcgatggcggcgcggagtatataaaaatattcgtgaatttggagcggtt

SEQ ID NO: 30530 - DNA, 614 bp, Artificial Sequence
  chemically treated genomic DNA (Homo sapiens) CpG-island No: 30530
aaccgctccaaattcacgaatatttttatatactccgcgccgccatcgaatcgcgcgaaacaacttatcgtatcaaacgcgaccgttcattctctaaatatataaacaaccgaatatacctatccgcgcgtaccgcgatacttcttccactcatatcgatcttacgatatcgcctcgctctaatataaaacgatatatcccacgcgctatatcacgacctacgtctcaatcgaccccaacccttatcgtattaaacgactctacacgaatcaccgtaacaaatacttactcgcaccaaccaatttcgctcctatataatcacccgatttcaaaaccacaaaaacgaaatttcttcgctaaataaaccgaaaaatcaacacacgaaaatccactaaaacaccgacgcccgtaatatattcgctcccgctaccctcaaaaaataatacgaaacgatatattatcacgaaaactctcgcaaaacatccgcgaaaaccacaatatccgactattaaaaaacgttaacacgttacaatttcaaaattcacgtcgtcctccgtatattaaacgtaccgacaaaatcaaacgcgttaaacgtacgaaataaccgtcctacc

SEQ ID NO: 30531 - DNA, 614 bp, Artificial Sequence
  chemically treated genomic DNA (Homo sapiens) CpG-island No: 30531
ggtcgttttagatttacgggtgtttttatgtgtttcgcgtcgttatcgggtcgcgcgaggtagtttgtcgtattaagcgcggtcgtttattttttgaatgtgtaaataatcgggtgtgtttattcgcgcgtgtcgcgatattttttttatttatatcggttttgcggtatcgtttcgttttgatgtgggacggtatgttttacgcgttgtattacggtttgcgttttagtcgattttagtttttgtcgtgttggacgattttatacggattatcgtggtaagtgtttgttcgtattagttagtttcgtttttgtgtaattattcggttttaagattataagggcgagattttttcgttgggtgagtcggaaggttaatatacgagagtttattgggatatcggcgttcgtggtgtattcgttttcgttgtttttagagaatagtacggggcgatatgttattacgagggttttcgtagaatattcgcggggattataatgttcgattgttggaagacgttagtacgttgtaattttagagtttacgtcgtttttcgtgtgttgggcgtgtcgataaagttaagcgcgttagacgtgcgggataatcgttttatt

SEQ ID NO: 30532 - DNA, 614 bp, Artificial Sequence
  chemically treated genomic DNA (Homo sapiens) CpG-island No: 30532
aataaaacgattatcccgcacgtctaacgcgcttaactttatcgacacgcccaacacacgaaaaacgacgtaaactctaaaattacaacgtactaacgtcttccaacaatcgaacattataatccccgcgaatattctacgaaaaccctcgtaataacatatcgccccgtactattctctaaaaacaacgaaaacgaatacaccacgaacgccgatatcccaataaactctcgtatattaaccttccgactcacccaacgaaaaaatctcgcccttataatcttaaaaccgaataattacacaaaaacgaaactaactaatacgaacaaacacttaccacgataatccgtataaaatcgtccaacacgacaaaaactaaaatcgactaaaacgcaaaccgtaatacaacgcgtaaaacataccgtcccacatcaaaacgaaacgataccgcaaaaccgatataaataaaaaaaatatcgcgacacgcgcgaataaacacacccgattatttacacattcaaaaaataaacgaccgcgcttaatacgacaaactacctcgcgcgacccgataacgacgcgaaacacataaaaacacccgtaaatctaaaacgacc

SEQ ID NO: 30533 - DNA, 637 bp, Artificial Sequence
  chemically treated genomic DNA (Homo sapiens) CpG-island No: 30533
tgacgcgtcggattaggtatggcgcgaatcggcgattcgttttgtgttcgaatttatgggcgaagtgaatcgtttgtagggaattattcgcggcgggtagttttatgttggcgcgtatcgttggtcgttgggttatatatttgcgtattaggggtcggtggatttttttttgcgtttttgggaagtggatattagtcgtcgtattagtttcgattcgtcgttgtcggtataggtattggaagttagttcgaaaggttattatatttaattagtggtgtagtcgttggggtggtataacgaatcgttgacggtcgtgatgtatggcgacgatgtttcgtagcgtggcgagcgtttattcgttggtttgtaatatgcgcggttgtataacggcgacgagcgtatcgaaattcgcgatgaggaatttgttttcgtataaagcgtttgataggttgagtgaatgttaaacgttcggaggcgtttttcgcgattcgggttttttaatggtaaggtttgtaatttgtaggtttgataagacgcggtaagcgtcgtattaggtattgagtatttaatgtcggatgcgtcgtgaacgttttattcggtttataaacgtacgaagatttaatatgttgtaatagat

SEQ ID NO: 30534 - DNA, 637 bp, Artificial Sequence
  chemically treated genomic DNA (Homo sapiens) CpG-island No: 30534
atctattacaacatattaaatcttcgtacgtttataaaccgaataaaacgttcacgacgcatccgacattaaatactcaatacctaatacgacgcttaccgcgtcttatcaaacctacaaattacaaaccttaccattaaaaaacccgaatcgcgaaaaacgcctccgaacgtttaacattcactcaacctatcaaacgctttatacgaaaacaaattcctcatcgcgaatttcgatacgctcgtcgccgttatacaaccgcgcatattacaaaccaacgaataaacgctcgccacgctacgaaacatcgtcgccatacatcacgaccgtcaacgattcgttataccaccccaacgactacaccactaattaaatataataacctttcgaactaacttccaatacctataccgacaacgacgaatcgaaactaatacgacgactaatatccacttcccaaaaacgcaaaaaaaaatccaccgacccctaatacgcaaatatataacccaacgaccaacgatacgcgccaacataaaactacccgccgcgaataattccctacaaacgattcacttcgcccataaattcgaacacaaaacgaatcgccgattcgcgccatacctaatccgacgcgtca

SEQ ID NO: 30535 - DNA, 637 bp, Artificial Sequence
  chemically treated genomic DNA (Homo sapiens) CpG-island No: 30535
atttattgtaatatgttgaattttcgtgcgtttgtaggtcggataaggcgtttacgacgtattcggtattaggtgtttaatgtttgatgcgacgtttgtcgcgttttattaggtttataggttataaattttgttattaagaagttcggatcgcgggaagcgttttcgggcgtttaatatttatttaatttattaggcgttttgtgcgagagtaagttttttatcgcgggtttcgatacgttcgtcgtcgttatatagtcgcgtatgttgtagattaacgaataaacgttcgttacgttgcggggtatcgtcgttatgtattacgatcgttagcggttcgttgtattattttagcggttgtattattaattgggtgtagtgatttttcgggttggtttttagtatttgtatcggtagcggcgaatcgaggttggtacggcggttgatatttattttttaagggcgtaggaagagatttatcggtttttgatacgtaggtgtgtagtttagcggttagcgatgcgcgttaatatggaattgttcgtcgcgaatggttttttgtaggcggtttatttcgtttataaattcgagtataaaacgggtcgtcggttcgcgttatatttgattcggcgcgtta

SEQ ID NO: 30536 - DNA, 637 bp, Artificial Sequence
  chemically treated genomic DNA (Homo sapiens) CpG-island No: 30536
taacgcgccgaatcaaatataacgcgaaccgacgacccgttttatactcgaatttataaacgaaataaaccgcctacaaaaaaccattcgcgacgaacaattccatattaacgcgcatcgctaaccgctaaactacacacctacgtatcaaaaaccgataaatctcttcctacgcccttaaaaaataaatatcaaccgccgtaccaacctcgattcgccgctaccgatacaaatactaaaaaccaacccgaaaaatcactacacccaattaataatacaaccgctaaaataatacaacgaaccgctaacgatcgtaatacataacgacgataccccgcaacgtaacgaacgtttattcgttaatctacaacatacgcgactatataacgacgacgaacgtatcgaaacccgcgataaaaaacttactctcgcacaaaacgcctaataaattaaataaatattaaacgcccgaaaacgcttcccgcgatccgaacttcttaataacaaaatttataacctataaacctaataaaacgcgacaaacgtcgcatcaaacattaaacacctaataccgaatacgtcgtaaacgccttatccgacctacaaacgcacgaaaattcaacatattacaataaat

SEQ ID NO: 30537 - DNA, 642 bp, Artificial Sequence
  chemically treated genomic DNA (Homo sapiens) CpG-island No: 30537
gtgatgaggttggtggtagtatgaataattttaacggttatgtcgtcggtattaacgtttacggtagcgtcgggaagttgaaggtttataatgttagtatgaacggcgtggagattaatacgggttttatcgttggtacggtagatattattgtgagttttgataaacgtagtggaaggtagtaatttgatcgacgttgacgttattattttaacgttcgtggtatggattgttaaaggtagtatcgatgttagcggtaacgttgacgttattatgagttataatgtttatatcgatgtggtaatagatgtttcggtgaatgatatcgcgaaagtattggatgcgggttatattaataacgaattgtttattagtttgaacgtcggtacgattgttgaattgaatagtgttttgaaataggttagcggtagttaggcgattacggtatttcgcgaagcgcgcgtgttaagtaatcgttttagtatgttggtagatgtcgcgtcgaaagtgggtaacggtttggcgtttaacgttgtcgcgaaaggcgattcgcgtgtcgagttaggtaataatatcgaatacgatatgttggtattgcgtaaaattatcgatttgagcgaaagttagacgatgagtttggag

SEQ ID NO: 30538 - DNA, 642 bp, Artificial Sequence
  chemically treated genomic DNA (Homo sapiens) CpG-island No: 30538
ctccaaactcatcgtctaactttcgctcaaatcgataattttacgcaataccaacatatcgtattcgatattattacctaactcgacacgcgaatcgcctttcgcgacaacgttaaacgccaaaccgttacccactttcgacgcgacatctaccaacatactaaaacgattacttaacacgcgcgcttcgcgaaataccgtaatcgcctaactaccgctaacctatttcaaaacactattcaattcaacaatcgtaccgacgttcaaactaataaacaattcgttattaatataacccgcatccaatactttcgcgatatcattcaccgaaacatctattaccacatcgatataaacattataactcataataacgtcaacgttaccgctaacatcgatactacctttaacaatccataccacgaacgttaaaataataacgtcaacgtcgatcaaattactaccttccactacgtttatcaaaactcacaataatatctaccgtaccaacgataaaacccgtattaatctccacgccgttcatactaacattataaaccttcaacttcccgacgctaccgtaaacgttaataccgacgacataaccgttaaaattattcatactaccaccaacctcatcac

SEQ ID NO: 30539 - DNA, 642 bp, Artificial Sequence
  chemically treated genomic DNA (Homo sapiens) CpG-island No: 30539
ttttagatttatcgtttggttttcgtttaggtcgatagttttacgtaatgttagtatgtcgtattcggtattattatttaattcggtacgcggatcgtttttcgcgataacgttgaacgttagatcgttatttattttcggcgcggtatttgttagtatattaaagcggttgtttaatacgcgcgtttcgcggaatatcgtggtcgtttggttatcgttgatttgttttagagtattgtttagtttagtagtcgtgtcgacgtttaggttggtaaatagttcgttgttggtgtaattcgtatttagtgttttcgcgatgttatttatcgaggtatttgttgttatatcggtgtaggtattgtggtttatggtgacgttaacgttatcgttggtatcggtgttgtttttggtagtttatattacggacgttgaggtgatggcgttagcgtcggttaggttgttattttttattacgtttattaaaatttatagtggtgtttgtcgtattagcggtaaagttcgtgttaatttttacgtcgtttatgttggtattgtgaatttttagtttttcggcgttgtcgtaaacgttggtatcgacgatatagtcgttgaggttgtttatgttgttattagttttattat

SEQ ID NO: 30540 - DNA, 642 bp, Artificial Sequence
  chemically treated genomic DNA (Homo sapiens) CpG-island No: 30540
ataataaaactaataacaacataaacaacctcaacgactatatcgtcgataccaacgtttacgacaacgccgaaaaactaaaaattcacaataccaacataaacgacgtaaaaattaacacgaactttaccgctaatacgacaaacaccactataaattttaataaacgtaataaaaaataacaacctaaccgacgctaacgccatcacctcaacgtccgtaatataaactaccaaaaacaacaccgataccaacgataacgttaacgtcaccataaaccacaatacctacaccgatataacaacaaatacctcgataaataacatcgcgaaaacactaaatacgaattacaccaacaacgaactatttaccaacctaaacgtcgacacgactactaaactaaacaatactctaaaacaaatcaacgataaccaaacgaccacgatattccgcgaaacgcgcgtattaaacaaccgctttaatatactaacaaataccgcgccgaaaataaataacgatctaacgttcaacgttatcgcgaaaaacgatccgcgtaccgaattaaataataataccgaatacgacatactaacattacgtaaaactatcgacctaaacgaaaaccaaacgataaatctaaaa

SEQ ID NO: 30541 - DNA, 672 bp, Artificial Sequence
  chemically treated genomic DNA (Homo sapiens) CpG-island No: 30541
tttcggtacgaaggcggcgttaaattgtaattcgttatttattattagttttggtgcgcgtttacggacgatttttgtcgtttgttggacgttagtaatataggggtgacgggcgttattattgttggaaaacgatagtatcgttacgcgcggttttttttcggtgatggcgcgttaggtttcggtattggtaagcgcgatattcgttagttgcgtcgtcgtcggttgtggtattacgttgtaatcggtaaagtttaacgtcgggtcgttgtattgtggtaatattaggaaaatggaagagagcgttttatagtttggttgtaagtcgataatgcgtaattcggtacgtagtatatttgtcgtggaagagaggttgttcgcgatatagatattcgttttatcggcgttgattattgttgcggcgaatattagagggtcggtaagtttttttagcgtattcggcggcgttttttcgttcgcgcgggttagttagcgatgagtaaatttttttcgtattgcgaggttgttatgcggattaattatttgtagttcgtttatcgttacgtcgtgattgagcgtaaattgacgaagtttaaacggattggcgattagaatgggcgttgttagattttgttgatgtaaatattgcgcggtttttagtatacgttggtt

SEQ ID NO: 30542 - DNA, 672 bp, Artificial Sequence
  chemically treated genomic DNA (Homo sapiens) CpG-island No: 30542
aaccaacgtatactaaaaaccgcgcaatatttacatcaacaaaatctaacaacgcccattctaatcgccaatccgtttaaacttcgtcaatttacgctcaatcacgacgtaacgataaacgaactacaaataattaatccgcataacaacctcgcaatacgaaaaaaatttactcatcgctaactaacccgcgcgaacgaaaaaacgccgccgaatacgctaaaaaaacttaccgaccctctaatattcgccgcaacaataatcaacgccgataaaacgaatatctatatcgcgaacaacctctcttccacgacaaatatactacgtaccgaattacgcattatcgacttacaaccaaactataaaacgctctcttccattttcctaatattaccacaatacaacgacccgacgttaaactttaccgattacaacgtaataccacaaccgacgacgacgcaactaacgaatatcgcgcttaccaataccgaaacctaacgcgccatcaccgaaaaaaaaccgcgcgtaacgatactatcgttttccaacaataataacgcccgtcacccctatattactaacgtccaacaaacgacaaaaatcgtccgtaaacgcgcaccaaaactaataataaataacgaattacaatttaacgccgccttcgtaccgaaa

SEQ ID NO: 30543 - DNA, 672 bp, Artificial Sequence
  chemically treated genomic DNA (Homo sapiens) CpG-island No: 30543
gattaacgtgtgttgaaagtcgcgtaatatttatattaataaggtttggtaacgtttattttggtcgttaattcgtttgaatttcgttagtttgcgtttagttacggcgtggcgatggacgggttataggtgattgattcgtatggtaatttcgtaatgcgggaagaatttgtttatcgttggttggttcgcgcgggcgaaaaaacgtcgtcggatgcgttggaaaaatttatcgattttttgatgttcgtcgtagtaatggttagcgtcggtaaagcggatgtttgtatcgcgggtaattttttttttacggtaaatgtgttgcgtgtcggattacgtattatcggtttgtagttaggttgtaaaacgtttttttttatttttttgatgttgttatagtatagcggttcggcgttgggttttgtcgattgtagcgtggtgttatagtcgacggcggcgtagttggcggatatcgcgtttgttagtgtcgaaatttggcgcgttattatcggagaagagtcgcgcgtggcgatgttgtcgttttttagtaatggtagcgttcgttatttttgtgttgttaacgtttagtaggcgatagaaatcgttcgtgagcgcgtattaaagttggtggtggatggcgagttatagtttgacgtcgttttcgtgtcggaa

SEQ ID NO: 30544 - DNA, 672 bp, Artificial Sequence
  chemically treated genomic DNA (Homo sapiens) CpG-island No: 30544
ttccgacacgaaaacgacgtcaaactataactcgccatccaccaccaactttaatacgcgctcacgaacgatttctatcgcctactaaacgttaacaacacaaaaataacgaacgctaccattactaaaaaacgacaacatcgccacgcgcgactcttctccgataataacgcgccaaatttcgacactaacaaacgcgatatccgccaactacgccgccgtcgactataacaccacgctacaatcgacaaaacccaacgccgaaccgctatactataacaacatcaaaaaaataaaaaaaaacgttttacaacctaactacaaaccgataatacgtaatccgacacgcaacacatttaccgtaaaaaaaaaattacccgcgatacaaacatccgctttaccgacgctaaccattactacgacgaacatcaaaaaatcgataaatttttccaacgcatccgacgacgttttttcgcccgcgcgaaccaaccaacgataaacaaattcttcccgcattacgaaattaccatacgaatcaatcacctataacccgtccatcgccacgccgtaactaaacgcaaactaacgaaattcaaacgaattaacgaccaaaataaacgttaccaaaccttattaatataaatattacgcgactttcaacacacgttaatc

SEQ ID NO: 30545 - DNA, 578 bp, Artificial Sequence
  chemically treated genomic DNA (Homo sapiens) CpG-island No: 30545
gtttcgtttagtataatcgtcgtgtcgtgggtcgtatttagttcgaagttttgttttagtagttttgtcgttaggtttattacgcgttttttatcgttttcgcgtacggaaagtagcgtacgatcgtgtttttttatggtggagttgttgtttagttgcgttttggtaaacgttttagcgaaggtgcggtttacgtttatgattttttcggtagagcgtatttttggttttaatagcgggttaacgttcgggaatttattgaacggtagtattattttttttatcgagtagtacggcgggataatttttttggttacgttttgtttagttagcgatttgttagttattacgcgcgtcgttatttttgttagcggtacgtcggtggttttggagacgaacggaacggtacgcgtcgtacgcgggttaattttaattaggtagatttcgttgttttttatcgtaaattgtacgtttattaggtcgcgtatttgtaattcgaaggttagttttgtatttgttggcgtattatattttgaattttttgatttaaggtgtaggtgggtaaagaattttcggag

SEQ ID NO: 30546 - DNA, 578 bp, Artificial Sequence
  chemically treated genomic DNA (Homo sapiens) CpG-island No: 30546
ctccgaaaattctttacccacctacaccttaaatcaaaaaattcaaaatataatacgccaacaaatacaaaactaaccttcgaattacaaatacgcgacctaataaacgtacaatttacgataaaaaacaacgaaatctacctaattaaaattaacccgcgtacgacgcgtaccgttccgttcgtctccaaaaccaccgacgtaccgctaacaaaaataacgacgcgcgtaataactaacaaatcgctaactaaacaaaacgtaaccaaaaaaattatcccgccgtactactcgataaaaaaaataatactaccgttcaataaattcccgaacgttaacccgctattaaaaccaaaaatacgctctaccgaaaaaatcataaacgtaaaccgcaccttcgctaaaacgtttaccaaaacgcaactaaacaacaactccaccataaaaaaacacgatcgtacgctactttccgtacgcgaaaacgataaaaaacgcgtaataaacctaacgacaaaactactaaaacaaaacttcgaactaaatacgacccacgacacgacgattatactaaacgaaac

SEQ ID NO: 30547 - DNA, 578 bp, Artificial Sequence
  chemically treated genomic DNA (Homo sapiens) CpG-island No: 30547
tttcggaggttttttgtttatttatattttaagttaggaaatttaggatgtgatgcgttagtaggtgtagaattggttttcgaattgtaggtgcgcggtttgatgaacgtgtagtttgcggtgaaaaataacgaagtttatttgattgaagttaattcgcgtgcggcgcgtatcgtttcgttcgtttttaaagttatcggcgtatcgttggtaaaagtggcggcgcgcgtgatggttggtaaatcgttggttgagtagggcgtaattaaagaagttatttcgtcgtattattcggtgaaagaagtggtgttgtcgtttaataaattttcgggcgttgattcgttgttagggttagaaatgcgttttatcggggaagttatgggcgtgggtcgtattttcgttgaagcgtttgttaaagcgtagttgggtagtaattttattatgaagaaatacggtcgtgcgttgtttttcgtgcgcgaaggcgataaagaacgcgtggtggatttggcggtaaaattgttgaaatagggtttcgagttggatgcgatttacggtacggcgattgtgttgggcgaagt

SEQ ID NO: 30548 - DNA, 578 bp, Artificial Sequence
  chemically treated genomic DNA (Homo sapiens) CpG-island No: 30548
acttcgcccaacacaatcgccgtaccgtaaatcgcatccaactcgaaaccctatttcaacaattttaccgccaaatccaccacgcgttctttatcgccttcgcgcacgaaaaacaacgcacgaccgtatttcttcataataaaattactacccaactacgctttaacaaacgcttcaacgaaaatacgacccacgcccataacttccccgataaaacgcatttctaaccctaacaacgaatcaacgcccgaaaatttattaaacgacaacaccacttctttcaccgaataatacgacgaaataacttctttaattacgccctactcaaccaacgatttaccaaccatcacgcgcgccgccacttttaccaacgatacgccgataactttaaaaacgaacgaaacgatacgcgccgcacgcgaattaacttcaatcaaataaacttcgttatttttcaccgcaaactacacgttcatcaaaccgcgcacctacaattcgaaaaccaattctacacctactaacgcatcacatcctaaatttcctaacttaaaatataaataaacaaaaaacctccgaaa

SEQ ID NO: 30549 - DNA, 594 bp, Artificial Sequence
  chemically treated genomic DNA (Homo sapiens) CpG-island No: 30549
gcggacgggcgggggcgttggagaggggttgaacggggtcgggggacggcgacggggggcggggcgtaggggggttggcgggcggggcggggggcgggtgtcgcgggcggcggtgtgggggcgaggcgtagtcgggggggtcgcgcggggcggtggggcgggggtggagcggggcgggcggggcgggtagtggcggggcgagaggggggcggaggtggcgcgcgggagggaggcggtacgggcgcggtagggagggtcgcgggggggcgcggggggggggggagttgggcgcgggggagggggggcggggggggcgggtggggcgcgcggggcgggtaaggtcggggggcgtcgagggtcgggggggggcggggggggggcgggggtggggggggggggggggcgcgcggggggtggggggggcgcgggggcgggggggggttcggggggggggggggggggggatcgggggagggggaggggggggcggtgggatggggtggggttgggggtggtgaggtggggtgcggttgggggtggtggggtggggtggggttgggcggggggggcgggggtagggtagatttttgtttt

SEQ ID NO: 30550 - DNA, 594 bp, Artificial Sequence
  chemically treated genomic DNA (Homo sapiens) CpG-island No: 30550
aaaacaaaaatctaccctacccccgccccccccgcccaaccccaccccaccccaccacccccaaccgcaccccacctcaccacccccaaccccaccccatcccaccgcccccccctccccctcccccgatccccccccccccccccccccgaacccccccccgcccccgcgccccccccaccccccgcgcgccccccccccccccccacccccgccccccccccgcccccccccgaccctcgacgccccccgaccttacccgccccgcgcgccccacccgccccccccgccccccctcccccgcgcccaactccccccccccccgcgcccccccgcgaccctccctaccgcgcccgtaccgcctccctcccgcgcgccacctccgcccccctctcgccccgccactacccgccccgcccgccccgctccacccccgccccaccgccccgcgcgacccccccgactacgcctcgcccccacaccgccgcccgcgacacccgccccccgccccgcccgccaacccccctacgccccgccccccgtcgccgtcccccgaccccgttcaacccctctccaacgcccccgcccgtccgc

SEQ ID NO: 30551 - DNA, 594 bp, Artificial Sequence
  chemically treated genomic DNA (Homo sapiens) CpG-island No: 30551
gaggtaagaatttattttgttttcgtttttttcgtttaattttattttattttattatttttaatcgtattttattttattatttttaattttattttattttatcgtttttttttttttttttttcggttttttttttttttttttttcgggttttttttcgttttcgcgttttttttatttttcgcgcgttttttttttttttttattttcgtttttttttcgttttttttcggttttcggcgtttttcgattttgttcgtttcgcgcgttttattcgtttttttcgttttttttttttcgcgtttagtttttttttttttcgcgttttttcgcggttttttttgtcgcgttcgtgtcgtttttttttcgcgcgttattttcgtttttttttcgtttcgttattgttcgtttcgttcgtttcgttttattttcgttttatcgtttcgcgcggttttttcggttgcgtttcgtttttatatcgtcgttcgcggtattcgtttttcgtttcgttcgttagtttttttgcgtttcgtttttcgtcgtcgtttttcggtttcgtttagtttttttttagcgttttcgttcgttcgt

SEQ ID NO: 30552 - DNA, 594 bp, Artificial Sequence
  chemically treated genomic DNA (Homo sapiens) CpG-island No: 30552
acgaacgaacgaaaacgctaaaaaaaaactaaacgaaaccgaaaaacgacgacgaaaaacgaaacgcaaaaaaactaacgaacgaaacgaaaaacgaataccgcgaacgacgatataaaaacgaaacgcaaccgaaaaaaccgcgcgaaacgataaaacgaaaataaaacgaaacgaacgaaacgaacaataacgaaacgaaaaaaaaacgaaaataacgcgcgaaaaaaaaacgacacgaacgcgacaaaaaaaaccgcgaaaaaacgcgaaaaaaaaaaaaactaaacgcgaaaaaaaaaaaacgaaaaaaacgaataaaacgcgcgaaacgaacaaaatcgaaaaacgccgaaaaccgaaaaaaaacgaaaaaaaaacgaaaataaaaaaaaaaaaaaaacgcgcgaaaaataaaaaaaacgcgaaaacgaaaaaaaacccgaaaaaaaaaaaaaaaaaaaaccgaaaaaaaaaaaaaaaaaaacgataaaataaaataaaattaaaaataataaaataaaatacgattaaaaataataaaataaaataaaattaaacgaaaaaaacgaaaacaaaataaattcttacctc

SEQ ID NO: 30553 - DNA, 561 bp, Artificial Sequence
  chemically treated genomic DNA (Homo sapiens) CpG-island No: 30553
tcgtcgacgtttttcgacgtggtattcgcgttaaggcgtgtcgagtagttttaaggtcgaggatttgggcgcgtttcgtattttttttttcggttttagggcgtggtcgtcggtttttgcgttcggttcgagaagggcgtttgtcgcggttgcggcgcgttcgttcggtgtatcggattcgattatattttgggtgggtttttcgtttcggcgtcgtatttatcgtgtagtttcgtttcgagttcgagattttggtgtttttattcgcgttgttgtagtaagaaataaaagagcggcgttcgtttttagttttatatacgtcgcgtttcgtttcgttttttattcgtcgtagtaggggcggtgttggtattcgaggggcgggagtagcgcgggttgtttttcgttttgtcgcgtttttcgttgggttattagatcggttgggcgcggtttttttcgcgtcgggtatttttagttcgtagtgtgtttagcgtgggggttgtagtcgtcgttagagtgggcgttaggttttcggttttgtttttgcggttatatttttttttt

SEQ ID NO: 30554 - DNA, 561 bp, Artificial Sequence
  chemically treated genomic DNA (Homo sapiens) CpG-island No: 30554
aaaaaaaaaatataaccgcaaaaacaaaaccgaaaacctaacgcccactctaacgacgactacaacccccacgctaaacacactacgaactaaaaatacccgacgcgaaaaaaaccgcgcccaaccgatctaataacccaacgaaaaacgcgacaaaacgaaaaacaacccgcgctactcccgcccctcgaataccaacaccgcccctactacgacgaataaaaaacgaaacgaaacgcgacgtatataaaactaaaaacgaacgccgctcttttatttcttactacaacaacgcgaataaaaacaccaaaatctcgaactcgaaacgaaactacacgataaatacgacgccgaaacgaaaaacccacccaaaatataatcgaatccgatacaccgaacgaacgcgccgcaaccgcgacaaacgcccttctcgaaccgaacgcaaaaaccgacgaccacgccctaaaaccgaaaaaaaaaatacgaaacgcgcccaaatcctcgaccttaaaactactcgacacgccttaacgcgaataccacgtcgaaaaacgtcgacga

SEQ ID NO: 30555 - DNA, 561 bp, Artificial Sequence
  chemically treated genomic DNA (Homo sapiens) CpG-island No: 30555
aaaggggaaatgtagtcgtaaaagtaaagtcgggggtttggcgtttattttggcggcgattatagtttttacgttgggtatattgcgagttgggggtgttcggcgcgggagaagtcgcgtttagtcggtttggtagtttagcggggggcgcggtagggcgaggagtagttcgcgttgttttcgtttttcgggtgttagtatcgtttttgttgcggcgggtgaggggcggggcggggcgcggcgtatataaggttaggggcgggcgtcgtttttttgttttttgttgtagtaacgcgagtgggagtattaggatttcgggttcggaacgagattgtacggtgagtgcggcgtcggggcggggggtttatttagggtgtggtcggattcggtgtatcgggcgggcgcgtcgtaatcgcgataggcgtttttttcggatcggacgtaggggtcggcgattacgttttgggatcgagaagaggggtgcgggacgcgtttagattttcggttttggggttgttcggtacgttttggcgcgagtgttacgtcgagaggcgtcggcgg

SEQ ID NO: 30556 - DNA, 561 bp, Artificial Sequence
  chemically treated genomic DNA (Homo sapiens) CpG-island No: 30556
ccgccgacgcctctcgacgtaacactcgcgccaaaacgtaccgaacaaccccaaaaccgaaaatctaaacgcgtcccgcacccctcttctcgatcccaaaacgtaatcgccgacccctacgtccgatccgaaaaaaacgcctatcgcgattacgacgcgcccgcccgatacaccgaatccgaccacaccctaaataaaccccccgccccgacgccgcactcaccgtacaatctcgttccgaacccgaaatcctaatactcccactcgcgttactacaacaaaaaacaaaaaaacgacgcccgcccctaaccttatatacgccgcgccccgccccgcccctcacccgccgcaacaaaaacgatactaacacccgaaaaacgaaaacaacgcgaactactcctcgccctaccgcgccccccgctaaactaccaaaccgactaaacgcgacttctcccgcgccgaacacccccaactcgcaatatacccaacgtaaaaactataatcgccgccaaaataaacgccaaacccccgactttacttttacgactacatttccccttt

SEQ ID NO: 30557 - DNA, 585 bp, Artificial Sequence
  chemically treated genomic DNA (Homo sapiens) CpG-island No: 30557
ggtcgtttttttcgcgttcggaacgtttttttcggaggtatagggcgggttgcggagtttacggtttagggtttcgcgggcgggagaggcggcgtgggagtcgggatttatttgtcgggtcggtgggcgcgcgcgtgttcggggtcgttcggcgtttgggagcgcgtaattagcgttcggcgttgcggggttcgtcgtgagtttattttttcgcgcggcgtcggggaagggtcggttcgttcgcgttatttgtcgggttttcgggtattgtttggtttttaggtcgtttcggaagtcgcgtcgtttgcgtgggattttgcgacgttgttatttagtcgtaagcggaattcgtttggttcgttatttttttattcggtgcgtttgggtcgtgttcgggtttacgtcggattcgtcggtatttcgattttgcgcgtggtttcgtatttagtttttttcggagtttaggtgtattgggtcgggagatatcgttgggttgcgcggcgtgggaagagtttgtagagcgcgtggtggggatttggtggtaggaggaatagtattagttttggtcgtattatttttttcgtt

SEQ ID NO: 30558 - DNA, 585 bp, Artificial Sequence
  chemically treated genomic DNA (Homo sapiens) CpG-island No: 30558
aacgaaaaaaataatacgaccaaaactaatactattcctcctaccaccaaatccccaccacgcgctctacaaactcttcccacgccgcgcaacccaacgatatctcccgacccaatacacctaaactccgaaaaaaactaaatacgaaaccacgcgcaaaatcgaaataccgacgaatccgacgtaaacccgaacacgacccaaacgcaccgaataaaaaaataacgaaccaaacgaattccgcttacgactaaataacaacgtcgcaaaatcccacgcaaacgacgcgacttccgaaacgacctaaaaaccaaacaatacccgaaaacccgacaaataacgcgaacgaaccgacccttccccgacgccgcgcgaaaaaataaactcacgacgaaccccgcaacgccgaacgctaattacgcgctcccaaacgccgaacgaccccgaacacgcgcgcgcccaccgacccgacaaataaatcccgactcccacgccgcctctcccgcccgcgaaaccctaaaccgtaaactccgcaacccgccctatacctccgaaaaaaacgttccgaacgcgaaaaaaacgacc

SEQ ID NO: 30559 - DNA, 585 bp, Artificial Sequence
  chemically treated genomic DNA (Homo sapiens) CpG-island No: 30559
agcggggaaagtggtgcgattagggttgatgttgttttttttgttattaggtttttattacgcgttttgtaggttttttttacgtcgcgtagtttagcggtgtttttcggtttagtgtatttgagtttcggggagggttgggtgcggggttacgcgtaagatcgaggtgtcggcgggttcggcgtgggttcggatacggtttaggcgtatcgggtgaaggggtgacgagttaagcgagtttcgtttgcggttgggtggtagcgtcgtagggttttacgtaggcggcgcggttttcggggcggtttggaggttaggtagtgttcgggggttcggtaggtggcgcgggcgagtcgattttttttcggcgtcgcgcgaggagatgagtttacggcgggtttcgtagcgtcggacgttggttgcgcgtttttaggcgtcgagcggtttcgggtacgcgcgcgtttatcggttcggtaggtgggtttcggtttttacgtcgtttttttcgttcgcgggattttgggtcgtgggtttcgtagttcgttttgtgttttcgggaggggcgtttcgggcgcggggggaacggtt

SEQ ID NO: 30560 - DNA, 585 bp, Artificial Sequence
  chemically treated genomic DNA (Homo sapiens) CpG-island No: 30560
aaccgttccccccgcgcccgaaacgcccctcccgaaaacacaaaacgaactacgaaacccacgacccaaaatcccgcgaacgaaaaaaacgacgtaaaaaccgaaacccacctaccgaaccgataaacgcgcgcgtacccgaaaccgctcgacgcctaaaaacgcgcaaccaacgtccgacgctacgaaacccgccgtaaactcatctcctcgcgcgacgccgaaaaaaaatcgactcgcccgcgccacctaccgaacccccgaacactacctaacctccaaaccgccccgaaaaccgcgccgcctacgtaaaaccctacgacgctaccacccaaccgcaaacgaaactcgcttaactcgtcaccccttcacccgatacgcctaaaccgtatccgaacccacgccgaacccgccgacacctcgatcttacgcgtaaccccgcacccaaccctccccgaaactcaaatacactaaaccgaaaaacaccgctaaactacgcgacgtaaaaaaaacctacaaaacgcgtaataaaaacctaataacaaaaaaaacaacatcaaccctaatcgcaccactttccccgct

SEQ ID NO: 30561 - DNA, 674 bp, Artificial Sequence
  chemically treated genomic DNA (Homo sapiens) CpG-island No: 30561
gggcgtgcgcggggttcggtcgtcggtgtttttggagatgtttttttggtttggtgtgatacgtgtgtatatagttttcgttttttcgtgagcgttcgggtgcgtgtgttttttttcgattattttgaggagcgagggtgttggttttcgagagggcggcgagaaggacggaggtagaggttatttatacggttcggcgggtgcggttcggtttagcgtttttcgttttttttagtttttcgcgtagttttaatagtaaaattttattgagttcggacgaaattggcgggtttttgggttaattatcgtgtagtttttcgttagacgttggattaatggttgtgcgtttgaggtttggtaatcgtttttcgtaagatattatcgggtaatgtagtttttcgcgattaagggtaggatagttggacggcgtatagttttttgggagatgtagttcggttgttcgcgggcgcgcgagttcgatcgacgcgttagaaggaggtgttttgcgaagtcgggttgcgattttaggggtcgtcgtgttttggcgtgtgattcgaaagttagtttgtaggcggggtttaaggttagggcgcggtagatttgattcgttttttttaaattttgttaatgttagaattcggataattttaatttggtaaagatggtaggaagtt

SEQ ID NO: 30562 - DNA, 674 bp, Artificial Sequence
  chemically treated genomic DNA (Homo sapiens) CpG-island No: 30562
aacttcctaccatctttaccaaattaaaattatccgaattctaacattaacaaaatttaaaaaaaacgaatcaaatctaccgcgccctaaccttaaaccccgcctacaaactaactttcgaatcacacgccaaaacacgacgacccctaaaatcgcaacccgacttcgcaaaacacctccttctaacgcgtcgatcgaactcgcgcgcccgcgaacaaccgaactacatctcccaaaaaactatacgccgtccaactatcctacccttaatcgcgaaaaactacattacccgataatatcttacgaaaaacgattaccaaacctcaaacgcacaaccattaatccaacgtctaacgaaaaactacacgataattaacccaaaaacccgccaatttcgtccgaactcaataaaattttactattaaaactacgcgaaaaactaaaaaaaacgaaaaacgctaaaccgaaccgcacccgccgaaccgtataaataacctctacctccgtccttctcgccgccctctcgaaaaccaacaccctcgctcctcaaaataatcgaaaaaaaacacacgcacccgaacgctcacgaaaaaacgaaaactatatacacacgtatcacaccaaaccaaaaaaacatctccaaaaacaccgacgaccgaaccccgcgcacgccc

SEQ ID NO: 30563 - DNA, 674 bp, Artificial Sequence
  chemically treated genomic DNA (Homo sapiens) CpG-island No: 30563
ggttttttgttatttttattaagttgagattattcgggttttggtattaatagagtttgaggaaagcgggttaagtttatcgcgttttaattttggatttcgtttgtaggttgattttcgagttatacgttagagtacggcgatttttaaggtcgtagttcggtttcgtaaggtatttttttttaacgcgtcggtcgaattcgcgcgttcgcgagtagtcggattatattttttaggaagttgtgcgtcgtttagttgttttgtttttggtcgcgaaggattatattattcggtgatattttgcgggaggcggttgttagattttaagcgtataattattggtttagcgtttggcggggagttgtacggtgattggtttaggagttcgttagtttcgttcgagtttagtagagttttgttgttaagattgcgcgaggagttagagagagcggagagcgttgagtcgggtcgtattcgtcgagtcgtgtgagtaatttttattttcgtttttttcgtcgttttttcggggattagtattttcgttttttagggtggtcgggagggagtatacgtattcgggcgtttacgagagggcggggattgtgtatatacgtgttatattagattagagaagtatttttagggatatcggcggtcgagtttcgcgtacgttt

SEQ ID NO: 30564 - DNA, 674 bp, Artificial Sequence
  chemically treated genomic DNA (Homo sapiens) CpG-island No: 30564
aaacgtacgcgaaactcgaccgccgatatccctaaaaatacttctctaatctaatataacacgtatatacacaatccccgccctctcgtaaacgcccgaatacgtatactccctcccgaccaccctaaaaaacgaaaatactaatccccgaaaaaacgacgaaaaaaacgaaaataaaaattactcacacgactcgacgaatacgacccgactcaacgctctccgctctctctaactcctcgcgcaatcttaacaacaaaactctactaaactcgaacgaaactaacgaactcctaaaccaatcaccgtacaactccccgccaaacgctaaaccaataattatacgcttaaaatctaacaaccgcctcccgcaaaatatcaccgaataatataatccttcgcgaccaaaaacaaaacaactaaacgacgcacaacttcctaaaaaatataatccgactactcgcgaacgcgcgaattcgaccgacgcgttaaaaaaaaataccttacgaaaccgaactacgaccttaaaaatcgccgtactctaacgtataactcgaaaatcaacctacaaacgaaatccaaaattaaaacgcgataaacttaacccgctttcctcaaactctattaataccaaaacccgaataatctcaacttaataaaaataacaaaaaacc

SEQ ID NO: 30565 - DNA, 621 bp, Artificial Sequence
  chemically treated genomic DNA (Homo sapiens) CpG-island No: 30565
ttatttgaatcggttaatgtcggcgggttagggggcgggggttgaaaattttataaaggcgtcgatcggtcggataggcggtagcggcggtttttgtagcggtggtcggttgttgggtgtggagttttttagcgtttttcgggttcgattttttgagcgttttgtttcggcgttagtttatttcgtttttcggcgttatgattataattattatttttaagggagtcgattttaatagtaggaatagttttcggtgaggcgatcgggtcgcgttcgagtcgcgcggggttgaggggttgggagggtcgttgtcggcggggtttcgcgtcggtcgttgcgggtaacgagtttcgtgcgttgtgttcgcgtcggggcgggtggcggggttttgtcgtcgcgtcgtttttgtgtcgtttggcgagttttgcgcgtcggttttattcgggtttttgttgttttttatttattttttttacggagttaggggttgaggaggtcggggttggtcgtttttcggagtacggtcggttttcgttaatcggaattttcggggagggtttcgtttttttttgtgtgtatttcggttggtgtatttttagggtggtgggtttgttttttagg

SEQ ID NO: 30566 - DNA, 621 bp, Artificial Sequence
  chemically treated genomic DNA (Homo sapiens) CpG-island No: 30566
cctaaaaaacaaacccaccaccctaaaaatacaccaaccgaaatacacacaaaaaaaaacgaaaccctccccgaaaattccgattaacgaaaaccgaccgtactccgaaaaacgaccaaccccgacctcctcaacccctaactccgtaaaaaaaataaataaaaaacaacaaaaacccgaataaaaccgacgcgcaaaactcgccaaacgacacaaaaacgacgcgacgacaaaaccccgccacccgccccgacgcgaacacaacgcacgaaactcgttacccgcaacgaccgacgcgaaaccccgccgacaacgaccctcccaacccctcaaccccgcgcgactcgaacgcgacccgatcgcctcaccgaaaactattcctactattaaaatcgactcccttaaaaataataattataatcataacgccgaaaaacgaaataaactaacgccgaaacaaaacgctcaaaaaatcgaacccgaaaaacgctaaaaaactccacacccaacaaccgaccaccgctacaaaaaccgccgctaccgcctatccgaccgatcgacgcctttataaaattttcaacccccgccccctaacccgccgacattaaccgattcaaataa

SEQ ID NO: 30567 - DNA, 621 bp, Artificial Sequence
  chemically treated genomic DNA (Homo sapiens) CpG-island No: 30567
tttggggggtaagtttattattttggggatgtattagtcgggatgtatataggagaaagcgaagtttttttcgaaggtttcgattaacgaaaatcggtcgtgtttcgaggggcgattagtttcggtttttttagtttttgatttcgtggaaggaatgaatggagagtagtagggattcgggtggggtcggcgcgtagggttcgttaggcggtataaaggcggcgcgacggtagaatttcgttattcgtttcggcgcgagtatagcgtacggggttcgttattcgtaacgatcggcgcgaggtttcgtcggtagcggtttttttagttttttagtttcgcgcggttcgggcgcgattcggtcgttttatcgggagttatttttgttgttggggtcgatttttttgaaggtggtggttgtggttatggcgtcgaggagcgaggtaggttggcgtcggagtagaacgtttaaagggtcggattcgaggggcgttgggaaattttatatttaatagtcgattatcgttgtaggagtcgtcgttgtcgtttgttcggtcgatcgacgtttttatagggtttttaattttcgttttttaattcgtcggtattggtcgatttaaatga

SEQ ID NO: 30568 - DNA, 621 bp, Artificial Sequence
  chemically treated genomic DNA (Homo sapiens) CpG-island No: 30568
tcatttaaatcgaccaataccgacgaattaaaaaacgaaaattaaaaaccctataaaaacgtcgatcgaccgaacaaacgacaacgacgactcctacaacgataatcgactattaaatataaaatttcccaacgcccctcgaatccgaccctttaaacgttctactccgacgccaacctacctcgctcctcgacgccataaccacaaccaccaccttcaaaaaaatcgaccccaacaacaaaaataactcccgataaaacgaccgaatcgcgcccgaaccgcgcgaaactaaaaaactaaaaaaaccgctaccgacgaaacctcgcgccgatcgttacgaataacgaaccccgtacgctatactcgcgccgaaacgaataacgaaattctaccgtcgcgccgcctttataccgcctaacgaaccctacgcgccgaccccacccgaatccctactactctccattcattccttccacgaaatcaaaaactaaaaaaaccgaaactaatcgcccctcgaaacacgaccgattttcgttaatcgaaaccttcgaaaaaaacttcgctttctcctatatacatcccgactaatacatccccaaaataataaacttaccccccaaa

SEQ ID NO: 30569 - DNA, 634 bp, Artificial Sequence
  chemically treated genomic DNA (Homo sapiens) CpG-island No: 30569
ggttcgttatcgagtttttttatagcgtcgaattttaggtttttagaagtcgttcggacgttaatgtttttcgtttaggtttttcgtttagagttggttgcgagataagatttcgtttgggcgttttttgtagcgtttgtaagtttaaatttttagtgttgcggcgttgtttttttttagttacggttatttttttgcggttttttgtacgcgttttttttttttggcgtcgatagtaaattagggaaaatagcgtcgaggattgattgtatttagagtatcgcgttaataggattaggcggcgtcggggatattttggtgtcgagcggagaaaaggttttcggagacggcgggaggggtaggaggatttcggggttggagacggtgcgaatgcgcgtgcgtaggttggggcggcggtatttgggtgggaattcgtgcgggatttaggttttagtaagcgtataacgttttttaattttgggagttttcgttatatttcggtttttattttagtgtcgtcgtagttatttgtttaaatttcgatagttaaacgggtttgtgttggaaagtaatcgtttttatttttatattagaatatatataagaggtacgggaataaaatcgatatttttga

SEQ ID NO: 30570 - DNA, 634 bp, Artificial Sequence
  chemically treated genomic DNA (Homo sapiens) CpG-island No: 30570
tcaaaaatatcgattttattcccgtacctcttatatatattctaatataaaaataaaaacgattactttccaacacaaacccgtttaactatcgaaatttaaacaaataactacgacgacactaaaataaaaaccgaaatataacgaaaactcccaaaattaaaaaacgttatacgcttactaaaacctaaatcccgcacgaattcccacccaaataccgccgccccaacctacgcacgcgcattcgcaccgtctccaaccccgaaatcctcctacccctcccgccgtctccgaaaaccttttctccgctcgacaccaaaatatccccgacgccgcctaatcctattaacgcgatactctaaatacaatcaatcctcgacgctattttccctaatttactatcgacgccaaaaaaaaaaaacgcgtacaaaaaaccgcaaaaaaataaccgtaactaaaaaaaaacaacgccgcaacactaaaaatttaaacttacaaacgctacaaaaaacgcccaaacgaaatcttatctcgcaaccaactctaaacgaaaaacctaaacgaaaaacattaacgtccgaacgacttctaaaaacctaaaattcgacgctataaaaaaactcgataacgaacc

SEQ ID NO: 30571 - DNA, 634 bp, Artificial Sequence
  chemically treated genomic DNA (Homo sapiens) CpG-island No: 30571
ttaggggtatcgattttgttttcgtgttttttgtgtgtgttttagtgtggaagtggaggcgattgttttttagtataagttcgtttgattgtcggggtttggataagtggttgcgacgatattaaggtggagatcgggatgtagcgaggatttttagagttgggagacgttgtacgtttattgggatttaaatttcgtacgagtttttatttaagtgtcgtcgttttagtttacgtacgcgtattcgtatcgtttttagtttcggggtttttttgtttttttcgtcgttttcgggggtttttttttcgttcggtattagggtgttttcggcgtcgtttgattttgttagcgcggtattttgagtgtagttagttttcggcgttgttttttttgatttgttgtcgacgttaggaaggaaggacgcgtgtagaggatcgtagaggggtggtcgtggttgagaggagatagcgtcgtagtattgagggtttgggtttgtaggcgttgtaggagacgtttaggcggagttttgtttcgtagttagttttgagcgggaggtttgagcgggaagtattggcgttcgagcgatttttaggagtttggggttcggcgttatggaggagttcgatggcgagtt

SEQ ID NO: 30572 - DNA, 634 bp, Artificial Sequence
  chemically treated genomic DNA (Homo sapiens) CpG-island No: 30572
aactcgccatcgaactcctccataacgccgaaccccaaactcctaaaaatcgctcgaacgccaatacttcccgctcaaacctcccgctcaaaactaactacgaaacaaaactccgcctaaacgtctcctacaacgcctacaaacccaaaccctcaatactacgacgctatctcctctcaaccacgaccacccctctacgatcctctacacgcgtccttccttcctaacgtcgacaacaaatcaaaaaaaacaacgccgaaaactaactacactcaaaataccgcgctaacaaaatcaaacgacgccgaaaacaccctaataccgaacgaaaaaaaaacccccgaaaacgacgaaaaaaacaaaaaaaccccgaaactaaaaacgatacgaatacgcgtacgtaaactaaaacgacgacacttaaataaaaactcgtacgaaatttaaatcccaataaacgtacaacgtctcccaactctaaaaatcctcgctacatcccgatctccaccttaatatcgtcgcaaccacttatccaaaccccgacaatcaaacgaacttatactaaaaaacaatcgcctccacttccacactaaaacacacacaaaaaacacgaaaacaaaatcgatacccctaa

SEQ ID NO: 30573 - DNA, 1015 bp, Artificial Sequence
  chemically treated genomic DNA (Homo sapiens) CpG-island No: 30573
ttttgattatgttttattacgaaggaggataatatagtttcgtttagagttaggcgcgttttcgggcgggtcgggtgcgcgtgttcgtttatttttcgtcggtcgggcgcgtttggtttaggacgcggtggttgggacggggggtgggggtggttatgtaagcgttgtcgttttcggaggcgttagtaatgggaggtttcggttattcgtgttcgcgtagtagggtggggggagggagcgtacgacgtgcgcgtatttttttttttcgtttatcgttgtcgttttttttttttgtcgtttttggtgttgtttgtgtgttcgtttggtgcggatttggtattttttttgtgaagcggtagttgaggagatttcggcgttcgttatggtcgacgaaaagtttaaggtgagttcgtcgtcggttttttcgtttcgtcgcgcggtgggggttatggcgcgggtcggggttcggttagagttcgtcgttggtttttagcgttttttcgggttttttacggggtcggtcgcggtttaggttcgggcgtttcgcgttatttttttttttttttttttttttttttttcgcgtcgaaggaggtttcgtcgttttttttcgttttcggcggttttcgagtgcgcgtcgggcgcgagttgggcgggtagaaagcggacgttcgcggatttattagtttcgaacggggatttttggtttagtcggtcggcgcgcgtgaggaggggcgttagggcgcgcggggtttttattttttgtcgatttcgcgtcgggtgttgtagttttcgaggcggcgaggagttttttgggttcgggttttatttttcgggtaggaatcgcgggtatttggggatttttgtttggggtcgcggcggcggggcgagggttcggggcgaattaatgggttgcggacgggtaggaatttggatgttcgcgggtcgtcgttttgggtttgggggtagggggattttcgtggagtattttttattttaatagttttaggggttcg

SEQ ID NO: 30574 - DNA, 1015 bp, Artificial Sequence
  chemically treated genomic DNA (Homo sapiens) CpG-island No: 30574
cgaacccctaaaactattaaaataaaaaatactccacgaaaatccccctacccccaaacccaaaacgacgacccgcgaacatccaaattcctacccgtccgcaacccattaattcgccccgaaccctcgccccgccgccgcgaccccaaacaaaaatccccaaatacccgcgattcctacccgaaaaataaaacccgaacccaaaaaactcctcgccgcctcgaaaactacaacacccgacgcgaaatcgacaaaaaataaaaaccccgcgcgccctaacgcccctcctcacgcgcgccgaccgactaaaccaaaaatccccgttcgaaactaataaatccgcgaacgtccgctttctacccgcccaactcgcgcccgacgcgcactcgaaaaccgccgaaaacgaaaaaaaacgacgaaacctccttcgacgcgaaaaaaaaaaaaaaaaaaaaaaaaaaaaataacgcgaaacgcccgaacctaaaccgcgaccgaccccgtaaaaaacccgaaaaaacgctaaaaaccaacgacgaactctaaccgaaccccgacccgcgccataacccccaccgcgcgacgaaacgaaaaaaccgacgacgaactcaccttaaacttttcgtcgaccataacgaacgccgaaatctcctcaactaccgcttcacaaaaaaaataccaaatccgcaccaaacgaacacacaaacaacaccaaaaacgacaaaaaaaaaaaacgacaacgataaacgaaaaaaaaaaatacgcgcacgtcgtacgctccctccccccaccctactacgcgaacacgaataaccgaaacctcccattactaacgcctccgaaaacgacaacgcttacataaccacccccaccccccgtcccaaccaccgcgtcctaaaccaaacgcgcccgaccgacgaaaaataaacgaacacgcgcacccgacccgcccgaaaacgcgcctaactctaaacgaaactatattatcctccttcgtaataaaacataatcaaaa

SEQ ID NO: 30575 - DNA, 1015 bp, Artificial Sequence
  chemically treated genomic DNA (Homo sapiens) CpG-island No: 30575
cgggtttttgaggttattaaagtgggaaatattttacgggaatttttttatttttaggtttaggacggcggttcgcgggtatttaggtttttgttcgttcgtagtttattgattcgtttcgaattttcgtttcgtcgtcgcggttttaggtaggggtttttagatgttcgcggtttttattcgagaggtgaagttcgagtttagaggatttttcgtcgtttcggagattgtaatattcgacgcggggtcgatagaaggtggagatttcgcgcgttttaacgtttttttttacgcgcgtcggtcggttgggttaagaattttcgttcggggttggtgggttcgcgggcgttcgttttttgttcgtttaattcgcgttcggcgcgtattcggaggtcgtcgggggcgggagagagcggcggggtttttttcggcgcgggagggaggaagagagggagggaggaaaatggcgcggagcgttcgggtttgagtcgcggtcggtttcgtggggggttcgggaaagcgttgggagttagcggcgggttttggtcggatttcggttcgcgttatgatttttatcgcgcggcgaggcgaaggggtcggcggcgagtttattttgggtttttcgtcggttatggcgagcgtcggagtttttttagttgtcgttttataaaagaggtattaggttcgtattaaacgagtatataagtagtattaggagcggtagaagaaggaggcggtagcggtggacgaggggagagggtgcgcgtacgtcgtgcgttttttttttttattttgttgcgcgagtacgagtagtcgaagttttttattgttggcgttttcgggagcggtaacgtttatataattatttttatttttcgttttagttatcgcgttttgggttaggcgcgttcggtcggcgggaagtaggcggatacgcgtattcggttcgttcgggggcgcgtttggttttgggcggggttgtattgttttttttcgtggtggagtataattaaaa

SEQ ID NO: 30576 - DNA, 1015 bp, Artificial Sequence
  chemically treated genomic DNA (Homo sapiens) CpG-island No: 30576
ttttaattatactccaccacgaaaaaaaacaatacaaccccgcccaaaaccaaacgcgcccccgaacgaaccgaatacgcgtatccgcctacttcccgccgaccgaacgcgcctaacccaaaacgcgataactaaaacgaaaaataaaaataattatataaacgttaccgctcccgaaaacgccaacaataaaaaacttcgactactcgtactcgcgcaacaaaataaaaaaaaaaaacgcacgacgtacgcgcaccctctcccctcgtccaccgctaccgcctccttcttctaccgctcctaatactacttatatactcgtttaatacgaacctaatacctcttttataaaacgacaactaaaaaaactccgacgctcgccataaccgacgaaaaacccaaaataaactcgccgccgaccccttcgcctcgccgcgcgataaaaatcataacgcgaaccgaaatccgaccaaaacccgccgctaactcccaacgctttcccgaaccccccacgaaaccgaccgcgactcaaacccgaacgctccgcgccattttcctccctccctctcttcctccctcccgcgccgaaaaaaaccccgccgctctctcccgcccccgacgacctccgaatacgcgccgaacgcgaattaaacgaacaaaaaacgaacgcccgcgaacccaccaaccccgaacgaaaattcttaacccaaccgaccgacgcgcgtaaaaaaaaacgttaaaacgcgcgaaatctccaccttctatcgaccccgcgtcgaatattacaatctccgaaacgacgaaaaatcctctaaactcgaacttcacctctcgaataaaaaccgcgaacatctaaaaacccctacctaaaaccgcgacgacgaaacgaaaattcgaaacgaatcaataaactacgaacgaacaaaaacctaaatacccgcgaaccgccgtcctaaacctaaaaataaaaaaattcccgtaaaatatttcccactttaataacctcaaaaacccg

SEQ ID NO: 30577 - DNA, 516 bp, Artificial Sequence
  chemically treated genomic DNA (Homo sapiens) CpG-island No: 30577
  misc_feature (393)..(393): n is either a, c, g or t
ttttcgcggttttggttggtttcgtgtgcggcgggggggggttcgtttggggtttttaggggtttgcggaggtatgtatagagcggggagtcgtttttgtatgtagggcgggaggggttcgcggcgtgtcggggcgttttttttgttcgttgagggaattttcgattggtcggggtcgttatatttattttttgaagttaaagggtatcgtgtcgtcgtcgggggtgggagcgttgtaggttaggcgggcgcggcgtcgcgtggtttcgagttcgttgttaacgtttttttcggtcgtttcgttttcgtcgggggtttttttgatattcgttattcgttattcgttattcgtttttcgttgtcgggaagtgacgtttcgtacgttattgggtncgtcgttcggtcgtttttttcgttattcggttaaaggggttcgcggaggtagggaaggggcggagagtcgaggttgtcggaagggaagggagtttttaaagattttagtatttatttttttaa

SEQ ID NO: 30578 - DNA, 516 bp, Artificial Sequence
  chemically treated genomic DNA (Homo sapiens) CpG-island No: 30578
  misc_feature (124)..(124): n is either a, c, g or t
ttaaaaaaataaatactaaaatctttaaaaactcccttcccttccgacaacctcgactctccgccccttccctacctccgcgaacccctttaaccgaataacgaaaaaaacgaccgaacgacgnacccaataacgtacgaaacgtcacttcccgacaacgaaaaacgaataacgaataacgaataacgaatatcaaaaaaacccccgacgaaaacgaaacgaccgaaaaaaacgttaacaacgaactcgaaaccacgcgacgccgcgcccgcctaacctacaacgctcccacccccgacgacgacacgataccctttaacttcaaaaaataaatataacgaccccgaccaatcgaaaattccctcaacgaacaaaaaaaacgccccgacacgccgcgaacccctcccgccctacatacaaaaacgactccccgctctatacatacctccgcaaacccctaaaaaccccaaacgaacccccccccgccgcacacgaaaccaaccaaaaccgcgaaaa

SEQ ID NO: 30579 - DNA, 516 bp, Artificial Sequence
  chemically treated genomic DNA (Homo sapiens) CpG-island No: 30579
  misc_feature (124)..(124): n is either a, c, g or t
ttgaaggaatgagtattggagtttttggggatttttttttttttcgatagtttcgatttttcgttttttttttgttttcgcgggtttttttaatcgggtggcggaaggggcggtcgggcggcgngtttaatggcgtgcggagcgttatttttcggtagcgggaggcgagtggcgagtggcgagtggcgagtgttaggggggttttcggcgggggcggggcggtcggaggaggcgttggtagcgggttcgaaattacgcggcgtcgcgttcgtttggtttgtagcgtttttattttcggcggcggtacgatgttttttgattttaggaggtgagtgtggcgatttcggttagtcgggagtttttttagcgggtagagggagcgtttcggtacgtcgcggatttttttcgttttgtatgtaaaagcggtttttcgttttgtgtatgttttcgtaggtttttagggattttaggcgagttttttttcgtcgtatacgaagttagttagagtcgcggagg

SEQ ID NO: 30580 - DNA, 516 bp, Artificial Sequence
  chemically treated genomic DNA (Homo sapiens) CpG-island No: 30580
  misc_feature (393)..(393): n is either a, c, g or t
cctccgcgactctaactaacttcgtatacgacgaaaaaaaactcgcctaaaatccctaaaaacctacgaaaacatacacaaaacgaaaaaccgcttttacatacaaaacgaaaaaaatccgcgacgtaccgaaacgctccctctacccgctaaaaaaactcccgactaaccgaaatcgccacactcacctcctaaaatcaaaaaacatcgtaccgccgccgaaaataaaaacgctacaaaccaaacgaacgcgacgccgcgtaatttcgaacccgctaccaacgcctcctccgaccgccccgcccccgccgaaaacccccctaacactcgccactcgccactcgccactcgcctcccgctaccgaaaaataacgctccgcacgccattaaacncgccgcccgaccgccccttccgccacccgattaaaaaaacccgcgaaaacaaaaaaaaaacgaaaaatcgaaactatcgaaaaaaaaaaaaatccccaaaaactccaatactcattccttcaa

SEQ ID NO: 30581 - DNA, 1016 bp, Artificial Sequence
  chemically treated genomic DNA (Homo sapiens) CpG-island No: 30581
  misc_feature (429)..(429): n is either a, c, g or t
  misc_feature (469)..(469): n is either a, c, g or t
  misc_feature (482)..(482): n is either a, c, g or t
gggtcggtcgtggaggtttgtaggaggtagcgggcgaggaggggttcgcgattagtttgacgcgcggtttttttttttttatgtttttttttttgttcgtatagagagcgttttcgttgatacgtgacgttcgcgcgttttagttaggttcgttttagcgtttgtttgtcgtttagtagttacgacgcggttaatttcgataataacgagttcgagaataattaggtggtggttaagttgggttatttcggttgggtcgcgtttcgggtttatcgttatcgacgtcgcggtcgtcgttattttcgtgcgggtttcgtgagcgttcgcggttcgcgtcgtcgtcggcgttattggaggtcgatttgcgtttttacgtaatacgcgggttcgacgtgaatttgtcggtcgatcgtaaagtggtttgcgatnaacggttcgaacggcggcgtacgttggtttttttcgagantttcgttgcggtnacgcgagagttttttcgtggaggtgggtcgttcggggttggcggcgttcggcgcgttggttttcggtattacgtcgtgcgattcgggcgtgttacggtttaacgagttgttcgtcgatttagacgcgttgttcgatcgtaaagagtattgggtggtggcgcgcgtcgggttcgtgtcgagcggcggcgacgcgtttagttttacgttgcggttcggcggcgacgtgtttttgggtattaacgggcgttcgcgcggtcgtttgttgtgcgtcgatattacgtaggcgttttgggtttttttcgtcgtgcgcggcggcgtcgcgggttagttgcgttttttcggtgagttttcggtttcgcgtgcgcgaggtttcgtttttttttcgtttcgtgtcgttttatttcgttgcgttttttttcggtttcgtttttttcgttaggcgttgtatcgttcgaggttagttcgcggtttttaattttaagcgttcgggtacgatttatttcgtttaaaattgtcggattttattttagagtt

SEQ ID NO: 30582 - DNA, 1016 bp, Artificial Sequence
  chemically treated genomic DNA (Homo sapiens) CpG-island No: 30582
  misc_feature (535)..(535): n is either a, c, g or t
  misc_feature (548)..(548): n is either a, c, g or t
  misc_feature (588)..(588): n is either a, c, g or t
aactctaaaataaaatccgacaattttaaacgaaataaatcgtacccgaacgcttaaaattaaaaaccgcgaactaacctcgaacgatacaacgcctaacgaaaaaaacgaaaccgaaaaaaaacgcaacgaaataaaacgacacgaaacgaaaaaaaaacgaaacctcgcgcacgcgaaaccgaaaactcaccgaaaaaacgcaactaacccgcgacgccgccgcgcacgacgaaaaaaacccaaaacgcctacgtaatatcgacgcacaacaaacgaccgcgcgaacgcccgttaatacccaaaaacacgtcgccgccgaaccgcaacgtaaaactaaacgcgtcgccgccgctcgacacgaacccgacgcgcgccaccacccaatactctttacgatcgaacaacgcgtctaaatcgacgaacaactcgttaaaccgtaacacgcccgaatcgcacgacgtaataccgaaaaccaacgcgccgaacgccgccaaccccgaacgacccacctccacgaaaaaactctcgcgtnaccgcaacgaaantctcgaaaaaaaccaacgtacgccgccgttcgaaccgttnatcgcaaaccactttacgatcgaccgacaaattcacgtcgaacccgcgtattacgtaaaaacgcaaatcgacctccaataacgccgacgacgacgcgaaccgcgaacgctcacgaaacccgcacgaaaataacgacgaccgcgacgtcgataacgataaacccgaaacgcgacccaaccgaaataacccaacttaaccaccacctaattattctcgaactcgttattatcgaaattaaccgcgtcgtaactactaaacgacaaacaaacgctaaaacgaacctaactaaaacgcgcgaacgtcacgtatcaacgaaaacgctctctatacgaacaaaaaaaaaaacataaaaaaaaaaaaaccgcgcgtcaaactaatcgcgaacccctcctcgcccgctacctcctacaaacctccacgaccgaccc

SEQ ID NO: 30583 - DNA, 1016 bp, Artificial Sequence
  chemically treated genomic DNA (Homo sapiens) CpG-island No: 30583
  misc_feature (535)..(535): n is either a, c, g or t
  misc_feature (548)..(548): n is either a, c, g or t
  misc_feature (588)..(588): n is either a, c, g or t
aattttggggtggagttcggtaattttggacggggtggatcgtgttcgggcgtttaaagttgggaatcgcgggttggtttcgggcggtgtagcgtttagcgagaggggcggggtcggggaagagcgtagcggggtgagacggtacgggacgggggaggggcggggtttcgcgtacgcggggtcggggatttatcgaggagacgtagttggttcgcgacgtcgtcgcgtacggcgaagaaggtttagagcgtttgcgtggtgtcgacgtatagtaggcggtcgcgcggacgttcgttgatgtttaggagtacgtcgtcgtcgggtcgtagcgtgaagttgagcgcgtcgtcgtcgttcggtacgggttcggcgcgcgttattatttagtattttttgcggtcgagtagcgcgtttgggtcggcgggtagttcgttgggtcgtagtacgttcgggtcgtacgacgtgatgtcgaaggttagcgcgtcgggcgtcgttagtttcggacggtttatttttacgaagaggttttcgcgtngtcgtagcggggntttcggagaagattagcgtgcgtcgtcgttcgggtcgttngtcgtaggttattttgcggtcggtcgataggtttacgtcgggttcgcgtgttgcgtggaagcgtaggtcggtttttagtagcgtcggcgacgacgcgggtcgcgggcgtttacggggttcgtacgagaatggcggcggtcgcggcgtcggtggcggtgggttcggggcgcggtttagtcgaggtggtttagtttggttattatttggttgttttcgagttcgttgttgtcgaagttggtcgcgtcgtggttgttgggcggtaggtaggcgttgaagcgggtttggttgaggcgcgcgggcgttacgtgttagcgaaggcgttttttgtgcggataaagggagggatatggagggggagaggtcgcgcgttaggttggtcgcgagttttttttcgttcgttgttttttgtaggtttttacgatcgattt

SEQ ID NO: 30584 - DNA, 1016 bp, Artificial Sequence
  chemically treated genomic DNA (Homo sapiens) CpG-island No: 30584
  misc_feature (429)..(429): n is either a, c, g or t
  misc_feature (469)..(469): n is either a, c, g or t
  misc_feature (482)..(482): n is either a, c, g or t
aaatcgatcgtaaaaacctacaaaaaacaacgaacgaaaaaaaactcgcgaccaacctaacgcgcgacctctccccctccatatccctccctttatccgcacaaaaaacgccttcgctaacacgtaacgcccgcgcgcctcaaccaaacccgcttcaacgcctacctaccgcccaacaaccacgacgcgaccaacttcgacaacaacgaactcgaaaacaaccaaataataaccaaactaaaccacctcgactaaaccgcgccccgaacccaccgccaccgacgccgcgaccgccgccattctcgtacgaaccccgtaaacgcccgcgacccgcgtcgtcgccgacgctactaaaaaccgacctacgcttccacgcaacacgcgaacccgacgtaaacctatcgaccgaccgcaaaataacctacgacnaacgacccgaacgacgacgcacgctaatcttctccgaaanccccgctacgacnacgcgaaaacctcttcgtaaaaataaaccgtccgaaactaacgacgcccgacgcgctaaccttcgacatcacgtcgtacgacccgaacgtactacgacccaacgaactacccgccgacccaaacgcgctactcgaccgcaaaaaatactaaataataacgcgcgccgaacccgtaccgaacgacgacgacgcgctcaacttcacgctacgacccgacgacgacgtactcctaaacatcaacgaacgtccgcgcgaccgcctactatacgtcgacaccacgcaaacgctctaaaccttcttcgccgtacgcgacgacgtcgcgaaccaactacgtctcctcgataaatccccgaccccgcgtacgcgaaaccccgcccctcccccgtcccgtaccgtctcaccccgctacgctcttccccgaccccgcccctctcgctaaacgctacaccgcccgaaaccaacccgcgattcccaactttaaacgcccgaacacgatccaccccgtccaaaattaccgaactccaccccaaaatt

SEQ ID NO: 30585 - DNA, 701 bp, Artificial Sequence
  chemically treated genomic DNA (Homo sapiens) CpG-island No: 30585
cggtcgaggggtacggggaaggggattcggggagggagagagggaggagcggcgaggttaaggtaggtggtacgtcgtcgttttttcggtcgttcgtatttcggaggttagttttagttggtagcgagtttttttttttttcgttgggtttggagcgcggcgcgggttcggtttttggggacgcgttaagagtaggtcggatagtagggcgggggtcgggtcgcgagtttatggcgcggcgagcggatttagtttcgaggttgatgacgtttttttttttggtttgcggcgtttggtttggtagggcgggtgacgttatcgtttcgttacgtgattattatttaaataaatattttttttttttttgcgcgcgggtttggttcgtttcgttttttagaggtcgtatataaacgcgtttttcgggttaggttcgttgcgaaggatatttgggttgtgtgtgcgacgcgggtcggaggggtagtcgggggaatcgcgaagaagtcgaggagttcggagtttcgcgtgacgttttttttttagtttaaaagcggtttttggttcggcgtagagagattcgggggtttagttttttttcgaaaagcgtcgttttgtttttggtttcgagaatagataaagagtatcgtagggtcgattacgttgggggcgttgaggtcggttatggttatggaagtgggtatttt

SEQ ID NO: 30586 - DNA, 701 bp, Artificial Sequence
  chemically treated genomic DNA (Homo sapiens) CpG-island No: 30586
aaaatacccacttccataaccataaccgacctcaacgcccccaacgtaatcgaccctacgatactctttatctattctcgaaaccaaaaacaaaacgacgcttttcgaaaaaaaactaaacccccgaatctctctacgccgaaccaaaaaccgcttttaaactaaaaaaaaaacgtcacgcgaaactccgaactcctcgacttcttcgcgattcccccgactacccctccgacccgcgtcgcacacacaacccaaatatccttcgcaacgaacctaacccgaaaaacgcgtttatatacgacctctaaaaaacgaaacgaaccaaacccgcgcgcaaaaaaaaaaaaaatatttatttaaataataatcacgtaacgaaacgataacgtcacccgccctaccaaaccaaacgccgcaaaccaaaaaaaaaaacgtcatcaacctcgaaactaaatccgctcgccgcgccataaactcgcgacccgacccccgccctactatccgacctactcttaacgcgtccccaaaaaccgaacccgcgccgcgctccaaacccaacgaaaaaaaaaaaaactcgctaccaactaaaactaacctccgaaatacgaacgaccgaaaaaacgacgacgtaccacctaccttaacctcgccgctcctccctctctccctccccgaatccccttccccgtacccctcgaccg

SEQ ID NO: 30587 - DNA, 701 bp, Artificial Sequence
  chemically treated genomic DNA (Homo sapiens) CpG-island No: 30587
agggtgtttatttttatgattatggtcggttttagcgtttttagcgtgatcggttttgcggtgttttttgtttgttttcggggttaagggtagggcggcgtttttcgaggaaaagttagattttcgggtttttttgcgtcgaattaaaagtcgtttttggattgagagaggagcgttacgcggggtttcgggtttttcggttttttcgcggttttttcgattgttttttcgattcgcgtcgtatatatagtttaaatgtttttcgtagcgagtttggttcggggagcgcgtttatatgcggtttttgggggacggggcgggttagattcgcgcgtagggggagggggggtgtttgtttgaatggtgattacgtgacggggcggtgacgttattcgttttgttaggttaggcgtcgtaagttagagggggagacgttattagtttcggagttgggttcgttcgtcgcgttataggttcgcggttcggttttcgttttgttgttcggtttgtttttggcgcgtttttagggatcggattcgcgtcgcgttttaggtttagcggggaggaggagggttcgttgttagttgaggttgattttcgggatgcgagcggtcgggagaacggcgacgtgttatttgttttggtttcgtcgttttttttttttttttttttcgagttttttttttcgtgtttttcggtcg

SEQ ID NO: 30588 - DNA, 701 bp, Artificial Sequence
  chemically treated genomic DNA (Homo sapiens) CpG-island No: 30588
cgaccgaaaaacacgaaaaaaaaaactcgaaaaaaaaaaaaaaaaaaaacgacgaaaccaaaacaaataacacgtcgccgttctcccgaccgctcgcatcccgaaaatcaacctcaactaacaacgaaccctcctcctccccgctaaacctaaaacgcgacgcgaatccgatccctaaaaacgcgccaaaaacaaaccgaacaacaaaacgaaaaccgaaccgcgaacctataacgcgacgaacgaacccaactccgaaactaataacgtctccccctctaacttacgacgcctaacctaacaaaacgaataacgtcaccgccccgtcacgtaatcaccattcaaacaaacaccccccctccccctacgcgcgaatctaacccgccccgtcccccaaaaaccgcatataaacgcgctccccgaaccaaactcgctacgaaaaacatttaaactatatatacgacgcgaatcgaaaaaacaatcgaaaaaaccgcgaaaaaaccgaaaaacccgaaaccccgcgtaacgctcctctctcaatccaaaaacgacttttaattcgacgcaaaaaaacccgaaaatctaacttttcctcgaaaaacgccgccctacccttaaccccgaaaacaaacaaaaaacaccgcaaaaccgatcacgctaaaaacgctaaaaccgaccataatcataaaaataaacaccct

SEQ ID NO: 30589 - DNA, 500 bp, Artificial Sequence
  chemically treated genomic DNA (Homo sapiens) CpG-island No: 30589
  misc_feature (134)..(134): n is either a, c, g or t
cgttggaggtttgcgggcgttgttgggggagcgagcggcgtaatgtttgttgttggattgtcgtttttttttcgtttttaacgtcggttatatcgtcggttttgttaacgtgcgttttagtattatcgtgcggncgtcgggttaagggcgttatgggtttggagtatatcgtcgttaacgtcgagtttcgcgatcgtttgttggcggcgtttattacgtcgtgtgttgttggacgagcgtagtcgttttggacggcgtaagcggatcggtattttggttttggcggcggcgtttttgtcgtaggcggtcgcgtaagtttttttttttaaaggtacgttttcggggaagttcggggcgggtcgtatatttttgaggttttgttcggtatttttggttttcggttttcgggggatcgttttatttgtagcgcgtgggcgttggagtatatttatttttggaatttgttattggttttgtttggttttggaaataaagatttg

SEQ ID NO: 30590 - DNA, 500 bp, Artificial Sequence
  chemically treated genomic DNA (Homo sapiens) CpG-island No: 30590
  misc_feature (367)..(367): n is either a, c, g or t
caaatctttatttccaaaaccaaacaaaaccaataacaaattccaaaaataaatatactccaacgcccacgcgctacaaataaaacgatcccccgaaaaccgaaaaccaaaaataccgaacaaaacctcaaaaatatacgacccgccccgaacttccccgaaaacgtacctttaaaaaaaaaaacttacgcgaccgcctacgacaaaaacgccgccgccaaaaccaaaataccgatccgcttacgccgtccaaaacgactacgctcgtccaacaacacacgacgtaataaacgccgccaacaaacgatcgcgaaactcgacgttaacgacgatatactccaaacccataacgcccttaacccgacgnccgcacgataatactaaaacgcacgttaacaaaaccgacgatataaccgacgttaaaaacgaaaaaaaaacgacaatccaacaacaaacattacgccgctcgctcccccaacaacgcccgcaaacctccaacg

SEQ ID NO: 30591 - DNA, 500 bp, Artificial Sequence
  chemically treated genomic DNA (Homo sapiens) CpG-island No: 30591
  misc_feature (367)..(367): n is either a, c, g or t
taagtttttgtttttagagttaaataaagttaatgataagttttagagataaatgtattttagcgtttacgcgttgtaggtggggcgatttttcgggagtcgagagttaggggtatcgggtaaaattttaggggtgtgcggttcgtttcgagttttttcgagggcgtatttttgaggaagaagatttgcgcggtcgtttgcggtagaggcgtcgtcgttagggttagggtgtcgattcgtttgcgtcgtttagggcggttgcgttcgtttagtaatatacggcgtggtaggcgtcgttagtaggcggtcgcggagttcggcgttggcgacgatgtgttttaggtttatggcgtttttggttcggcgntcgtacgatggtgttgaagcgtacgttgatagagtcggcgatgtggtcggcgttgaaagcgaagaaggagcggtagtttagtagtaggtattgcgtcgttcgtttttttagtagcgttcgtaggtttttagcg

SEQ ID NO: 30592 - DNA, 500 bp, Artificial Sequence
  chemically treated genomic DNA (Homo sapiens) CpG-island No: 30592
  misc_feature (134)..(134): n is either a, c, g or t
cgctaaaaacctacgaacgctactaaaaaaacgaacgacgcaatacctactactaaactaccgctccttcttcgctttcaacgccgaccacatcgccgactctatcaacgtacgcttcaacaccatcgtacgancgccgaaccaaaaacgccataaacctaaaacacatcgtcgccaacgccgaactccgcgaccgcctactaacgacgcctaccacgccgtatattactaaacgaacgcaaccgccctaaacgacgcaaacgaatcgacaccctaaccctaacgacgacgcctctaccgcaaacgaccgcgcaaatcttcttcctcaaaaatacgccctcgaaaaaactcgaaacgaaccgcacacccctaaaattttacccgatacccctaactctcgactcccgaaaaatcgccccacctacaacgcgtaaacgctaaaatacatttatctctaaaacttatcattaactttatttaactctaaaaacaaaaactta

SEQ ID NO: 30593 - DNA, 598 bp, Artificial Sequence
  chemically treated genomic DNA (Homo sapiens) CpG-island No: 30593
agagtcgttttgcgcgtgcgtattatttaggcggttagatttgaatattttattgaggcgagtcgggcgttgtgagcggattgttagaggcggttgtttgttttcgttttaaggaaatttagagcgtgtggattttaaataagtttgcgtaaaatttgtcgaggaggtttgtcgcggtaggtaaagagaatgattttttcgttttgggttttagggaaggtttcgggttttgtttgggcgttttgaagtttttgcggtgggaggtagggtacgtttttttagtttggcggttttcgttagcgtcgggtcgagtagacgtttttgtttcgggtcgggtatattgtgttttttttttttttttcggtttgtacgttgtgtcgtttttcgtttttttaatattttttcgtttgtatttcggttttttcggttattcggttcgggttgtttgttcgtcgtttttttggcgttttttttcgtttcgttttgtcgttttttgttagggttcgcggattttttttgtatttttgtcgtttttttttagggatttttcggttgtttgtattttttatttaagttttttttggttttaaatgaagtg

SEQ ID NO: 30594 - DNA, 598 bp, Artificial Sequence
  chemically treated genomic DNA (Homo sapiens) CpG-island No: 30594
cacttcatttaaaaccaaaaaaaacttaaataaaaaatacaaacaaccgaaaaatccctaaaaaaaaacgacaaaaatacaaaaaaaatccgcgaaccctaacaaaaaacgacaaaacgaaacgaaaaaaaacgccaaaaaaacgacgaacaaacaacccgaaccgaataaccgaaaaaaccgaaatacaaacgaaaaaatattaaaaaaacgaaaaacgacacaacgtacaaaccgaaaaaaaaaaaaaaaacacaatatacccgacccgaaacaaaaacgtctactcgacccgacgctaacgaaaaccgccaaactaaaaaaacgtaccctacctcccaccgcaaaaacttcaaaacgcccaaacaaaacccgaaaccttccctaaaacccaaaacgaaaaaatcattctctttacctaccgcgacaaacctcctcgacaaattttacgcaaacttatttaaaatccacacgctctaaatttccttaaaacgaaaacaaacaaccgcctctaacaatccgctcacaacgcccgactcgcctcaataaaatattcaaatctaaccgcctaaataatacgcacgcgcaaaacgactct

SEQ ID NO: 30595 - DNA, 598 bp, Artificial Sequence
  chemically treated genomic DNA (Homo sapiens) CpG-island No: 30595
tattttatttagagttaaaaaaagtttaagtgagaaatataaatagtcgagaggtttttagggaagagcggtaggggtgtaagaagagttcgcgagttttgatagaggacggtagggcggggcggaagaggacgttaagagagcgacggataagtaattcgagtcgggtggtcggaggggtcgaggtgtaggcggagaagtgttagggaagcgggaggcggtataacgtataggtcgaggaggggaaaaagggtatagtgtgttcggttcggggtaggggcgtttattcggttcggcgttaacggaggtcgttaggttgagggagcgtattttattttttatcgtaggaattttagggcgtttagataaaattcgaagttttttttgaagtttagaacgaaagagttattttttttatttgtcgcggtaaattttttcgataaattttgcgtagatttgtttggggtttatacgttttgagtttttttagagcggaaatagatagtcgtttttagtagttcgtttataacgttcggttcgttttagtgaagtatttaaatttaatcgtttaggtgatgcgtacgcgtaaagcggtttt

SEQ ID NO: 30596 - DNA, 598 bp, Artificial Sequence
  chemically treated genomic DNA (Homo sapiens) CpG-island No: 30596
aaaaccgctttacgcgtacgcatcacctaaacgattaaatttaaatacttcactaaaacgaaccgaacgttataaacgaactactaaaaacgactatctatttccgctctaaaaaaactcaaaacgtataaaccccaaacaaatctacgcaaaatttatcgaaaaaatttaccgcgacaaataaaaaaaataactctttcgttctaaacttcaaaaaaaacttcgaattttatctaaacgccctaaaattcctacgataaaaaataaaatacgctccctcaacctaacgacctccgttaacgccgaaccgaataaacgcccctaccccgaaccgaacacactataccctttttcccctcctcgacctatacgttataccgcctcccgcttccctaacacttctccgcctacacctcgacccctccgaccacccgactcgaattacttatccgtcgctctcttaacgtcctcttccgccccgccctaccgtcctctatcaaaactcgcgaactcttcttacacccctaccgctcttccctaaaaacctctcgactatttatatttctcacttaaactttttttaactctaaataaaata

SEQ ID NO: 30597 - DNA, 574 bp, Artificial Sequence
  chemically treated genomic DNA (Homo sapiens) CpG-island No: 30597
agggcggaagcggggagaaggcggattcgggaggcggggatacgttacgtcgacgcgggcgtgattttgggcgagagggtttggcgggaattttgaaagtcgttggcggatcgcgcgtagcggttagagatcgagttttaaggagagtgcggcgtttttcgaggcgtgtagttgggaattgtaatttatttgggttgtgcgtagaaggttggggtaagcgagtagagaagtggagcgtaagttaggggcgttgggggtcgtgcgggtcgggcgcgtgttacgttcgcggggtgaagtcggagcgcggggtttgttggagagaggagcgttgcggatcgaggtgagtgtgtgaggcgtaggttgggttttttagagtcgcggttcgttttcgtttatttgcgttttggtcggtttagtgtttagcggtagttggggttttcgcgcgtagtgtgaaattcggacgtggtagggcgtgttcgcgttcgatcgatttttagttgttggggcgaaaatataagtggattttagtttttagaattaggggagaaatattagagtttttataggtaatatt

SEQ ID NO: 30598 - DNA, 574 bp, Artificial Sequence
  chemically treated genomic DNA (Homo sapiens) CpG-island No: 30598
aatattacctataaaaactctaatatttctcccctaattctaaaaactaaaatccacttatattttcgccccaacaactaaaaatcgatcgaacgcgaacacgccctaccacgtccgaatttcacactacgcgcgaaaaccccaactaccgctaaacactaaaccgaccaaaacgcaaataaacgaaaacgaaccgcgactctaaaaaacccaacctacgcctcacacactcacctcgatccgcaacgctcctctctccaacaaaccccgcgctccgacttcaccccgcgaacgtaacacgcgcccgacccgcacgacccccaacgcccctaacttacgctccacttctctactcgcttaccccaaccttctacgcacaacccaaataaattacaattcccaactacacgcctcgaaaaacgccgcactctccttaaaactcgatctctaaccgctacgcgcgatccgccaacgactttcaaaattcccgccaaaccctctcgcccaaaatcacgcccgcgtcgacgtaacgtatccccgcctcccgaatccgccttctccccgcttccgccct

SEQ ID NO: 30599 - DNA, 574 bp, Artificial Sequence
  chemically treated genomic DNA (Homo sapiens) CpG-island No: 30599
ggtgttgtttataaaggttttaatgttttttttttagttttaaagattgaggtttatttgtgttttcgttttagtagttgagggtcggtcgggcgcggatacgttttgttacgttcgggttttatattgcgcgcggaggttttaattgtcgttgagtattggatcggttaggacgtaggtgggcgaggacgagtcgcggttttggagggtttagtttgcgttttatatatttatttcggttcgtagcgtttttttttttagtaggtttcgcgtttcgattttatttcgcgggcgtggtacgcgttcgattcgtacggtttttaacgtttttggtttacgttttatttttttattcgtttgttttagttttttgcgtataatttagatgagttgtagtttttagttgtacgtttcgggaagcgtcgtattttttttagggttcggtttttggtcgttgcgcgcggttcgttagcggtttttagaattttcgttaaattttttcgtttagggttacgttcgcgtcgacgtaacgtattttcgtttttcggattcgtttttttttcgttttcgtttt

SEQ ID NO: 30600 - DNA, 574 bp, Artificial Sequence
  chemically treated genomic DNA (Homo sapiens) CpG-island No: 30600
aaaacgaaaacgaaaaaaaaacgaatccgaaaaacgaaaatacgttacgtcgacgcgaacgtaaccctaaacgaaaaaatttaacgaaaattctaaaaaccgctaacgaaccgcgcgcaacgaccaaaaaccgaaccctaaaaaaaatacgacgcttcccgaaacgtacaactaaaaactacaactcatctaaattatacgcaaaaaactaaaacaaacgaataaaaaaataaaacgtaaaccaaaaacgttaaaaaccgtacgaatcgaacgcgtaccacgcccgcgaaataaaatcgaaacgcgaaacctactaaaaaaaaaaacgctacgaaccgaaataaatatataaaacgcaaactaaaccctccaaaaccgcgactcgtcctcgcccacctacgtcctaaccgatccaatactcaacgacaattaaaacctccgcgcgcaatataaaacccgaacgtaacaaaacgtatccgcgcccgaccgaccctcaactactaaaacgaaaacacaaataaacctcaatctttaaaactaaaaaaaaaacattaaaacctttataaacaacacc

SEQ ID NO: 30601 - DNA, 511 bp, Artificial Sequence
  chemically treated genomic DNA (Homo sapiens) CpG-island No: 30601
tatttttttttttcgtttttcgggattcgggtgtttaatttatttttttttattttcgcgcgttcggtggttttcgggtcggggttttatcgtttggttcggtcgggaattgttcggttttttcgtttttattttttaatacgaagtggcgtcggttggtttttttttttacgttgttagattttacgtcgtcgtttattgatgtcgaaagcggtttttaggaatacgttatgtttggcgtcgtagttttaaacgacgcggacgcgcgaaaattacgttataggagattagcgcgtatgcgatcggtagagagagaaggcgataggcgaacggcgggaaggggaaggaggggttttgtttttgaattaaaaggcgcggggtatttaaattagttgtgtgcgtttgcgtagtgcgtttgcgtagtataaagagttaggagttcggattagtcggatttgttattatggaaattataggtttggttttttcgatttttagggagtttaattgt

SEQ ID NO: 30602 - DNA, 511 bp, Artificial Sequence
  chemically treated genomic DNA (Homo sapiens) CpG-island No: 30602
acaattaaactccctaaaaatcgaaaaaaccaaacctataatttccataataacaaatccgactaatccgaactcctaactctttatactacgcaaacgcactacgcaaacgcacacaactaatttaaataccccgcgccttttaattcaaaaacaaaacccctccttccccttcccgccgttcgcctatcgccttctctctctaccgatcgcatacgcgctaatctcctataacgtaattttcgcgcgtccgcgtcgtttaaaactacgacgccaaacataacgtattcctaaaaaccgctttcgacatcaataaacgacgacgtaaaatctaacaacgtaaaaaaaaaaaccaaccgacgccacttcgtattaaaaaataaaaacgaaaaaaccgaacaattcccgaccgaaccaaacgataaaaccccgacccgaaaaccaccgaacgcgcgaaaataaaaaaaaataaattaaacacccgaatcccgaaaaacgaaaaaaaaaaata

SEQ ID NO: 30603 - DNA, 511 bp, Artificial Sequence
  chemically treated genomic DNA (Homo sapiens) CpG-island No: 30603
ataattgagttttttgggagtcggagaaattagatttatggtttttatggtgatagattcggttagttcggatttttggttttttatattgcgtaagcgtattgcgtaagcgtatataattgatttggatatttcgcgttttttggtttaaagataaagtttttttttttttttttcgtcgttcgtttatcgttttttttttttgtcggtcgtatgcgcgttggttttttgtgacgtagttttcgcgcgttcgcgtcgtttggagttgcgacgttaaatatggcgtgtttttagaagtcgttttcggtattagtaggcggcggcgtggggtttggtagcgtggggagagggattaatcgacgttatttcgtgttgggaagtgggagcgggagggtcgggtaattttcgatcgaattaaacggtgaggtttcggttcgagagttatcgagcgcgcgggagtggaagggagtgggttgggtattcgagtttcgagaggcgagggaggaaagtg

SEQ ID NO: 30604 - DNA, 511 bp, Artificial Sequence
  chemically treated genomic DNA (Homo sapiens) CpG-island No: 30604
cactttcctccctcgcctctcgaaactcgaatacccaacccactcccttccactcccgcgcgctcgataactctcgaaccgaaacctcaccgtttaattcgatcgaaaattacccgaccctcccgctcccacttcccaacacgaaataacgtcgattaatccctctccccacgctaccaaaccccacgccgccgcctactaataccgaaaacgacttctaaaaacacgccatatttaacgtcgcaactccaaacgacgcgaacgcgcgaaaactacgtcacaaaaaaccaacgcgcatacgaccgacaaaaaaaaaaaacgataaacgaacgacgaaaaaaaaaaaaaaaaactttatctttaaaccaaaaaacgcgaaatatccaaatcaattatatacgcttacgcaatacgcttacgcaatataaaaaaccaaaaatccgaactaaccgaatctatcaccataaaaaccataaatctaatttctccgactcccaaaaaactcaattat

SEQ ID NO: 30605 - DNA, 613 bp, Artificial Sequence
  chemically treated genomic DNA (Homo sapiens) CpG-island No: 30605
attcgggaagtgattcgtttggtttaagacgtcgaggtggagttggagcggtagcgtgggttgttgtagtagatcggggatgttttgtcgagttagcgggggagggtgtttatcgcggtttttttcgtttagtcgcgtgtgtttgtgatttttcgcgtcggcggtgatttttattttggttatcgtttgtgatcgtagtattgttcggcgttgtttggataagttgttgtattatcggttttcggttgagtttttttttattatcgttagttaggattgcgggtacgaggagacggtttaggttatcgttttttacggtagcgcggttacgtatattcggtagttcgatttgagtagtattgcggtgtcgtcggattatcgtaagttttaggttattataagatcgcgcgttattatcgttgggcgttgggttaggtttttcggtagtttcgttttttcgcggtcgtggtggtggaggatgatttggaggtggtttcggattttttcgagtattttcgggttatttattcgttgttgaaggtcgatttttttttgtggtgcgtttcggtttggaatgataacggtaaggagtagatggtggacgttagtaggt

SEQ ID NO: 30606 - DNA, 613 bp, Artificial Sequence
  chemically treated genomic DNA (Homo sapiens) CpG-island No: 30606
acctactaacgtccaccatctactccttaccgttatcattccaaaccgaaacgcaccacaaaaaaaaatcgaccttcaacaacgaataaataacccgaaaatactcgaaaaaatccgaaaccacctccaaatcatcctccaccaccacgaccgcgaaaaaacgaaactaccgaaaaacctaacccaacgcccaacgataataacgcgcgatcttataataacctaaaacttacgataatccgacgacaccgcaatactactcaaatcgaactaccgaatatacgtaaccgcgctaccgtaaaaaacgataacctaaaccgtctcctcgtacccgcaatcctaactaacgataataaaaaaaaactcaaccgaaaaccgataatacaacaacttatccaaacaacgccgaacaatactacgatcacaaacgataaccaaaataaaaatcaccgccgacgcgaaaaatcacaaacacacgcgactaaacgaaaaaaaccgcgataaacaccctcccccgctaactcgacaaaacatccccgatctactacaacaacccacgctaccgctccaactccacctcgacgtcttaaaccaaacgaatcacttcccgaat

SEQ ID NO: 30607 - DNA, 613 bp, Artificial Sequence
  chemically treated genomic DNA (Homo sapiens) CpG-island No: 30607
gtttgttggcgtttattatttgttttttgtcgttgttattttaggtcgagacgtattatagggaggggtcggtttttagtagcggataggtggttcgaaagtattcgaagaagttcggggttatttttaggttattttttattattacggtcgcggggaagcgaaattgtcggaagatttggtttagcgtttagcggtagtggcgcgcgattttgtagtagtttggaatttgcggtggttcggcggtatcgtaatgttgtttaggtcgggttgtcggatgtgcgtgatcgcgttgtcgtaggaggcgatggtttgggtcgttttttcgtgttcgtagttttggttaacgatgatggggaagagtttagtcgagggtcgataatgtagtagtttgtttaggtagcgtcgaatagtgttgcggttataggcgatgattaggatgggaattatcgtcggcgcggggggttataggtatacgcggttgggcgggaggggtcgcggtgggtattttttttcgttggttcgatagggtattttcgatttgttgtagtagtttacgttgtcgttttagttttatttcggcgttttgggttaggcgaattatttttcgggt

SEQ ID NO: 30608 - DNA, 613 bp, Artificial Sequence
  chemically treated genomic DNA (Homo sapiens) CpG-island No: 30608
acccgaaaaataattcgcctaacccaaaacgccgaaataaaactaaaacgacaacgtaaactactacaacaaatcgaaaataccctatcgaaccaacgaaaaaaaatacccaccgcgacccctcccgcccaaccgcgtatacctataaccccccgcgccgacgataattcccatcctaatcatcgcctataaccgcaacactattcgacgctacctaaacaaactactacattatcgaccctcgactaaactcttccccatcatcgttaaccaaaactacgaacacgaaaaaacgacccaaaccatcgcctcctacgacaacgcgatcacgcacatccgacaacccgacctaaacaacattacgataccgccgaaccaccgcaaattccaaactactacaaaatcgcgcgccactaccgctaaacgctaaaccaaatcttccgacaatttcgcttccccgcgaccgtaataataaaaaataacctaaaaataaccccgaacttcttcgaatactttcgaaccacctatccgctactaaaaaccgacccctccctataatacgtctcgacctaaaataacaacgacaaaaaacaaataataaacgccaacaaac

SEQ ID NO: 30609 - DNA, 656 bp, Artificial Sequence
  chemically treated genomic DNA (Homo sapiens) CpG-island No: 30609
tggggttagattgtggtacggcgattattaacggcgcggcgttttgttttggtaacgtcgtgcgtcgcggtaatatcggtattgttggcgtattcggtatcggtagttaggagttgagcgttcgtatttatgaatttggcggcggcgtttcgtaattgattggtatcggcgggcgcgatttgagcgagaaaatcggcggtttgatgatgttcgacgttatcgggatgttggaaaacgattcgtaaattgaaattattgcgtttatttttaaatcgtttgcgtttgcggtggttcgtaaagtgttggaacgtgcgcgcgtttgtcgtaagtcggtggtcgtttgttttttcgatcgtggcgaaacgttagtggatgagtaggggttatagtttgttcgcggtattaaagaggtagcgttaaaagcggtgatgtttttcggcgtgaaataggaaaatttcgatttgtatacgtttaattagtcgttgattgcggatgtgcgtgcgcgtttgtaatcgtagtagaaatatattcgtggtttgttttgcggcggtacgttgtgcgacgaaattatgttcgcggtgatggaaaaatatggcgatgtttatagtaatatttagttcgattcggaatttcgtttgaaagatattaatcgtagt

SEQ ID NO: 30610 - DNA, 656 bp, Artificial Sequence
  chemically treated genomic DNA (Homo sapiens) CpG-island No: 30610
actacgattaatatctttcaaacgaaattccgaatcgaactaaatattactataaacatcgccatatttttccatcaccgcgaacataatttcgtcgcacaacgtaccgccgcaaaacaaaccacgaatatatttctactacgattacaaacgcgcacgcacatccgcaatcaacgactaattaaacgtatacaaatcgaaattttcctatttcacgccgaaaaacatcaccgcttttaacgctacctctttaataccgcgaacaaactataacccctactcatccactaacgtttcgccacgatcgaaaaaacaaacgaccaccgacttacgacaaacgcgcgcacgttccaacactttacgaaccaccgcaaacgcaaacgatttaaaaataaacgcaataatttcaatttacgaatcgttttccaacatcccgataacgtcgaacatcatcaaaccgccgattttctcgctcaaatcgcgcccgccgataccaatcaattacgaaacgccgccgccaaattcataaatacgaacgctcaactcctaactaccgataccgaatacgccaacaataccgatattaccgcgacgcacgacgttaccaaaacaaaacgccgcgccgttaataatcgccgtaccacaatctaacccca

SEQ ID NO: 30611 - DNA, 656 bp, Artificial Sequence
  chemically treated genomic DNA (Homo sapiens) CpG-island No: 30611
gttgcggttgatattttttaggcggaatttcggatcgggttgaatgttgttgtagatatcgttatgtttttttattatcgcgaatatggtttcgtcgtatagcgtgtcgtcgtagaataggttacgaatgtatttttgttgcggttgtagacgcgtacgtatattcgtaattaacggttggttaagcgtatgtaggtcgagatttttttgttttacgtcggagagtattatcgtttttagcgttgtttttttggtgtcgcgggtaaattgtagtttttgtttatttattggcgtttcgttacgatcgaggaagtagacgattatcggtttgcggtaggcgcgcgtacgttttagtattttgcgggttatcgtaggcgtaggcggtttggagataagcgtaatgattttagtttgcggatcgttttttagtatttcgatggcgtcgagtattattaggtcgtcgattttttcgtttaggtcgcgttcgtcggtgttaattagttgcgaaacgtcgtcgttaaatttatgaatgcggacgtttaatttttgattgtcggtgtcggatgcgttaataatatcgatgttgtcgcgacgtacggcgttattaaaatagagcgtcgcgtcgttgataatcgtcgtgttatagtttggtttta

SEQ ID NO: 30612 - DNA, 656 bp, Artificial Sequence
  chemically treated genomic DNA (Homo sapiens) CpG-island No: 30612
taaaaccaaactataacacgacgattatcaacgacgcgacgctctattttaataacgccgtacgtcgcgacaacatcgatattattaacgcatccgacaccgacaatcaaaaattaaacgtccgcattcataaatttaacgacgacgtttcgcaactaattaacaccgacgaacgcgacctaaacgaaaaaatcgacgacctaataatactcgacgccatcgaaatactaaaaaacgatccgcaaactaaaatcattacgcttatctccaaaccgcctacgcctacgataacccgcaaaatactaaaacgtacgcgcgcctaccgcaaaccgataatcgtctacttcctcgatcgtaacgaaacgccaataaataaacaaaaactacaatttacccgcgacaccaaaaaaacaacgctaaaaacgataatactctccgacgtaaaacaaaaaaatctcgacctacatacgcttaaccaaccgttaattacgaatatacgtacgcgtctacaaccgcaacaaaaatacattcgtaacctattctacgacgacacgctatacgacgaaaccatattcgcgataataaaaaaacataacgatatctacaacaacattcaacccgatccgaaattccgcctaaaaaatatcaaccgcaac

SEQ ID NO: 30613 - DNA, 697 bp, Artificial Sequence
  chemically treated genomic DNA (Homo sapiens) CpG-island No: 30613
gaaatttacgtaaagtcggaattgtttgcgttatatttacgttatcgttaacgtatagtatcggtttttgcgtttttgttagtatttggcgcgtttgtttaatttcggtatgtgggaaagttatttcgtttttaacggtggtgaattacggttttaggttatcgttggttaattggatattttttgggatatcgattagaatcggattaggacgatttgagtaggtaacgtcgaatgttttagttatgatgcgcggtaatttttttagcgattgtattagaaagttgtgtttggtataggttaacgataattttaggatatttattttttgaaatgcgttagtgtcgataacggtgcggatatttgatcggtgatggtaataatagggatggaatttaatagtgcgttcgtaagttcggttattaggttggttgcgttcggattagacgtggcgatatatacgttagttttgtcggtagtacgagtatatcgatagtcgttattgtcgtattttgtttatgtcggtatagtaagtgttttacgtcgtcgttatataatgtatcgtaaatcggtataattgcgttattcggataatcgaaaacggtgtttatattttgtgttcgtaacgtatgtattatttattgtgcgttatttatagttagtttttcgttttgaattttgagaaatagaattttgt

SEQ ID NO: 30614 - DNA, 697 bp, Artificial Sequence
  chemically treated genomic DNA (Homo sapiens) CpG-island No: 30614
acaaaattctatttctcaaaattcaaaacgaaaaactaactataaataacgcacaataaataatacatacgttacgaacacaaaatataaacaccgttttcgattatccgaataacgcaattataccgatttacgatacattatataacgacgacgtaaaacacttactataccgacataaacaaaatacgacaataacgactatcgatatactcgtactaccgacaaaactaacgtatatatcgccacgtctaatccgaacgcaaccaacctaataaccgaacttacgaacgcactattaaattccatccctattattaccatcaccgatcaaatatccgcaccgttatcgacactaacgcatttcaaaaaataaatatcctaaaattatcgttaacctataccaaacacaactttctaatacaatcgctaaaaaaattaccgcgcatcataactaaaacattcgacgttacctactcaaatcgtcctaatccgattctaatcgatatcccaaaaaatatccaattaaccaacgataacctaaaaccgtaattcaccaccgttaaaaacgaaataactttcccacataccgaaattaaacaaacgcgccaaatactaacaaaaacgcaaaaaccgatactatacgttaacgataacgtaaatataacgcaaacaattccgactttacgtaaatttc

SEQ ID NO: 30615 - DNA, 697 bp, Artificial Sequence
  chemically treated genomic DNA (Homo sapiens) CpG-island No: 30615
ataaaattttgttttttaagatttaggacggggaattaattatgaatggcgtatagtgggtggtatatgcgttgcgggtatagggtgtgaatatcgttttcggttattcgggtggcgtaattatgtcggtttacgatgtattgtatgacggcggcgtggagtatttgttatgtcgatatgagtagggtgcggtaatggcggttatcggtatgttcgtgttatcggtaaaattggcgtatgtatcgttacgtttggttcgggcgtaattaatttgataatcgggtttgcgaacgtattgttagattttatttttgttgttgttattatcggttaagtgttcgtatcgttatcggtattgacgtattttaggaagtggatgttttgggattgtcgttagtttgtattaagtatagttttttggtgtagtcgttggaagagttgtcgcgtattatggttgaagtattcgacgttgtttgtttaggtcgttttggttcggttttggtcgatattttaaaagatatttagttagttagcggtgatttggaatcgtggtttattatcgttgaaaacgaagtgatttttttatatgtcgaagttgagtaagcgcgttagatgttggtaaaagcgtaaaaatcgatgttgtacgttggcggtggcgtgggtatggcgtaggtagtttcggttttgcgtgaatttt

SEQ ID NO: 30616 - DNA, 697 bp, Artificial Sequence
  chemically treated genomic DNA (Homo sapiens) CpG-island No: 30616
aaaattcacgcaaaaccgaaactacctacgccatacccacgccaccgccaacgtacaacatcgatttttacgcttttaccaacatctaacgcgcttactcaacttcgacatataaaaaaatcacttcgttttcaacgataataaaccacgattccaaatcaccgctaactaactaaatatcttttaaaatatcgaccaaaaccgaaccaaaacgacctaaacaaacaacgtcgaatacttcaaccataatacgcgacaactcttccaacgactacaccaaaaaactatacttaatacaaactaacgacaatcccaaaacatccacttcctaaaatacgtcaataccgataacgatacgaacacttaaccgataataacaacaacaaaaataaaatctaacaatacgttcgcaaacccgattatcaaattaattacgcccgaaccaaacgtaacgatacatacgccaattttaccgataacacgaacataccgataaccgccattaccgcaccctactcatatcgacataacaaatactccacgccgccgtcatacaatacatcgtaaaccgacataattacgccacccgaataaccgaaaacgatattcacaccctatacccgcaacgcatataccacccactatacgccattcataattaattccccgtcctaaatcttaaaaaacaaaattttat

SEQ ID NO: 30617 - DNA, 501 bp, Artificial Sequence
  chemically treated genomic DNA (Homo sapiens) CpG-island No: 30617
tatgttttttcgttggttggcgaaaatattattttttcgttatatatttagcgtaattattcggagttgtaaaaacggttgaatggttggttgtcggcggcgttgaaaacggcgcgtattttgatagtttgcgtggcggtaatgttgttgttgagcgtatggggattgttcgatttttggaattggttgtaaaacggcgcggggtagaaaatcgtagatattttgattcgtatcgtatttattttttttttttcggcggttggttggacggtgttcgttagtttgatcgaaaatcggttggtttcggatatttatggtcgttcgttatttagcgttcgtacgcgtattttgtttacgttgtttcgtaacgcgttggcggtgattattagtattattattattatgattgtgttgtcggaaatcggcgttaatatcgcgttattgttggtaggtgtcggggtattaggtttggttatttcgtttggttcgtaaacgttggtg

SEQ ID NO: 30618 - DNA, 501 bp, Artificial Sequence
  chemically treated genomic DNA (Homo sapiens) CpG-island No: 30618
caccaacgtttacgaaccaaacgaaataaccaaacctaataccccgacacctaccaacaataacgcgatattaacgccgatttccgacaacacaatcataataataataatactaataatcaccgccaacgcgttacgaaacaacgtaaacaaaatacgcgtacgaacgctaaataacgaacgaccataaatatccgaaaccaaccgattttcgatcaaactaacgaacaccgtccaaccaaccgccgaaaaaaaaaaaataaatacgatacgaatcaaaatatctacgattttctaccccgcgccgttttacaaccaattccaaaaatcgaacaatccccatacgctcaacaacaacattaccgccacgcaaactatcaaaatacgcgccgttttcaacgccgccgacaaccaaccattcaaccgtttttacaactccgaataattacgctaaatatataacgaaaaaataatattttcgccaaccaacgaaaaaacata

SEQ ID NO: 30619 - DNA, 501 bp, Artificial Sequence
  chemically treated genomic DNA (Homo sapiens) CpG-island No: 30619
tattagcgtttgcgaattaaacgagatagttagatttaatgtttcggtatttgttagtaatggcgcgatattgacgtcgattttcgataatataattatgatggtgatggtattgataattatcgttagcgcgttacgaaatagcgtaagtagggtacgcgtgcgggcgttgggtagcgggcggttatgaatattcgaagttagtcggttttcgattaaattggcgagtatcgtttagttaatcgtcgagaagaaaagaatgagtgcgatacggattaggatatttacggttttttgtttcgcgtcgttttgtagttagttttagaaatcgaataatttttatgcgtttaatagtaatattatcgttacgtagattgttagaatacgcgtcgtttttagcgtcgtcgatagttagttatttaatcgtttttgtagtttcggatagttacgttgagtatgtggcgagagagtgatgttttcgttagttagcgggaaaatata

SEQ ID NO: 30620 - DNA, 501 bp, Artificial Sequence
  chemically treated genomic DNA (Homo sapiens) CpG-island No: 30620
tatattttcccgctaactaacgaaaacatcactctctcgccacatactcaacgtaactatccgaaactacaaaaacgattaaataactaactatcgacgacgctaaaaacgacgcgtattctaacaatctacgtaacgataatattactattaaacgcataaaaattattcgatttctaaaactaactacaaaacgacgcgaaacaaaaaaccgtaaatatcctaatccgtatcgcactcattcttttcttctcgacgattaactaaacgatactcgccaatttaatcgaaaaccgactaacttcgaatattcataaccgcccgctacccaacgcccgcacgcgtaccctacttacgctatttcgtaacgcgctaacgataattatcaataccatcaccatcataattatattatcgaaaatcgacgtcaatatcgcgccattactaacaaataccgaaacattaaatctaactatctcgtttaattcgcaaacgctaata

SEQ ID NO: 30621 - DNA, 568 bp, Artificial Sequence
  chemically treated genomic DNA (Homo sapiens) CpG-island No: 30621
ttagatgtttgatgcgacgtttgcgcgttttattaggtttataattattgtcgattttgtgaggtttggattgaaggtattttgtgttcgtatgtcgtgtaattaatgtttgatgcgacgttgtgcgcgtgtttatgtaggttataattgttgtcgattttgtaggtcggataaggtatttgtgtcgtattcggtaattaatgtttgatgcgacgtttgacgcgttttattaggtttataatcggtgtcgtattcggtaattggtgtataatgtttgatgcgatgtttgacgtattttattaggtttataatgggtatcggatcggtaggtcggataaggcgtttacgtcgtattcggtaagaatagagtattagttaatcgaatttattttgcgtttaaattacgtcgttggtatatttcggcggtagtagcgggattaaggtttttagcgtcgtagttagacgcgatgtgtcgttgtcggttaaatttagatgttttattttacgtttcggacggatttttttgtcgtattagtgtagatgtattagcggtagttttagttagtta

SEQ ID NO: 30622 - DNA, 568 bp, Artificial Sequence
  chemically treated genomic DNA (Homo sapiens) CpG-island No: 30622
taactaactaaaactaccgctaatacatctacactaatacgacaaaaaaatccgtccgaaacgtaaaataaaacatctaaatttaaccgacaacgacacatcgcgtctaactacgacgctaaaaaccttaatcccgctactaccgccgaaatataccaacgacgtaatttaaacgcaaaataaattcgattaactaatactctattcttaccgaatacgacgtaaacgccttatccgacctaccgatccgatacccattataaacctaataaaatacgtcaaacatcgcatcaaacattatacaccaattaccgaatacgacaccgattataaacctaataaaacgcgtcaaacgtcgcatcaaacattaattaccgaatacgacacaaataccttatccgacctacaaaatcgacaacaattataacctacataaacacgcgcacaacgtcgcatcaaacattaattacacgacatacgaacacaaaataccttcaatccaaacctcacaaaatcgacaataattataaacctaataaaacgcgcaaacgtcgcatcaaacatctaa

SEQ ID NO: 30623 - DNA, 568 bp, Artificial Sequence
  chemically treated genomic DNA (Homo sapiens) CpG-island No: 30623
tgattggttgaaattgtcgttggtgtatttgtattggtacgataaagaagttcgttcggggcgtaaagtggggtatttgaatttgatcgatagcgatatatcgcgtttgattgcgacgttggaagttttaatttcgttgttgtcgtcggaatatgttagcggcgtgatttgggcgtagagtaagttcggttaattggtgttttatttttgtcggatgcggcgtaaacgttttattcggtttatcgattcggtatttattgtaggtttgataagatgcgttaagtatcgtattaggtattgtgtattaattgtcggatgcggtatcggttgtaggtttgataagacgcgttaagcgtcgtattaggtattgattgtcggatgcggtataagtgttttattcggtttataggatcggtaatagttgtagtttgtataagtacgcgtatagcgtcgtattaggtattgattgtacggtatgcggatataaagtgtttttagtttaggttttatagagtcggtaataattgtaggtttgataagacgcgtaagcgtcgtattaggtatttgg

SEQ ID NO: 30624 - DNA, 568 bp, Artificial Sequence
  chemically treated genomic DNA (Homo sapiens) CpG-island No: 30624
ccaaatacctaatacgacgcttacgcgtcttatcaaacctacaattattaccgactctataaaacctaaactaaaaacactttatatccgcataccgtacaatcaatacctaatacgacgctatacgcgtacttatacaaactacaactattaccgatcctataaaccgaataaaacacttataccgcatccgacaatcaatacctaatacgacgcttaacgcgtcttatcaaacctacaaccgataccgcatccgacaattaatacacaatacctaatacgatacttaacgcatcttatcaaacctacaataaataccgaatcgataaaccgaataaaacgtttacgccgcatccgacaaaaataaaacaccaattaaccgaacttactctacgcccaaatcacgccgctaacatattccgacgacaacaacgaaattaaaacttccaacgtcgcaatcaaacgcgatatatcgctatcgatcaaattcaaataccccactttacgccccgaacgaacttctttatcgtaccaatacaaatacaccaacgacaatttcaaccaatca

SEQ ID NO: 30625 - DNA, 520 bp, Artificial Sequence
  chemically treated genomic DNA (Homo sapiens) CpG-island No: 30625
atcgttagcgcggtcggatttggcggttagttgatggtattgacgtcgttttgggagtagggtgttatcgttgtttgtggttagataattaggagttagaacgtaattgtcgtacggcgggcgtggttggttcggtggtcggggttatgggtattttgtaggtattggaagttattaagttattaagcggtatagagatatttgcgggagaatttcgattgttcgacggtaaatcgagttagtggcgtagtttggcgttgcgtcgcgttagtggttgttcggtatgcggaggaagtaatgtagattttgtttaacgattaagcgatgtagtgcgtcgtcgggtaaattgtttacgaattattggagtaattcgattaacgataagcgggcgcggttttggcgattaattagtaaatcgtttcgcgtgagtagtgggcgtaatatatcgtgtaggatggcgattagattttgtttttttaggttattgtagggggttgaaatgttacgtattgcggataaa

SEQ ID NO: 30626 - DNA, 520 bp, Artificial Sequence
  chemically treated genomic DNA (Homo sapiens) CpG-island No: 30626
tttatccgcaatacgtaacatttcaaccccctacaataacctaaaaaaacaaaatctaatcgccatcctacacgatatattacgcccactactcacgcgaaacgatttactaattaatcgccaaaaccgcgcccgcttatcgttaatcgaattactccaataattcgtaaacaatttacccgacgacgcactacatcgcttaatcgttaaacaaaatctacattacttcctccgcataccgaacaaccactaacgcgacgcaacgccaaactacgccactaactcgatttaccgtcgaacaatcgaaattctcccgcaaatatctctataccgcttaataacttaataacttccaatacctacaaaatacccataaccccgaccaccgaaccaaccacgcccgccgtacgacaattacgttctaactcctaattatctaaccacaaacaacgataacaccctactcccaaaacgacgtcaataccatcaactaaccgccaaatccgaccgcgctaacgat

SEQ ID NO: 30627 - DNA, 520 bp, Artificial Sequence
  chemically treated genomic DNA (Homo sapiens) CpG-island No: 30627
tttgttcgtaatacgtaatattttaattttttgtaataatttgaaaaagtaggatttggtcgttattttgtacgatatgttgcgtttattgtttacgcgggacgatttgttgattaatcgttagagtcgcgttcgtttgtcgttggtcgagttgttttagtagttcgtgaatagtttgttcggcggcgtattgtatcgtttgatcgttaaataggatttgtattgtttttttcgtatatcgggtaattattggcgcggcgtaacgttaggttgcgttattggttcgatttatcgtcgaatagtcggagttttttcgtaggtgtttttatatcgtttaataatttaatggtttttagtgtttgtaaagtgtttataatttcgattatcgggttaattacgttcgtcgtgcggtagttgcgttttggtttttggttatttggttataggtagcggtaatattttgtttttagggcggcgttagtattattaattgatcgttaaattcgatcgcgttggcggt

SEQ ID NO: 30628 - DNA, 520 bp, Artificial Sequence
  chemically treated genomic DNA (Homo sapiens) CpG-island No: 30628
accgccaacgcgatcgaatttaacgatcaattaataatactaacgccgccctaaaaacaaaatattaccgctacctataaccaaataaccaaaaaccaaaacgcaactaccgcacgacgaacgtaattaacccgataatcgaaattataaacactttacaaacactaaaaaccattaaattattaaacgatataaaaacacctacgaaaaaactccgactattcgacgataaatcgaaccaataacgcaacctaacgttacgccgcgccaataattacccgatatacgaaaaaaacaatacaaatcctatttaacgatcaaacgatacaatacgccgccgaacaaactattcacgaactactaaaacaactcgaccaacgacaaacgaacgcgactctaacgattaatcaacaaatcgtcccgcgtaaacaataaacgcaacatatcgtacaaaataacgaccaaatcctactttttcaaattattacaaaaaattaaaatattacgtattacgaacaaa

SEQ ID NO: 30629 - DNA, 512 bp, Artificial Sequence
  chemically treated genomic DNA (Homo sapiens) CpG-island No: 30629
tcgcgcgagcgtcgcgtagtcgaggaagtcgtttcgagcggttgtttatcgtacgtttatggtagtcgcgtcgcgcgtcggtcgtttgcgttttcgttttttttcgtcgtcgtcggttcgcgtttttcgcgttttcggtttcgcgttttgttgtttcggggttgtcgcgcgcgtcgttttcgtttttttagcgtttttttttttggttcgattcggtcgagcgagcggtcgcgtttacgtttttttcgcgttttttcgcgttcgtttcgttttcggttcgcgtttgttttcgtcgggtattttttcgttcgtttttttttgcgcgttttggttttattcgcgcgggttttttttttttttcgttgtattagcgtcgggatgaagtcgggagtaaagtttttttcggggcggtttagcgtttattttcggcgagtatttaaggtgtcgttgttgttggggtcgtttttatattttaaattatttagtaagtgttgggcgagaggatggggagt

SEQ ID NO: 30630 - DNA, 512 bp, Artificial Sequence
  chemically treated genomic DNA (Homo sapiens) CpG-island No: 30630
actccccatcctctcgcccaacacttactaaataatttaaaatataaaaacgaccccaacaacaacgacaccttaaatactcgccgaaaataaacgctaaaccgccccgaaaaaaactttactcccgacttcatcccgacgctaatacaacgaaaaaaaaaaaaaacccgcgcgaataaaaccaaaacgcgcaaaaaaaaacgaacgaaaaaatacccgacgaaaacaaacgcgaaccgaaaacgaaacgaacgcgaaaaaacgcgaaaaaaacgtaaacgcgaccgctcgctcgaccgaatcgaaccaaaaaaaaaaacgctaaaaaaacgaaaacgacgcgcgcgacaaccccgaaacaacaaaacgcgaaaccgaaaacgcgaaaaacgcgaaccgacgacgacgaaaaaaaacgaaaacgcaaacgaccgacgcgcgacgcgactaccataaacgtacgataaacaaccgctcgaaacgacttcctcgactacgcgacgctcgcgcga

SEQ ID NO: 30631 - DNA, 512 bp, Artificial Sequence
  chemically treated genomic DNA (Homo sapiens) CpG-island No: 30631
gttttttattttttcgtttaatatttgttaggtagtttggggtgtagaagcgattttagtagtagcggtattttaggtgttcgtcgaaggtgaacgttggatcgtttcgggaagggttttgttttcgattttatttcgacgttggtgtaacgggaaaaagagagagttcgcgcgagtggggttagggcgcgtaggagagggcgggcgagaaagtgttcggcgagggtaggcgcgggtcgagggcggggcgggcgcgggagggcgcgagaggggcgtgggcgcggtcgttcgttcggtcgggtcgggttagggggaggggcgttgggagagcgagagcggcgcgcgcggtagtttcgaggtagtagagcgcggagtcgggagcgcggggagcgcgggtcggcggcggcgagggaggacgggggcgtagacggtcggcgcgcggcgcggttattatgggcgtgcggtgagtagtcgttcgggacgattttttcggttgcgcggcgttcgcgcgg

SEQ ID NO: 30632 - DNA, 512 bp, Artificial Sequence
  chemically treated genomic DNA (Homo sapiens) CpG-island No: 30632
ccgcgcgaacgccgcgcaaccgaaaaaatcgtcccgaacgactactcaccgcacgcccataataaccgcgccgcgcgccgaccgtctacgcccccgtcctccctcgccgccgccgacccgcgctccccgcgctcccgactccgcgctctactacctcgaaactaccgcgcgcgccgctctcgctctcccaacgcccctccccctaacccgacccgaccgaacgaacgaccgcgcccacgcccctctcgcgccctcccgcgcccgccccgccctcgacccgcgcctaccctcgccgaacactttctcgcccgccctctcctacgcgccctaaccccactcgcgcgaactctctctttttcccgttacaccaacgtcgaaataaaatcgaaaacaaaacccttcccgaaacgatccaacgttcaccttcgacgaacacctaaaataccgctactactaaaatcgcttctacaccccaaactacctaacaaatattaaacgaaaaaataaaaaac

SEQ ID NO: 30633 - DNA, 982 bp, Artificial Sequence
  chemically treated genomic DNA (Homo sapiens) CpG-island No: 30633
ggagtggttaattgggagatattaaacgcggtaagggaggagagcgtaacgtgtttgcggggtcgggcggttcggcggtcgcgaatgattttcggcggagtagggttagcgttttcgtgtggtagcgggcgcgtggtcgaggttcgaggagggttcggaggtttggtcgaggttcgaggaggggttcggaggtttggtcgaggttcgaggaggggttcggaggtttggtcgaggttcgaggaggggttcggaggtttggtcgaggttcgaggaggggttcggaggtttggtcgaggttcgaggaggggttcggaggtttggtcgaggttcgaggaggggttcggaggtttggtcgaggttcgaggaggggttcggaggtttggtcgaggttcgaggaggggttcggaggtttggtcgaggttcgaggagggttcggaggtttggtcgaggttcgaggaggggttcggaggtttggtcgaggttcgaggaggggttcggaggtttggtcgaggttcgaggaggggttcggaggtttggtcgaggttcgaggagggttcggaggtttggtcgaggttcgaggaggggttcggaggtttggtcgaggttcgaggaggggttcggaggtttggtcgaggttcgaggaggggttcggaggtttggtcgaggttcgaggagggttcggaggtttggtcgaggttcgaggagggttcggaggtttggtcgaggttcgaggaggggttcggaggtttggtcgaggttcgaggaggggttcggaggtttggtcgaggttcgaggaggggttcggaggtttggtcgaggttcgaggaggggttcggaggtttggtcgaggttcgaggaggggtttggaggtttggtcgaggttcgaggagggttcggaggtttgaaagcgtagattgtagggtagattattgtaggatttaggcgttgacgaataggaaagagggtgggaagtaagagaaga

SEQ ID NO: 30634 - DNA, 982 bp, Artificial Sequence
  chemically treated genomic DNA (Homo sapiens) CpG-island No: 30634
tcttctcttacttcccaccctctttcctattcgtcaacgcctaaatcctacaataatctaccctacaatctacgctttcaaacctccgaaccctcctcgaacctcgaccaaacctccaaacccctcctcgaacctcgaccaaacctccgaacccctcctcgaacctcgaccaaacctccgaacccctcctcgaacctcgaccaaacctccgaacccctcctcgaacctcgaccaaacctccgaacccctcctcgaacctcgaccaaacctccgaaccctcctcgaacctcgaccaaacctccgaaccctcctcgaacctcgaccaaacctccgaacccctcctcgaacctcgaccaaacctccgaacccctcctcgaacctcgaccaaacctccgaacccctcctcgaacctcgaccaaacctccgaaccctcctcgaacctcgaccaaacctccgaacccctcctcgaacctcgaccaaacctccgaacccctcctcgaacctcgaccaaacctccgaacccctcctcgaacctcgaccaaacctccgaaccctcctcgaacctcgaccaaacctccgaacccctcctcgaacctcgaccaaacctccgaacccctcctcgaacctcgaccaaacctccgaacccctcctcgaacctcgaccaaacctccgaacccctcctcgaacctcgaccaaacctccgaacccctcctcgaacctcgaccaaacctccgaacccctcctcgaacctcgaccaaacctccgaacccctcctcgaacctcgaccaaacctccgaacccctcctcgaacctcgaccaaacctccgaaccctcctcgaacctcgaccacgcgcccgctaccacacgaaaacgctaaccctactccgccgaaaatcattcgcgaccgccgaaccgcccgaccccgcaaacacgttacgctctcctcccttaccgcgtttaatatctcccaattaaccactcc

SEQ ID NO: 30635 - DNA, 982 bp, Artificial Sequence
  chemically treated genomic DNA (Homo sapiens) CpG-island No: 30635
tttttttttattttttatttttttttttgttcgttagcgtttagattttgtagtagtttgttttgtagtttgcgtttttagattttcggatttttttcggatttcggttagatttttagattttttttcggatttcggttagattttcggattttttttcggatttcggttagattttcggattttttttcggatttcggttagattttcggattttttttcggatttcggttagattttcggattttttttcggatttcggttagattttcgggtttttttcggatttcggttagattttcgggtttttttcggatttcggttagattttcggattttttttcggatttcggttagattttcggattttttttcggatttcggttagattttcggattttttttcggatttcggttagattttcgggtttttttcggatttcggttagattttcggattttttttcggatttcggttagattttcggattttttttcggatttcggttagattttcggattttttttcggatttcggttagattttcgggtttttttcggatttcggttagattttcggattttttttcggatttcggttagattttcggattttttttcggatttcggttagattttcggattttttttcggatttcggttagattttcggattttttttcggatttcggttagattttcgggttttttttcggatttcggttagattttcgggttttttttcggatttcggttagattttcgggttttttttcggatttcggttagattttcgggttttttttcggatttcggttagattttcgggtttttttcggatttcggttacgcgttcgttgttatacgggggcgttgattttgtttcgtcgaaggttattcgcggtcgtcgagtcgttcggtttcgtaggtacgttgcgttttttttttttgtcgcgtttaatgttttttagttgattatttt

SEQ ID NO: 30636 - DNA, 982 bp, Artificial Sequence
  chemically treated genomic DNA (Homo sapiens) CpG-island No: 30636
aaaataatcaactaaaaaacattaaacgcgacaaaaaaaaaaaacgcaacgtacctacgaaaccgaacgactcgacgaccgcgaataaccttcgacgaaacaaaatcaacgcccccgtataacaacgaacgcgtaaccgaaatccgaaaaaaacccgaaaatctaaccgaaatccgaaaaaaaacccgaaaatctaaccgaaatccgaaaaaaaacccgaaaatctaaccgaaatccgaaaaaaaacccgaaaatctaaccgaaatccgaaaaaaaacccgaaaatctaaccgaaatccgaaaaaaaatccgaaaatctaaccgaaatccgaaaaaaaatccgaaaatctaaccgaaatccgaaaaaaaatccgaaaatctaaccgaaatccgaaaaaaaatccgaaaatctaaccgaaatccgaaaaaaacccgaaaatctaaccgaaatccgaaaaaaaatccgaaaatctaaccgaaatccgaaaaaaaatccgaaaatctaaccgaaatccgaaaaaaaatccgaaaatctaaccgaaatccgaaaaaaacccgaaaatctaaccgaaatccgaaaaaaaatccgaaaatctaaccgaaatccgaaaaaaaatccgaaaatctaaccgaaatccgaaaaaaaatccgaaaatctaaccgaaatccgaaaaaaacccgaaaatctaaccgaaatccgaaaaaaacccgaaaatctaaccgaaatccgaaaaaaaatccgaaaatctaaccgaaatccgaaaaaaaatccgaaaatctaaccgaaatccgaaaaaaaatccgaaaatctaaccgaaatccgaaaaaaaatccgaaaatctaaccgaaatccgaaaaaaaatctaaaaatctaaccgaaatccgaaaaaaatccgaaaatctaaaaacgcaaactacaaaacaaactactacaaaatctaaacgctaacgaacaaaaaaaaaaataaaaaataaaaaaaaa

SEQ ID NO: 30637 - DNA, 554 bp, Artificial Sequence
  chemically treated genomic DNA (Homo sapiens) CpG-island No: 30637
cgttgttgagatgcgtggagttgatgataatgtagtaatattttatggggtagtcgtcgtttttttcgtcgtagtcgtcgtttttacgtatttcgcgtttatagtcgtagcgcgtcggggtcggcgacggtgggttgggaattcgttacgagggtacgtagttattttcggtacgttttttggagattggtttattgtatttttttgtggtgagcgtcgaggttttttcgttttcgtatgttcgtcgcgttttttttttagtttttcgtttttgtttttttttagattcgcgtcgggacgacgagtttcgcgggaggattttagtttaggagggggtcgggtcggcgaaacggaatcgagcgggagttagtgttcgcgcggtggtcgggcggagcggggttgcgggagtcgttcgcgcggtagtagaagcggcggcggcggtagtatttttcgcgttcggcgtttgtattcggagttgttgttgttggtaggtatgagtgttattatagtgagcggcgttgtcggtttattgtattgagttaatggtagggagt

SEQ ID NO: 30638 - DNA, 554 bp, Artificial Sequence
  chemically treated genomic DNA (Homo sapiens) CpG-island No: 30638
actccctaccattaactcaatacaataaaccgacaacgccgctcactataataacactcatacctaccaacaacaacaactccgaatacaaacgccgaacgcgaaaaatactaccgccgccgccgcttctactaccgcgcgaacgactcccgcaaccccgctccgcccgaccaccgcgcgaacactaactcccgctcgattccgtttcgccgacccgaccccctcctaaactaaaatcctcccgcgaaactcgtcgtcccgacgcgaatctaaaaaaaaacaaaaacgaaaaactaaaaaaaaaacgcgacgaacatacgaaaacgaaaaaacctcgacgctcaccacaaaaaaatacaataaaccaatctccaaaaaacgtaccgaaaataactacgtaccctcgtaacgaattcccaacccaccgtcgccgaccccgacgcgctacgactataaacgcgaaatacgtaaaaacgacgactacgacgaaaaaaacgacgactaccccataaaatattactacattatcatcaactccacgcatctcaacaacg

SEQ ID NO: 30639 - DNA, 554 bp, Artificial Sequence
  chemically treated genomic DNA (Homo sapiens) CpG-island No: 30639
gttttttgttattggtttagtgtaatggatcggtaacgtcgtttattataataatatttatgtttgttagtagtagtaatttcgagtgtaggcgtcgagcgcgggggatgttgtcgtcgtcgtcgtttttgttgtcgcgcgggcggttttcgtagtttcgtttcgttcggttatcgcgcgggtattgattttcgttcggtttcgtttcgtcggttcggtttttttttaggttggaattttttcgcggggttcgtcgtttcgacgcgaatttgaggagaaataggagcgagagattgaggggagagcgcggcgagtatgcggaggcgggggagtttcggcgtttattatagaggggtgtagtgagttagtttttagaggacgtgtcgggggtggttgcgtgttttcgtggcgggtttttagtttatcgtcgtcggtttcggcgcgttgcggttgtgggcgcggggtgcgtggaagcggcggttgcggcggaggaggcggcggttgttttatggagtgttattatattgttattagttttacgtattttagtaacg

SEQ ID NO: 30640 - DNA, 554 bp, Artificial Sequence
  chemically treated genomic DNA (Homo sapiens) CpG-island No: 30640
cgttactaaaatacgtaaaactaataacaatataataacactccataaaacaaccgccgcctcctccgccgcaaccgccgcttccacgcaccccgcgcccacaaccgcaacgcgccgaaaccgacgacgataaactaaaaacccgccacgaaaacacgcaaccacccccgacacgtcctctaaaaactaactcactacacccctctataataaacgccgaaactcccccgcctccgcatactcgccgcgctctcccctcaatctctcgctcctatttctcctcaaattcgcgtcgaaacgacgaaccccgcgaaaaaattccaacctaaaaaaaaaccgaaccgacgaaacgaaaccgaacgaaaatcaatacccgcgcgataaccgaacgaaacgaaactacgaaaaccgcccgcgcgacaacaaaaacgacgacgacgacaacatcccccgcgctcgacgcctacactcgaaattactactactaacaaacataaatattattataataaacgacgttaccgatccattacactaaaccaataacaaaaaac

SEQ ID NO: 30641 - DNA, 556 bp, Artificial Sequence
  chemically treated genomic DNA (Homo sapiens) CpG-island No: 30641
tttcggtttttgcgtatttggcggcgttcgatttttgcggcggcgttttatttttgcggcgtcgttttttattgtcgttttgtggatttttcgtagtttcgcgttttaggtgtggtattcgggattcgggtattcgtggtcgatggagtaggatcgtttggtttaggcgtttttagaagttgaagcgttttttcgtggtggcgattttttagacgtttaataattcgtttttgagtcgtcgcggttttaggtagtttttttatttcgttttttagttttaaatttgcgatttatttttaaattcgcgatttatttaaaaatcgtaatttatttttaaatttttggtcgtgttattcgtcgtttttttttgacggagttcgggatcgttggttagaagtagttcgtagttatcggggatgggattgagcggtaggttttcgtttttgtgtagtcgtcgtcgggcggatcgtttggttcggtagtagttatagggatatttggttttggtttttagatgttcggagagtaggcgggtttagaggtttttcggaggttg

SEQ ID NO: 30642 - DNA, 556 bp, Artificial Sequence
  chemically treated genomic DNA (Homo sapiens) CpG-island No: 30642
caacctccgaaaaacctctaaacccgcctactctccgaacatctaaaaaccaaaaccaaatatccctataactactaccgaaccaaacgatccgcccgacgacgactacacaaaaacgaaaacctaccgctcaatcccatccccgataactacgaactacttctaaccaacgatcccgaactccgtcaaaaaaaaacgacgaataacacgaccaaaaatttaaaaataaattacgatttttaaataaatcgcgaatttaaaaataaatcgcaaatttaaaactaaaaaacgaaataaaaaaactacctaaaaccgcgacgactcaaaaacgaattattaaacgtctaaaaaatcgccaccacgaaaaaacgcttcaacttctaaaaacgcctaaaccaaacgatcctactccatcgaccacgaatacccgaatcccgaataccacacctaaaacgcgaaactacgaaaaatccacaaaacgacaataaaaaacgacgccgcaaaaataaaacgccgccgcaaaaatcgaacgccgccaaatacgcaaaaaccgaaa

SEQ ID NO: 30643 - DNA, 556 bp, Artificial Sequence
  chemically treated genomic DNA (Homo sapiens) CpG-island No: 30643
tagttttcgggaaatttttaagttcgtttgtttttcgaatatttaagaattaggattagatgtttttgtggttgttgtcgagttaggcggttcgttcgacggcggttgtataggggcgagaatttgtcgtttaattttattttcggtggttgcggattgtttttggttagcggtttcgagtttcgttagaggaggacggcgggtggtacgattagggatttgagggtagattgcggtttttgggtggatcgcggatttgggggtggatcgtagatttagggttgggaggcggggtggaaaggttatttggagtcgcggcggtttaggagcgggttgttgagcgtttgagaagtcgttattacgaggaagcgttttagtttttggagacgtttgggttaggcggttttgttttatcgattacgagtattcggatttcgggtattatatttgggacgcggaattgcggaagatttatagggcggtagtgaggggcgacgtcgtagaggtggagcgtcgtcgtagaggtcgagcgtcgttagatgcgtagaagtcggga

SEQ ID NO: 30644 - DNA, 556 bp, Artificial Sequence
  chemically treated genomic DNA (Homo sapiens) CpG-island No: 30644
tcccgacttctacgcatctaacgacgctcgacctctacgacgacgctccacctctacgacgtcgcccctcactaccgccctataaatcttccgcaattccgcgtcccaaatataatacccgaaatccgaatactcgtaatcgataaaacaaaaccgcctaacccaaacgtctccaaaaactaaaacgcttcctcgtaataacgacttctcaaacgctcaacaacccgctcctaaaccgccgcgactccaaataacctttccaccccgcctcccaaccctaaatctacgatccacccccaaatccgcgatccacccaaaaaccgcaatctaccctcaaatccctaatcgtaccacccgccgtcctcctctaacgaaactcgaaaccgctaaccaaaaacaatccgcaaccaccgaaaataaaattaaacgacaaattctcgcccctatacaaccgccgtcgaacgaaccgcctaactcgacaacaaccacaaaaacatctaatcctaattcttaaatattcgaaaaacaaacgaacttaaaaatttcccgaaaacta

SEQ ID NO: 30645 - DNA, 588 bp, Artificial Sequence
  chemically treated genomic DNA (Homo sapiens) CpG-island No: 30645
gcggttggagaagttgagggtcgcgtggttcgggaggttttcggaggagggaagggtttattttagcgaggggtataggcggggaaggtgcggggcgaggcggtcgcgggtttttggtattttttttcgtatatttaggttaagttggcggtgttgtttgtgacgttggtggtcgtcgcggttttttatttgcggatgtagtagaagttgcggcggggcgtggtttcgcgttagttttgtatttcgcggttttagtataaggtgcgcggttatcgttatttggaggaggataattcggacgagagcgacgcggagggcgagtatggggacggcgcggaggaggaggcgtcgttttcggtgtttaggtttggttttaagttcgttggattcggtcgtcggttttgtttttacgaataggcgtaggggggcgacgggtcggaggagtagtgaggggtcgtttggttttcggatttagttttttttttcgtcggttttagtttattacgttttaggtcggggggatttttttcgagtttcgtgttgtttttaaaggttttagtttttttttttttacgttggggacgtttt

SEQ ID NO: 30646 - DNA, 588 bp, Artificial Sequence
  chemically treated genomic DNA (Homo sapiens) CpG-island No: 30646
aaaacgtccccaacgtaaaaaaaaaaaaactaaaacctttaaaaacaacacgaaactcgaaaaaaatccccccgacctaaaacgtaataaactaaaaccgacgaaaaaaaaaactaaatccgaaaaccaaacgacccctcactactcctccgacccgtcgcccccctacgcctattcgtaaaaacaaaaccgacgaccgaatccaacgaacttaaaaccaaacctaaacaccgaaaacgacgcctcctcctccgcgccgtccccatactcgccctccgcgtcgctctcgtccgaattatcctcctccaaataacgataaccgcgcaccttatactaaaaccgcgaaatacaaaactaacgcgaaaccacgccccgccgcaacttctactacatccgcaaataaaaaaccgcgacgaccaccaacgtcacaaacaacaccgccaacttaacctaaatatacgaaaaaaaataccaaaaacccgcgaccgcctcgccccgcaccttccccgcctatacccctcgctaaaataaacccttccctcctccgaaaacctcccgaaccacgcgaccctcaacttctccaaccgc

SEQ ID NO: 30647 - DNA, 588 bp, Artificial Sequence
  chemically treated genomic DNA (Homo sapiens) CpG-island No: 30647
ggggcgtttttaacgtgggggaggagagattggggtttttgaagatagtacgggattcggagggggttttttcgatttaagacgtggtaaattgaggtcggcgaggagggaggttgagttcgggaattaggcggttttttattgttttttcggttcgtcgtttttttgcgtttgttcgtaggggtagggtcggcggtcgagtttagcgggtttggggttaggtttgggtatcgggggcggcgttttttttttcgcgtcgtttttatgttcgtttttcgcgtcgttttcgttcgagttgtttttttttaagtagcggtaatcgcgtattttgtgttggggtcgcgggatgtagggttggcgcggggttacgtttcgtcgtagtttttgttgtattcgtaggtaggagatcgcggcggttattagcgttataagtagtatcgttagtttagtttgggtgtacggagagggatgttagggattcgcggtcgtttcgtttcgtatttttttcgtttatgtttttcgttgagataggtttttttttttttcgggagtttttcgggttacgcgatttttaatttttttagtcgt

SEQ ID NO: 30648 - DNA, 588 bp, Artificial Sequence
  chemically treated genomic DNA (Homo sapiens) CpG-island No: 30648
acgactaaaaaaattaaaaatcgcgtaacccgaaaaactcccgaaaaaaaaaaaaacctatctcaacgaaaaacataaacgaaaaaaatacgaaacgaaacgaccgcgaatccctaacatccctctccgtacacccaaactaaactaacgatactacttataacgctaataaccgccgcgatctcctacctacgaatacaacaaaaactacgacgaaacgtaaccccgcgccaaccctacatcccgcgaccccaacacaaaatacgcgattaccgctacttaaaaaaaaacaactcgaacgaaaacgacgcgaaaaacgaacataaaaacgacgcgaaaaaaaaaacgccgcccccgatacccaaacctaaccccaaacccgctaaactcgaccgccgaccctacccctacgaacaaacgcaaaaaaacgacgaaccgaaaaaacaataaaaaaccgcctaattcccgaactcaacctccctcctcgccgacctcaatttaccacgtcttaaatcgaaaaaaccccctccgaatcccgtactatcttcaaaaaccccaatctctcctcccccacgttaaaaacgcccc

SEQ ID NO: 30649 - DNA, 528 bp, Artificial Sequence
  chemically treated genomic DNA (Homo sapiens) CpG-island No: 30649
acgaaggagattttgttttaatacgcggatttgattatttcgtacgtatagttttttttttgtatacgaaggagattttgttttaatacgcggatttgattattttttacgtatagttttttttttgtatatgaaggagattttgttttaatacgcggatttgattatttcgtacgtagttttttttttgtatacgaaggagattttgttttaatacgcggatttgattatttcgtacgtatagttttttttttgtatacgaaggagattttgttttaatacgcggatttgattattttttacgtatagttttttttttgtatatgaaggagattttgttttaatacgcggatttgattatttcgtacgtagttttttttttgtatacgaaggagattttgttttaatacgcggatttgattatttcgtacgtatagttttttttttgtatatgaaggagaatttgttttaatacgcggatttgattattttttacgtatagtttttttttcgtatatgaaggagaat

SEQ ID NO: 30650 - DNA, 528 bp, Artificial Sequence
  chemically treated genomic DNA (Homo sapiens) CpG-island No: 30650
attctccttcatatacgaaaaaaaaactatacgtaaaaaataatcaaatccgcgtattaaaacaaattctccttcatatacaaaaaaaaaactatacgtacgaaataatcaaatccgcgtattaaaacaaaatctccttcgtatacaaaaaaaaaactacgtacgaaataatcaaatccgcgtattaaaacaaaatctccttcatatacaaaaaaaaaactatacgtaaaaaataatcaaatccgcgtattaaaacaaaatctccttcgtatacaaaaaaaaaactatacgtacgaaataatcaaatccgcgtattaaaacaaaatctccttcgtatacaaaaaaaaaactacgtacgaaataatcaaatccgcgtattaaaacaaaatctccttcatatacaaaaaaaaaactatacgtaaaaaataatcaaatccgcgtattaaaacaaaatctccttcgtatacaaaaaaaaaactatacgtacgaaataatcaaatccgcgtattaaaacaaaatctccttcgt

SEQ ID NO: 30651 - DNA, 528 bp, Artificial Sequence
  chemically treated genomic DNA (Homo sapiens) CpG-island No: 30651
atttttttttatgtacggggaggagattgtacgtgagagatagttagattcgcgtgttagagtagatttttttttatgtatagggaggagattgtacgtgcgagatagttagattcgcgtgttagagtagagtttttttcgtgtatagggaagagattacgtgcgagatagttagattcgcgtgttagagtagagttttttttatgtgtagggaggagattgtacgtgagagatagttagattcgcgtgttagagtagagtttttttcgtgtatagggaagagattgtacgtgcgagatagttagattcgcgtgttagagtagagtttttttcgtgtatagggaagagattacgtgcgagatagttagattcgcgtgttagagtagagttttttttatgtgtagggaggagattgtacgtgagagatagttagattcgcgtgttagagtagagtttttttcgtgtatagggaagagattgtacgtgcgagatagttagattcgcgtgttagagtagagtttttttcgt

SEQ ID NO: 30652 - DNA, 528 bp, Artificial Sequence
  chemically treated genomic DNA (Homo sapiens) CpG-island No: 30652
acgaaaaaaactctactctaacacgcgaatctaactatctcgcacgtacaatctcttccctatacacgaaaaaaactctactctaacacgcgaatctaactatctctcacgtacaatctcctccctacacataaaaaaaactctactctaacacgcgaatctaactatctcgcacgtaatctcttccctatacacgaaaaaaactctactctaacacgcgaatctaactatctcgcacgtacaatctcttccctatacacgaaaaaaactctactctaacacgcgaatctaactatctctcacgtacaatctcctccctacacataaaaaaaactctactctaacacgcgaatctaactatctcgcacgtaatctcttccctatacacgaaaaaaactctactctaacacgcgaatctaactatctcgcacgtacaatctcctccctatacataaaaaaaaatctactctaacacgcgaatctaactatctctcacgtacaatctcctccccgtacataaaaaaaaat

SEQ ID NO: 30653 - DNA, 679 bp, Artificial Sequence
  chemically treated genomic DNA (Homo sapiens) CpG-island No: 30653
tatagtacgtagttcgcgcgcggtataatttttttttttaattatattcggcgcgttcgagcgtttttttcgcgcggcggtcggcgtgggaggcgttgcggttggaggttacgatgggagtcggcgggtggtcgtttggggagattcggatatttaggggacgagtttaggtagcgttgatacgaattttttaagtcgcgtttcgggttgtggatcgttagagttgaacgtagtggtttttttttagcgtttcgggtttttttaggtcggggttcgcgggcggggggtgaggcgtggtttcgattgtcgggtcgcgataagcgttttgcgattcggttgaaagcgtatacgtgttttgtcgcgttgagtcgttagtaggattggtattatcgttttttttcggggttagggttattttgtcgtgatacgtagggataagttaaatattttcgttttcgggatcgaacggaatgaattagagtgattaattacgagaattattaggcgtttattgggttgattagtatttcgtttgatttagttgggtttggtcgtcgttattggtcggagcgtcgaagtatcggggacgttgacgtataggttgtttagttataagcgttgttcgtatttagagtaagttaaatgggtggtttttggtgaatgggattttgagaaagtg

SEQ ID NO: 30654 - DNA, 679 bp, Artificial Sequence
  chemically treated genomic DNA (Homo sapiens) CpG-island No: 30654
cactttctcaaaatcccattcaccaaaaaccacccatttaacttactctaaatacgaacaacgcttataactaaacaacctatacgtcaacgtccccgatacttcgacgctccgaccaataacgacgaccaaacccaactaaatcaaacgaaatactaatcaacccaataaacgcctaataattctcgtaattaatcactctaattcattccgttcgatcccgaaaacgaaaatatttaacttatccctacgtatcacgacaaaataaccctaaccccgaaaaaaaacgataataccaatcctactaacgactcaacgcgacaaaacacgtatacgctttcaaccgaatcgcaaaacgcttatcgcgacccgacaatcgaaaccacgcctcaccccccgcccgcgaaccccgacctaaaaaaacccgaaacgctaaaaaaaaaccactacgttcaactctaacgatccacaacccgaaacgcgacttaaaaaattcgtatcaacgctacctaaactcgtcccctaaatatccgaatctccccaaacgaccacccgccgactcccatcgtaacctccaaccgcaacgcctcccacgccgaccgccgcgcgaaaaaaacgctcgaacgcgccgaatataattaaaaaaaaaaattataccgcgcgcgaactacgtactata

SEQ ID NO: 30655 - DNA, 679 bp, Artificial Sequence
  chemically treated genomic DNA (Homo sapiens) CpG-island No: 30655
tatttttttagaattttatttattagaaattatttatttaatttgttttgggtgcgagtagcgtttgtgattgggtaatttgtgcgttagcgttttcggtgtttcggcgtttcggttagtgacggcgattaaatttagttaggttagacgaggtattgattagtttaatgagcgtttggtgattttcgtagttaattattttggtttatttcgttcgatttcggaggcgggagtgtttggtttgtttttgcgtgttacggtagggtgattttagtttcgagggagggcggtggtattagttttgttggcggtttagcgcggtaggatacgtgtgcgtttttagtcgggtcgtagggcgtttatcgcggttcggtagtcggggttacgttttatttttcgttcgcgaatttcgatttggggaaattcggggcgttggggaggggttattgcgtttagttttggcggtttatagttcgaagcgcggtttaggaagttcgtgttagcgttgtttgagttcgttttttggatgttcgggtttttttaggcggttattcgtcggtttttatcgtgatttttagtcgtagcgttttttacgtcggtcgtcgcgcgaggggagcgttcgggcgcgtcgggtgtggttgggggaaggggttgtgtcgcgcgcgggttgcgtgttgtg

SEQ ID NO: 30656 - DNA, 679 bp, Artificial Sequence
  chemically treated genomic DNA (Homo sapiens) CpG-island No: 30656
cacaacacgcaacccgcgcgcgacacaaccccttcccccaaccacacccgacgcgcccgaacgctcccctcgcgcgacgaccgacgtaaaaaacgctacgactaaaaatcacgataaaaaccgacgaataaccgcctaaaaaaacccgaacatccaaaaaacgaactcaaacaacgctaacacgaacttcctaaaccgcgcttcgaactataaaccgccaaaactaaacgcaataacccctccccaacgccccgaatttccccaaatcgaaattcgcgaacgaaaaataaaacgtaaccccgactaccgaaccgcgataaacgccctacgacccgactaaaaacgcacacgtatcctaccgcgctaaaccgccaacaaaactaataccaccgccctccctcgaaactaaaatcaccctaccgtaacacgcaaaaacaaaccaaacactcccgcctccgaaatcgaacgaaataaaccaaaataattaactacgaaaatcaccaaacgctcattaaactaatcaatacctcgtctaacctaactaaatttaatcgccgtcactaaccgaaacgccgaaacaccgaaaacgctaacgcacaaattacccaatcacaaacgctactcgcacccaaaacaaattaaataaataatttctaataaataaaattctaaaaaaata

SEQ ID NO: 30657 - DNA, 605 bp, Artificial Sequence
  chemically treated genomic DNA (Homo sapiens) CpG-island No: 30657
tacgagatcgtattgtagttagtgcggttgtttgggggatttcgtcgataattcgtgtttttgttcggtttttggggttttatcgaggggcgggagggtagggcggtttcgcggtttatttacgtttttatttagttcgatttttatttttttttgggagatgtttttttggatttttttgttgaagttggcgttgtttgtcgttcggtcgtatcgtttattattttttcgtaggtagtatagttgttcggggttcggttcggtcgttttcgggggtttagtcgttgagatcgttttcgcgttcggtattttagtttcggtgttcgcgtcggtttcgtttttcgtcgaggcggcggcggtcgcggtagcgattattgcggttattgcggcggtcgtattttcgtcgcggtttatttcgttaggcgtgaagtcgtttatgttttcgagttttcgaggtcggcgttgatagaaatttttttttttttggtcgtttcgttttttttcgtttcggtagcggtaatttattttgtatattaagttagatagcggtacggttaaatattaattgtttcgggtttgttggtttttgttggtatcgaaatagt

SEQ ID NO: 30658 - DNA, 605 bp, Artificial Sequence
  chemically treated genomic DNA (Homo sapiens) CpG-island No: 30658
actatttcgataccaacaaaaaccaacaaacccgaaacaattaatatttaaccgtaccgctatctaacttaatatacaaaataaattaccgctaccgaaacgaaaaaaaacgaaacgaccaaaaaaaaaaaaatttctatcaacgccgacctcgaaaactcgaaaacataaacgacttcacgcctaacgaaataaaccgcgacgaaaatacgaccgccgcaataaccgcaataatcgctaccgcgaccgccgccgcctcgacgaaaaacgaaaccgacgcgaacaccgaaactaaaataccgaacgcgaaaacgatctcaacgactaaacccccgaaaacgaccgaaccgaaccccgaacaactatactacctacgaaaaaataataaacgatacgaccgaacgacaaacaacgccaacttcaacaaaaaaatccaaaaaaacatctcccaaaaaaaaataaaaatcgaactaaataaaaacgtaaataaaccgcgaaaccgccctaccctcccgcccctcgataaaaccccaaaaaccgaacaaaaacacgaattatcgacgaaatcccccaaacaaccgcactaactacaatacgatctcgta

SEQ ID NO: 30659 - DNA, 605 bp, Artificial Sequence
  chemically treated genomic DNA (Homo sapiens) CpG-island No: 30659
attgtttcggtgttagtagagattagtaggttcgggatagttggtgtttggtcgtgtcgttgtttaatttggtgtgtagagtgaattgtcgttgtcggagcggagagaggcggagcggttaggagagaggggatttttgttagcgtcggtttcgggagttcggagatatgaacggttttacgtttgacgagatgagtcgcggcggggatgcggtcgtcgtagtggtcgtagtggtcgttgtcgcggtcgtcgtcgtttcggcggggaacgggatcggcgcgggtatcggggttgaggtgtcgggcgcgggggcggttttagcggttgggttttcgggggcggtcgggtcgggtttcgggtaattgtgttgtttgcgggaggatggtgagcggtgcggtcgggcggtaggtaacgttagttttagtaagaggatttagaagagtattttttagaagaaggtgaagatcgagttggataagagcgtaagtaaatcgcgggatcgttttgttttttcgtttttcggtggggttttaggagtcgggtaaaggtacgggttgtcggcggggttttttagataatcgtattggttgtagtgcggtttcgtg

SEQ ID NO: 30660 - DNA, 605 bp, Artificial Sequence
  chemically treated genomic DNA (Homo sapiens) CpG-island No: 30660
cacgaaaccgcactacaaccaatacgattatctaaaaaaccccgccgacaacccgtacctttacccgactcctaaaaccccaccgaaaaacgaaaaaacaaaacgatcccgcgatttacttacgctcttatccaactcgatcttcaccttcttctaaaaaatactcttctaaatcctcttactaaaactaacgttacctaccgcccgaccgcaccgctcaccatcctcccgcaaacaacacaattacccgaaacccgacccgaccgcccccgaaaacccaaccgctaaaaccgcccccgcgcccgacacctcaaccccgatacccgcgccgatcccgttccccgccgaaacgacgacgaccgcgacaacgaccactacgaccactacgacgaccgcatccccgccgcgactcatctcgtcaaacgtaaaaccgttcatatctccgaactcccgaaaccgacgctaacaaaaatcccctctctcctaaccgctccgcctctctccgctccgacaacgacaattcactctacacaccaaattaaacaacgacacgaccaaacaccaactatcccgaacctactaatctctactaacaccgaaacaat

SEQ ID NO: 30661 - DNA, 1156 bp, Artificial Sequence
  chemically treated genomic DNA (Homo sapiens) CpG-island No: 30661
ttcgttttcgacgcgttttttaatatataaatttttagaattcgtttttagtttatagcgcgacgttagttcgttttagtcgatttggaggtttcgggtttgagttatatagaaagattattttcgtcggtatttttatatatagttcgatattcggcgcgtcggttttttcgtttgatatattaacgttcgtcgttttcgcgtaatttgttatgtttcggttcgagtttttgatttaaaaattttagcgaaacggagagtcgtagagtcggtttcgggcggtttttgatggttttgttattgtttgggtttgaatcgatacgtttttttttattttttttttttcgcggttttatatttagttttcgtttttttttacgtttcgcgtttttttttttttattttggcgttttttttttttcgttacgtcgtggcggcgtagagattattttgatcgcgagagttgggcggggcgggggcggggcgcgtcgagttatgtagattaatcggtttttggttggttggagtagcgttggtaggggcggggtcggggcgcggttatagagcgcgcggggcgggggtcgaggggagtcgtttagtttcgtcgtttttttatttttttttttttttcggtcggttcggtagttttgtttttcgttttggtttttcggagaggtttcgtttcgttttcgttcgtcgcgtttttttcgcgcgtttttttcgtcggcgcgttttttttttttatttttggttgcggggcgagtcgggcgtttgttgtagcggtcgcggtggttgaggaggttcgagaggagtcggtggtagcggcggcggcgggatcggtagtagtagtagtagtagtagtagtaattattagttttttgtttcgcggcgttgtcgtacgagttttacgagtcgtttatttcgtcgtttttagcgttgttcgatttcgttggcgcgttttttcgtcgttagtttcggtagcgtttttagttgtttttcgattcgttttcggtttttcgcgttagtcgtagcgatagtcgtaacgttattcgtagttatagttatagttatagttttaggtatagttttcggtatagtttcggtttcggtttttgcgatagtttttttgggtatcgtttttgcgtcgatattttgg

SEQ ID NO: 30662 - DNA, 1156 bp, Artificial Sequence
  chemically treated genomic DNA (Homo sapiens) CpG-island No: 30662
ccaaaatatcgacgcaaaaacgatacccaaaaaaactatcgcaaaaaccgaaaccgaaactataccgaaaactatacctaaaactataactataactataactacgaataacgttacgactatcgctacgactaacgcgaaaaaccgaaaacgaatcgaaaaacaactaaaaacgctaccgaaactaacgacgaaaaaacgcgccaacgaaatcgaacaacgctaaaaacgacgaaataaacgactcgtaaaactcgtacgacaacgccgcgaaacaaaaaactaataattactactactactactactactactaccgatcccgccgccgccgctaccaccgactcctctcgaacctcctcaaccaccgcgaccgctacaacaaacgcccgactcgccccgcaaccaaaaataaaaaaaaaaaacgcgccgacgaaaaaaacgcgcgaaaaaaacgcgacgaacgaaaacgaaacgaaacctctccgaaaaaccaaaacgaaaaacaaaactaccgaaccgaccgaaaaaaaaaaaaaaataaaaaaacgacgaaactaaacgactcccctcgacccccgccccgcgcgctctataaccgcgccccgaccccgcccctaccaacgctactccaaccaaccaaaaaccgattaatctacataactcgacgcgccccgcccccgccccgcccaactctcgcgatcaaaataatctctacgccgccacgacgtaacgaaaaaaaaaaaacgccaaaataaaaaaaaaaaaacgcgaaacgtaaaaaaaaacgaaaactaaatataaaaccgcgaaaaaaaaaaaataaaaaaaaacgtatcgattcaaacccaaacaataacaaaaccatcaaaaaccgcccgaaaccgactctacgactctccgtttcgctaaaatttttaaatcaaaaactcgaaccgaaacataacaaattacgcgaaaacgacgaacgttaatatatcaaacgaaaaaaccgacgcgccgaatatcgaactatatataaaaataccgacgaaaataatctttctatataactcaaacccgaaacctccaaatcgactaaaacgaactaacgtcgcgctataaactaaaaacgaattctaaaaatttatatattaaaaaacgcgtcgaaaacgaa

SEQ ID NO: 30663 - DNA, 1156 bp, Artificial Sequence
  chemically treated genomic DNA (Homo sapiens) CpG-island No: 30663
ttaggatgtcggcgtagggacggtgtttagaggagttgtcgtaggagtcggagtcggggttgtgtcgaaggttatgtttggggttgtggttgtggttgtggttgcgggtggcgttgcggttgtcgttgcggttggcgcggaaggtcgagggcgagtcggaggataattgagggcgttgtcgggattggcggcgggagggcgcgttagcggggtcgggtagcgttgagaacggcggggtgagcggttcgtggggttcgtgcggtagcgtcgcggggtaggaggttagtggttgttgttgttgttgttgttgttgttgtcggtttcgtcgtcgtcgttgttatcgatttttttcgggtttttttagttatcgcggtcgttgtagtagacgttcggttcgtttcgtagttaggagtaaaggggaggagcgcgtcggcggggagggcgcgcggggagggcgcggcgggcggggacggggcggggttttttcgggaggttaaggcggggagtagggttgtcgggtcggtcgagggaggagagggggtggggaagcggcgggattgggcgatttttttcggttttcgtttcgcgcgttttgtggtcgcgtttcggtttcgtttttgttagcgttattttagttaattagaggtcgattgatttgtataattcggcgcgtttcgttttcgtttcgtttagttttcgcggttagaatggtttttacgtcgttacgacgtggcgggaaggaaaaggcgttaaaatggagggggaggggcgcggggcgtgaggggaggcgggagttgggtgtagggtcgcgagggaggaaggatggggaggggcgtatcgatttaaatttaaataataataaagttattaaaggtcgttcgaggtcggttttgcggtttttcgtttcgttgaggtttttgggttaagggttcgagtcggagtataataagttgcgcggagacgacgggcgttagtgtgttaggcggggaggtcggcgcgtcgggtgtcggattgtgtgtggggatgtcgacgagggtggtttttttgtgtgatttagattcgagatttttaagtcggttggggcgggttgacgtcgcgttgtaggttgggggcggattttgggggtttgtgtgttggggggcgcgtcgggggcgaa

SEQ ID NO: 30664 - DNA, 1156 bp, Artificial Sequence
  chemically treated genomic DNA (Homo sapiens) CpG-island No: 30664
ttcgcccccgacgcgccccccaacacacaaacccccaaaatccgcccccaacctacaacgcgacgtcaacccgccccaaccgacttaaaaatctcgaatctaaatcacacaaaaaaaccaccctcgtcgacatccccacacacaatccgacacccgacgcgccgacctccccgcctaacacactaacgcccgtcgtctccgcgcaacttattatactccgactcgaacccttaacccaaaaacctcaacgaaacgaaaaaccgcaaaaccgacctcgaacgacctttaataactttattattatttaaatttaaatcgatacgcccctccccatccttcctccctcgcgaccctacacccaactcccgcctcccctcacgccccgcgcccctccccctccattttaacgccttttccttcccgccacgtcgtaacgacgtaaaaaccattctaaccgcgaaaactaaacgaaacgaaaacgaaacgcgccgaattatacaaatcaatcgacctctaattaactaaaataacgctaacaaaaacgaaaccgaaacgcgaccacaaaacgcgcgaaacgaaaaccgaaaaaaatcgcccaatcccgccgcttccccaccccctctcctccctcgaccgacccgacaaccctactccccgccttaacctcccgaaaaaaccccgccccgtccccgcccgccgcgccctccccgcgcgccctccccgccgacgcgctcctcccctttactcctaactacgaaacgaaccgaacgtctactacaacgaccgcgataactaaaaaaacccgaaaaaaatcgataacaacgacgacgacgaaaccgacaacaacaacaacaacaacaacaacaaccactaacctcctaccccgcgacgctaccgcacgaaccccacgaaccgctcaccccgccgttctcaacgctacccgaccccgctaacgcgccctcccgccgccaatcccgacaacgccctcaattatcctccgactcgccctcgaccttccgcgccaaccgcaacgacaaccgcaacgccacccgcaaccacaaccacaaccacaaccccaaacataaccttcgacacaaccccgactccgactcctacgacaactcctctaaacaccgtccctacgccgacatcctaa

SEQ ID NO: 30665 - DNA, 686 bp, Artificial Sequence
  chemically treated genomic DNA (Homo sapiens) CpG-island No: 30665
ttcgttttcgcgtttagtttcgtttttcgttcggtttaggattcggtttcgtttatttggattttttgataggtcgagatcgttcgtcggtttttcgtttgttttttttcgatgaggtttagttttagttcgaaggttagaaagattgttcggtcgtaagggttcgcgtagttttaggttcgtattacgaattgtcgttgtaatcgcgtcgttagttcggttatcgattggcggaagaagcggagacggttagggagttcgagttcgattttgcgaggtttcgcgttcggttttgcggtttagtttggacgtttttcgcggatatagttcgtcgtcgggttcggtcgttttaagtcgtaggttcggtcgggtttgttcgtgaagcgtagtagtagcgttcgatttagttgtaggtcgcggtttagcgtttgtcgtatcgttatggtggcgtcgcggttcggtgttttcgtagtcgtcgttgtcgttattatcggcgtttttcgtcggttataataaatttggggcggtgtttttgcgtaggcgtaggcgttggtgggcggggtcggttttcgcggtagtttttcgattcggcgcgtgggggcgttatgttggtattggcgtttttagtagtgattttttttttgtattttggatttacgtggagggtttgtcggtttaggtaggtt

SEQ ID NO: 30666 - DNA, 686 bp, Artificial Sequence
  chemically treated genomic DNA (Homo sapiens) CpG-island No: 30666
aacctacctaaaccgacaaaccctccacgtaaatccaaaatacaaaaaaaaaatcactactaaaaacgccaataccaacataacgcccccacgcgccgaatcgaaaaactaccgcgaaaaccgaccccgcccaccaacgcctacgcctacgcaaaaacaccgccccaaatttattataaccgacgaaaaacgccgataataacgacaacgacgactacgaaaacaccgaaccgcgacgccaccataacgatacgacaaacgctaaaccgcgacctacaactaaatcgaacgctactactacgcttcacgaacaaacccgaccgaacctacgacttaaaacgaccgaacccgacgacgaactatatccgcgaaaaacgtccaaactaaaccgcaaaaccgaacgcgaaacctcgcaaaatcgaactcgaactccctaaccgtctccgcttcttccgccaatcgataaccgaactaacgacgcgattacaacgacaattcgtaatacgaacctaaaactacgcgaacccttacgaccgaacaatctttctaaccttcgaactaaaactaaacctcatcgaaaaaaaacaaacgaaaaaccgacgaacgatctcgacctatcaaaaaatccaaataaacgaaaccgaatcctaaaccgaacgaaaaacgaaactaaacgcgaaaacgaa

SEQ ID NO: 30667 - DNA, 686 bp, Artificial Sequence
  chemically treated genomic DNA (Homo sapiens) CpG-island No: 30667
gatttgtttgaatcggtaagttttttacgtgggtttaaagtgtaaagggaaagttattgttagaggcgttagtattagtatagcgtttttacgcgtcgagtcggggaattgtcgcgggggtcggtttcgtttattagcgtttgcgtttgcgtagaggtatcgttttaagtttgttgtgatcggcgggggacgtcggtggtggcggtagcggcggttgcgggggtatcgggtcgcggcgttattatggcggtgcgataggcgttgggtcgcggtttgtagttgggtcgagcgttgttgttgcgttttacgggtaagttcggtcgggtttacggtttggggcggtcgggttcggcggcgggttgtgttcgcggggagcgtttaggttgggtcgtaggatcgggcgcggagtttcgtagggtcgggttcgggttttttaatcgttttcgtttttttcgttagtcggtggtcgggttggcggcgcggttgtagcggtagttcgtggtgcgggtttggggttgcgcgggtttttgcggtcgggtagtttttttggttttcgggttagggttgggttttatcgaggaaaaataggcggagagtcggcgggcggtttcggtttgttaggagatttaggtgagcggggtcgggttttaagtcgagcggaggacggagttaagcgcgggggcggg

SEQ ID NO: 30668 - DNA, 686 bp, Artificial Sequence
  chemically treated genomic DNA (Homo sapiens) CpG-island No: 30668
cccgcccccgcgcttaactccgtcctccgctcgacttaaaacccgaccccgctcacctaaatctcctaacaaaccgaaaccgcccgccgactctccgcctatttttcctcgataaaacccaaccctaacccgaaaaccaaaaaaactacccgaccgcaaaaacccgcgcaaccccaaacccgcaccacgaactaccgctacaaccgcgccgccaacccgaccaccgactaacgaaaaaaacgaaaacgattaaaaaacccgaacccgaccctacgaaactccgcgcccgatcctacgacccaacctaaacgctccccgcgaacacaacccgccgccgaacccgaccgccccaaaccgtaaacccgaccgaacttacccgtaaaacgcaacaacaacgctcgacccaactacaaaccgcgacccaacgcctatcgcaccgccataataacgccgcgacccgatacccccgcaaccgccgctaccgccaccaccgacgtcccccgccgatcacaacaaacttaaaacgatacctctacgcaaacgcaaacgctaataaacgaaaccgacccccgcgacaattccccgactcgacgcgtaaaaacgctatactaatactaacgcctctaacaataactttccctttacactttaaacccacgtaaaaaacttaccgattcaaacaaatc

SEQ ID NO: 30669 - DNA, 816 bp, Artificial Sequence
  chemically treated genomic DNA (Homo sapiens) CpG-island No: 30669
gcgtcgcggagtttcgaggagtttgcgttgtgtttttttcgcggtgtttcgttattttcgggaagattcggcgtttgggttcgcgttttttgggtaagtttttcgggaagttttttcgggagttcgttggttttggttttagaagtttgcggattcgtttagggaggataagtagttgaaagatcgcgcggtgtcgtttcgaggtttcgggacgtgggtttatggtcggtttggcgttattttttcgggggaagttacgcgtattaggtatcgtacgcggttttgtattcgcgtcgtcggatttgaaattcggcggagggtatacggggttgtcgttgcgggtttcggattaatttatgtttatttcggagtttgtatcggcgtcgacgggtcggatttttttgcgcggtgtcgtttagcgggttcgtgcgaaaggcggggtcgattatacgcggtgtcgcgttttgagatcgtttatttgtagttaacgtagtttttcggtttagtttgggaagatgcgcgaatcgggaattttagagcgcggtggttagatcgggtttcgtcgttttttttatagttttttttttaatcgtttagacggagtttggtcgatttcgtcggagattgttaggtgagaggttttagagatattaagggtaaaaataaatttagcgttagcggcgggtattttgtaggtttgttggatcggagacgcgagcgaggggtttagttttttttgtttgtatattcggtgacgggcgcgtgtttgtttattgttgtaaggtgttggcgtgggtttttttgtttgtttttatt

SEQ ID NO: 30670 - DNA, 816 bp, Artificial Sequence
  chemically treated genomic DNA (Homo sapiens) CpG-island No: 30670
aataaaaacaaacaaaaaaacccacgccaacaccttacaacaataaacaaacacgcgcccgtcaccgaatatacaaacaaaaaaaactaaacccctcgctcgcgtctccgatccaacaaacctacaaaatacccgccgctaacgctaaatttatttttacccttaatatctctaaaacctctcacctaacaatctccgacgaaatcgaccaaactccgtctaaacgattaaaaaaaaaactataaaaaaaacgacgaaacccgatctaaccaccgcgctctaaaattcccgattcgcgcatcttcccaaactaaaccgaaaaactacgttaactacaaataaacgatctcaaaacgcgacaccgcgtataatcgaccccgcctttcgcacgaacccgctaaacgacaccgcgcaaaaaaatccgacccgtcgacgccgatacaaactccgaaataaacataaattaatccgaaacccgcaacgacaaccccgtataccctccgccgaatttcaaatccgacgacgcgaatacaaaaccgcgtacgatacctaatacgcgtaacttcccccgaaaaaataacgccaaaccgaccataaacccacgtcccgaaacctcgaaacgacaccgcgcgatctttcaactacttatcctccctaaacgaatccgcaaacttctaaaaccaaaaccaacgaactcccgaaaaaacttcccgaaaaacttacccaaaaaacgcgaacccaaacgccgaatcttcccgaaaataacgaaacaccgcgaaaaaaacacaacgcaaactcctcgaaactccgcgacgc

SEQ ID NO: 30671 - DNA, 816 bp, Artificial Sequence
  chemically treated genomic DNA (Homo sapiens) CpG-island No: 30671
aataaaagtaagtaagaaaatttacgttaatattttataatagtaaatagatacgcgttcgttatcgggtgtataaatagaaaaggttgggtttttcgttcgcgttttcggtttagtaggtttatagggtattcgtcgttggcgttgggtttatttttatttttagtgtttttggggttttttatttggtagttttcggcgaagtcgattaggtttcgtttgaacgattaggaaaggggttgtgggggaggcggcggagttcggtttagttatcgcgttttggggttttcgattcgcgtatttttttaggttgagtcgggaggttgcgttgattgtagataaacggttttagggcgcggtatcgcgtgtagtcggtttcgtttttcgtacgaattcgttgggcgatatcgcgtagggaggttcgattcgtcggcgtcggtataggtttcggagtaagtatgggttggttcggggttcgtagcggtagtttcgtgtgtttttcgtcgggttttaggttcggcggcgcgggtgtagagtcgcgtgcgatgtttggtgcgcgtggtttttttcggaaaggtggcgttaggtcgattatgggtttacgtttcggggtttcggagcggtatcgcgcggttttttagttgtttattttttttgggcgggttcgtaggtttttggggttaggattagcgagttttcgggaaagtttttcggaaagtttatttagagagcgcggatttaggcgtcgagttttttcggagatgacgagatatcgcgagaggagtatagcgtaggtttttcgggatttcgcggcgt

SEQ ID NO: 30672 - DNA, 816 bp, Artificial Sequence
  chemically treated genomic DNA (Homo sapiens) CpG-island No: 30672
acgccgcgaaatcccgaaaaacctacgctatactcctctcgcgatatctcgtcatctccgaaaaaactcgacgcctaaatccgcgctctctaaataaactttccgaaaaactttcccgaaaactcgctaatcctaaccccaaaaacctacgaacccgcccaaaaaaaataaacaactaaaaaaccgcgcgataccgctccgaaaccccgaaacgtaaacccataatcgacctaacgccacctttccgaaaaaaaccacgcgcaccaaacatcgcacgcgactctacacccgcgccgccgaacctaaaacccgacgaaaaacacacgaaactaccgctacgaaccccgaaccaacccatacttactccgaaacctataccgacgccgacgaatcgaacctccctacgcgatatcgcccaacgaattcgtacgaaaaacgaaaccgactacacgcgataccgcgccctaaaaccgtttatctacaatcaacgcaacctcccgactcaacctaaaaaaatacgcgaatcgaaaaccccaaaacgcgataactaaaccgaactccgccgcctcccccacaacccctttcctaatcgttcaaacgaaacctaatcgacttcgccgaaaactaccaaataaaaaaccccaaaaacactaaaaataaaaataaacccaacgccaacgacgaataccctataaacctactaaaccgaaaacgcgaacgaaaaacccaaccttttctatttatacacccgataacgaacgcgtatctatttactattataaaatattaacgtaaattttcttacttacttttatt

SEQ ID NO: 30673 - DNA, 708 bp, Artificial Sequence
  chemically treated genomic DNA (Homo sapiens) CpG-island No: 30673
cgggtgttgcgattggttgacgtttaggcgttgggaatcgtttcgcgttcgtttttcgattgaatttttggtttaggtgtaagaggcggtaggttttttgcggggtttacggggagaaggggacgttgggcgtagtatcgttttcggggcggtttttttttagttatatttcgattcggcgcggttattcggttttagttcgtaggttttattgttgcgttttttcggggacgcgaatgtttcgcgtcgggcgggcgttcgcggagggaggtttcgttttagggacgcggagttttagatgtttgcgtttaaggtttttcgtttggcgtcggttggtttcgaatttcggggtatgggtatttaggaagggggttgcgcgtgttgggaggttcgttttttcgtcgcgaattttcggggtagtcggggaatttatttgcggagcgggaagtttaggaacgttcgaagaggtcgtgggagtcgggttcgtttttcgcgggagggatttcggcgcgggaacgtcgaggaggggtcgcgtttatacgttggtgtagcgtcggttttatttgatcgcgattttgattttagggtgtggttttaggtaggacgcggcggcgaatttagagcgcgggagaagttgttaagtgtcgttggggttttggttaggagtttttttgttcgaggggcgtcgtgttgtttaatttttttttt

SEQ ID NO: 30674 - DNA, 708 bp, Artificial Sequence
  chemically treated genomic DNA (Homo sapiens) CpG-island No: 30674
aaaaaaaaaattaaacaacacgacgcccctcgaacaaaaaaactcctaaccaaaaccccaacgacacttaacaacttctcccgcgctctaaattcgccgccgcgtcctacctaaaaccacaccctaaaatcaaaatcgcgatcaaataaaaccgacgctacaccaacgtataaacgcgacccctcctcgacgttcccgcgccgaaatccctcccgcgaaaaacgaacccgactcccacgacctcttcgaacgttcctaaacttcccgctccgcaaataaattccccgactaccccgaaaattcgcgacgaaaaaacgaacctcccaacacgcgcaacccccttcctaaatacccataccccgaaattcgaaaccaaccgacgccaaacgaaaaaccttaaacgcaaacatctaaaactccgcgtccctaaaacgaaacctccctccgcgaacgcccgcccgacgcgaaacattcgcgtccccgaaaaaacgcaacaataaaacctacgaactaaaaccgaataaccgcgccgaatcgaaatataactaaaaaaaaaccgccccgaaaacgatactacgcccaacgtccccttctccccgtaaaccccgcaaaaaacctaccgcctcttacacctaaaccaaaaattcaatcgaaaaacgaacgcgaaacgattcccaacgcctaaacgtcaaccaatcgcaacacccg

SEQ ID NO: 30675 - DNA, 708 bp, Artificial Sequence
  chemically treated genomic DNA (Homo sapiens) CpG-island No: 30675
agagaaagagttgagtagtacggcgtttttcgggtagaggggtttttggttaaggttttagcgatatttggtaatttttttcgcgttttgggttcgtcgtcgcgttttatttgaggttatattttgaaattaaaatcgcggttaggtgaagtcggcgttgtattaacgtgtaagcgcggttttttttcggcgttttcgcgtcgaggtttttttcgcggagggcgggttcggtttttacgattttttcgagcgtttttgggtttttcgtttcgtaggtgggtttttcggttgtttcggaggttcgcggcgagaggacgggttttttaatacgcgtagttttttttttgggtgtttatgtttcgaagttcgggattagtcggcgttaggcgaggggttttgggcgtaggtatttggagtttcgcgtttttggagcgggattttttttcgcgggcgttcgttcggcgcggggtattcgcgttttcgagagggcgtagtagtggggtttgcgagttggggtcgggtggtcgcgtcgggtcggagtgtggttggagaggggtcgtttcggaagcggtgttgcgtttaacgttttttttttttcgtaagtttcgtaaggagtttgtcgttttttgtatttgagttaggagtttagtcgggaggcgggcgcggagcggtttttagcgtttggacgttagttagtcgtaatattcg

SEQ ID NO: 30676 - DNA, 708 bp, Artificial Sequence
  chemically treated genomic DNA (Homo sapiens) CpG-island No: 30676
cgaatattacgactaactaacgtccaaacgctaaaaaccgctccgcgcccgcctcccgactaaactcctaactcaaatacaaaaaacgacaaactccttacgaaacttacgaaaaaaaaaaaacgttaaacgcaacaccgcttccgaaacgacccctctccaaccacactccgacccgacgcgaccacccgaccccaactcgcaaaccccactactacgccctctcgaaaacgcgaataccccgcgccgaacgaacgcccgcgaaaaaaaatcccgctccaaaaacgcgaaactccaaatacctacgcccaaaacccctcgcctaacgccgactaatcccgaacttcgaaacataaacacccaaaaaaaaaactacgcgtattaaaaaacccgtcctctcgccgcgaacctccgaaacaaccgaaaaacccacctacgaaacgaaaaacccaaaaacgctcgaaaaaatcgtaaaaaccgaacccgccctccgcgaaaaaaacctcgacgcgaaaacgccgaaaaaaaaccgcgcttacacgttaatacaacgccgacttcacctaaccgcgattttaatttcaaaatataacctcaaataaaacgcgacgacgaacccaaaacgcgaaaaaaattaccaaatatcgctaaaaccttaaccaaaaacccctctacccgaaaaacgccgtactactcaactctttctct

SEQ ID NO: 30677 - DNA, 504 bp, Artificial Sequence
  chemically treated genomic DNA (Homo sapiens) CpG-island No: 30677
ttttcgggttttcgtgcgtagcgcgatttcgttttttatttttttaaggagttgcgatttaatttcgttcggttttcggcggttattcgggcgtttatcgggttgcggtaggaggcgggaggcgtaggtaggggcggcggcggcggcgggtataggtcggggcgggaggaggttatttcgtacggtgcggtattgtttttaaaatacgtttgttcggggtatttcgtaaatagttgatgaggtttcgtttttttgcgcgttacgtcgaggattgattaatggcgagtgaagcgttaagtttcgggttgggtcgttgttagggacggttacgaatgtacgaatttttttatggaaatattgtaaggggtcgagtaaaatttcgatcgtcgttagaagcgtagtcggagcgtcgtcgttagtgcggattttgtttttaatataggttttggaagcgttagagagtttttgaattttttgtattaggtgtgggagagggggcgttaa

SEQ ID NO: 30678 - DNA, 504 bp, Artificial Sequence
  chemically treated genomic DNA (Homo sapiens) CpG-island No: 30678
ttaacgccccctctcccacacctaatacaaaaaattcaaaaactctctaacgcttccaaaacctatattaaaaacaaaatccgcactaacgacgacgctccgactacgcttctaacgacgatcgaaattttactcgaccccttacaatatttccataaaaaaattcgtacattcgtaaccgtccctaacaacgacccaacccgaaacttaacgcttcactcgccattaatcaatcctcgacgtaacgcgcaaaaaaacgaaacctcatcaactatttacgaaataccccgaacaaacgtattttaaaaacaataccgcaccgtacgaaataacctcctcccgccccgacctatacccgccgccgccgccgcccctacctacgcctcccgcctcctaccgcaacccgataaacgcccgaataaccgccgaaaaccgaacgaaattaaatcgcaactccttaaaaaaataaaaaacgaaatcgcgctacgcacgaaaacccgaaaa

SEQ ID NO: 30679 - DNA, 504 bp, Artificial Sequence
  chemically treated genomic DNA (Homo sapiens) CpG-island No: 30679
ttggcgtttttttttttatatttaatatagaggatttagggattttttggcgtttttagagtttgtgttagggatagaattcgtattggcgacggcgtttcgattgcgtttttggcgacggtcggaattttgttcggttttttgtaatgtttttatgggaaggttcgtatattcgtgatcgtttttggtagcggtttagttcgggatttggcgttttattcgttattggttagttttcggcgtgacgcgtaggggggcggggttttattagttgtttgcgggatgtttcgagtaggcgtattttggaaataatatcgtatcgtgcggagtggttttttttcgtttcggtttgtgttcgtcgtcgtcgtcgtttttgtttgcgtttttcgttttttgtcgtagttcggtgagcgttcgggtggtcgtcgggggtcgggcggagttggatcgtagttttttggggaagtggggagcggagtcgcgttgcgtacgggggttcgggaa

SEQ ID NO: 30680 - DNA, 504 bp, Artificial Sequence
  chemically treated genomic DNA (Homo sapiens) CpG-island No: 30680
ttcccgaacccccgtacgcaacgcgactccgctccccacttccccaaaaaactacgatccaactccgcccgacccccgacgaccacccgaacgctcaccgaactacgacaaaaaacgaaaaacgcaaacaaaaacgacgacgacgacgaacacaaaccgaaacgaaaaaaaaccactccgcacgatacgatattatttccaaaatacgcctactcgaaacatcccgcaaacaactaataaaaccccgcccccctacgcgtcacgccgaaaactaaccaataacgaataaaacgccaaatcccgaactaaaccgctaccaaaaacgatcacgaatatacgaaccttcccataaaaacattacaaaaaaccgaacaaaattccgaccgtcgccaaaaacgcaatcgaaacgccgtcgccaatacgaattctatccctaacacaaactctaaaaacgccaaaaaatccctaaatcctctatattaaatataaaaaaaaaaacgccaa

SEQ ID NO: 30681 - DNA, 843 bp, Artificial Sequence
  chemically treated genomic DNA (Homo sapiens) CpG-island No: 30681
ttttagacgtcgttttttaggttattttttttttcgtataatttagaatacgcgggttacggtcgttaggttgcgttcgttttgttcgcgttttagcggcgcggaggttcggacggcgttatgatatgagtagtggtggcgatttacgcgtattcgtcgtttcgagtgttgtagtttagcgtttagcgagagcgcgtcgcgtatttgtcggttttgtcggtttttcggcgttcgtttagttttttagcgcgaaggtttagttcggtttacggcgttcgttcggttcggtcgcgcgttttattagcggtagtagtttttcgaggtttttagcgtgaagttaacgcgcgtggttcgcgtgaagggtagtagtattttggggatgttgagtttggtcgtagcggcggaggggttcgtcgttaatagtatcgatagcgttagtagtagtagttttcggtttcgcgtcgttattttcgtcgcgcgttatttttcgcgattttgcgttcggtcgttcgcgtcgtttcgttgtttttcgttttcgttcgcgcgcgcgttaggttagtaggtgatgagcgcgggggcggggcgagggtcgtcggcggtcgtcgttttttgggtttgagcgcgggaattttgggggtcgagttcgcggcgattttatttttagttcggttttcgcgtagggacgcggggttgggggatgggcgcgcgttcgggttttcggagttgagggagaaggtttggggcgcgttcgcggggatttttggattttagaagttttaagggggagttttcgggcgtttcgtagtacgtatttcgttttggtatttgtttttggcggtggag

SEQ ID NO: 30682 - DNA, 843 bp, Artificial Sequence
  chemically treated genomic DNA (Homo sapiens) CpG-island No: 30682
ctccaccgccaaaaacaaataccaaaacgaaatacgtactacgaaacgcccgaaaactcccccttaaaacttctaaaatccaaaaatccccgcgaacgcgccccaaaccttctccctcaactccgaaaacccgaacgcgcgcccatcccccaaccccgcgtccctacgcgaaaaccgaactaaaaataaaatcgccgcgaactcgacccccaaaattcccgcgctcaaacccaaaaaacgacgaccgccgacgaccctcgccccgcccccgcgctcatcacctactaacctaacgcgcgcgcgaacgaaaacgaaaaacaacgaaacgacgcgaacgaccgaacgcaaaatcgcgaaaaataacgcgcgacgaaaataacgacgcgaaaccgaaaactactactactaacgctatcgatactattaacgacgaacccctccgccgctacgaccaaactcaacatccccaaaatactactacccttcacgcgaaccacgcgcgttaacttcacgctaaaaacctcgaaaaactactaccgctaataaaacgcgcgaccgaaccgaacgaacgccgtaaaccgaactaaaccttcgcgctaaaaaactaaacgaacgccgaaaaaccgacaaaaccgacaaatacgcgacgcgctctcgctaaacgctaaactacaacactcgaaacgacgaatacgcgtaaatcgccaccactactcatatcataacgccgtccgaacctccgcgccgctaaaacgcgaacaaaacgaacgcaacctaacgaccgtaacccgcgtattctaaattatacgaaaaaaaaaataacctaaaaaacgacgtctaaaa

SEQ ID NO: 30683 - DNA, 843 bp, Artificial Sequence
  chemically treated genomic DNA (Homo sapiens) CpG-island No: 30683
ttttatcgttaggggtaaatattagggcgggatgcgtgttgcggggcgttcgggggtttttttttgggatttttagggtttaggggttttcgcgggcgcgttttaagtttttttttttagtttcgggggttcgggcgcgcgtttattttttagtttcgcgtttttgcgcgagggtcgggttgggggtggggtcgtcgcgagttcggtttttagagttttcgcgtttaggtttaggaagcggcggtcgtcgacggttttcgtttcgttttcgcgtttattatttgttggtttggcgcgcgcgcgggcgggagcggagggtaacggggcggcgcgggcggtcgggcgtagggtcgcgggaggtgacgcgcggcgaggatggcggcgcggggtcgggggttgttgttgttgacgttgtcggtgttgttggcggcgggttttttcgtcgttgcggttaagtttaatatttttaaagtgttgttgttttttacgcgggttacgcgcgttaattttacgttggaggtttcggagggttgttatcgttggtgaggcgcgcggtcgggtcgggcgggcgtcgtgggtcgggttgggttttcgcgttgagaggttgggcgggcgtcgggaggtcggtagagtcggtaggtgcgcggcgcgttttcgttgggcgttaggttgtagtattcggagcggcgggtgcgcgtgggtcgttattattgtttatgttatggcgtcgttcgggttttcgcgtcgttgaggcgcgagtagagcgggcgtagtttggcggtcgtgattcgcgtgttttgggttgtgcgggaggaggggtggtttggggagcggcgtttggga

SEQ ID NO: 30684 - DNA, 843 bp, Artificial Sequence
  chemically treated genomic DNA (Homo sapiens) CpG-island No: 30684
tcccaaacgccgctccccaaaccacccctcctcccgcacaacccaaaacacgcgaatcacgaccgccaaactacgcccgctctactcgcgcctcaacgacgcgaaaacccgaacgacgccataacataaacaataataacgacccacgcgcacccgccgctccgaatactacaacctaacgcccaacgaaaacgcgccgcgcacctaccgactctaccgacctcccgacgcccgcccaacctctcaacgcgaaaacccaacccgacccacgacgcccgcccgacccgaccgcgcgcctcaccaacgataacaaccctccgaaacctccaacgtaaaattaacgcgcgtaacccgcgtaaaaaacaacaacactttaaaaatattaaacttaaccgcaacgacgaaaaaacccgccgccaacaacaccgacaacgtcaacaacaacaacccccgaccccgcgccgccatcctcgccgcgcgtcacctcccgcgaccctacgcccgaccgcccgcgccgccccgttaccctccgctcccgcccgcgcgcgcgccaaaccaacaaataataaacgcgaaaacgaaacgaaaaccgtcgacgaccgccgcttcctaaacctaaacgcgaaaactctaaaaaccgaactcgcgacgaccccacccccaacccgaccctcgcgcaaaaacgcgaaactaaaaaataaacgcgcgcccgaacccccgaaactaaaaaaaaaaacttaaaacgcgcccgcgaaaacccctaaaccctaaaaatcccaaaaaaaaacccccgaacgccccgcaacacgcatcccgccctaatatttacccctaacgataaaa

SEQ ID NO: 30685 - DNA, 992 bp, Artificial Sequence
  chemically treated genomic DNA (Homo sapiens) CpG-island No: 30685
aagcggcgcggaggcggtgggtagagtttacggtcgcgggtagaatttacggtcgcgtttcgtcgggtgggcgttcggaacgtttcgggtttttcggagcgcgtcgttttaattcggtatgttttttagtttttcgcgttttcgagtgcggtttttttaggtttggaaagcgtttagaattaaaggtagaatatgaggagagattttacgtcgtttaggggtttttcgcggtagaggtcgacgtcgagtttaaggatacgttttcggggatattaaagttaaaggttaaaggttaagttcgagttttagttcgcgttcgcggcgattttcggaggtcgaagggcgtgggaattacgggcgtaagtcggttgtttattttcgtttcgggtcgttttttttaggagattagtgtagggcgagcggtcggaattcgggaatcgtagtcgataggtagtttatttacgtcgcgttagtcgggtacgaatttgtataacgcgatttttattaattttgcgttagcgcgtattgacgtagcgtttatgttcggtatttaggattaatagaaagtttcgaaggggatttgggttaattatattgcgtcgttttgagtcgtgttttcgtttcgcgtttgttacggaggtttacgacgtttaggcgttttcgcgattattcggagtgattgttcggtagagcgcggtaggtgttaacgcggggttttcgcgtagttggttcggttgggtgttaaagatttggtcggttttttttttaggttgcgtcgttcggttcgtgttttagcgtaggttttcggggcgtcgagtttgggggtgttcgtttcgcgggttttttttatttttaggaaaacgcgtcgcggggtttttcgtttgtttgttttgtatatacgtgttgttaaattttttcgtatcgtttttagatttggattggtcgttttattttttttttttattgatttatgttttgtttttttttttttt

SEQ ID NO: 30686 - DNA, 992 bp, Artificial Sequence
  chemically treated genomic DNA (Homo sapiens) CpG-island No: 30686
aaaaaaaaaaaaaacaaaacataaatcaataaaaaaaaaaaataaaacgaccaatccaaatctaaaaacgatacgaaaaaatttaacaacacgtatatacaaaacaaacaaacgaaaaaccccgcgacgcgttttcctaaaaataaaaaaaacccgcgaaacgaacacccccaaactcgacgccccgaaaacctacgctaaaacacgaaccgaacgacgcaacctaaaaaaaaaaccgaccaaatctttaacacccaaccgaaccaactacgcgaaaaccccgcgttaacacctaccgcgctctaccgaacaatcactccgaataatcgcgaaaacgcctaaacgtcgtaaacctccgtaacaaacgcgaaacgaaaacacgactcaaaacgacgcaatataattaacccaaatccccttcgaaactttctattaatcctaaataccgaacataaacgctacgtcaatacgcgctaacgcaaaattaataaaaatcgcgttatacaaattcgtacccgactaacgcgacgtaaataaactacctatcgactacgattcccgaattccgaccgctcgccctacactaatctcctaaaaaaaacgacccgaaacgaaaataaacaaccgacttacgcccgtaattcccacgcccttcgacctccgaaaatcgccgcgaacgcgaactaaaactcgaacttaacctttaacctttaactttaatatccccgaaaacgtatccttaaactcgacgtcgacctctaccgcgaaaaacccctaaacgacgtaaaatctctcctcatattctacctttaattctaaacgctttccaaacctaaaaaaaccgcactcgaaaacgcgaaaaactaaaaaacataccgaattaaaacgacgcgctccgaaaaacccgaaacgttccgaacgcccacccgacgaaacgcgaccgtaaattctacccgcgaccgtaaactctacccaccgcctccgcgccgctt

SEQ ID NO: 30687 - DNA, 992 bp, Artificial Sequence
  chemically treated genomic DNA (Homo sapiens) CpG-island No: 30687
aggaaaagaaaaagtaaaatatagattaatgaagggagaaggtggggcggttagtttagatttaaagacggtgcggggggatttggtaatacgtgtgtgtaagatagatagacgggaggtttcgcggcgcgtttttttaggaatgaaagggattcgcggggcgagtatttttaaattcggcgtttcggggatttgcgttgagatacgggtcgggcggcgtagtttgaggagaaagtcggttaggtttttgatatttagtcggattaattgcgcggagatttcgcgttgatatttatcgcgttttgtcgggtaattatttcgggtggtcgcggaagcgtttgggcgtcgtgggttttcgtagtaaacgcggggcgggagtacgatttagggcggcgtaatgtgattggtttaggtttttttcggagttttttattggttttgggtatcgagtatgggcgttgcgttagtgcgcgttggcgtaaggttggtggaagtcgcgttgtgtaggttcgtgttcggttggcgcggcgtgggtaagttgtttgtcggttacggttttcggatttcggtcgttcgttttgtattaattttttgggagaggcggttcggggcgggggtgggtagtcggtttgcgttcgtggtttttacgtttttcggttttcgggggtcgtcgcgggcgcgggttggggttcggatttggtttttggtttttggttttggtgttttcgggagcgtgtttttgggttcggcgtcggtttttgtcgcgggaggtttttgggcggcgtggggtttttttttatgttttgtttttggttttaggcgttttttaggtttagggaaatcgtattcggggacgcggggaattggggaatatgtcgggttggggcggcgcgtttcggggaattcgggacgtttcgagcgtttattcggcgggacgcggtcgtgagttttgttcgcggtcgtgagttttgtttatcgttttcgcgtcgttt

SEQ ID NO: 30688 - DNA, 992 bp, Artificial Sequence
  chemically treated genomic DNA (Homo sapiens) CpG-island No: 30688
aaacgacgcgaaaacgataaacaaaactcacgaccgcgaacaaaactcacgaccgcgtcccgccgaataaacgctcgaaacgtcccgaattccccgaaacgcgccgccccaacccgacatattccccaattccccgcgtccccgaatacgatttccctaaacctaaaaaacgcctaaaaccaaaaacaaaacataaaaaaaaaccccacgccgcccaaaaacctcccgcgacaaaaaccgacgccgaacccaaaaacacgctcccgaaaacaccaaaaccaaaaaccaaaaaccaaatccgaaccccaacccgcgcccgcgacgacccccgaaaaccgaaaaacgtaaaaaccacgaacgcaaaccgactacccacccccgccccgaaccgcctctcccaaaaaattaatacaaaacgaacgaccgaaatccgaaaaccgtaaccgacaaacaacttacccacgccgcgccaaccgaacacgaacctacacaacgcgacttccaccaaccttacgccaacgcgcactaacgcaacgcccatactcgatacccaaaaccaataaaaaactccgaaaaaaacctaaaccaatcacattacgccgccctaaatcgtactcccgccccgcgtttactacgaaaacccacgacgcccaaacgcttccgcgaccacccgaaataattacccgacaaaacgcgataaatatcaacgcgaaatctccgcgcaattaatccgactaaatatcaaaaacctaaccgactttctcctcaaactacgccgcccgacccgtatctcaacgcaaatccccgaaacgccgaatttaaaaatactcgccccgcgaatccctttcattcctaaaaaaacgcgccgcgaaacctcccgtctatctatcttacacacacgtattaccaaatccccccgcaccgtctttaaatctaaactaaccgccccaccttctcccttcattaatctatattttactttttcttttcct

SEQ ID NO: 30689 - DNA, 867 bp, Artificial Sequence
  chemically treated genomic DNA (Homo sapiens) CpG-island No: 30689
attcgcggggtacgtcggcgatcgtagggtcggggcgagtcgggagtttcggcggttgggttgggcggaggacgggtagtcgaggttcggtttttagcggcgcgtatcggtttcgggtttttttgggcgttggcgggttcgtttttttataaataaaatatagggcgtcgattttcgtaagtgatttcgaggagtttttttaagcggattttacgttagttcgacgatcgggcgttcgtttcgttcggttttcgggttttagtttcggggattttcgtttttttttttagttttcgtttcgttttcgggatcggtcgcgcgggcgtttttaggatttcgcgtttcgttcgttttttttttttttcgagtcgcgaattttttcggaggcggcggtttcggttgtcgttgggtttcggggtcgcgggttttgattgcgtcgttttttcgcgtagagttcgtcggcgtttcgacgggtttcggagtagcggttttcggtcgggtgagtgggagacgcgggaggaggaagggggttgttttaggtcgggcgggagggaacgtggcgcggtcgggcggggcggacgggggcgatcgcggggtttagtcgggggaggaaggaatcgtagagtcgtgttcgggagggatcgtagcgttattttttgcggggcgtcgttttcgcgttatcgagggtagttaatttttagtagaggatcggggtcgcggtcgtcgggggcgtagcgcggttagggcggttttcgtttacggtttaggtattttcgttgggttttgtcgggttttattttttttcgcgtagcgattcgggaagtaggatattttgtggagagtttaggattcgggagacgttttggg

SEQ ID NO: 30690 - DNA, 867 bp, Artificial Sequence
  chemically treated genomic DNA (Homo sapiens) CpG-island No: 30690
cccaaaacgtctcccgaatcctaaactctccacaaaatatcctacttcccgaatcgctacgcgaaaaaaaataaaacccgacaaaacccaacgaaaatacctaaaccgtaaacgaaaaccgccctaaccgcgctacgcccccgacgaccgcgaccccgatcctctactaaaaattaactaccctcgataacgcgaaaacgacgccccgcaaaaaataacgctacgatccctcccgaacacgactctacgattccttcctcccccgactaaaccccgcgatcgcccccgtccgccccgcccgaccgcgccacgttccctcccgcccgacctaaaacaacccccttcctcctcccgcgtctcccactcacccgaccgaaaaccgctactccgaaacccgtcgaaacgccgacgaactctacgcgaaaaaacgacgcaatcaaaacccgcgaccccgaaacccaacgacaaccgaaaccgccgcctccgaaaaaattcgcgactcgaaaaaaaaaaaaaacgaacgaaacgcgaaatcctaaaaacgcccgcgcgaccgatcccgaaaacgaaacgaaaactaaaaaaaaaaacgaaaatccccgaaactaaaacccgaaaaccgaacgaaacgaacgcccgatcgtcgaactaacgtaaaatccgcttaaaaaaactcctcgaaatcacttacgaaaatcgacgccctatattttatttataaaaaaacgaacccgccaacgcccaaaaaaacccgaaaccgatacgcgccgctaaaaaccgaacctcgactacccgtcctccgcccaacccaaccgccgaaactcccgactcgccccgaccctacgatcgccgacgtaccccgcgaat

SEQ ID NO: 30691 - DNA, 867 bp, Artificial Sequence
  chemically treated genomic DNA (Homo sapiens) CpG-island No: 30691
tttagggcgtttttcgggttttgggttttttataggatgttttatttttcgagtcgttgcgcggggaagggtgaggttcggtagggtttagcgggagtgtttgggtcgtgggcgggggtcgttttaatcgcgttgcgttttcggcggtcgcgatttcggttttttgttaggagttagttgttttcggtggcgcgggaacggcgtttcgtagagagtggcgttgcggtttttttcggatacggttttgcggtttttttttttttcggttgggtttcgcgatcgttttcgttcgtttcgttcggtcgcgttacgttttttttcgttcggtttgggatagtttttttttttttttcgcgttttttatttattcggtcgggggtcgttgtttcggggttcgtcggggcgtcggcgagttttgcgcggggaaacggcgtaattagggttcgcgatttcgggatttagcggtagtcgaggtcgtcgttttcggaaaagttcgcggttcgggaggggaggagagcgggcgggacgcggggttttagaggcgttcgcgcggtcgatttcgggagcggggcgggaattaggggaaggggcgggggttttcgaggttggggttcgggggtcggacggggcgggcgttcggtcgtcgggttgacgtggagttcgtttagaaaggtttttcggggttatttgcgaaagtcgacgttttgtattttatttatggaggagcgagttcgttagcgtttaggagggttcgaggtcggtgcgcgtcgttggaggtcggatttcggttgttcgtttttcgtttagtttagtcgtcgaggttttcggttcgtttcgattttgcggtcgtcggcgtgtttcgcgggt

SEQ ID NO: 30692 - DNA, 867 bp, Artificial Sequence
  chemically treated genomic DNA (Homo sapiens) CpG-island No: 30692
acccgcgaaacacgccgacgaccgcaaaatcgaaacgaaccgaaaacctcgacgactaaactaaacgaaaaacgaacaaccgaaatccgacctccaacgacgcgcaccgacctcgaaccctcctaaacgctaacgaactcgctcctccataaataaaatacaaaacgtcgactttcgcaaataaccccgaaaaacctttctaaacgaactccacgtcaacccgacgaccgaacgcccgccccgtccgacccccgaaccccaacctcgaaaacccccgccccttcccctaattcccgccccgctcccgaaatcgaccgcgcgaacgcctctaaaaccccgcgtcccgcccgctctcctcccctcccgaaccgcgaacttttccgaaaacgacgacctcgactaccgctaaatcccgaaatcgcgaaccctaattacgccgtttccccgcgcaaaactcgccgacgccccgacgaaccccgaaacaacgacccccgaccgaataaataaaaaacgcgaaaaaaaaaaaaaaactatcccaaaccgaacgaaaaaaaacgtaacgcgaccgaacgaaacgaacgaaaacgatcgcgaaacccaaccgaaaaaaaaaaaaaccgcaaaaccgtatccgaaaaaaaccgcaacgccactctctacgaaacgccgttcccgcgccaccgaaaacaactaactcctaacaaaaaaccgaaatcgcgaccgccgaaaacgcaacgcgattaaaacgacccccgcccacgacccaaacactcccgctaaaccctaccgaacctcacccttccccgcgcaacgactcgaaaaataaaacatcctataaaaaacccaaaacccgaaaaacgccctaaa

SEQ ID NO: 30693 - DNA, 875 bp, Artificial Sequence
  chemically treated genomic DNA (Homo sapiens) CpG-island No: 30693
ttcgcgtcgcgtttcgttttttttcggtttcggttttttttcgtttagcgcggggaggcggggacgcgtcggcggcggaggtttttttagtcgcgttttttttatttattggggagttcggcggtggcggtatttttcgaggtagattcgttgagttgttagttcgtcggttagcgagtgagaggtcggatagattgtggagtcgatagattgaaggatagcggtatcgttagacggttagaaagtttcgttatgagttggggtacggagttgtgggtgagtcggggagaggggcgtttcgtacggatttcggtttttgagaagcgcgggttgggcgggcgtcgcggattttcggcggtgaaagcgcgtttcgtcgttttcggttcggcgttggcggagggtgagggtttcgttcgtttttgtgtgtagatttttttttttttttcggtcgggggtttagggggtcgttagttcgtgttttcgtttttgtcgtcgtggtgtagttcgggcggcgttcgggacggtcgggggagtagttcgcgggtttttgcgtgcgtcgtgatttttttttgtttttttttttttttttatttttatttttttcgacgtttggtttcgcgttcggcggtttttttttttttttgtattttttttttcggaggcgggggagggggtttattgtttttaaggggcgttgttcgagggcggggaggggatcggtcgcgatttttcgttcgggttaggttcgcggggttagggcgtcgttcgtttggggcggcgtcgtttagagttttcgttttaggtatggggatttaggcggttttgttcggagttcggtttcgggttagttaggtttagtttatacgtatattttt

SEQ ID NO: 30694 - DNA, 875 bp, Artificial Sequence
  chemically treated genomic DNA (Homo sapiens) CpG-island No: 30694
aaaaatatacgtataaactaaacctaactaacccgaaaccgaactccgaacaaaaccgcctaaatccccatacctaaaacgaaaactctaaacgacgccgccccaaacgaacgacgccctaaccccgcgaacctaacccgaacgaaaaatcgcgaccgatcccctccccgccctcgaacaacgccccttaaaaacaataaaccccctcccccgcctccgaaaaaaaaaatacaaaaaaaaaaaaaaaccgccgaacgcgaaaccaaacgtcgaaaaaaataaaaataaaaaaaaaaaaaaaaacaaaaaaaaatcacgacgcacgcaaaaacccgcgaactactcccccgaccgtcccgaacgccgcccgaactacaccacgacgacaaaaacgaaaacacgaactaacgaccccctaaacccccgaccgaaaaaaaaaaaaaaatctacacacaaaaacgaacgaaaccctcaccctccgccaacgccgaaccgaaaacgacgaaacgcgctttcaccgccgaaaatccgcgacgcccgcccaacccgcgcttctcaaaaaccgaaatccgtacgaaacgcccctctccccgactcacccacaactccgtaccccaactcataacgaaactttctaaccgtctaacgataccgctatccttcaatctatcgactccacaatctatccgacctctcactcgctaaccgacgaactaacaactcaacgaatctacctcgaaaaataccgccaccgccgaactccccaataaataaaaaaaacgcgactaaaaaaacctccgccgccgacgcgtccccgcctccccgcgctaaacgaaaaaaaaccgaaaccgaaaaaaaacgaaacgcgacgcgaa

SEQ ID NO: 30695 - DNA, 875 bp, Artificial Sequence
  chemically treated genomic DNA (Homo sapiens) CpG-island No: 30695
agaaatgtgcgtgtgggttgggtttggttggttcgaggtcgggtttcgaataaagtcgtttgggtttttatatttggggcgagggttttgggcggcgtcgttttagacgggcgacgttttagtttcgcggatttggttcgggcgaggaatcgcggtcggtttttttttcgttttcgaatagcgttttttggggataatgggttttttttttcgttttcgggaggagagatataaaggaagagaggagtcgtcgggcgcgaagttaggcgtcgggaaaagtgaaggtggaggagggagaaggaataagaggggattacggcgtacgtaggagttcgcgggttgttttttcggtcgtttcgggcgtcgttcgagttgtattacggcggtaaaggcgggagtacggattagcggttttttagattttcggtcgagaagggaagaggagtttgtatataaagacgagcgggatttttatttttcgttagcgtcggatcgaggacggcggagcgcgtttttatcgtcgagggttcgcggcgttcgtttaattcgcgttttttaggggtcggggttcgtgcggggcgttttttttttcgatttatttatagtttcgtgttttagtttatggcggaattttttggtcgtttggcggtgtcgttgttttttagtttgtcggttttatagtttgttcgattttttattcgttggtcggcgggttagtagtttagcgggtttatttcgaaaggtgtcgttatcgtcgggttttttagtgagtgagaaagacgcgattggagaagttttcgtcgtcgacgcgttttcgttttttcgcgttgggcgggagggggtcggggtcgaggggaggcggaacgcggcgcggg

SEQ ID NO: 30696 - DNA, 875 bp, Artificial Sequence
  chemically treated genomic DNA (Homo sapiens) CpG-island No: 30696
cccgcgccgcgttccgcctcccctcgaccccgaccccctcccgcccaacgcgaaaaaacgaaaacgcgtcgacgacgaaaacttctccaatcgcgtctttctcactcactaaaaaacccgacgataacgacacctttcgaaataaacccgctaaactactaacccgccgaccaacgaataaaaaatcgaacaaactataaaaccgacaaactaaaaaacaacgacaccgccaaacgaccaaaaaattccgccataaactaaaacacgaaactataaataaatcgaaaaaaaaaacgccccgcacgaaccccgacccctaaaaaacgcgaattaaacgaacgccgcgaaccctcgacgataaaaacgcgctccgccgtcctcgatccgacgctaacgaaaaataaaaatcccgctcgtctttatatacaaactcctcttcccttctcgaccgaaaatctaaaaaaccgctaatccgtactcccgcctttaccgccgtaatacaactcgaacgacgcccgaaacgaccgaaaaaacaacccgcgaactcctacgtacgccgtaatcccctcttattccttctccctcctccaccttcacttttcccgacgcctaacttcgcgcccgacgactcctctcttcctttatatctctcctcccgaaaacgaaaaaaaaaacccattatccccaaaaaacgctattcgaaaacgaaaaaaaaaccgaccgcgattcctcgcccgaaccaaatccgcgaaactaaaacgtcgcccgtctaaaacgacgccgcccaaaaccctcgccccaaatataaaaacccaaacgactttattcgaaacccgacctcgaaccaaccaaacccaacccacacgcacatttct

SEQ ID NO: 30697 - DNA, 1281 bp, Artificial Sequence
  chemically treated genomic DNA (Homo sapiens) CpG-island No: 30697
cgcgcgttattgttatattttaggcgttcgttacgtcgttaggtgtgttcggtcgattcggaagtagcggtatttttagtgcgttgcggagacgttattttgtcgcggtataggggcgggagcgtttgtggttttgcgtatttgcgttattacgtaggttggcggggtttcgtgatggggaggtgacgtaggcgatacggaagcggcggtgggcggggatagggagttagcggaatttagtttcgttttttaaagttttttaattttttcggagttagcgtagcgcgaacgttgggtgcggcgtttttaagcgtcgcggtgatacgtgtgtgaggcgtcggaggttcggatggtgcgcgtgttgggtcgcgggtcgaaggagtcgttagggttgcgtaggtttgtggcgcgttcgcggagaggtcggggtaggttggggtcgggtcggggcggtgcgtaggtttggggacgagatcggggcggggggtttcgcgaggtttggggcgcgggaagggttggcgggcgtagtcgggacgtttagggagaacgtgggcgcgggttcgcgtagggtttcggtcgttttcgaggaggattcgggatgtttcgttcgttcgcgagttcgtttttttagagttcgggtattttcgaggagggttcggggtcgggttgttttcgtcggttttcgtcgtttttcgggtttcgggtcggtgatgggggtcgtcggggttcgttgtttgtgtaggatttaggttaatttcggagaggttgaagtcggaattagggcgagggcgtcgcgtgcggtcgtagagtttagcggggcgggtgcggtttcggggcgggtatttttttcgtggttgcggaggaggttatggagttcggggcggggtgcggtttcgatgttgttgtttttggcgggtggcgtgggggttttgggtttggggttggagtggcggtcgttaaatttagatatacgagaggggagatttcgcgcgttttcgtttacgtaacgttcgttacggagttatgttcggggagaggtgttcgggtcgttgtgttcgcggtcgggttcggggtaggcgttgcggagtcgttcgggaggtttttggagcgcggcgttgggtttcgggaggtcgttgttttcgtgggtttttttttttagtacgtggttgattttgcgagcgttcgttgtagtttattttggaaaagtgattttagaaggaggagggagcgggaatgagtttaaatggtgttggttggggttcgcgtaggtggaaatgtgga

SEQ ID NO: 30698 - DNA, 1281 bp, Artificial Sequence
  chemically treated genomic DNA (Homo sapiens) CpG-island No: 30698
tccacatttccacctacgcgaaccccaaccaacaccatttaaactcattcccgctccctcctccttctaaaatcacttttccaaaataaactacaacgaacgctcgcaaaatcaaccacgtactaaaaaaaaaaacccacgaaaacaacgacctcccgaaacccaacgccgcgctccaaaaacctcccgaacgactccgcaacgcctaccccgaacccgaccgcgaacacaacgacccgaacacctctccccgaacataactccgtaacgaacgttacgtaaacgaaaacgcgcgaaatctcccctctcgtatatctaaatttaacgaccgccactccaaccccaaacccaaaacccccacgccacccgccaaaaacaacaacatcgaaaccgcaccccgccccgaactccataacctcctccgcaaccacgaaaaaaatacccgccccgaaaccgcacccgccccgctaaactctacgaccgcacgcgacgccctcgccctaattccgacttcaacctctccgaaattaacctaaatcctacacaaacaacgaaccccgacgacccccatcaccgacccgaaacccgaaaaacgacgaaaaccgacgaaaacaacccgaccccgaaccctcctcgaaaatacccgaactctaaaaaaacgaactcgcgaacgaacgaaacatcccgaatcctcctcgaaaacgaccgaaaccctacgcgaacccgcgcccacgttctccctaaacgtcccgactacgcccgccaacccttcccgcgccccaaacctcgcgaaaccccccgccccgatctcgtccccaaacctacgcaccgccccgacccgaccccaacctaccccgacctctccgcgaacgcgccacaaacctacgcaaccctaacgactccttcgacccgcgacccaacacgcgcaccatccgaacctccgacgcctcacacacgtatcaccgcgacgcttaaaaacgccgcacccaacgttcgcgctacgctaactccgaaaaaattaaaaaactttaaaaaacgaaactaaattccgctaactccctatccccgcccaccgccgcttccgtatcgcctacgtcacctccccatcacgaaaccccgccaacctacgtaataacgcaaatacgcaaaaccacaaacgctcccgcccctataccgcgacaaaataacgtctccgcaacgcactaaaaataccgctacttccgaatcgaccgaacacacctaacgacgtaacgaacgcctaaaatataacaataacgcgcg

SEQ ID NO: 30699 - DNA, 1281 bp, Artificial Sequence
  chemically treated genomic DNA (Homo sapiens) CpG-island No: 30699
tttatatttttatttgcgcgaattttagttagtattatttaggtttattttcgtttttttttttttttaaagttatttttttaggatgaattgtaacggacgttcgtagggttaattacgtgttggggagaggagtttacggaagtagcggtttttcggggtttagcgtcgcgttttaggggtttttcgggcgatttcgtagcgtttgtttcgagttcggtcgcggatatagcgattcgagtattttttttcgagtatggtttcgtggcgagcgttacgtaaacgggggcgcgcggagttttttttttcgtgtgtttgggtttggcggtcgttattttagttttaggtttaggatttttacgttattcgttagaagtagtagtatcggaatcgtatttcgtttcgggttttatggtttttttcgtaattacgaggaaggtgttcgtttcggggtcgtattcgtttcgttgagttttgcggtcgtacgcgacgttttcgttttgatttcgattttaattttttcgaagttgatttgaattttgtatagatagcgggtttcggcgatttttattatcggttcggagttcgggggacggcggagatcggcgaggatagttcggtttcggatttttttcgggaatattcgggttttggagaagcgagttcgcgagcgggcggagtatttcgggtttttttcggggacggtcgaagttttgcgcggattcgcgtttacgttttttttgagcgtttcggttgcgttcgttagtttttttcgcgttttaggtttcgcggaatttttcgtttcggtttcgtttttaggtttgcgtatcgtttcgattcgattttagtttatttcggttttttcgcgggcgcgttataagtttacgtagttttggcgattttttcggttcgcggtttagtacgcgtattattcgggttttcggcgttttatatacgtgttatcgcgacgtttaaaggcgtcgtatttagcgttcgcgttgcgttaatttcgaaagggttgggaggttttaagaggcggggttagatttcgttaattttttgttttcgtttatcgtcgttttcgtgtcgtttacgttatttttttattacgggatttcgttagtttacgtgatgacgtaagtgcgtagagttataggcgttttcgtttttgtgtcgcggtagggtgacgttttcgtagcgtattagaggtgtcgttattttcgggtcggtcgagtatatttggcggcgtggcggacgtttgaagtgtgatagtggcgcgcg

SEQ ID NO: 30700 - DNA, 1281 bp, Artificial Sequence
  chemically treated genomic DNA (Homo sapiens) CpG-island No: 30700
cgcgcgccactatcacacttcaaacgtccgccacgccgccaaatatactcgaccgacccgaaaataacgacacctctaatacgctacgaaaacgtcaccctaccgcgacacaaaaacgaaaacgcctataactctacgcacttacgtcatcacgtaaactaacgaaatcccgtaataaaaaaataacgtaaacgacacgaaaacgacgataaacgaaaacaaaaaattaacgaaatctaaccccgcctcttaaaacctcccaaccctttcgaaattaacgcaacgcgaacgctaaatacgacgcctttaaacgtcgcgataacacgtatataaaacgccgaaaacccgaataatacgcgtactaaaccgcgaaccgaaaaaatcgccaaaactacgtaaacttataacgcgcccgcgaaaaaaccgaaataaactaaaatcgaatcgaaacgatacgcaaacctaaaaacgaaaccgaaacgaaaaattccgcgaaacctaaaacgcgaaaaaaactaacgaacgcaaccgaaacgctcaaaaaaaacgtaaacgcgaatccgcgcaaaacttcgaccgtccccgaaaaaaacccgaaatactccgcccgctcgcgaactcgcttctccaaaacccgaatattcccgaaaaaaatccgaaaccgaactatcctcgccgatctccgccgtcccccgaactccgaaccgataataaaaatcgccgaaacccgctatctatacaaaattcaaatcaacttcgaaaaaattaaaatcgaaatcaaaacgaaaacgtcgcgtacgaccgcaaaactcaacgaaacgaatacgaccccgaaacgaacaccttcctcgtaattacgaaaaaaaccataaaacccgaaacgaaatacgattccgatactactacttctaacgaataacgtaaaaatcctaaacctaaaactaaaataacgaccgccaaacccaaacacacgaaaaaaaaaactccgcgcgcccccgtttacgtaacgctcgccacgaaaccatactcgaaaaaaaatactcgaatcgctatatccgcgaccgaactcgaaacaaacgctacgaaatcgcccgaaaaacccctaaaacgcgacgctaaaccccgaaaaaccgctacttccgtaaactcctctccccaacacgtaattaaccctacgaacgtccgttacaattcatcctaaaaaaataactttaaaaaaaaaaaaaaacgaaaataaacctaaataatactaactaaaattcgcgcaaataaaaatataaa

SEQ ID NO: 30701 - DNA, 1210 bp, Artificial Sequence
  chemically treated genomic DNA (Homo sapiens) CpG-island No: 30701
gagcggcgtttttatcgcggtgtttttcgggttttatattcgcgtttcggtaggcggcgacgtatcggatcggcggttatcgggtttagattttcgcgggtagggtcgtttcggagttcgcgtttcgtcggcggcgtcgtttttcgtttttatttttgaataaagacgtggatcgggtataattcgttgacgtcgagagcggtcggaaattgcggggaacgcgggttcggttattcgcgcgttcgtttcgagtttcgtagaggggcggtagggttagcgatttttatttttcggtttttcgggattcggattgcgatttttgtttcggggattttagcgattttaacgatttttattttttagagtttttgagattttgtttcgcgattttaacgatttttattttttagagttcgcggcgatttttggtttcgcgagatcgcgagttcggtttgtgattttcgttttagttatttatattttttagcgtcgttagcgatttcggtttcggcgatttttattttttaaaattttttgcgattttcgtttcgcgagggtttcgcgtatcgttcgttcgtcggtcgtttcgggtttcgcgtttcgtattagtgttttcgggaaacgttagtcgtcgtaagcgttgtcggacggtcgggttcggaggggattgggggatagcgagggggaagcgttcgtcgtcggggcgtattgatcgtagttgtcgtttttttttatggtgcgggagtcgggtttcgcgtttcggttcgtcgttcgcgtttcgtcgcgttattcgcgttttcgttcgttttagttcggttcggagtttcgttttcggcgtttcgcgtttcgcgtttcgttcgttcgcgtttgcgtttgcgttcgttttttgttttcggttcgaggtttcgtttttcgttcgaggtttcgtttttttttcgcgcgcgtcgtatttcgggtattcggttttttttcgaggtttcggtttgcgtacgcgcgtttattcgaggttttttttttgttttcgtttttagattacgttttcgtttcgagatatatatattttttttttttttttcggttcgttttttggggtcgagtaggtttcggtttttgaagggcggtgtaagttttcggggtggcggattcgatttggtttgtagttaggttattgtacgaaagtttaaggtcgtgttcggttattgaagggtag

SEQ ID NO: 30702 - DNA, 1210 bp, Artificial Sequence
  chemically treated genomic DNA (Homo sapiens) CpG-island No: 30702
ctacccttcaataaccgaacacgaccttaaactttcgtacaataacctaactacaaaccaaatcgaatccgccaccccgaaaacttacaccgcccttcaaaaaccgaaacctactcgaccccaaaaaacgaaccgaaaaaaaaaaaaaaaatatatatatctcgaaacgaaaacgtaatctaaaaacgaaaacaaaaaaaaaacctcgaataaacgcgcgtacgcaaaccgaaacctcgaaaaaaaaccgaatacccgaaatacgacgcgcgcgaaaaaaaaacgaaacctcgaacgaaaaacgaaacctcgaaccgaaaacaaaaaacgaacgcaaacgcaaacgcgaacgaacgaaacgcgaaacgcgaaacgccgaaaacgaaactccgaaccgaactaaaacgaacgaaaacgcgaataacgcgacgaaacgcgaacgacgaaccgaaacgcgaaacccgactcccgcaccataaaaaaaaacgacaactacgatcaatacgccccgacgacgaacgcttccccctcgctatcccccaatcccctccgaacccgaccgtccgacaacgcttacgacgactaacgtttcccgaaaacactaatacgaaacgcgaaacccgaaacgaccgacgaacgaacgatacgcgaaaccctcgcgaaacgaaaatcgcaaaaaattttaaaaaataaaaatcgccgaaaccgaaatcgctaacgacgctaaaaaatataaataactaaaacgaaaatcacaaaccgaactcgcgatctcgcgaaaccaaaaatcgccgcgaactctaaaaaataaaaatcgttaaaatcgcgaaacaaaatctcaaaaactctaaaaaataaaaatcgttaaaatcgctaaaatccccgaaacaaaaatcgcaatccgaatcccgaaaaaccgaaaaataaaaatcgctaaccctaccgcccctctacgaaactcgaaacgaacgcgcgaataaccgaacccgcgttccccgcaatttccgaccgctctcgacgtcaacgaattatacccgatccacgtctttattcaaaaataaaaacgaaaaacgacgccgccgacgaaacgcgaactccgaaacgaccctacccgcgaaaatctaaacccgataaccgccgatccgatacgtcgccgcctaccgaaacgcgaatataaaacccgaaaaacaccgcgataaaaacgccgctc

SEQ ID NO: 30703 - DNA, 1210 bp, Artificial Sequence
  chemically treated genomic DNA (Homo sapiens) CpG-island No: 30703
ttgttttttagtggtcggatacgattttgggttttcgtgtagtagtttggttgtaggttaggtcgagttcgttatttcggggatttgtatcgttttttagaaatcgaaatttgttcggttttaggaggcggatcgggagaaggggggggggtgtgtgtgtttcgggacgggggcgtggtttagaggcgggggtaggggaggagtttcgggtggacgcgcgtgcgtaggtcggagtttcgggaggaggtcgggtattcggggtgcggcgcgcgcgggaggaaggcggggtttcgggcgaggggcggggtttcgggtcgggggtagggggcgggcgtaggcgtaggcgcgggcgggcggggcgcggggcgcggggcgtcgggggcggggtttcgagtcgggttgaggcgagcgggggcgcgggtggcgcggcgggacgcgagcggcgagtcggagcgcggagttcggttttcgtattatggaggaggacgatagttacggttagtgcgtttcggcggcggacgtttttttttcgttgttttttagtttttttcgggttcggtcgttcggtagcgtttgcggcggttggcgtttttcggggatattggtgcgggacgcggagttcggggcgatcggcgggcgagcggtgcgcggggttttcgcggggcgggggtcgtagggggttttgagggatgagggtcgtcggggtcggggtcgttggcggcgttgagggatgtgggtggttggggcgggggttataggtcgggttcgcggtttcgcggggttaggggtcgtcgcgagttttgaggaatgagggtcgttggggtcgcggggtaggattttaggggttttgagggatgagagtcgttggggtcgttggggttttcggggtaggggtcgtagttcgggtttcggggggtcgaggggtggaggtcgttggttttgtcgtttttttgcggggttcggggcggacgcgcggatggtcgggttcgcgtttttcgtagttttcggtcgttttcggcgttagcgagttgtgttcggtttacgtttttgtttagaaatgagaacggggagcggcgtcgtcggcgaggcgcgggtttcgggacggttttgttcgcgggagtttgggttcggtagtcgtcggttcggtgcgtcgtcgtttgtcgagacgcgggtgtggagttcgaggggtatcgcggtggggacgtcgttt

SEQ ID NO: 30704 - DNA, 1210 bp, Artificial Sequence
  chemically treated genomic DNA (Homo sapiens) CpG-island No: 30704
aaacgacgtccccaccgcgatacccctcgaactccacacccgcgtctcgacaaacgacgacgcaccgaaccgacgactaccgaacccaaactcccgcgaacaaaaccgtcccgaaacccgcgcctcgccgacgacgccgctccccgttctcatttctaaacaaaaacgtaaaccgaacacaactcgctaacgccgaaaacgaccgaaaactacgaaaaacgcgaacccgaccatccgcgcgtccgccccgaaccccgcaaaaaaacgacaaaaccaacgacctccacccctcgaccccccgaaacccgaactacgacccctaccccgaaaaccccaacgaccccaacgactctcatccctcaaaacccctaaaatcctaccccgcgaccccaacgaccctcattcctcaaaactcgcgacgacccctaaccccgcgaaaccgcgaacccgacctataacccccgccccaaccacccacatccctcaacgccgccaacgaccccgaccccgacgaccctcatccctcaaaaccccctacgacccccgccccgcgaaaaccccgcgcaccgctcgcccgccgatcgccccgaactccgcgtcccgcaccaatatccccgaaaaacgccaaccgccgcaaacgctaccgaacgaccgaacccgaaaaaaactaaaaaacaacgaaaaaaaaacgtccgccgccgaaacgcactaaccgtaactatcgtcctcctccataatacgaaaaccgaactccgcgctccgactcgccgctcgcgtcccgccgcgccacccgcgcccccgctcgcctcaacccgactcgaaaccccgcccccgacgccccgcgccccgcgccccgcccgcccgcgcctacgcctacgcccgccccctacccccgacccgaaaccccgcccctcgcccgaaaccccgccttcctcccgcgcgcgccgcaccccgaatacccgacctcctcccgaaactccgacctacgcacgcgcgtccacccgaaactcctcccctacccccgcctctaaaccacgcccccgtcccgaaacacacacaccccccccccttctcccgatccgcctcctaaaaccgaacaaatttcgatttctaaaaaacgatacaaatccccgaaataacgaactcgacctaacctacaaccaaactactacacgaaaacccaaaatcgtatccgaccactaaaaaacaa

SEQ ID NO: 30705 - DNA, 869 bp, Artificial Sequence
  chemically treated genomic DNA (Homo sapiens) CpG-island No: 30705
gcgcgtgacgggcgcgcgtgacgtcgagggggtaggtttgagaagtaggttgcgtcgggattcggcggtcggttttcgcggaaggggcgggttaggttagggggcggtgtttaatgggagttggttttggggtcgggttttcgcgtgcgttggtttggcggcgagagcgcgcggcgggggcgtgttcggcgggcggggcggggttagtcgggggcggggcggggcgcggtttaacggcggcggcggcggcggcgacggcgatagtagcggtggtggtgtttggttagttcggcggttgtagatttcgcggcgacgtttgcgagggattcgggtcgcgggtcgaggcgggcggcgtttgcgagggattcgtgtcgcgggtagaggcgggcggcgcgcggcggcggcgttcggcgatggtaggcgtttttggagcggtcgttttttagcgtaagtggggcgtgaatgcgggcggtcgaggggggcgtgtgagggtttgcggtttcgtaggcgcggtgatttcgagtgtttcgggcgcgaggtcgggagtggaaattgaggttcgaagcggggcggcggatttaaggttacgtagcggggcgggttttttcgggtttttgaggttatttcgtcgttttttgcgtcgttcgaagagttcggggtttacggtgtgagggaaattgtggggttcgcggtttcggaatttaggtcgggtcggcgtttatgggatttgtcggcgggtaagaattattttgttgttttagcgttggggttacgaagttcggtttttggggaaatattatattcgttcgatgttgagggttggaggagatgagaatggtttttcggagggtttgtttgagcgtaggttt

SEQ ID NO: 30706 - DNA, 869 bp, Artificial Sequence
  chemically treated genomic DNA (Homo sapiens) CpG-island No: 30706
aaacctacgctcaaacaaaccctccgaaaaaccattctcatctcctccaaccctcaacatcgaacgaatataatatttccccaaaaaccgaacttcgtaaccccaacgctaaaacaacaaaataattcttacccgccgacaaatcccataaacgccgacccgacctaaattccgaaaccgcgaaccccacaatttccctcacaccgtaaaccccgaactcttcgaacgacgcaaaaaacgacgaaataacctcaaaaacccgaaaaaacccgccccgctacgtaaccttaaatccgccgccccgcttcgaacctcaatttccactcccgacctcgcgcccgaaacactcgaaatcaccgcgcctacgaaaccgcaaaccctcacacgcccccctcgaccgcccgcattcacgccccacttacgctaaaaaacgaccgctccaaaaacgcctaccatcgccgaacgccgccgccgcgcgccgcccgcctctacccgcgacacgaatccctcgcaaacgccgcccgcctcgacccgcgacccgaatccctcgcaaacgtcgccgcgaaatctacaaccgccgaactaaccaaacaccaccaccgctactatcgccgtcgccgccgccgccgccgccgttaaaccgcgccccgccccgcccccgactaaccccgccccgcccgccgaacacgcccccgccgcgcgctctcgccgccaaaccaacgcacgcgaaaacccgaccccaaaaccaactcccattaaacaccgccccctaacctaacccgccccttccgcgaaaaccgaccgccgaatcccgacgcaacctacttctcaaacctaccccctcgacgtcacgcgcgcccgtcacgcgc

SEQ ID NO: 30707 - DNA, 869 bp, Artificial Sequence
  chemically treated genomic DNA (Homo sapiens) CpG-island No: 30707
gagtttgcgtttaaataggtttttcgaggggttatttttattttttttaatttttaatatcgggcgggtgtagtatttttttaggagtcggatttcgtggttttagcgttgggataataaaatgatttttgttcgtcggtaagttttatggacgtcggttcggtttaagtttcgaggtcgcgggttttataattttttttatatcgtgagtttcgagtttttcgggcggcgtaggaagcgacggggtggttttaggagttcgggaaggttcgtttcgttgcgtgattttggattcgtcgtttcgtttcgggttttagtttttattttcggtttcgcgttcggggtattcggaattatcgcgtttgcggagtcgtaggtttttatacgtttttttcggtcgttcgtatttacgttttatttacgttggaaggcggtcgttttagggacgtttattatcgtcgagcgtcgtcgtcgcgcgtcgttcgtttttattcgcgatacgggtttttcgtaggcgtcgttcgtttcgattcgcggttcgggtttttcgtaggcgtcgtcgcgagatttgtagtcgtcgagttaattagatattattatcgttgttgtcgtcgtcgtcgtcgtcgtcgtcgtcgttaggtcgcgtttcgtttcgttttcggttggtttcgtttcgttcgtcgggtacgttttcgtcgcgcgttttcgtcgttaggttaacgtacgcggaagttcggttttaagattagtttttattaagtatcgttttttaatttgattcgtttttttcgcgggaatcgatcgtcgaatttcggcgtagtttgttttttagatttgttttttcggcgttacgcgcgttcgttacgcgt

SEQ ID NO: 30708 - DNA, 869 bp, Artificial Sequence
  chemically treated genomic DNA (Homo sapiens) CpG-island No: 30708
acgcgtaacgaacgcgcgtaacgccgaaaaaacaaatctaaaaaacaaactacgccgaaattcgacgatcgattcccgcgaaaaaaacgaatcaaattaaaaaacgatacttaataaaaactaatcttaaaaccgaacttccgcgtacgttaacctaacgacgaaaacgcgcgacgaaaacgtacccgacgaacgaaacgaaaccaaccgaaaacgaaacgaaacgcgacctaacgacgacgacgacgacgacgacgacgacaacaacgataataatatctaattaactcgacgactacaaatctcgcgacgacgcctacgaaaaacccgaaccgcgaatcgaaacgaacgacgcctacgaaaaacccgtatcgcgaataaaaacgaacgacgcgcgacgacgacgctcgacgataataaacgtccctaaaacgaccgccttccaacgtaaataaaacgtaaatacgaacgaccgaaaaaaacgtataaaaacctacgactccgcaaacgcgataattccgaataccccgaacgcgaaaccgaaaataaaaactaaaacccgaaacgaaacgacgaatccaaaatcacgcaacgaaacgaaccttcccgaactcctaaaaccaccccgtcgcttcctacgccgcccgaaaaactcgaaactcacgatataaaaaaaattataaaacccgcgacctcgaaacttaaaccgaaccgacgtccataaaacttaccgacgaacaaaaatcattttattatcccaacgctaaaaccacgaaatccgactcctaaaaaaatactacacccgcccgatattaaaaattaaaaaaaataaaaataacccctcgaaaaacctatttaaacgcaaactc

SEQ ID NO: 30709 - DNA, 527 bp, Artificial Sequence
  chemically treated genomic DNA (Homo sapiens) CpG-island No: 30709
ggagttttttagtagggattatttttagtaatgcggtagcggtcgttttatgatatattaattattatttgtttttttttttcgtcgcggttataggaggcgttgcgggtgggcggtgaggtgggatcgcgggcggatttgtggggcggggggcgggggtattgtggaatacgagtggaggtggagggggcgcggttcgtcgaagtgtttttttgggtgtttagtttggttttttcggggttcggggttgcgtatcgtcgtgcgtttttcgtagaggttttgtcgatgtcgtatcgtttcgtatcgcgataaaagtttttttcggttttaatattataatcgttaagcgtggtttttgatattttcgttggcgttttcgttcgcgcgtttttttttcgtgttaaggtatacgtatacgtatcgatttatttattgttttttattttaggtgttaaaatttttcgaagtaggtgtagtttttcgttcggtaggtttaggttggttcggcgttttttcgtttattttat

SEQ ID NO: 30710 - DNA, 527 bp, Artificial Sequence
  chemically treated genomic DNA (Homo sapiens) CpG-island No: 30710
ataaaataaacgaaaaaacgccgaaccaacctaaacctaccgaacgaaaaactacacctacttcgaaaaattttaacacctaaaataaaaaacaataaataaatcgatacgtatacgtataccttaacacgaaaaaaaaacgcgcgaacgaaaacgccaacgaaaatatcaaaaaccacgcttaacgattataatattaaaaccgaaaaaaacttttatcgcgatacgaaacgatacgacatcgacaaaacctctacgaaaaacgcacgacgatacgcaaccccgaaccccgaaaaaaccaaactaaacacccaaaaaaacacttcgacgaaccgcgccccctccacctccactcgtattccacaatacccccgccccccgccccacaaatccgcccgcgatcccacctcaccgcccacccgcaacgcctcctataaccgcgacgaaaaaaaaaaacaaataataattaatatatcataaaacgaccgctaccgcattactaaaaataatccctactaaaaaactcc

SEQ ID NO: 30711 - DNA, 527 bp, Artificial Sequence
  chemically treated genomic DNA (Homo sapiens) CpG-island No: 30711
ataaggtgagcgagggggcgtcgggttagtttggatttgtcgggcgaggggttgtatttgtttcgagaagttttggtatttgggatggaaagtaatgagtgggtcggtgcgtgtgcgtgtgttttggtacggggggagggcgcgcgaacgaagacgttagcgggagtgttagagattacgtttggcgattgtgatgttggaatcgggaagggtttttgtcgcggtgcggggcggtgcgatatcggtagagtttttgcggagggcgtacggcggtgcgtagtttcggatttcggagggattaggttgggtatttaggggggtatttcggcgagtcgcgttttttttatttttattcgtgttttataatattttcgtttttcgttttatagattcgttcgcgattttattttatcgtttattcgtagcgttttttgtgatcgcggcgagggggagaggtaaatagtaattaatatgttatggggcggtcgttgtcgtattgttaagaataatttttgttggagagtttt

SEQ ID NO: 30712 - DNA, 527 bp, Artificial Sequence
  chemically treated genomic DNA (Homo sapiens) CpG-island No: 30712
aaaactctccaacaaaaattattcttaacaatacgacaacgaccgccccataacatattaattactatttacctctccccctcgccgcgatcacaaaaaacgctacgaataaacgataaaataaaatcgcgaacgaatctataaaacgaaaaacgaaaatattataaaacacgaataaaaataaaaaaaacgcgactcgccgaaatacccccctaaatacccaacctaatccctccgaaatccgaaactacgcaccgccgtacgccctccgcaaaaactctaccgatatcgcaccgccccgcaccgcgacaaaaacccttcccgattccaacatcacaatcgccaaacgtaatctctaacactcccgctaacgtcttcgttcgcgcgccctccccccgtaccaaaacacacgcacacgcaccgacccactcattactttccatcccaaataccaaaacttctcgaaacaaatacaacccctcgcccgacaaatccaaactaacccgacgccccctcgctcaccttat

SEQ ID NO: 30713 - DNA, 672 bp, Artificial Sequence
  chemically treated genomic DNA (Homo sapiens) CpG-island No: 30713
ttttttcggtgggatatacgattttttcgtaacgggcgtattgggggtttatgatcgcggttttcgggggcggcggcggcggcggttgttggtttttaggagtcgttgtgatatttttcggcgagtttcgtatcgttttttggtaggcgggagggttgcgggcggcgggcgtcgggtagggagtcggcgtcgggttacgggtgagtgtacggggagggcgacggggtttggcgtttggggtcggtcgcgttttcgggttcgtaggcgttgggtttcggtttcggtttcggtttcgcgtcgttggttttgcgtcgttcgtattttaggtacgggtgatttatatagttattcgcgttcgtttttcgcgtttattcgttttttcgtttcgtcgtcgtcgtcgcgtaggttaaatttatcggcgcgttcggatcgaagtggtagggaacgtgtacgtcgggtattttgggagggagggcgtagcgggggagggggcgggtagagattcggaaagtttcgtagatcgtcgtgggtgcgattgtgcggtttggggagtgagtttcgcgttatcgtcgttgtaggtcggggagtttaggtgggcggcggttggggagggagggatttaggcgggggaggtgataaatatcggtggggagagtgtttaaattcgcgtat

SEQ ID NO: 30714 - DNA, 672 bp, Artificial Sequence
  chemically treated genomic DNA (Homo sapiens) CpG-island No: 30714
atacgcgaatttaaacactctccccaccgatatttatcacctcccccgcctaaatccctccctccccaaccgccgcccacctaaactccccgacctacaacgacgataacgcgaaactcactccccaaaccgcacaatcgcacccacgacgatctacgaaactttccgaatctctacccgccccctcccccgctacgccctccctcccaaaatacccgacgtacacgttccctaccacttcgatccgaacgcgccgataaatttaacctacgcgacgacgacgacgaaacgaaaaaacgaataaacgcgaaaaacgaacgcgaataactatataaatcacccgtacctaaaatacgaacgacgcaaaaccaacgacgcgaaaccgaaaccgaaaccgaaacccaacgcctacgaacccgaaaacgcgaccgaccccaaacgccaaaccccgtcgccctccccgtacactcacccgtaacccgacgccgactccctacccgacgcccgccgcccgcaaccctcccgcctaccaaaaaacgatacgaaactcgccgaaaaatatcacaacgactcctaaaaaccaacaaccgccgccgccgccgcccccgaaaaccgcgatcataaacccccaatacgcccgttacgaaaaaatcgtatatcccaccgaaaaaa

SEQ ID NO: 30715 - DNA, 672 bp, Artificial Sequence
  chemically treated genomic DNA (Homo sapiens) CpG-island No: 30715
gtacgcgggtttgagtattttttttatcggtgtttgttatttttttcgtttggatttttttttttttagtcgtcgtttatttgggtttttcggtttgtagcggcggtggcgcgaggtttattttttaggtcgtatagtcgtatttacggcggtttgcggagtttttcgggtttttgttcgttttttttttcgttgcgtttttttttttagggtgttcgacgtgtacgttttttgttatttcggttcgggcgcgtcggtgggtttggtttgcgcggcggcggcggcgaggcgggggagcgagtgagcgcgaggggcgggcgcgagtgattgtgtgagttattcgtatttggagtgcgagcgacgtagagttagcggcgcggagtcggagtcggagtcgagatttagcgtttgcgagttcgagagcgcggtcggttttaggcgttaggtttcgtcgtttttttcgtgtatttattcgtggttcggcgtcgattttttattcggcgttcgtcgttcgtagttttttcgtttgttaggaggcggtgcggggttcgtcgggggatgttatagcggtttttgggagttagtagtcgtcgtcgtcgtcgttttcgggaatcgcgattatgaatttttagtgcgttcgttgcggaaaagtcgtgtattttatcgagaaag

SEQ ID NO: 30716 - DNA, 672 bp, Artificial Sequence
  chemically treated genomic DNA (Homo sapiens) CpG-island No: 30716
ctttctcgataaaatacacgacttttccgcaacgaacgcactaaaaattcataatcgcgattcccgaaaacgacgacgacgacgactactaactcccaaaaaccgctataacatcccccgacgaaccccgcaccgcctcctaacaaacgaaaaaactacgaacgacgaacgccgaataaaaaatcgacgccgaaccacgaataaatacacgaaaaaaacgacgaaacctaacgcctaaaaccgaccgcgctctcgaactcgcaaacgctaaatctcgactccgactccgactccgcgccgctaactctacgtcgctcgcactccaaatacgaataactcacacaatcactcgcgcccgcccctcgcgctcactcgctcccccgcctcgccgccgccgccgcgcaaaccaaacccaccgacgcgcccgaaccgaaataacaaaaaacgtacacgtcgaacaccctaaaaaaaaaaacgcaacgaaaaaaaaaacgaacaaaaacccgaaaaactccgcaaaccgccgtaaatacgactatacgacctaaaaaataaacctcgcgccaccgccgctacaaaccgaaaaacccaaataaacgacgactaaaaaaaaaaaaatccaaacgaaaaaaataacaaacaccgataaaaaaaatactcaaacccgcgtac

SEQ ID NO: 30717 - DNA, 1594 bp, Artificial Sequence
  chemically treated genomic DNA (Homo sapiens) CpG-island No: 30717
ggtttcgggacggttgttttttgcgtgcggtcgcgggattgcggataaagttgtagtgtggtcgggagcgcggggtcgggagcgcggggtcggttcggcggtaggaagggcgtggtcgtggggtgtagcgaggacggttcgtgcgggaggaacgtgcgtagcgtggagtttgggggtcgagaagtttttattgtaaggttggttttcgagattcgcgttcgggcgtcgcggtgcgggaagcggtcgttttcgcggggacgtttttgcgtcgggtgttaggtgcggattacgggtagtttcggtttcgcgggcgtcgggcgggggtttacgtttttttcgttcgttagttttagtcgtagatcgcgcgggcggggcgttcgagagggttttttttttttttggttaaatttcggttacgtgaatcgttttttatttatttttgcgttaatcgcgcggcgcggacggatttcgagaggggttacggttcgtcgtcggcggggttattttataacgcgtcgtgcgtgacgtgaggggtttttgttgtaatggcgagttaagtcggaggatgtgtagttgcggcggcggcgtcggttacgaagaggacggggataggcgtcgtgcgaatcgagtttagttagtcggaggacgcgggtagggcgggacgggagttcggattcgtttgtcgtcgtcgtcgtcgtcgtcgtgtcggtttcgcgttttcgcgcgcgagcgggaggagtcgtcgttatttcgcgttcgagtcgtcgttagcgcgcgtcgggtatggtttttttttaaaggcgtaggtcgcggcggcgggggcgggcgtgcggaataaagcgtcggcgcggggtttgcgggcggttcgggggtcgcgatgggcgcggcgggttcgcggcggcggcggcgttgttcgggtcgggtttcgcggcgttagggcgggttggttttcgcgggcgggggtagcgggttgagggcgcgcggagtttgcggcggcggttcggcgggcggagcggcgcgggtatggtcgcgcgcggtcggcgcgtttggtttagcgtgttgttcgggttcgttttgggtttcgtgttggtttcgcggttcgttttgtttcgggttttcgagttgaagcgagcgggtttacggcgtcgcgttagtttcgagggttgtcggttcgggtaggcggcggttttttaggtcggcggggcgcgcggcgatgcgcgcggggcgtagttttggtcgttcggttcggatttagatggcggttcgcgcgataggaatttttttttcgtgggagttatgatcgtttagaaatatttgtagattcgggtcgtggtcgtttataggtgagtttttgtttttcgggtatcgttttttgcgttcggtatttcggcggtcggtatttcgggtgtttttttggttttcgttttcgttcgttttttaggttttttttgggttttcggcgggatcgggttgtttttcgggagacgtcgggtcgagggagaaaagattagaggcgggatggtgagcgcggcgtttaggaatatggtttttggggttagatggattagtgtggtttcgttgggtgtatttttta

SEQ ID NO: 30718 - DNA, 1594 bp, Artificial Sequence
  chemically treated genomic DNA (Homo sapiens) CpG-island No: 30718
taaaaaatacacccaacgaaaccacactaatccatctaaccccaaaaaccatattcctaaacgccgcgctcaccatcccgcctctaatcttttctccctcgacccgacgtctcccgaaaaacaacccgatcccgccgaaaacccaaaaaaaacctaaaaaacgaacgaaaacgaaaaccaaaaaaacacccgaaataccgaccgccgaaataccgaacgcaaaaaacgatacccgaaaaacaaaaactcacctataaacgaccacgacccgaatctacaaatatttctaaacgatcataactcccacgaaaaaaaaattcctatcgcgcgaaccgccatctaaatccgaaccgaacgaccaaaactacgccccgcgcgcatcgccgcgcgccccgccgacctaaaaaaccgccgcctacccgaaccgacaaccctcgaaactaacgcgacgccgtaaacccgctcgcttcaactcgaaaacccgaaacaaaacgaaccgcgaaaccaacacgaaacccaaaacgaacccgaacaacacgctaaaccaaacgcgccgaccgcgcgcgaccatacccgcgccgctccgcccgccgaaccgccgccgcaaactccgcgcgccctcaacccgctacccccgcccgcgaaaaccaacccgccctaacgccgcgaaacccgacccgaacaacgccgccgccgccgcgaacccgccgcgcccatcgcgacccccgaaccgcccgcaaaccccgcgccgacgctttattccgcacgcccgcccccgccgccgcgacctacgcctttaaaaaaaaaccatacccgacgcgcgctaacgacgactcgaacgcgaaataacgacgactcctcccgctcgcgcgcgaaaacgcgaaaccgacacgacgacgacgacgacgacgacaaacgaatccgaactcccgtcccgccctacccgcgtcctccgactaactaaactcgattcgcacgacgcctatccccgtcctcttcgtaaccgacgccgccgccgcaactacacatcctccgacttaactcgccattacaacaaaaacccctcacgtcacgcacgacgcgttataaaataaccccgccgacgacgaaccgtaacccctctcgaaatccgtccgcgccgcgcgattaacgcaaaaataaataaaaaacgattcacgtaaccgaaatttaaccaaaaaaaaaaaaaaccctctcgaacgccccgcccgcgcgatctacgactaaaactaacgaacgaaaaaaacgtaaacccccgcccgacgcccgcgaaaccgaaactacccgtaatccgcacctaacacccgacgcaaaaacgtccccgcgaaaacgaccgcttcccgcaccgcgacgcccgaacgcgaatctcgaaaaccaaccttacaataaaaacttctcgacccccaaactccacgctacgcacgttcctcccgcacgaaccgtcctcgctacaccccacgaccacgcccttcctaccgccgaaccgaccccgcgctcccgaccccgcgctcccgaccacactacaactttatccgcaatcccgcgaccgcacgcaaaaaacaaccgtcccgaaacc

SEQ ID NO: 30719 - DNA, 1594 bp, Artificial Sequence
  chemically treated genomic DNA (Homo sapiens) CpG-island No: 30719
tgagaggtatatttagcgaggttatattagtttatttgattttaaaggttatgtttttgagcgtcgcgtttattatttcgtttttgattttttttttttcggttcggcgtttttcgagaggtaattcgatttcgtcggaagtttaagaagggtttaggaagcgggcggaggcgagagttaggagagtattcgggatgtcggtcgtcgggatgtcggacgtaggaggcggtgttcggggagtaggggtttatttgtaggcggttacggttcgagtttgtaggtatttttgggcggttatgatttttacgaagagaaagtttttgtcgcgcgggtcgttatttgggttcgagtcgggcggttagagttgcgtttcgcgcgtatcgtcgcgcgtttcgtcggtttgggaagtcgtcgtttgttcggatcggtagttttcggggttggcgcggcgtcgtgggttcgttcgttttagttcggaagttcggggtaggacgagtcgcgaggttagtacgaagtttaggacgagttcgagtagtacgttgagttaggcgcgtcggtcgcgcgcggttatgttcgcgtcgtttcgttcgtcgggtcgtcgtcgtaggtttcgcgcgtttttagttcgttgttttcgttcgcggaggttagttcgttttagcgtcgcgaggttcggttcgggtagcgtcgtcgtcgtcgcgggttcgtcgcgtttatcgcggttttcgagtcgttcgtaggtttcgcgtcggcgttttgtttcgtacgttcgttttcgtcgtcgcggtttgcgtttttaagaggggattatgttcggcgcgcgttagcggcggttcgggcgcgaggtggcggcggtttttttcgttcgcgcgcggggacgcggggtcggtacgacggcgacgacggcggcggtagacgagttcgggttttcgtttcgttttgttcgcgtttttcggttggttgggttcggttcgtacggcgtttgttttcgtttttttcgtagtcggcgtcgtcgtcgtagttgtatatttttcggtttagttcgttattgtaataggagttttttacgttacgtacggcgcgttatgaagtggtttcgtcggcggcgagtcgtggtttttttcgggattcgttcgcgtcgcgcgattggcgtaaaagtgaatgaggggcggtttacgtggtcgaagtttgattaaaaaaaaaaaaagttttttcgggcgtttcgttcgcgcggtttgcgattggagttggcgggcggagggggcgtgggttttcgttcggcgttcgcggggtcggagttgttcgtgattcgtatttagtattcggcgtaagggcgttttcgcgaggacggtcgtttttcgtatcgcggcgttcgggcgcgaatttcgggagttagttttgtagtgggggtttttcggtttttagattttacgttgcgtacgtttttttcgtacgggtcgttttcgttgtattttacggttacgttttttttgtcgtcgggtcggtttcgcgttttcggtttcgcgttttcgattatattgtagttttgttcgtagtttcgcggtcgtacgtagggaatagtcgtttcggagtt

SEQ ID NO: 30720 - DNA, 1594 bp, Artificial Sequence
  chemically treated genomic DNA (Homo sapiens) CpG-island No: 30720
aactccgaaacgactattccctacgtacgaccgcgaaactacgaacaaaactacaatataatcgaaaacgcgaaaccgaaaacgcgaaaccgacccgacgacaaaaaaaacgtaaccgtaaaatacaacgaaaacgacccgtacgaaaaaaacgtacgcaacgtaaaatctaaaaaccgaaaaacccccactacaaaactaactcccgaaattcgcgcccgaacgccgcgatacgaaaaacgaccgtcctcgcgaaaacgcccttacgccgaatactaaatacgaatcacgaacaactccgaccccgcgaacgccgaacgaaaacccacgccccctccgcccgccaactccaatcgcaaaccgcgcgaacgaaacgcccgaaaaaactttttttttttttaatcaaacttcgaccacgtaaaccgcccctcattcacttttacgccaatcgcgcgacgcgaacgaatcccgaaaaaaaccacgactcgccgccgacgaaaccacttcataacgcgccgtacgtaacgtaaaaaactcctattacaataacgaactaaaccgaaaaatatacaactacgacgacgacgccgactacgaaaaaaacgaaaacaaacgccgtacgaaccgaacccaaccaaccgaaaaacgcgaacaaaacgaaacgaaaacccgaactcgtctaccgccgccgtcgtcgccgtcgtaccgaccccgcgtccccgcgcgcgaacgaaaaaaaccgccgccacctcgcgcccgaaccgccgctaacgcgcgccgaacataatcccctcttaaaaacgcaaaccgcgacgacgaaaacgaacgtacgaaacaaaacgccgacgcgaaacctacgaacgactcgaaaaccgcgataaacgcgacgaacccgcgacgacgacgacgctacccgaaccgaacctcgcgacgctaaaacgaactaacctccgcgaacgaaaacaacgaactaaaaacgcgcgaaacctacgacgacgacccgacgaacgaaacgacgcgaacataaccgcgcgcgaccgacgcgcctaactcaacgtactactcgaactcgtcctaaacttcgtactaacctcgcgactcgtcctaccccgaacttccgaactaaaacgaacgaacccacgacgccgcgccaaccccgaaaactaccgatccgaacaaacgacgacttcccaaaccgacgaaacgcgcgacgatacgcgcgaaacgcaactctaaccgcccgactcgaacccaaataacgacccgcgcgacaaaaactttctcttcgtaaaaatcataaccgcccaaaaatacctacaaactcgaaccgtaaccgcctacaaataaacccctactccccgaacaccgcctcctacgtccgacatcccgacgaccgacatcccgaatactctcctaactctcgcctccgcccgcttcctaaacccttcttaaacttccgacgaaatcgaattacctctcgaaaaacgccgaaccgaaaaaaaaaaaatcaaaaacgaaataataaacgcgacgctcaaaaacataacctttaaaatcaaataaactaatataacctcgctaaatatacctctca

SEQ ID NO: 30721 - DNA, 614 bp, Artificial Sequence
  chemically treated genomic DNA (Homo sapiens) CpG-island No: 30721
cgttgtttcggtttcggcgagcgtagtcgggatttttttttcgttacgtttttcggttacgtttttttgcgtttggtttagcgacggggcggggtcggtttgcgattggtcgggattacgatcgcgttcgggcgcgttacgtgtgcgtaggagcgtatcggaagcgttcggttggaggcgcggcggtagggttgggcggcggcggcggcggcggttatggaacgttaagaggagtttttgttcgcgcggtcggttttggagatcgaggggttgcgttttttgtatattacgggtgagtcgttgcggggtagtcgggcgcgcgtcgttatttttgcgacgcgtagttatgatgggtgggtcgttcgtcgttgtatcgggcgtcggagtttgggaggtttgggaacggtcgggcgttggcgtttacgcggattttgggtagtaggttcggattttgcgcggaggtttttcgggagtcgtatttttttgggcggttcggttgttttttgtttgcgtaagttttttttgcgaattaagttttttttgtggtagttattggggttattcggtcgttggcgtttgtttttgggattcgttttatatagttttatatatat

SEQ ID NO: 30722 - DNA, 614 bp, Artificial Sequence
  chemically treated genomic DNA (Homo sapiens) CpG-island No: 30722
atatatataaaactatataaaacgaatcccaaaaacaaacgccaacgaccgaataaccccaataactaccacaaaaaaaacttaattcgcaaaaaaaacttacgcaaacaaaaaacaaccgaaccgcccaaaaaaatacgactcccgaaaaacctccgcgcaaaatccgaacctactacccaaaatccgcgtaaacgccaacgcccgaccgttcccaaacctcccaaactccgacgcccgatacaacgacgaacgacccacccatcataactacgcgtcgcaaaaataacgacgcgcgcccgactaccccgcaacgactcacccgtaatatacaaaaaacgcaacccctcgatctccaaaaccgaccgcgcgaacaaaaactcctcttaacgttccataaccgccgccgccgccgccgcccaaccctaccgccgcgcctccaaccgaacgcttccgatacgctcctacgcacacgtaacgcgcccgaacgcgatcgtaatcccgaccaatcgcaaaccgaccccgccccgtcgctaaaccaaacgcaaaaaaacgtaaccgaaaaacgtaacgaaaaaaaaatcccgactacgctcgccgaaaccgaaacaacg

SEQ ID NO: 30723 - DNA, 614 bp, Artificial Sequence
  chemically treated genomic DNA (Homo sapiens) CpG-island No: 30723
gtgtgtatggggttgtgtgggacgggttttagaggtaaacgttaacggtcgagtgattttagtaattattataggaagggtttggttcgtaaaaaagatttgcgtaaataagggatagtcgagtcgtttagggaagtgcggttttcgagaagttttcgcgtaaggttcgggtttgttgtttaaggttcgcgtaagcgttaacgttcgatcgtttttaggttttttaggtttcggcgttcggtgtagcggcggacgatttatttattatggttgcgcgtcgtaaaagtggcggcgcgcgttcggttgtttcgtaacgatttattcgtggtgtgtaggaagcgtagtttttcggtttttagggtcggtcgcgcggatagagattttttttggcgttttatgatcgtcgtcgtcgtcgtcgtttagttttgtcgtcgcgtttttagtcgggcgttttcggtgcgtttttacgtatacgtggcgcgttcggacgcggtcgtggtttcggttaatcgtaggtcgatttcgtttcgtcgttgggttaaacgtaggggggcgtggtcgaggggcgtggcgggggagaaatttcggttacgttcgtcggggtcgggatagcg

SEQ ID NO: 30724 - DNA, 614 bp, Artificial Sequence
  chemically treated genomic DNA (Homo sapiens) CpG-island No: 30724
cgctatcccgaccccgacgaacgtaaccgaaatttctcccccgccacgcccctcgaccacgcccccctacgtttaacccaacgacgaaacgaaatcgacctacgattaaccgaaaccacgaccgcgtccgaacgcgccacgtatacgtaaaaacgcaccgaaaacgcccgactaaaaacgcgacgacaaaactaaacgacgacgacgacgacgatcataaaacgccaaaaaaaatctctatccgcgcgaccgaccctaaaaaccgaaaaactacgcttcctacacaccacgaataaatcgttacgaaacaaccgaacgcgcgccgccacttttacgacgcgcaaccataataaataaatcgtccgccgctacaccgaacgccgaaacctaaaaaacctaaaaacgatcgaacgttaacgcttacgcgaaccttaaacaacaaacccgaaccttacgcgaaaacttctcgaaaaccgcacttccctaaacgactcgactatcccttatttacgcaaatcttttttacgaaccaaacccttcctataataattactaaaatcactcgaccgttaacgtttacctctaaaacccgtcccacacaaccccatacacac

SEQ ID NO: 30725 - DNA, 559 bp, Artificial Sequence
  chemically treated genomic DNA (Homo sapiens) CpG-island No: 30725
ttttgtgcgcgcgttacgattttcggtaagaacgttttcggaggcgtggtttttcgattgtttcggtttggcggtcgagttgcgcgcgtattcggcggttgcgattggtgttgtttggcggcggggcgcggggtacgttgggacgtttcgttggcgggaggttacgggttttttatagcgcgggggaacgggaggttgtaggatggttaagttgacggcggagttgatcgagtaggcggcgtagtatattaacgcggtgcgcgatcgggagttggattttcggggtgagttcgggggcgtgggcggttagtttttaggcggtatcgagtcgttttatttttcgcgttttgtcgcgtgtatcgaaggtcggagtttggttcgcgggtcggttgtttgggtttcgatcgggttgcgtagggaacgtcgggtttgatttttgtcgttgttgttagatgagtattcggttaagtttttgggagttttttgttagcgtcgtgttttttgataggtacgggtgattttattattttttggtgcgttttcgtggggttttgttagg

SEQ ID NO: 30726 - DNA, 559 bp, Artificial Sequence
  chemically treated genomic DNA (Homo sapiens) CpG-island No: 30726
cctaacaaaaccccacgaaaacgcaccaaaaaataataaaatcacccgtacctatcaaaaaacacgacgctaacaaaaaactcccaaaaacttaaccgaatactcatctaacaacaacgacaaaaatcaaacccgacgttccctacgcaacccgatcgaaacccaaacaaccgacccgcgaaccaaactccgaccttcgatacacgcgacaaaacgcgaaaaataaaacgactcgataccgcctaaaaactaaccgcccacgcccccgaactcaccccgaaaatccaactcccgatcgcgcaccgcgttaatatactacgccgcctactcgatcaactccgccgtcaacttaaccatcctacaacctcccgttcccccgcgctataaaaaacccgtaacctcccgccaacgaaacgtcccaacgtaccccgcgccccgccgccaaacaacaccaatcgcaaccgccgaatacgcgcgcaactcgaccgccaaaccgaaacaatcgaaaaaccacgcctccgaaaacgttcttaccgaaaatcgtaacgcgcgcacaaaa

SEQ ID NO: 30727 - DNA, 559 bp, Artificial Sequence
  chemically treated genomic DNA (Homo sapiens) CpG-island No: 30727
tttaatagggttttacgaggacgtattaggaagtaatgaagttattcgtgtttgttaagaggtacggcgttaatagaaggtttttaggagtttaatcggatgtttatttggtaataacggtaagaattaggttcggcgttttttgcgtagttcggtcggagtttagataatcggttcgcgggttaagtttcggttttcggtgtacgcggtaaagcgcggaaaataaggcggttcggtgtcgtttggggattggtcgtttacgttttcggatttatttcggaggtttagttttcggtcgcgtatcgcgttggtgtattgcgtcgtttgttcgattagtttcgtcgttagtttgattattttgtagtttttcgttttttcgcgttgtggaaagttcgtggtttttcgttagcgagacgttttagcgtgtttcgcgtttcgtcgttaggtagtattaatcgtagtcgtcgagtgcgcgcgtagttcgatcgttaggtcgaagtaatcgaagagttacgttttcgggggcgtttttgtcggaagtcgtggcgcgcgtataggg

SEQ ID NO: 30728 - DNA, 559 bp, Artificial Sequence
  chemically treated genomic DNA (Homo sapiens) CpG-island No: 30728
ccctatacgcgcgccacgacttccgacaaaaacgcccccgaaaacgtaactcttcgattacttcgacctaacgatcgaactacgcgcgcactcgacgactacgattaatactacctaacgacgaaacgcgaaacacgctaaaacgtctcgctaacgaaaaaccacgaactttccacaacgcgaaaaaacgaaaaactacaaaataatcaaactaacgacgaaactaatcgaacaaacgacgcaatacaccaacgcgatacgcgaccgaaaactaaacctccgaaataaatccgaaaacgtaaacgaccaatccccaaacgacaccgaaccgccttattttccgcgctttaccgcgtacaccgaaaaccgaaacttaacccgcgaaccgattatctaaactccgaccgaactacgcaaaaaacgccgaacctaattcttaccgttattaccaaataaacatccgattaaactcctaaaaaccttctattaacgccgtacctcttaacaaacacgaataacttcattacttcctaatacgtcctcgtaaaaccctattaaa

SEQ ID NO: 30729 - DNA, 573 bp, Artificial Sequence
  chemically treated genomic DNA (Homo sapiens) CpG-island No: 30729
tgtttacgttttttttaagagtcgtagttttaacgaaaatagaaatgggattgttaagtagtaaattatttgtttttttcgtatatacgcgtatatttcgtggagtcgttgggtagttagtcggttgttttttttgggtagtttagcgatcgtagtttttgttgtggaggaggacgcgttttttatttacgtcgtagtcggtcgggtgaagttgttttgaagttcgttatcgtttttagttttgttgttttcggggtttaggtattttttagttgcgttcgttcgtttgtttgtcggcgcgtcggaggtcgtagcgttgtacgcggttgatgggttttggggtttaggcgttttggtcgtgggagattagcggtttcggcgcgtttcgcgcgtttttacggttcggtttcgcgagtttagtagtcggcgcggcgttgttcggcgtttattttcgtttgtgtttttttttcgggcgtcgcgggtttttcgggttttgggtcggtttttcgggcgttttttttttttttttcgtttttttttagcgtgggaattcgatgttggttttttagggtt

SEQ ID NO: 30730 - DNA, 573 bp, Artificial Sequence
  chemically treated genomic DNA (Homo sapiens) CpG-island No: 30730
aaccctaaaaaaccaacatcgaattcccacgctaaaaaaaaacgaaaaaaaaaaaaaaaacgcccgaaaaaccgacccaaaacccgaaaaacccgcgacgcccgaaaaaaaaacacaaacgaaaataaacgccgaacaacgccgcgccgactactaaactcgcgaaaccgaaccgtaaaaacgcgcgaaacgcgccgaaaccgctaatctcccacgaccaaaacgcctaaaccccaaaacccatcaaccgcgtacaacgctacgacctccgacgcgccgacaaacaaacgaacgaacgcaactaaaaaatacctaaaccccgaaaacaacaaaactaaaaacgataacgaacttcaaaacaacttcacccgaccgactacgacgtaaataaaaaacgcgtcctcctccacaacaaaaactacgatcgctaaactacccaaaaaaaacaaccgactaactacccaacgactccacgaaatatacgcgtatatacgaaaaaaacaaataatttactacttaacaatcccatttctattttcgttaaaactacgactcttaaaaaaaacgtaaaca

SEQ ID NO: 30731 - DNA, 573 bp, Artificial Sequence
  chemically treated genomic DNA (Homo sapiens) CpG-island No: 30731
agttttgggaagttagtatcgggtttttacgttggggaggagcgagaggaaaggagaggacgttcgaggggtcggtttagggttcgggggattcgcggcgttcgagggaggagtatagacgggggtgggcgtcgagtagcgtcgcgtcggttgttgagttcgcggggtcgggtcgtgagaacgcgcggggcgcgtcggggtcgttggttttttacggttagggcgtttgggttttagagtttattagtcgcgtgtagcgttgcggttttcggcgcgtcggtaggtaagcgagcgggcgtagttgggggatgtttggatttcggaggtagtagggttggaggcggtggcgggttttagggtaattttattcggtcggttgcggcgtgggtaagaggcgcgtttttttttatagtaaaagttgcgatcgttgggttgtttagagaaggtagtcggttaattgtttagcggttttacgaggtgtgcgcgtgtgtgcgagagagataaatgatttattgtttagtagttttatttttgttttcgttaggattgcggtttttggagaaagcgtgagta

SEQ ID NO: 30732 - DNA, 573 bp, Artificial Sequence
  chemically treated genomic DNA (Homo sapiens) CpG-island No: 30732
tactcacgctttctccaaaaaccgcaatcctaacgaaaacaaaaataaaactactaaacaataaatcatttatctctctcgcacacacgcgcacacctcgtaaaaccgctaaacaattaaccgactaccttctctaaacaacccaacgatcgcaacttttactataaaaaaaaacgcgcctcttacccacgccgcaaccgaccgaataaaattaccctaaaacccgccaccgcctccaaccctactacctccgaaatccaaacatcccccaactacgcccgctcgcttacctaccgacgcgccgaaaaccgcaacgctacacgcgactaataaactctaaaacccaaacgccctaaccgtaaaaaaccaacgaccccgacgcgccccgcgcgttctcacgacccgaccccgcgaactcaacaaccgacgcgacgctactcgacgcccacccccgtctatactcctccctcgaacgccgcgaatcccccgaaccctaaaccgacccctcgaacgtcctctcctttcctctcgctcctccccaacgtaaaaacccgatactaacttcccaaaact

SEQ ID NO: 30733 - DNA, 746 bp, Artificial Sequence
  chemically treated genomic DNA (Homo sapiens) CpG-island No: 30733
gttatttacggagagtacgttaattatagagagtacgttaattatagagagtacgttaattacggagagtacgttaattagagagagtacgttaattacggagagtacgttaattacggagagtacgttaattacggagagtacgttaattagagagagtacgttaattacggagagtacgttaattacggagagtacgttaattagagagagtacgttatttacggagagtacgttaattacggagagtatattatttatggagagtacgttaattatggagagtacgttaattacggagaatatattaattacggagaatacgttaattacggagagtacgttaattacggagagtacgttaattatagagagtacgttaattacggagagtacgttaattacggcgagtacgttaattatggagagagtatattaattacggagagtacgttaattacggagagtacgttaaatacggagagtatgttaattagggagggtatattaattagggagggtacgttaattacggagggtacgttaattacggagagtacgttaattacggagagtacgttaattacggagagtacgttaattacggagagtacgttaattatggagagagtatattaattacggagagtacgttaattacggagaatacgttaattatggggagtatattaattatggagagtacgttttttgtaacgttttatattattgtagtatagtttagt

SEQ ID NO: 30734 - DNA, 746 bp, Artificial Sequence
  chemically treated genomic DNA (Homo sapiens) CpG-island No: 30734
actaaactatactacaataatataaaacgttacaaaaaacgtactctccataattaatatactccccataattaacgtattctccgtaattaacgtactctccgtaattaatatactctctccataattaacgtactctccgtaattaacgtactctccgtaattaacgtactctccgtaattaacgtactctccgtaattaacgtaccctccgtaattaacgtaccctccctaattaatataccctccctaattaacatactctccgtatttaacgtactctccgtaattaacgtactctccgtaattaatatactctctccataattaacgtactcgccgtaattaacgtactctccgtaattaacgtactctctataattaacgtactctccgtaattaacgtactctccgtaattaacgtattctccgtaattaatatattctccgtaattaacgtactctccataattaacgtactctccataaataatatactctccgtaattaacgtactctccgtaaataacgtactctctctaattaacgtactctccgtaattaacgtactctccgtaattaacgtactctctctaattaacgtactctccgtaattaacgtactctccgtaattaacgtactctccgtaattaacgtactctctctaattaacgtactctccgtaattaacgtactctctataattaacgtactctctataattaacgtactctccgtaaataac

SEQ ID NO: 30735 - DNA, 746 bp, Artificial Sequence
  chemically treated genomic DNA (Homo sapiens) CpG-island No: 30735
attgggttgtgttgtagtggtgtgggacgttgtagagagcgtgttttttatggttagtgtgttttttatggttagcgtgtttttcgtggttagcgtgtttttcgtggttagtgtgttttttttatggttagcgtgtttttcgtggttagcgtgtttttcgtggttagcgtgtttttcgtggttagcgtgtttttcgtggttaacgtgtttttcgtggttagcgtgttttttttggttagtgtgttttttttggttagtatgtttttcgtgtttagcgtgtttttcgtggttagcgtgtttttcgtggttagtgtgttttttttatggttagcgtgttcgtcgtggttagcgtgtttttcgtggttagcgtgttttttgtggttaacgtgtttttcgtggttagcgtgtttttcgtggttagcgtgtttttcgtggttagtgtgtttttcgtggttagcgtgttttttatggttagcgtgttttttatggatagtgtgtttttcgtggttagcgtgtttttcgtgggtagcgtgttttttttggttagcgtgtttttcgtggttagcgtgtttttcgtggttagcgtgttttttttggttagcgtgtttttcgtggttagcgtgtttttcgtggttagcgtgtttttcgtggttagcgtgttttttttggttagcgtgtttttcgtggttagcgtgttttttgtggttagcgtgttttttgtggttagcgtgtttttcgtggatagt

SEQ ID NO: 30736 - DNA, 746 bp, Artificial Sequence
  chemically treated genomic DNA (Homo sapiens) CpG-island No: 30736
actatccacgaaaaacacgctaaccacaaaaaacacgctaaccacaaaaaacacgctaaccacgaaaaacacgctaaccaaaaaaaacacgctaaccacgaaaaacacgctaaccacgaaaaacacgctaaccacgaaaaacacgctaaccaaaaaaaacacgctaaccacgaaaaacacgctaaccacgaaaaacacgctaaccaaaaaaaacacgctacccacgaaaaacacgctaaccacgaaaaacacactatccataaaaaacacgctaaccataaaaaacacgctaaccacgaaaaacacactaaccacgaaaaacacgctaaccacgaaaaacacgctaaccacgaaaaacacgttaaccacaaaaaacacgctaaccacgaaaaacacgctaaccacgacgaacacgctaaccataaaaaaaacacactaaccacgaaaaacacgctaaccacgaaaaacacgctaaacacgaaaaacatactaaccaaaaaaaacacactaaccaaaaaaaacacgctaaccacgaaaaacacgttaaccacgaaaaacacgctaaccacgaaaaacacgctaaccacgaaaaacacgctaaccacgaaaaacacgctaaccataaaaaaaacacactaaccacgaaaaacacgctaaccacgaaaaacacgctaaccataaaaaacacactaaccataaaaaacacgctctctacaacgtcccacaccactacaacacaacccaat

SEQ ID NO: 30737 - DNA, 578 bp, Artificial Sequence
  chemically treated genomic DNA (Homo sapiens) CpG-island No: 30737
cgtcgggaggagggaatttcgaggtcgggtttggcggggcgcgtttagtcggttacgtgggagattgagtttttcgattttagtcgcggttttcgagttcgggatcgatttggcgaggttgtttttggtttttgaggagtcggggtcggggcgggggcggtcggtttttttttttttttttcgtttttttttttttttcgttgtcgttttttttttttttaataaataatttttttattttatgtagaaaagttttttttttttgtttgtttttaaagtcgtttttattttttcgttcgggtgacggaatttcgggtttgtttttttttgtttaatgtcgttgtcgggattacggtggtcgcgcgttaggcgtagggagtttcggaggcggcggtttagagcgcggttagttcgttcggtttttgcgtttcggttcggtttttgcggttatcgcgggttttcggttttgtttttcgagcgttttgcgtttttttttttttttttttgttttttcgtaggtttgtttatagtcgttattaggggagacgttatacgggttttattttaggattggtgat

SEQ ID NO: 30738 - DNA, 578 bp, Artificial Sequence
  chemically treated genomic DNA (Homo sapiens) CpG-island No: 30738
atcaccaatcctaaaataaaacccgtataacgtctcccctaataacgactataaacaaacctacgaaaaaacaaaaaaaaaaaaaaaaaaacgcaaaacgctcgaaaaacaaaaccgaaaacccgcgataaccgcaaaaaccgaaccgaaacgcaaaaaccgaacgaactaaccgcgctctaaaccgccgcctccgaaactccctacgcctaacgcgcgaccaccgtaatcccgacaacgacattaaacaaaaaaaaacaaacccgaaattccgtcacccgaacgaaaaaataaaaacgactttaaaaacaaacaaaaaaaaaaaacttttctacataaaataaaaaaattatttattaaaaaaaaaaaaaacgacaacgaaaaaaaaaaaaaaacgaaaaaaaaaaaaaaaaaccgaccgcccccgccccgaccccgactcctcaaaaaccaaaaacaacctcgccaaatcgatcccgaactcgaaaaccgcgactaaaatcgaaaaactcaatctcccacgtaaccgactaaacgcgccccgccaaacccgacctcgaaattccctcctcccgacg

SEQ ID NO: 30739 - DNA, 578 bp, Artificial Sequence
  chemically treated genomic DNA (Homo sapiens) CpG-island No: 30739
attattaattttaaaataaaattcgtgtaacgttttttttagtagcggttataaataaatttacgaggaggtaggaggaagaggaaaggggcgtagggcgttcggggagtagagtcgggggttcgcggtggtcgtagaggtcgggtcggggcgtagaggtcgggcgagttggtcgcgttttgggtcgtcgttttcggaattttttgcgtttggcgcgcggttatcgtggtttcggtaacggtattaaatagagggaaatagattcgggatttcgttattcgggcggggggataaggacggttttgagagtagataggaaaagggagtttttttgtatggggtgaaaaaattatttattgaaggaggaggaggcggtagcggaggaaggggaggggcgggaggagggaagaaaaatcggtcgttttcgtttcggtttcggttttttaggagttaagggtagtttcgttaggtcggtttcgggttcgaggatcgcggttggggtcgaggggtttagttttttacgtgatcggttgggcgcgtttcgttagattcggtttcgggatttttttttttcggcg

SEQ ID NO: 30740 - DNA, 578 bp, Artificial Sequence
  chemically treated genomic DNA (Homo sapiens) CpG-island No: 30740
cgccgaaaaaaaaaaatcccgaaaccgaatctaacgaaacgcgcccaaccgatcacgtaaaaaactaaacccctcgaccccaaccgcgatcctcgaacccgaaaccgacctaacgaaactacccttaactcctaaaaaaccgaaaccgaaacgaaaacgaccgatttttcttccctcctcccgcccctccccttcctccgctaccgcctcctcctccttcaataaataattttttcaccccatacaaaaaaactcccttttcctatctactctcaaaaccgtccttatccccccgcccgaataacgaaatcccgaatctatttccctctatttaataccgttaccgaaaccacgataaccgcgcgccaaacgcaaaaaattccgaaaacgacgacccaaaacgcgaccaactcgcccgacctctacgccccgacccgacctctacgaccaccgcgaacccccgactctactccccgaacgccctacgcccctttcctcttcctcctacctcctcgtaaatttatttataaccgctactaaaaaaaacgttacacgaattttattttaaaattaataat

SEQ ID NO: 30741 - DNA, 1525 bp, Artificial Sequence
  chemically treated genomic DNA (Homo sapiens) CpG-island No: 30741
tacgcgcgcgagggttttgcgagtggtttcgtgattttgtttttaatttcgggtgtttttttttttttattagcgttcggcgtttggttttggtttcggttttcgaggttttcgggatttttttcgagcgtttttcgagttggcgcggggggtggaggcggggttatggagcgcgtttcggggatcgttgtattcggaggcggtcgtcgtgcggttttttttcgtttcgagagtgaggtggtcgggttttgacgagaaggtttacgtttgtcgcgggggtggttcgcgatggtagtcggggttcgagtttcgtttggggggttgtttttgttggagaaaacgtttttttgagggcggcggtaaacgcgtagcgaggtttcgtgtcgcgttagaagttattttgagaaaggggtatcgggatatcgaggggtttttattttttttttagtttgtgacgttcgcgttttcgggtgggttcgaggggcgtttgggtacggttagtcgaggttttcgagagttttagtgtcgttttttattttaggtttttttttttgaggtagagttcgggatttcgcgttttcgttttaggtttcggtttacgttttcgttcggtcgttaggcgcgtaacggaaagcgttttcgtttcgtttcgtttcgtttattgcgtgacgcgtattcggtcgagttaattagagttcgtggcgcgcgttttatacgtcggtttttttcgttttttagtttaagaaagggcgcgcggattcggtaggttagagtgtcgagtagcgcggtgggtgcggttgtgagacggtaggagatttttgtttcgcggtgtacgcgattttcgagacgatagcgcggttattgttagtagcgaaggcgtttttcgcggagcgtttcgacggcgttcgttcgtttatgtcgagttgagcgcggtagcggcggcgggatgttggcgttgttggtcgttagcgtggcgttcgtcgtggtcgttggggtttaggatagttcggcgttcggtagtcgtttcgtgtgtacggtattgtttttagaggcggtgtacgtcggttgttcgttgttcgcgatgtttatgtagggcggcgcgtagagtttcgaggaggagttgagggtcgcggtgttgtagttgcgcgagatcgtcgtgtagtagaaggagacgttgggcgcgtagcgcgaggttattcgcgagtttacgggtaagttagcgcgttgcgaggggttggcgggcggtaaggcgcgcggcgcgggggttacgggtaaggatattatgggcgatttgtcgcgggatttcggttacgtcgtggagtagtttagtcgttcgttgtagatttttaaggatcgtttggagagtttcgaggtagcggttcgcggggagcgcgggggatttggaatggggacgttttcgagtcgggggcggaagattcgggaggatggggaaagggggtttggttttggggagggtgtgatcgttcgtgggggtgagttggatttgagggtgaaaggcggggat

SEQ ID NO: 30742 - DNA, 1525 bp, Artificial Sequence
  chemically treated genomic DNA (Homo sapiens) CpG-island No: 30742
atccccgcctttcaccctcaaatccaactcacccccacgaacgatcacaccctccccaaaaccaaaccccctttccccatcctcccgaatcttccgcccccgactcgaaaacgtccccattccaaatcccccgcgctccccgcgaaccgctacctcgaaactctccaaacgatccttaaaaatctacaacgaacgactaaactactccacgacgtaaccgaaatcccgcgacaaatcgcccataatatccttacccgtaacccccgcgccgcgcgccttaccgcccgccaacccctcgcaacgcgctaacttacccgtaaactcgcgaataacctcgcgctacgcgcccaacgtctccttctactacacgacgatctcgcgcaactacaacaccgcgaccctcaactcctcctcgaaactctacgcgccgccctacataaacatcgcgaacaacgaacaaccgacgtacaccgcctctaaaaacaataccgtacacacgaaacgactaccgaacgccgaactatcctaaaccccaacgaccacgacgaacgccacgctaacgaccaacaacgccaacatcccgccgccgctaccgcgctcaactcgacataaacgaacgaacgccgtcgaaacgctccgcgaaaaacgccttcgctactaacaataaccgcgctatcgtctcgaaaatcgcgtacaccgcgaaacaaaaatctcctaccgtctcacaaccgcacccaccgcgctactcgacactctaacctaccgaatccgcgcgccctttcttaaactaaaaaacgaaaaaaaccgacgtataaaacgcgcgccacgaactctaattaactcgaccgaatacgcgtcacgcaataaacgaaacgaaacgaaacgaaaacgctttccgttacgcgcctaacgaccgaacgaaaacgtaaaccgaaacctaaaacgaaaacgcgaaatcccgaactctacctcaaaaaaaaaaacctaaaataaaaaacgacactaaaactctcgaaaacctcgactaaccgtacccaaacgcccctcgaacccacccgaaaacgcgaacgtcacaaactaaaaaaaaaataaaaacccctcgatatcccgatacccctttctcaaaataacttctaacgcgacacgaaacctcgctacgcgtttaccgccgccctcaaaaaaacgttttctccaacaaaaacaaccccccaaacgaaactcgaaccccgactaccatcgcgaaccacccccgcgacaaacgtaaaccttctcgtcaaaacccgaccacctcactctcgaaacgaaaaaaaaccgcacgacgaccgcctccgaatacaacgatccccgaaacgcgctccataaccccgcctccaccccccgcgccaactcgaaaaacgctcgaaaaaaatcccgaaaacctcgaaaaccgaaaccaaaaccaaacgccgaacgctaataaaaaaaaaaaaacacccgaaattaaaaacaaaatcacgaaaccactcgcaaaaccctcgcgcgcgta

SEQ ID NO: 30743 - DNA, 1525 bp, Artificial Sequence
  chemically treated genomic DNA (Homo sapiens) CpG-island No: 30743
attttcgttttttatttttaagtttagtttatttttacggacgattatattttttttagggttaggttttttttttttattttttcgagtttttcgttttcgattcgggagcgtttttattttaggtttttcgcgtttttcgcgggtcgttatttcgaggttttttaggcggtttttgagggtttgtagcgagcggttgagttgttttacgacgtggtcggggtttcgcggtaggtcgtttatagtgtttttgttcgtggttttcgcgtcgcgcgttttgtcgttcgttagtttttcgtagcgcgttagtttgttcgtgagttcgcggatggtttcgcgttgcgcgtttagcgtttttttttgttgtacgacggtttcgcgtagttgtagtatcgcggtttttagttttttttcgggattttgcgcgtcgttttgtatgggtatcgcgggtagcgggtagtcggcgtgtatcgtttttgggggtagtgtcgtgtatacgaagcggttatcgggcgtcgggttgttttgggttttagcggttacggcgagcgttacgttggcggttagtagcgttagtatttcgtcgtcgttgtcgcgtttagttcggtatgggcgagcgggcgtcgtcggggcgtttcgcgggaggcgttttcgttgttggtagtagtcgcgttgtcgtttcgagggtcgcgtgtatcgcggggtagaagttttttgtcgttttatagtcgtatttatcgcgttgttcggtattttggtttgtcgggttcgcgcgtttttttttaagttgaggggcggagggggtcggcgtgtggggcgcgcgttacgagttttgattggttcggtcgggtgcgcgttacgtagtgggcggagcggggcggggcgggggcgtttttcgttgcgcgtttggcggtcgggcgggagcgtgggtcggagtttgaggcgagagcgcgaggtttcgggttttgttttaggaaaggaggtttgaggtggaaaacgatattggggttttcgagagtttcggttggtcgtgtttaggcgtttttcgaatttattcgaggacgcgggcgttataggttgaggagaaagtgggaatttttcggtgtttcggtgttttttttttagggtggtttttggcgcggtacggggtttcgttgcgcgtttgtcgtcgtttttagggaggcgttttttttagtaggagtagttttttaggcgggattcgaatttcgattgttatcgcgagttattttcgcggtaggcgtgggttttttcgttaaggttcggttattttattttcgaggcgggaaggagtcgtacgacggtcgttttcggatgtaacggttttcgggacgcgttttatggtttcgtttttatttttcgcgttaattcggaaaacgttcgggaagaatttcgggggtttcggggatcgggattaggattaggcgtcggacgttgatgggaaggaggggatattcggagttagggataaagttacgaggttattcgtagagttttcgcgcgcgtg

SEQ ID NO: 30744 - DNA, 1525 bp, Artificial Sequence
  chemically treated genomic DNA (Homo sapiens) CpG-island No: 30744
cacgcgcgcgaaaactctacgaataacctcgtaactttatccctaactccgaatatcccctccttcccatcaacgtccgacgcctaatcctaatcccgatccccgaaacccccgaaattcttcccgaacgttttccgaattaacgcgaaaaataaaaacgaaaccataaaacgcgtcccgaaaaccgttacatccgaaaacgaccgtcgtacgactccttcccgcctcgaaaataaaataaccgaaccttaacgaaaaaacccacgcctaccgcgaaaataactcgcgataacaatcgaaattcgaatcccgcctaaaaaactactcctactaaaaaaaacgcctccctaaaaacgacgacaaacgcgcaacgaaaccccgtaccgcgccaaaaaccaccctaaaaaaaaaacaccgaaacaccgaaaaattcccactttctcctcaacctataacgcccgcgtcctcgaataaattcgaaaaacgcctaaacacgaccaaccgaaactctcgaaaaccccaatatcgttttccacctcaaacctcctttcctaaaacaaaacccgaaacctcgcgctctcgcctcaaactccgacccacgctcccgcccgaccgccaaacgcgcaacgaaaaacgcccccgccccgccccgctccgcccactacgtaacgcgcacccgaccgaaccaatcaaaactcgtaacgcgcgccccacacgccgaccccctccgcccctcaacttaaaaaaaaacgcgcgaacccgacaaaccaaaataccgaacaacgcgataaatacgactataaaacgacaaaaaacttctaccccgcgatacacgcgaccctcgaaacgacaacgcgactactaccaacaacgaaaacgcctcccgcgaaacgccccgacgacgcccgctcgcccataccgaactaaacgcgacaacgacgacgaaatactaacgctactaaccgccaacgtaacgctcgccgtaaccgctaaaacccaaaacaacccgacgcccgataaccgcttcgtatacacgacactacccccaaaaacgatacacgccgactacccgctacccgcgatacccatacaaaacgacgcgcaaaatcccgaaaaaaaactaaaaaccgcgatactacaactacgcgaaaccgtcgtacaacaaaaaaaaacgctaaacgcgcaacgcgaaaccatccgcgaactcacgaacaaactaacgcgctacgaaaaactaacgaacgacaaaacgcgcgacgcgaaaaccacgaacaaaaacactataaacgacctaccgcgaaaccccgaccacgtcgtaaaacaactcaaccgctcgctacaaaccctcaaaaaccgcctaaaaaacctcgaaataacgacccgcgaaaaacgcgaaaaacctaaaataaaaacgctcccgaatcgaaaacgaaaaactcgaaaaaataaaaaaaaaaaacctaaccctaaaaaaaatataatcgtccgtaaaaataaactaaacttaaaaataaaaaacgaaaat

SEQ ID NO: 30745 - DNA, 529 bp, Artificial Sequence
  chemically treated genomic DNA (Homo sapiens) CpG-island No: 30745
cgttcggttgggttcggttcggaaagtttcgcgaagttttcgttcggtcggtttagggcggcgcgaataagcggttttttttgcgtcggcggttttcggtagttggatcgcggttcgttggggcgcggacgtattcgagttggggcgggggcgggggcggggcggtcgcgttgttaaggtgattcgggcgcgggaaggcggtttcggttcgcgcgggtcgggtcgggcggcggcggcggtattatgagcggtcggaagcgtagttttattttcggggtttacggcgggtagggcgtggcgcggcgcggggcggggcgcgtgcgcgcgtgtgcgtgtgtacgcgtgggggggagttcgtgcggggtgtgttcgcgtttgggcgggtgggtttgggttatgattgttgtgggggttgagcgtttgattttagtgcgcgtatggttgtcgtgttgtggcgtttgtgtgtgtgtgtttttgtttttgtgtttgtgtgtgtttttattgcgtgtttatgtgtatgtgtggggag

SEQ ID NO: 30746 - DNA, 529 bp, Artificial Sequence
  chemically treated genomic DNA (Homo sapiens) CpG-island No: 30746
ctccccacacatacacataaacacgcaataaaaacacacacaaacacaaaaacaaaaacacacacacacaaacgccacaacacgacaaccatacgcgcactaaaatcaaacgctcaacccccacaacaatcataacccaaacccacccgcccaaacgcgaacacaccccgcacgaactcccccccacgcgtacacacgcacacgcgcgcacgcgccccgccccgcgccgcgccacgccctacccgccgtaaaccccgaaaataaaactacgcttccgaccgctcataataccgccgccgccgcccgacccgacccgcgcgaaccgaaaccgccttcccgcgcccgaatcaccttaacaacgcgaccgccccgcccccgcccccgccccaactcgaatacgtccgcgccccaacgaaccgcgatccaactaccgaaaaccgccgacgcaaaaaaaaccgcttattcgcgccgccctaaaccgaccgaacgaaaacttcgcgaaactttccgaaccgaacccaaccgaacg

SEQ ID NO: 30747 - DNA, 529 bp, Artificial Sequence
  chemically treated genomic DNA (Homo sapiens) CpG-island No: 30747
ttttttatatatgtatatggatacgtaatgggaatatatatagatatagaaatagaaatatatatatataggcgttatagtacgatagttatgcgcgtattgaggttaaacgtttagtttttatagtagttatagtttaggtttattcgtttaaacgcgagtatatttcgtacgggtttttttttacgcgtgtatacgtatacgcgcgtacgcgtttcgtttcgcgtcgcgttacgttttattcgtcgtaggtttcgaaggtgaagttgcgttttcggtcgtttatggtgtcgtcgtcgtcgttcggttcggttcgcgcgagtcggagtcgttttttcgcgttcgggttattttggtaacgcggtcgtttcgttttcgttttcgttttagttcggatacgttcgcgttttagcgggtcgcggtttagttgtcgggggtcgtcggcgtagaaagggtcgtttgttcgcgtcgttttgggtcggtcgggcgggggtttcgcgggatttttcgagtcgggtttagtcgggcg

SEQ ID NO: 30748 - DNA, 529 bp, Artificial Sequence
  chemically treated genomic DNA (Homo sapiens) CpG-island No: 30748
cgcccgactaaacccgactcgaaaaatcccgcgaaacccccgcccgaccgacccaaaacgacgcgaacaaacgaccctttctacgccgacgacccccgacaactaaaccgcgacccgctaaaacgcgaacgtatccgaactaaaacgaaaacgaaaacgaaacgaccgcgttaccaaaataacccgaacgcgaaaaaacgactccgactcgcgcgaaccgaaccgaacgacgacgacgacaccataaacgaccgaaaacgcaacttcaccttcgaaacctacgacgaataaaacgtaacgcgacgcgaaacgaaacgcgtacgcgcgtatacgtatacacgcgtaaaaaaaaacccgtacgaaatatactcgcgtttaaacgaataaacctaaactataactactataaaaactaaacgtttaacctcaatacgcgcataactatcgtactataacgcctatatatatatatttctatttctatatctatatatattcccattacgtatccatatacatatataaaaaa

SEQ ID NO: 30749 - DNA, 711 bp, Artificial Sequence
  chemically treated genomic DNA (Homo sapiens) CpG-island No: 30749
ggagacggtcgcgattagataatgttttgtatttatcgcggtttcggttaattataggtcggcgtttttcggtttcgtgcggcgttatcggttattgtttcggtcggaggaaaatttggttttagtcggttatttgcggttaatttagttagagcgcgcggcgtttttacggcgttcggttcggggaaggggtttgggtagtaggcgtcgcggcgtatttcggggtagggtcgcgaattgagggtaggacgcgtcgtttttttcgttcgaacgcggcgttgtttttttaagatgatttttttttcggggttaagtagcgcgttggcggtttcgtcgtagggggtagcgatattcgggttatcggattggcgacggcggcggtttttcgggtagtttttagttttcgcgggatgttcggtttatcgtcgtcggagaagaggagttttttaggttaaaaaaatttttttaagtttagggtcgtatcgcggcggtcgcggtatgtgtcgttattcgttttcgattcgtagatttcggggtcgggacgtcggggttagtacgcgggtcgcgaacgtttagtttgcggggtcgcgcggcgcgcgttcgttttaggatcgttttattttttgcgcgtgtttagggggcggggcgtttttgattagttaattagcgttagattttagggatcgtttttgaagtttttttagggggcgg

SEQ ID NO: 30750 - DNA, 711 bp, Artificial Sequence
  chemically treated genomic DNA (Homo sapiens) CpG-island No: 30750
ccgccccctaaaaaaacttcaaaaacgatccctaaaatctaacgctaattaactaatcaaaaacgccccgccccctaaacacgcgcaaaaaataaaacgatcctaaaacgaacgcgcgccgcgcgaccccgcaaactaaacgttcgcgacccgcgtactaaccccgacgtcccgaccccgaaatctacgaatcgaaaacgaataacgacacataccgcgaccgccgcgatacgaccctaaacttaaaaaaatttttttaacctaaaaaactcctcttctccgacgacgataaaccgaacatcccgcgaaaactaaaaactacccgaaaaaccgccgccgtcgccaatccgataacccgaatatcgctaccccctacgacgaaaccgccaacgcgctacttaaccccgaaaaaaaaatcatcttaaaaaaacaacgccgcgttcgaacgaaaaaaacgacgcgtcctaccctcaattcgcgaccctaccccgaaatacgccgcgacgcctactacccaaaccccttccccgaaccgaacgccgtaaaaacgccgcgcgctctaactaaattaaccgcaaataaccgactaaaaccaaattttcctccgaccgaaacaataaccgataacgccgcacgaaaccgaaaaacgccgacctataattaaccgaaaccgcgataaatacaaaacattatctaatcgcgaccgtctcc

SEQ ID NO: 30751 - DNA, 711 bp, Artificial Sequence
  chemically treated genomic DNA (Homo sapiens) CpG-island No: 30751
tcgttttttaagaagattttaggggcggtttttggagtttggcgttgattggttgattagaagcgtttcgttttttgggtacgcgtaggaggtggggcggttttgaggcgggcgcgcgtcgcgcggtttcgtaggttgagcgttcgcgattcgcgtgttggtttcggcgtttcggtttcggagtttgcgagtcggaggcgggtggcggtatatgtcgcggtcgtcgcggtgcgattttgggtttggggggatttttttggtttggagggtttttttttttcggcggcggtgagtcgggtatttcgcggggattgggagttgttcgaggggtcgtcgtcgtcgttagttcggtagttcggatgtcgttgttttttgcggcggggtcgttaacgcgttgtttggtttcgggaggaggattattttaaagggatagcgtcgcgttcgggcggagggggcggcgcgttttgtttttagttcgcgattttgtttcggggtacgtcgcggcgtttgttgtttagatttttttttcgggtcgggcgtcgtgggagcgtcgcgcgttttgattggattagtcgtagatggtcgattagagttaggttttttttcggtcggagtagtggtcggtggcgtcgtacggggtcgggaggcgtcggtttgtgattggtcgaggtcgcggtgaatgtaggatattgtttggtcgcggtcgttttt

SEQ ID NO: 30752 - DNA, 711 bp, Artificial Sequence
  chemically treated genomic DNA (Homo sapiens) CpG-island No: 30752
aaaaacgaccgcgaccaaacaatatcctacattcaccgcgacctcgaccaatcacaaaccgacgcctcccgaccccgtacgacgccaccgaccactactccgaccgaaaaaaaacctaactctaatcgaccatctacgactaatccaatcaaaacgcgcgacgctcccacgacgcccgacccgaaaaaaaaatctaaacaacaaacgccgcgacgtaccccgaaacaaaatcgcgaactaaaaacaaaacgcgccgccccctccgcccgaacgcgacgctatccctttaaaataatcctcctcccgaaaccaaacaacgcgttaacgaccccgccgcaaaaaacaacgacatccgaactaccgaactaacgacgacgacgacccctcgaacaactcccaatccccgcgaaatacccgactcaccgccgccgaaaaaaaaaaaccctccaaaccaaaaaaatccccccaaacccaaaatcgcaccgcgacgaccgcgacatataccgccacccgcctccgactcgcaaactccgaaaccgaaacgccgaaaccaacacgcgaatcgcgaacgctcaacctacgaaaccgcgcgacgcgcgcccgcctcaaaaccgccccacctcctacgcgtacccaaaaaacgaaacgcttctaatcaaccaatcaacgccaaactccaaaaaccgcccctaaaatcttcttaaaaaacga

SEQ ID NO: 30753 - DNA, 2074 bp, Artificial Sequence
  chemically treated genomic DNA (Homo sapiens) CpG-island No: 30753
gtcgcgtagcgtcggaaatttttcgcggtagttaggagggtcgtagttttttcggagtttcgttttttgtttcggggcggcgtattcggtttcgggaaggtgtcgcgcgggagacgtggtagtagtttttttagttcgcgttcgggcgtagcggtcgagcgtttcgtgtagtcgggtaaggaagatttcgcggtagtagcgtatcggtcggcggggagattcgtttgaagcgtcggcgttcgttaggggacgggaagtggcgttcggttcgtttttgcggttcgcggttcgcggtttagtagtttcgcgtcgttttttttttttcggtttttttttcggttttcgttatttcggtcgaatttttgtataaattatgttaggcgcgtttgacgttaggtggcggcgcgcgggcgcgggcgcgggcgcggcgcggttcggagggagttggcggcgggcgcgcgcggtttcgcggtttcgggtgcgcgcggcgtgtcggacgcgcgtaggcgttggcgtgttggggtcgcggcggcggcggcggcggcggcggtagcggcggcggcggcggcggcgcgggggttgagtcgtggtggtgcggacgcgttcgtgttcgggaattatcggattaaatttgaatcgagtgaaattatataaaggagcgtcgcggaggaggcggttcggggattcggatattttgaaatttattagagattcgttcgttttcggttaatttcgtgttcgtggatttagttttttggtcgtagttgtcgagttaatttcggagttcgttttgcgttttgtttttttttcggtattaggtagcggaggagttcgatcgattcggtgagcgcgagagttcgttcggcgttttcgggaggggcggcggcggcggcggcggtaggaaatcgtttcgggtcggggtcggggtcgcgttaggagttgggagcgaggagttgggcgtgtgcggggcgaggggcgaggggcgagggcgggagggggtcggggttagcgtaggagcgtagcgtcgttcgcgtagtgtcgtcggcgtcgtcgttcgcggggttcgaattcgcgtttcgagcgtcgttcggcgttttaatttttgtttgcgttcgtcgggtcggcggcggcgggggcgcgcggtgcggtcgagggttattttttcgtatgtaaatggttttttgttgtgttgtcggcgtggggggggggtacgggggataggagggagcgtgtttgcgcgcgggggagcgcgagcgcgttttttttcgtcggcgtcgagtacgagttgtcggttttatcgagagaaaaaggaaggaggaaaagttgggttttaatttaagtgcgagcgggcgatgggcgcgcgggcgcggggcggttgagtagcggcggcggcggttcggggacggcggcgattttcgtttttcgttttcgtttttcgtttcggatcgattacgtcgcgttcgtcgggagttgcggtcgtatcggcgcgaataaagtgcgtttttttcggcgcggcggcgttagttcgcgcggggatcgttatcgagcgaggtgggtcggcggcggggaaagtgcgcggggcgtcgcgtggggcgggggtagcgcgaatacgcggcgcgggaggcgtttcgagtttagttagtgtcggtcgcgggcgcggagttgcgagttcggagttgggggtttttggggtttttcggcggtttttaagtgcgttaggaggagaagaaagggagcggggtcggggcgagcgtcgggaggcgcggcgaggaggggattttattttgtcgagttggtcgggtcgtcggcggcggtagttgtataatagcgattttaattttttaacgtaattcggttttttcgttttttaattcgtcgggggttagcgtcggtggggggtggttattaggtggttttcgaggtgattcgggtgcgttttgttttcgtagagagtcgcggtttggagcgtgaacggtcgaggtggttggaggttaagcggttagcggggagaggaaaggagggcggtgggggacgcgttgtttgtttggttcgtatcggggattgggttcgttgg

SEQ ID NO: 30754 - DNA, 2074 bp, Artificial Sequence
  chemically treated genomic DNA (Homo sapiens) CpG-island No: 30754
ccaacgaacccaatccccgatacgaaccaaacaaacaacgcgtcccccaccgccctcctttcctctccccgctaaccgcttaacctccaaccacctcgaccgttcacgctccaaaccgcgactctctacgaaaacaaaacgcacccgaatcacctcgaaaaccacctaataaccaccccccaccgacgctaacccccgacgaattaaaaaacgaaaaaaccgaattacgttaaaaaattaaaatcgctattatacaactaccgccgccgacgacccgaccaactcgacaaaataaaatcccctcctcgccgcgcctcccgacgctcgccccgaccccgctccctttcttctcctcctaacgcacttaaaaaccgccgaaaaaccccaaaaacccccaactccgaactcgcaactccgcgcccgcgaccgacactaactaaactcgaaacgcctcccgcgccgcgtattcgcgctacccccgccccacgcgacgccccgcgcactttccccgccgccgacccacctcgctcgataacgatccccgcgcgaactaacgccgccgcgccgaaaaaaacgcactttattcgcgccgatacgaccgcaactcccgacgaacgcgacgtaatcgatccgaaacgaaaaacgaaaacgaaaaacgaaaatcgccgccgtccccgaaccgccgccgccgctactcaaccgccccgcgcccgcgcgcccatcgcccgctcgcacttaaattaaaacccaacttttcctccttcctttttctctcgataaaaccgacaactcgtactcgacgccgacgaaaaaaaacgcgctcgcgctcccccgcgcgcaaacacgctccctcctatcccccgtaccccccccccacgccgacaacacaacaaaaaaccatttacatacgaaaaaataaccctcgaccgcaccgcgcgcccccgccgccgccgacccgacgaacgcaaacaaaaattaaaacgccgaacgacgctcgaaacgcgaattcgaaccccgcgaacgacgacgccgacgacactacgcgaacgacgctacgctcctacgctaaccccgaccccctcccgccctcgcccctcgcccctcgccccgcacacgcccaactcctcgctcccaactcctaacgcgaccccgaccccgacccgaaacgatttcctaccgccgccgccgccgccgcccctcccgaaaacgccgaacgaactctcgcgctcaccgaatcgatcgaactcctccgctacctaataccgaaaaaaaaacaaaacgcaaaacgaactccgaaattaactcgacaactacgaccaaaaaactaaatccacgaacacgaaattaaccgaaaacgaacgaatctctaataaatttcaaaatatccgaatccccgaaccgcctcctccgcgacgctcctttatataatttcactcgattcaaatttaatccgataattcccgaacacgaacgcgtccgcaccaccacgactcaacccccgcgccgccgccgccgccgccgctaccgccgccgccgccgccgccgccgcgaccccaacacgccaacgcctacgcgcgtccgacacgccgcgcgcacccgaaaccgcgaaaccgcgcgcgcccgccgccaactccctccgaaccgcgccgcgcccgcgcccgcgcccgcgcgccgccacctaacgtcaaacgcgcctaacataatttatacaaaaattcgaccgaaataacgaaaaccgaaaaaaaaaccgaaaaaaaaaaaacgacgcgaaactactaaaccgcgaaccgcgaaccgcaaaaacgaaccgaacgccacttcccgtcccctaacgaacgccgacgcttcaaacgaatctccccgccgaccgatacgctactaccgcgaaatcttccttacccgactacacgaaacgctcgaccgctacgcccgaacgcgaactaaaaaaactactaccacgtctcccgcgcgacaccttcccgaaaccgaatacgccgccccgaaacaaaaaacgaaactccgaaaaaactacgaccctcctaactaccgcgaaaaatttccgacgctacgcgac

SEQ ID NO: 30755 - DNA, 2074 bp, Artificial Sequence
  chemically treated genomic DNA (Homo sapiens) CpG-island No: 30755
ttagcgagtttaattttcggtgcgaattaaataaataacgcgttttttatcgtttttttttttttttttcgttgatcgtttggtttttagttatttcggtcgtttacgttttaagtcgcggttttttgcgagggtagagcgtattcgggttatttcgggggttatttggtgattattttttatcggcgttgattttcggcgggttggggggcgggggagtcgagttgcgttggaaggttaaagtcgttattatgtagttgtcgtcgtcggcggttcggttagttcgataaggtggggtttttttttcgtcgcgtttttcggcgttcgtttcggtttcgtttttttttttttttttttagcgtatttgggagtcgtcggggagttttaggagtttttaatttcgggttcgtaatttcgcgttcgcgatcggtattggttgagttcgggacgtttttcgcgtcgcgtgttcgcgttgttttcgttttacgcggcgtttcgcgtatttttttcgtcgtcgatttatttcgttcggtggcggttttcgcgcgggttggcgtcgtcgcgtcgggaggaacgtattttgttcgcgtcggtgcggtcgtagttttcggcgagcgcggcgtggtcggttcggagcggggggcgggggcgggaggcgggggtcgtcgtcgttttcgagtcgtcgtcgtcgttgtttagtcgtttcgcgttcgcgcgtttatcgttcgttcgtatttgagttggagtttaatttttttttttttttttttttttcgatggagtcggtaattcgtgttcggcgtcggcgggaggaaacgcgttcgcgttttttcgcgcgtagatacgtttttttttgtttttcgtattttttttttacgtcggtagtataataaaaagttatttatatgcgaggaagtgattttcggtcgtatcgcgcgttttcgtcgtcgtcggttcggcggacgtaggtaaaagttggggcgtcgggcggcgttcggggcgcgggttcgggtttcgcgggcggcgacgtcggcgatattacgcgggcggcgttgcgtttttgcgttggtttcggttttttttcgttttcgtttttcgtttttcgtttcgtatacgtttaatttttcgtttttaatttttagcgcggtttcggtttcggttcggagcgattttttgtcgtcgtcgtcgtcgtcgtttttttcgggggcgtcgggcgaattttcgcgtttatcgggtcggtcgggttttttcgttgtttagtgtcgaggggaaaataaaacgtagagcgggtttcggagttggttcggtagttgcggttagggggttgaatttacgggtacggagttggtcgggggcgaacgggtttttggtgagttttagggtgttcgggttttcgggtcgtttttttcgcggcgtttttttgtgtaattttattcgatttaagtttaattcgatagttttcgagtacgagcgcgttcgtattattacgatttaattttcgcgtcgtcgtcgtcgtcgtcgttgtcgtcgtcgtcgtcgtcgtcgtcgcggttttagtacgttagcgtttgcgcgcgttcggtacgtcgcgcgtattcgaagtcgcggggtcgcgcgcgttcgtcgttagtttttttcgggtcgcgtcgcgttcgcgttcgcgttcgcgcgtcgttatttgacgttaggcgcgtttggtataatttatgtaagaattcggtcggggtggcggaggtcgagggagaggtcgagagaaaaggggcggcgcggagttgttgggtcgcgggtcgcgggtcgtaagggcgggtcgggcgttatttttcgttttttggcgggcgtcggcgttttaggcgggttttttcgtcggtcggtgcgttgttgtcgcggagttttttttgttcggttgtacggagcgttcggtcgttgcgttcgggcgcggattggaggggttgttgttacgtttttcgcgcggtattttttcggagtcgggtgcgtcgtttcggggtaggaagcggggtttcgggagggttgcgatttttttggttgtcgcgaagggttttcgacgttgcgcggt

SEQ ID NO: 30756 - DNA, 2074 bp, Artificial Sequence
  chemically treated genomic DNA (Homo sapiens) CpG-island No: 30756
accgcgcaacgtcgaaaacccttcgcgacaaccaaaaaaatcgcaaccctcccgaaaccccgcttcctaccccgaaacgacgcacccgactccgaaaaaataccgcgcgaaaaacgtaacaacaacccctccaatccgcgcccgaacgcaacgaccgaacgctccgtacaaccgaacaaaaaaaactccgcgacaacaacgcaccgaccgacgaaaaaacccgcctaaaacgccgacgcccgccaaaaaacgaaaaataacgcccgacccgcccttacgacccgcgacccgcgacccaacaactccgcgccgccccttttctctcgacctctccctcgacctccgccaccccgaccgaattcttacataaattataccaaacgcgcctaacgtcaaataacgacgcgcgaacgcgaacgcgaacgcgacgcgacccgaaaaaaactaacgacgaacgcgcgcgaccccgcgacttcgaatacgcgcgacgtaccgaacgcgcgcaaacgctaacgtactaaaaccgcgacgacgacgacgacgacgacgacaacgacgacgacgacgacgacgcgaaaattaaatcgtaataatacgaacgcgctcgtactcgaaaactatcgaattaaacttaaatcgaataaaattacacaaaaaaacgccgcgaaaaaaacgacccgaaaacccgaacaccctaaaactcaccaaaaacccgttcgcccccgaccaactccgtacccgtaaattcaaccccctaaccgcaactaccgaaccaactccgaaacccgctctacgttttattttcccctcgacactaaacaacgaaaaaacccgaccgacccgataaacgcgaaaattcgcccgacgcccccgaaaaaaacgacgacgacgacgacgacaaaaaatcgctccgaaccgaaaccgaaaccgcgctaaaaattaaaaacgaaaaattaaacgtatacgaaacgaaaaacgaaaaacgaaaacgaaaaaaaaccgaaaccaacgcaaaaacgcaacgccgcccgcgtaatatcgccgacgtcgccgcccgcgaaacccgaacccgcgccccgaacgccgcccgacgccccaacttttacctacgtccgccgaaccgacgacgacgaaaacgcgcgatacgaccgaaaatcacttcctcgcatataaataactttttattatactaccgacgtaaaaaaaaaatacgaaaaacaaaaaaaaacgtatctacgcgcgaaaaaacgcgaacgcgtttcctcccgccgacgccgaacacgaattaccgactccatcgaaaaaaaaaaaaaaaaaaaaaaattaaactccaactcaaatacgaacgaacgataaacgcgcgaacgcgaaacgactaaacaacgacgacgacgactcgaaaacgacgacgacccccgcctcccgcccccgccccccgctccgaaccgaccacgccgcgctcgccgaaaactacgaccgcaccgacgcgaacaaaatacgttcctcccgacgcgacgacgccaacccgcgcgaaaaccgccaccgaacgaaataaatcgacgacgaaaaaaatacgcgaaacgccgcgtaaaacgaaaacaacgcgaacacgcgacgcgaaaaacgtcccgaactcaaccaataccgatcgcgaacgcgaaattacgaacccgaaattaaaaactcctaaaactccccgacgactcccaaatacgctaaaaaaaaaaaaaaaaaaacgaaaccgaaacgaacgccgaaaaacgcgacgaaaaaaaaaccccaccttatcgaactaaccgaaccgccgacgacgacaactacataataacgactttaaccttccaacgcaactcgactcccccgccccccaacccgccgaaaatcaacgccgataaaaaataatcaccaaataacccccgaaataacccgaatacgctctaccctcgcaaaaaaccgcgacttaaaacgtaaacgaccgaaataactaaaaaccaaacgatcaacgaaaaaaaaaaaaaaaaacgataaaaaacgcgttatttatttaattcgcaccgaaaattaaactcgctaa

SEQ ID NO: 30757 - DNA, 771 bp, Artificial Sequence
  chemically treated genomic DNA (Homo sapiens) CpG-island No: 30757
tgcgaaagaggaagttcggaaggagcgaggaatggggtgggtggtagcgggggcggtttagtcgttgtcgtttttgtttattagtacggcgttcgatttttcggtgatttttagtagcgcgtgtacgtcggggttgttttcgcgtcgtaggtcgtcggttttttcgcgtttcgtcgttttcgtcgtcgtcggcgtttatttttattatttcggtggttttgagtatttttatttggttttcgcggatttttttgacgtggaaggtgaagggtggtattttgtagatcgcggttttggagcgcgcgtatattacgtggtcgggcgtgaaggatttgcgtaatttgtttcgcgacgtttttagtttttcgcgtcgttcggcgggtattaggcgcgtgtttagtttgtttatgcgtttttttagggtgtgtcgcgttttttttaggttttttttggttttgaggcgcgttttttttaggttttcgcgggtacgtattttggttttttttattttttttttggagaaggtttttttgaagtcgtttacgcgtcgtagtgtttgcgtttgatacgttttgcgcgggattttttaataatttttttaatttttatcgtttcgttcgacgaaagttttagcgtcgttgcgtttttttcgggtcgttcgttttcgtttagtttttcgttttttttttttggtagcgttttcgatttttttagcgatttgttgatgtttagtttggtcggtagttttattttattttaagggaagaggag

SEQ ID NO: 30758 - DNA, 771 bp, Artificial Sequence
  chemically treated genomic DNA (Homo sapiens) CpG-island No: 30758
ctcctcttcccttaaaataaaataaaactaccgaccaaactaaacatcaacaaatcgctaaaaaaatcgaaaacgctaccaaaaaaaaaaaacgaaaaactaaacgaaaacgaacgacccgaaaaaaacgcaacgacgctaaaactttcgtcgaacgaaacgataaaaattaaaaaaattattaaaaaatcccgcgcaaaacgtatcaaacgcaaacactacgacgcgtaaacgacttcaaaaaaaccttctccaaaaaaaaaataaaaaaaaccaaaatacgtacccgcgaaaacctaaaaaaaacgcgcctcaaaaccaaaaaaaacctaaaaaaaacgcgacacaccctaaaaaaacgcataaacaaactaaacacgcgcctaatacccgccgaacgacgcgaaaaactaaaaacgtcgcgaaacaaattacgcaaatccttcacgcccgaccacgtaatatacgcgcgctccaaaaccgcgatctacaaaataccacccttcaccttccacgtcaaaaaaatccgcgaaaaccaaataaaaatactcaaaaccaccgaaataataaaaataaacgccgacgacgacgaaaacgacgaaacgcgaaaaaaccgacgacctacgacgcgaaaacaaccccgacgtacacgcgctactaaaaatcaccgaaaaatcgaacgccgtactaataaacaaaaacgacaacgactaaaccgcccccgctaccacccaccccattcctcgctccttccgaacttcctctttcgca

SEQ ID NO: 30759 - DNA, 771 bp, Artificial Sequence
  chemically treated genomic DNA (Homo sapiens) CpG-island No: 30759
tttttttttttttaggatgaagtgaagttgtcggttaaattgagtattagtaaatcgttgaaagagtcggaggcgttgttagagaaggagggcgaggagttgggcgagggcgagcggttcgaggaggacgtagcggcgttggagttttcgtcggacgaggcggtggaggttgaggaggttattgaggagtttcgcgtagagcgtattaagcgtagatattgcggcgcgtggacgattttaagaaggttttttttaaggagaagatggagaagattaaggtgcgtattcgcgagaatttggagaagacgcgttttaagattaaggaaaatttggagaagacgcggtatattttggagaagcgtatgaataagttgggtacgcgtttggtgttcgtcgagcggcgcgagaaattgaagacgtcgcgggataagttgcgtaaattttttacgttcgattacgtggtgtacgcgcgttttaagatcgcggtttataaggtgttattttttattttttacgttaagaagattcgcgagggttaggtggaagtgtttaaggttatcgagatggtggaggtgggcgtcgacgacgacgagggcggcggagcgcggggaggtcggcgatttgcggcgcgggagtagtttcgacgtgtacgcgttgttggagattatcgaggagtcggacgtcgtgttggtggataagagcgatagcgattgagtcgttttcgttgttatttattttatttttcgtttttttcgaattttttttttcgta

SEQ ID NO: 30760 - DNA, 771 bp, Artificial Sequence
  chemically treated genomic DNA (Homo sapiens) CpG-island No: 30760
tacgaaaaaaaaaattcgaaaaaaacgaaaaataaaataaataacaacgaaaacgactcaatcgctatcgctcttatccaccaacacgacgtccgactcctcgataatctccaacaacgcgtacacgtcgaaactactcccgcgccgcaaatcgccgacctccccgcgctccgccgccctcgtcgtcgtcgacgcccacctccaccatctcgataaccttaaacacttccacctaaccctcgcgaatcttcttaacgtaaaaaataaaaaataacaccttataaaccgcgatcttaaaacgcgcgtacaccacgtaatcgaacgtaaaaaatttacgcaacttatcccgcgacgtcttcaatttctcgcgccgctcgacgaacaccaaacgcgtacccaacttattcatacgcttctccaaaatataccgcgtcttctccaaattttccttaatcttaaaacgcgtcttctccaaattctcgcgaatacgcaccttaatcttctccatcttctccttaaaaaaaaccttcttaaaatcgtccacgcgccgcaatatctacgcttaatacgctctacgcgaaactcctcaataacctcctcaacctccaccgcctcgtccgacgaaaactccaacgccgctacgtcctcctcgaaccgctcgccctcgcccaactcctcgccctccttctctaacaacgcctccgactctttcaacgatttactaatactcaatttaaccgacaacttcacttcatcctaaaaaaaaaaaaa

SEQ ID NO: 30761 - DNA, 1185 bp, Artificial Sequence
  chemically treated genomic DNA (Homo sapiens) CpG-island No: 30761
gggcgtttaattttttttttgttttttttttatttcgtgagaaagtcgacgtttttattcgtttggttttttcgaaatacgtttcgggtggttaatgcgatttttagggtttaaagattagattttcgcgttttttattaagatatcgacgcgaagcgtagaggtggaatcgcggacgttttggtaggttcgggatatattgattttggtggcgcgatgtttttttcgtacgcggacgtattcgtagttttatttttttaaattttattgcgggaaggaattttcgattcgtatcgttttcgtttcgtagtaacggcgatattttgaggttcggacgagcggcgtttttttttagtttcggttattttttagcgaagttttaggcgatcgagacgaagaaagagagttcgaggaattggatatttacgagtttatcgtttattttgtcggcggggaggaaggtcgttttcgttcgtcgtggtatgcgtttcgcgggtgtttttttaatattgtagcgcggagggtttttttttacgtcggcgattgtttatcgcgtttttcgttttttttcggttttcggtttttgttttagtttttttttttcggtttttttttttttttgttttgtttttttttcgtttttttattttttttattcggtcggtaattttacgtttcgtttttttttagcggcggttattttatcgtcggggtgttaggggtatttcgaggttttacgcggggcgatttttatttcggtcgtagtttattgttttagtttcgtattagtaagttttaagagtgtggatgcgataggcgcgcgtagagggcgttcgcgaatttttgtgttatcgttttttttcggcgcgcggggtcgagcgagattagagtgtgttggattgcgtgttcggatttcgtgaatgaagggagcgggaggaaggagcgggggtgggcggtaggtatggagggggcgtttggtttttagagtttcgcgtttgtggattgcgcgtttttggagggtagttttttatttttttcggttcgggcgtttttttgagttttgttttcgttttatttcgcgtatttaggtttcggttttttcgttttggaaagcggttttcgtttttttttagttagttagagcgcggaggttttatttagtaatcgagcgggggataagggggg

SEQ ID NO: 30762 - DNA, 1185 bp, Artificial Sequence
  chemically treated genomic DNA (Homo sapiens) CpG-island No: 30762
ccccccttatcccccgctcgattactaaataaaacctccgcgctctaactaactaaaaaaaaacgaaaaccgctttccaaaacgaaaaaaccgaaacctaaatacgcgaaataaaacgaaaacaaaactcaaaaaaacgcccgaaccgaaaaaaataaaaaactaccctccaaaaacgcgcaatccacaaacgcgaaactctaaaaaccaaacgccccctccatacctaccgcccacccccgctccttcctcccgctcccttcattcacgaaatccgaacacgcaatccaacacactctaatctcgctcgaccccgcgcgccgaaaaaaaacgataacacaaaaattcgcgaacgccctctacgcgcgcctatcgcatccacactcttaaaacttactaatacgaaactaaaacaataaactacgaccgaaataaaaatcgccccgcgtaaaacctcgaaatacccctaacaccccgacgataaaataaccgccgctaaaaaaaaacgaaacgtaaaattaccgaccgaataaaaaaaataaaaaaacgaaaaaaaaacaaaacaaaaaaaaaaaaaaaccgaaaaaaaaaaactaaaacaaaaaccgaaaaccgaaaaaaaacgaaaaacgcgataaacaatcgccgacgtaaaaaaaaaccctccgcgctacaatattaaaaaaacacccgcgaaacgcataccacgacgaacgaaaacgaccttcctccccgccgacaaaataaacgataaactcgtaaatatccaattcctcgaactctctttcttcgtctcgatcgcctaaaacttcgctaaaaaataaccgaaactaaaaaaaaacgccgctcgtccgaacctcaaaatatcgccgttactacgaaacgaaaacgatacgaatcgaaaattccttcccgcaataaaatttaaaaaaataaaactacgaatacgtccgcgtacgaaaaaaacatcgcgccaccaaaatcaatatatcccgaacctaccaaaacgtccgcgattccacctctacgcttcgcgtcgatatcttaataaaaaacgcgaaaatctaatctttaaaccctaaaaatcgcattaaccacccgaaacgtatttcgaaaaaaccaaacgaataaaaacgtcgactttctcacgaaataaaaaaaaaacaaaaaaaaaattaaacgccc

SEQ ID NO: 30763 - DNA, 1185 bp, Artificial Sequence
  chemically treated genomic DNA (Homo sapiens) CpG-island No: 30763
ttttttttatttttcgttcggttgttgggtggggttttcgcgttttggttagttgggagggggcgagggtcgttttttagggcgggaagatcggagtttaggtgcgcggggtggggcggggatagagtttagagaggcgttcgggtcggagaaggtagggggttgttttttagagacgcgtagtttatagacgcgaagttttggggattaagcgttttttttatgtttgtcgtttattttcgtttttttttttcgttttttttatttacgaggttcgagtacgtagtttagtatattttagtttcgttcggtttcgcgcgtcgaggggaggcgatgatatagaggttcgcggacgttttttacgcgcgtttgtcgtatttatatttttgggatttgttaatgcggggttggagtagtgggttgcggtcggggtggaggtcgtttcgcgtggggtttcggggtatttttagtatttcggcggtggagtggtcgtcgttggagggaggcgagacgtgggattgtcggtcgggtaaaaggagtgagggggcggggaggaggtagagtaaggggaggaagaggtcgggagaagagggttagagtaaagatcgagagtcggagaaaggcgaaaggcgcggtgagtaatcgtcgacgtagagaggggtttttcgcgttgtaatattgagaaggtattcgcgggacgtatgttacggcggacggaggcggttttttttttcgtcggtagggtggacggtgggttcgtgagtatttagtttttcgaatttttttttttcgtttcggtcgtttgaggtttcgttggaaagtggtcgaggttgggagggggcgtcgttcgttcggattttagggtgtcgtcgttgttgcggggcgggagcggtgcgagtcgggggttttttttcgtagtggagtttgggggagtggggttgcgagtgcgttcgcgtgcgaagagggtatcgcgttattaggattaatatgtttcgggtttgttagggcgttcgcgattttatttttgcgtttcgcgtcggtgttttggtggggaacgcgggagtttagtttttagattttagaaatcgtattgattattcgaagcgtatttcggaaagattaggcgggtggaagcgtcggtttttttacgggatagggagaggataaggaaggggttgggcgttt

SEQ ID NO: 30764 - DNA, 1185 bp, Artificial Sequence
  chemically treated genomic DNA (Homo sapiens) CpG-island No: 30764
aaacgcccaaccccttccttatcctctccctatcccgtaaaaaaaccgacgcttccacccgcctaatctttccgaaatacgcttcgaataatcaatacgatttctaaaatctaaaaactaaactcccgcgttccccaccaaaacaccgacgcgaaacgcaaaaataaaatcgcgaacgccctaacaaacccgaaacatattaatcctaataacgcgataccctcttcgcacgcgaacgcactcgcaaccccactcccccaaactccactacgaaaaaaaacccccgactcgcaccgctcccgccccgcaacaacgacgacaccctaaaatccgaacgaacgacgccccctcccaacctcgaccactttccaacgaaacctcaaacgaccgaaacgaaaaaaaaaaattcgaaaaactaaatactcacgaacccaccgtccaccctaccgacgaaaaaaaaaaccgcctccgtccgccgtaacatacgtcccgcgaataccttctcaatattacaacgcgaaaaacccctctctacgtcgacgattactcaccgcgcctttcgcctttctccgactctcgatctttactctaaccctcttctcccgacctcttcctccccttactctacctcctccccgccccctcactccttttacccgaccgacaatcccacgtctcgcctccctccaacgacgaccactccaccgccgaaatactaaaaataccccgaaaccccacgcgaaacgacctccaccccgaccgcaacccactactccaaccccgcattaacaaatcccaaaaatataaatacgacaaacgcgcgtaaaaaacgtccgcgaacctctatatcatcgcctcccctcgacgcgcgaaaccgaacgaaactaaaatatactaaactacgtactcgaacctcgtaaataaaaaaaacgaaaaaaaaaaacgaaaataaacgacaaacataaaaaaaacgcttaatccccaaaacttcgcgtctataaactacgcgtctctaaaaaacaaccccctaccttctccgacccgaacgcctctctaaactctatccccgccccaccccgcgcacctaaactccgatcttcccgccctaaaaaacgaccctcgccccctcccaactaaccaaaacgcgaaaaccccacccaacaaccgaacgaaaaataaaaaaaa

SEQ ID NO: 30765 - DNA, 787 bp, Artificial Sequence
  chemically treated genomic DNA (Homo sapiens) CpG-island No: 30765
ttggaataaattcgggtatttgatttttcgtattttcggagttgttttgggaagtcgaaataagtttgggcgttcggattgcggagattggaaagtagggggcggagggcgggagattgggggcgggaagtggaggtgtaggttgtagttggggatcgcggtgggcgttggaggggagggtttgtgtgcgcggttgttttttagcgttgggggagcggacgggttaggggttttagggaagcggcgtttcgggatcggggtggttttttcgtttttgtgtgcgcggcgatttttatatttagttcgggcggaggagtttgagagaagcgttattgagagtggggtgggcgttttggggaaaggtttgcgtgcgttcggttttatcgttgttagagaagtggaagagagagagtgggcgtcgggagggggtttataggcgtcgcgatttattttatttttttttacgtttgtgggagtgagtggggaaggggttttgggagaggcggcgcgcgggtattgaggttatcgtgagtttttcggatttgatagtattaaaggaaaattttggcgagtagtaggttagcgagcgattttagtagtagggacgcggtcgtgcgagattcgcggataggcgaagggggattttaggggagtagttgttgtttacgggttacgggcgatgtacggagtggagaagtgaacgtggtttataggatttttgttcggaaggtggagagcgttataggggaattttttcgatttttgttcgtttcgtaatttggtaaaa

SEQ ID NO: 30766 - DNA, 787 bp, Artificial Sequence
  chemically treated genomic DNA (Homo sapiens) CpG-island No: 30766
ttttaccaaattacgaaacgaacaaaaatcgaaaaaattcccctataacgctctccaccttccgaacaaaaatcctataaaccacgttcacttctccactccgtacatcgcccgtaacccgtaaacaacaactactcccctaaaatcccccttcgcctatccgcgaatctcgcacgaccgcgtccctactactaaaatcgctcgctaacctactactcgccaaaattttcctttaatactatcaaatccgaaaaactcacgataacctcaatacccgcgcgccgcctctcccaaaaccccttccccactcactcccacaaacgtaaaaaaaaataaaataaatcgcgacgcctataaaccccctcccgacgcccactctctctcttccacttctctaacaacgataaaaccgaacgcacgcaaacctttccccaaaacgcccaccccactctcaataacgcttctctcaaactcctccgcccgaactaaatataaaaatcgccgcgcacacaaaaacgaaaaaaccaccccgatcccgaaacgccgcttccctaaaacccctaacccgtccgctcccccaacgctaaaaaacaaccgcgcacacaaaccctcccctccaacgcccaccgcgatccccaactacaacctacacctccacttcccgcccccaatctcccgccctccgccccctactttccaatctccgcaatccgaacgcccaaacttatttcgacttcccaaaacaactccgaaaatacgaaaaatcaaatacccgaatttattccaa

SEQ ID NO: 30767 - DNA, 787 bp, Artificial Sequence
  chemically treated genomic DNA (Homo sapiens) CpG-island No: 30767
ttttgttaagttacgagacggataggaatcgaggagatttttttgtagcgttttttatttttcggatagaaattttgtagattacgtttatttttttatttcgtgtatcgttcgtggttcgtgggtagtagttgtttttttgggattttttttcgtttgttcgcgagtttcgtacggtcgcgtttttgttgttggggtcgttcgttggtttgttgttcgttaggatttttttttgatgttgttaagttcgggaagtttacgatgattttagtgttcgcgcgtcgttttttttaaagttttttttttatttatttttataagcgtggagggagatggggtaggtcgcggcgtttatagattttttttcggcgtttatttttttttttttatttttttagtagcggtagggtcgagcgtacgtaaatttttttttaaaacgtttattttatttttagtagcgttttttttaggttttttcgttcgagttgggtgtggggatcgtcgcgtatatagagacgggaaagttatttcggtttcggagcgtcgtttttttagagtttttggttcgttcgtttttttagcgttggaggatagtcgcgtatatagatttttttttttaacgtttatcgcggtttttagttgtagtttgtatttttatttttcgtttttagtttttcgtttttcgttttttgttttttagttttcgtagttcgggcgtttagatttgtttcgattttttagggtagtttcgagggtgcggaagattaagtgttcgggtttgttttag

SEQ ID NO: 30768 - DNA, 787 bp, Artificial Sequence
  chemically treated genomic DNA (Homo sapiens) CpG-island No: 30768
ctaaaacaaacccgaacacttaatcttccgcaccctcgaaactaccctaaaaaatcgaaacaaatctaaacgcccgaactacgaaaactaaaaaacaaaaaacgaaaaacgaaaaactaaaaacgaaaaataaaaatacaaactacaactaaaaaccgcgataaacgttaaaaaaaaaaatctatatacgcgactatcctccaacgctaaaaaaacgaacgaaccaaaaactctaaaaaaacgacgctccgaaaccgaaataactttcccgtctctatatacgcgacgatccccacacccaactcgaacgaaaaaacctaaaaaaaacgctactaaaaataaaataaacgttttaaaaaaaaatttacgtacgctcgaccctaccgctactaaaaaaataaaaaaaaaaaaataaacgccgaaaaaaaatctataaacgccgcgacctaccccatctccctccacgcttataaaaataaataaaaaaaaaactttaaaaaaaacgacgcgcgaacactaaaatcatcgtaaacttcccgaacttaacaacatcaaaaaaaaatcctaacgaacaacaaaccaacgaacgaccccaacaacaaaaacgcgaccgtacgaaactcgcgaacaaacgaaaaaaaatcccaaaaaaacaactactacccacgaaccacgaacgatacacgaaataaaaaaataaacgtaatctacaaaatttctatccgaaaaataaaaaacgctacaaaaaaatctcctcgattcctatccgtctcgtaacttaacaaaa

SEQ ID NO: 30769 - DNA, 716 bp, Artificial Sequence
  chemically treated genomic DNA (Homo sapiens) CpG-island No: 30769
  misc_feature (30)..(30): n is either a, c, g or t
  misc_feature (32)..(32): n is either a, c, g or t
gtatttttcgttttttttttttttatttangnaatttttttttttatatattttttaatttttcgttttagttttttaaatttttatttttttcgttaagtagcgtcgtcgtttcggttttttattagatttttttagtttcgcgttttatcggtgtcgtcgtttttttttttttttagtttcggttttatataaagtttcggatttatcgcgcggtcggtttcgggagtcgttattttcgatttcgcgggtttcgggtcgtagagtcgtcgttgttacggggtttaggtcgttattcgttttcgcggttttttttttttattttatttcggtttcggtttcggtttcggttttggttttttgtttttttttcgcgttttttcgtttcgttcggtcggtgtcgttgtgttcggggtcgcgggttttttagtcgtcgttatcgtcgtcgtcgtcgcgattcgggataattagagttattcggaagacgcggatattggattgttaggttttcggattcggatttcgcgtttgtgtggagtttggagtcggtgagcgtaggggaaattcggaatttggatgaaggagcgaaattttgggtttcggaatgcgcgtttattcggagtttagattagggagttttagtttagggaatgttggaaaattcggcgtgtcggttagaattaagataaatttaaagaaatttggattagagagtt

SEQ ID NO: 30770 - DNA, 716 bp, Artificial Sequence
  chemically treated genomic DNA (Homo sapiens) CpG-island No: 30770
  misc_feature (685)..(685): n is either a, c, g or t
  misc_feature (687)..(687): n is either a, c, g or t
aactctctaatccaaatttctttaaatttatcttaattctaaccgacacgccgaattttccaacattccctaaactaaaactccctaatctaaactccgaataaacgcgcattccgaaacccaaaatttcgctccttcatccaaattccgaatttcccctacgctcaccgactccaaactccacacaaacgcgaaatccgaatccgaaaacctaacaatccaatatccgcgtcttccgaataactctaattatcccgaatcgcgacgacgacgacgataacgacgactaaaaaacccgcgaccccgaacacaacgacaccgaccgaacgaaacgaaaaaacgcgaaaaaaaaacaaaaaaccaaaaccgaaaccgaaaccgaaaccgaaataaaataaaaaaaaaaaaccgcgaaaacgaataacgacctaaaccccgtaacaacgacgactctacgacccgaaacccgcgaaatcgaaaataacgactcccgaaaccgaccgcgcgataaatccgaaactttatataaaaccgaaactaaaaaaaaaaaaaaacgacgacaccgataaaacgcgaaactaaaaaaatctaataaaaaaccgaaacgacgacgctacttaacgaaaaaaataaaaatttaaaaaactaaaacgaaaaattaaaaaatatataaaaaaaaaaattncntaaataaaaaaaaaaaaaacgaaaaatac

SEQ ID NO: 30771 - DNA, 716 bp, Artificial Sequence
  chemically treated genomic DNA (Homo sapiens) CpG-island No: 30771
  misc_feature (685)..(685): n is either a, c, g or t
  misc_feature (687)..(687): n is either a, c, g or t
agttttttaatttaggtttttttgagtttattttggttttaatcggtacgtcgggttttttagtattttttgagttaagattttttaatttgggtttcgggtgagcgcgtatttcgagatttaggatttcgtttttttatttaggtttcgggttttttttgcgtttatcggttttagattttatataagcgcggaattcggattcgagggtttggtagtttagtgttcgcgtttttcgggtgattttggttgtttcggatcgcggcggcggcggcggtggcggcggttgagggattcgcggtttcggatatagcggtatcggtcgggcggggcggagaggcgcggggagggggtagagagttagagtcggagtcggagtcggagtcggggtggggtgggggggaggggtcgcgggaacggatggcggtttgggtttcgtagtagcggcggttttacggttcggggttcgcgaggtcggaggtggcggttttcgggatcggtcgcgcggtgagttcggagttttgtgtggagtcgggattgggggaggaaagaggcggcggtatcgatggggcgcggggttgaggggatttgatggggggtcggggcggcggcgttgtttgacggaggaagtgggggtttggggggttggggcggagagttggaaggtgtgtaggggggggggttntntgggtggggggggggggggcgaggggtgt

SEQ ID NO: 30772 - DNA, 716 bp, Artificial Sequence
  chemically treated genomic DNA (Homo sapiens) CpG-island No: 30772
  misc_feature (30)..(30): n is either a, c, g or t
  misc_feature (32)..(32): n is either a, c, g or t
acacccctcgccccccccccccccacccananaacccccccccctacacaccttccaactctccgccccaaccccccaaacccccacttcctccgtcaaacaacgccgccgccccgaccccccatcaaatcccctcaaccccgcgccccatcgataccgccgcctctttcctcccccaatcccgactccacacaaaactccgaactcaccgcgcgaccgatcccgaaaaccgccacctccgacctcgcgaaccccgaaccgtaaaaccgccgctactacgaaacccaaaccgccatccgttcccgcgacccctcccccccaccccaccccgactccgactccgactccgactctaactctctaccccctccccgcgcctctccgccccgcccgaccgataccgctatatccgaaaccgcgaatccctcaaccgccgccaccgccgccgccgccgcgatccgaaacaaccaaaatcacccgaaaaacgcgaacactaaactaccaaaccctcgaatccgaattccgcgcttatataaaatctaaaaccgataaacgcaaaaaaaacccgaaacctaaataaaaaaacgaaatcctaaatctcgaaatacgcgctcacccgaaacccaaattaaaaaatcttaactcaaaaaatactaaaaaacccgacgtaccgattaaaaccaaaataaactcaaaaaaacctaaattaaaaaact

SEQ ID NO: 30773 - DNA, 505 bp, Artificial Sequence
  chemically treated genomic DNA (Homo sapiens) CpG-island No: 30773
  misc_feature (173)..(173): n is either a, c, g or t
  misc_feature (333)..(333): n is either a, c, g or t
gtcggtacgtttacgttcgcggatttttagacgttttagataatcggtcgcgtcgttagttagcgcgcgttatttatttagtttttcgttatagttcgatgcgataatattatcgtcgcgtattagtatcggcgggtgtgtcgatgattgttcgttttagtagatcgcgtagntcggtaaattcgtttatttttttacgtagcgtttgtatcggtgtattatcgatagtttttaattgcgtacgagtttcggtagttgttggaaagcgtggcgtatacgggttagatcgcgtgggcgagtagttcgtaaagttagacgtgttagaatacgttntaggtcgtcgattgacgtagtatcggttgtagtcggcggtgaaattttgtatgcgttaatagttgttgggtttagtatacgcggtatcgtattgtatatgagtagcgtttagtatacggtgttatcgcgtgagggttagtcgagaagaagtagcgtattttcgtatattcgt

SEQ ID NO: 30774 - DNA, 505 bp, Artificial Sequence
  chemically treated genomic DNA (Homo sapiens) CpG-island No: 30774
  misc_feature (173)..(173): n is either a, c, g or t
  misc_feature (333)..(333): n is either a, c, g or t
acgaatatacgaaaatacgctacttcttctcgactaaccctcacgcgataacaccgtatactaaacgctactcatatacaatacgataccgcgtatactaaacccaacaactattaacgcatacaaaatttcaccgccgactacaaccgatactacgtcaatcgacgacctanaacgtattctaacacgtctaactttacgaactactcgcccacgcgatctaacccgtatacgccacgctttccaacaactaccgaaactcgtacgcaattaaaaactatcgataatacaccgatacaaacgctacgtaaaaaaataaacgaatttaccganctacgcgatctactaaaacgaacaatcatcgacacacccgccgatactaatacgcgacgataatattatcgcatcgaactataacgaaaaactaaataaataacgcgcgctaactaacgacgcgaccgattatctaaaacgtctaaaaatccgcgaacgtaaacgtaccgac

SEQ ID NO: 30775 - DNA, 505 bp, Artificial Sequence
  chemically treated genomic DNA (Homo sapiens) CpG-island No: 30775
  misc_feature (173)..(173): n is either a, c, g or t
  misc_feature (333)..(333): n is either a, c, g or t
gcgggtgtgcgaaaatacgttgttttttttcgattgatttttacgcgatggtatcgtatgttgaacgttgtttatatgtagtgcgatatcgcgtgtgttgagtttagtaattattggcgtatgtaggattttatcgtcggttatagtcggtattgcgttagtcggcgatttgnaacgtattttggtacgtttggttttacgaattgttcgtttacgcgatttggttcgtatgcgttacgttttttagtaattgtcggagttcgtgcgtagttagaaattgtcgatagtgtatcggtataggcgttacgtgagaagatgggcgagtttgtcganttgcgcgatttgttggagcgagtaattatcgatatattcgtcggtgttggtacgcgacggtggtgttatcgtatcgggttataacgaagagttggatgagtggcgcgcgttggttgacggcgcgatcgattatttggagcgtttggaagttcgcgagcgtgaacgtatcggt

SEQ ID NO: 30776 - DNA, 505 bp, Artificial Sequence
  chemically treated genomic DNA (Homo sapiens) CpG-island No: 30776
  misc_feature (173)..(173): n is either a, c, g or t
  misc_feature (333)..(333): n is either a, c, g or t
accgatacgttcacgctcgcgaacttccaaacgctccaaataatcgatcgcgccgtcaaccaacgcgcgccactcatccaactcttcgttataacccgatacgataacaccaccgtcgcgtaccaacaccgacgaatatatcgataattactcgctccaacaaatcgcgcaantcgacaaactcgcccatcttctcacgtaacgcctataccgatacactatcgacaatttctaactacgcacgaactccgacaattactaaaaaacgtaacgcatacgaaccaaatcgcgtaaacgaacaattcgtaaaaccaaacgtaccaaaatacgttncaaatcgccgactaacgcaataccgactataaccgacgataaaatcctacatacgccaataattactaaactcaacacacgcgatatcgcactacatataaacaacgttcaacatacgataccatcgcgtaaaaatcaatcgaaaaaaaacaacgtattttcgcacacccgc

SEQ ID NO: 30777 - DNA, 956 bp, Artificial Sequence
  chemically treated genomic DNA (Homo sapiens) CpG-island No: 30777
cgtttgcgtagtgggttttaggcgttgcgcgttgcgggagttaggagattttcgtttttggtttttcgtttcggtttttcgttttttagtttacgtttttttttgcgaacgcgtacgtgaacgggagcgcggacgcgttcgagaatgcgttttatttcgtagaagcgggtgggttttgtggagagtcgcgggttcgcgggtagtagcgttttttttatttcggcgggttcgggttcggtcggtcgtttatcggattggcggattggttgattgatacgtttcgtttgttttcgttttcgttcgtgtttcgtttagttttattttttttttcgtttttcgggttcgggggtagacggtagacggaggcgttttttttttttcgttttttttttcggttttttttttttttagtatttcggttgttgttcggtagcggtagtagttgcgtcggcggtttatatagtagcgagaggcgagaggaggttgtttcgaggatgaagtgtaaatttaattagatacggatttacgatttcgaggggtttaagaagcgggcggcgtgtttgtgttttcggagcgagcgcgaggacgaggttttgttagtgagtagtagtcggtattcggatcgttggatcgtgtcgggcggggtatggagttcgaggaggagtcgggcggtgcggcggttcgagaggtgtacgaagaggcgggagttaaggggaagttaggtcggtttttgggcgttttcgaatagaattaggattttaagtatagaacgtacgtgtatgtattgattgttacggagttgttggaggattgggaagattcggttagtattgggaggaagcgagagtggtttaaagtcgaagatgttattaaggttttttagtgttataagttcgtgtacgtcgaatatttggagaaattaaagttgggcggttttttaattaatggaaatttta

SEQ ID NO: 30778 - DNA, 956 bp, Artificial Sequence
  chemically treated genomic DNA (Homo sapiens) CpG-island No: 30778
taaaatttccattaattaaaaaaccgcccaactttaatttctccaaatattcgacgtacacgaacttataacactaaaaaaccttaataacatcttcgactttaaaccactctcgcttcctcccaatactaaccgaatcttcccaatcctccaacaactccgtaacaatcaatacatacacgtacgttctatacttaaaatcctaattctattcgaaaacgcccaaaaaccgacctaacttccccttaactcccgcctcttcgtacacctctcgaaccgccgcaccgcccgactcctcctcgaactccataccccgcccgacacgatccaacgatccgaataccgactactactcactaacaaaacctcgtcctcgcgctcgctccgaaaacacaaacacgccgcccgcttcttaaacccctcgaaatcgtaaatccgtatctaattaaatttacacttcatcctcgaaacaacctcctctcgcctctcgctactatataaaccgccgacgcaactactaccgctaccgaacaacaaccgaaatactaaaaaaaaaaaaaaccgaaaaaaaaaacgaaaaaaaaaaaacgcctccgtctaccgtctacccccgaacccgaaaaacgaaaaaaaaaataaaactaaacgaaacacgaacgaaaacgaaaacaaacgaaacgtatcaatcaaccaatccgccaatccgataaacgaccgaccgaacccgaacccgccgaaataaaaaaaacgctactacccgcgaacccgcgactctccacaaaacccacccgcttctacgaaataaaacgcattctcgaacgcgtccgcgctcccgttcacgtacgcgttcgcaaaaaaaaacgtaaactaaaaaacgaaaaaccgaaacgaaaaaccaaaaacgaaaatctcctaactcccgcaacgcgcaacgcctaaaacccactacgcaaacg

SEQ ID NO: 30779 - DNA, 956 bp, Artificial Sequence
  chemically treated genomic DNA (Homo sapiens) CpG-island No: 30779
tggagtttttattggttggggaatcgtttagttttagtttttttagatattcggcgtgtacgggtttgtggtattggagaattttgatggtattttcgattttgaattattttcgtttttttttaatgttaatcgaatttttttaattttttagtagtttcgtgatagttagtatatatacgtacgttttgtgtttggggttttggttttgttcgaagacgtttaggagtcggtttaatttttttttgattttcgttttttcgtatatttttcggatcgtcgtatcgttcggttttttttcgggttttatgtttcgttcggtacgatttagcggttcgggtatcggttgttatttattaataggatttcgttttcgcgttcgtttcggaagtataggtacgtcgttcgttttttgaatttttcggggtcgtaggttcgtgtttggttgggtttgtattttattttcgaggtagttttttttcgtttttcgttgttgtgtgggtcgtcgacgtagttgttgtcgttgtcgggtagtagtcgaggtgttgggaagagaaagggtcgaggagaggggcggggagagagaggcgttttcgtttgtcgtttgttttcgagttcggggagcggagggagagatgaagttgggcggggtacgggcggaggcgggggtaagcgaggcgtgttagttagttagttcgttagttcgatgggcggtcggtcgaattcgggttcgtcggagtggaggaggcgttgttgttcgcgagttcgcgattttttatagagtttattcgtttttgcgaggtgaagcgtattttcgggcgcgttcgcgttttcgtttacgtgcgcgttcgtaggggagggcgtgggttgaggggcgaggaatcggggcgaggggttaggggcgggggttttttggttttcgtagcgcgtaacgtttggggtttattgcgtaggcg

SEQ ID NO: 30780 - DNA, 956 bp, Artificial Sequence
  chemically treated genomic DNA (Homo sapiens) CpG-island No: 30780
cgcctacgcaataaaccccaaacgttacgcgctacgaaaaccaaaaaacccccgcccctaacccctcgccccgattcctcgcccctcaacccacgccctcccctacgaacgcgcacgtaaacgaaaacgcgaacgcgcccgaaaatacgcttcacctcgcaaaaacgaataaactctataaaaaatcgcgaactcgcgaacaacaacgcctcctccactccgacgaacccgaattcgaccgaccgcccatcgaactaacgaactaactaactaacacgcctcgcttacccccgcctccgcccgtaccccgcccaacttcatctctccctccgctccccgaactcgaaaacaaacgacaaacgaaaacgcctctctctccccgcccctctcctcgaccctttctcttcccaacacctcgactactacccgacaacgacaacaactacgtcgacgacccacacaacaacgaaaaacgaaaaaaaactacctcgaaaataaaatacaaacccaaccaaacacgaacctacgaccccgaaaaattcaaaaaacgaacgacgtacctatacttccgaaacgaacgcgaaaacgaaatcctattaataaataacaaccgatacccgaaccgctaaatcgtaccgaacgaaacataaaacccgaaaaaaaaccgaacgatacgacgatccgaaaaatatacgaaaaaacgaaaatcaaaaaaaaattaaaccgactcctaaacgtcttcgaacaaaaccaaaaccccaaacacaaaacgtacgtatatatactaactatcacgaaactactaaaaaattaaaaaaattcgattaacattaaaaaaaaacgaaaataattcaaaatcgaaaataccatcaaaattctccaataccacaaacccgtacacgccgaatatctaaaaaaactaaaactaaacgattccccaaccaataaaaactcca

SEQ ID NO: 30781 - DNA, 609 bp, Artificial Sequence
  chemically treated genomic DNA (Homo sapiens) CpG-island No: 30781
ttggtcgcgtcgttttcgcggttatttgttcgcggtcggtttttttcggttcgcgtttcgagtcgtttttatttgagtcggagatgtggattcggagcgggcggtttttgttcgaggacgacgagaggtcgttttgtgagcggtcgcgggggttcgggttttcgggaagttagcgtagggtaggcgtcgtcggcggggcgggcgtttcgggttcggggattgggatcgtcgtcgtttgttcggtcggatcgatcggggacgtcgcggggcgttagttcgtttcggttatcggttttcggcggcggggtcggagtatcgggtggggtcggcgtcgagggttgcgttgttcgttgttgttcggttttgtttcgcgcgtcgcgattcggaggtagcgagaagggcggggaggtggacgtcgggcgtcgaggagtcggtgcggagggcgggaggaggaagaggatagaaaagtttgtataggaaggagtcgtttatagtcggttttcgttttagcgggcgaaagttgtagggttcggagttgggtcgttttcggtgttcgcgaatttgttcggttgttttttttttaagtttcgggtattggttttcggtagg

SEQ ID NO: 30782 - DNA, 609 bp, Artificial Sequence
  chemically treated genomic DNA (Homo sapiens) CpG-island No: 30782
cctaccgaaaaccaatacccgaaacttaaaaaaaaaacaaccgaacaaattcgcgaacaccgaaaacgacccaactccgaaccctacaactttcgcccgctaaaacgaaaaccgactataaacgactccttcctatacaaacttttctatcctcttcctcctcccgccctccgcaccgactcctcgacgcccgacgtccacctccccgcccttctcgctacctccgaatcgcgacgcgcgaaacaaaaccgaacaacaacgaacaacgcaaccctcgacgccgaccccacccgatactccgaccccgccgccgaaaaccgataaccgaaacgaactaacgccccgcgacgtccccgatcgatccgaccgaacaaacgacgacgatcccaatccccgaacccgaaacgcccgccccgccgacgacgcctaccctacgctaacttcccgaaaacccgaacccccgcgaccgctcacaaaacgacctctcgtcgtcctcgaacaaaaaccgcccgctccgaatccacatctccgactcaaataaaaacgactcgaaacgcgaaccgaaaaaaaccgaccgcgaacaaataaccgcgaaaacgacgcgaccaa

SEQ ID NO: 30783 - DNA, 609 bp, Artificial Sequence
  chemically treated genomic DNA (Homo sapiens) CpG-island No: 30783
tttgtcgggggttagtgttcggggtttgggggaggagtagtcgggtaggttcgcgggtatcgagggcggtttagtttcgagttttgtagttttcgttcgttggagcgagagtcggttgtaggcggtttttttttgtgtaaatttttttgtttttttttttttttcgtttttcgtatcggtttttcggcgttcggcgtttattttttcgtttttttcgttgttttcgggtcgcggcgcgcggggtagagtcgggtagtagcgggtagcgtagttttcggcgtcggttttattcggtgtttcggtttcgtcgtcgggagtcgatggtcgaggcgggttggcgtttcgcggcgttttcggtcgattcggtcgggtaggcggcggcggttttagttttcgagttcgaggcgttcgtttcgtcggcggcgtttgttttgcgttggtttttcggggattcgagttttcgcggtcgtttatagagcgatttttcgtcgttttcgagtaggggtcgttcgtttcgggtttatattttcggtttaggtaagagcggttcggggcgcgggtcggggagggtcggtcgcgggtaggtggtcgcgagggcgacgcggttaa

SEQ ID NO: 30784 - DNA, 609 bp, Artificial Sequence
  chemically treated genomic DNA (Homo sapiens) CpG-island No: 30784
ttaaccgcgtcgccctcgcgaccacctacccgcgaccgaccctccccgacccgcgccccgaaccgctcttacctaaaccgaaaatataaacccgaaacgaacgacccctactcgaaaacgacgaaaaatcgctctataaacgaccgcgaaaactcgaatccccgaaaaaccaacgcaaaacaaacgccgccgacgaaacgaacgcctcgaactcgaaaactaaaaccgccgccgcctacccgaccgaatcgaccgaaaacgccgcgaaacgccaacccgcctcgaccatcgactcccgacgacgaaaccgaaacaccgaataaaaccgacgccgaaaactacgctacccgctactacccgactctaccccgcgcgccgcgacccgaaaacaacgaaaaaaacgaaaaaataaacgccgaacgccgaaaaaccgatacgaaaaacgaaaaaaaaaaaaaaacaaaaaaatttacacaaaaaaaaaccgcctacaaccgactctcgctccaacgaacgaaaactacaaaactcgaaactaaaccgccctcgatacccgcgaacctacccgactactcctcccccaaaccccgaacactaacccccgacaaa

SEQ ID NO: 30785 - DNA, 1034 bp, Artificial Sequence
  chemically treated genomic DNA (Homo sapiens) CpG-island No: 30785
cgtaggttgcgatggtgtttaggagttgtcgttgtcgttgttttatcgcgtttagtagttgttgggcgcgtttttttcggggcggttgtgggggtggtttttcgtcgagttttagtttcgttttttcgcggtttacgtcggtagtttttttgttcgggagagagcgagagatagacggttagggtcggcgtttgcgcggggttaagtttttttttttcgtttcgacgggtttttttttattttcgtgattagtttgagttcgggttttattttattttcgtttgcgcggttcgattatcgtttttttttcggtcgtttttttttttagcgttgcgttagggtttcgtaaggttgcgtttcgtttcgtttttatcggttttttttaatttttttgggggtcgtggtttttttaagttgttcggcgtagaggcggggtcgagttttttggatcggaagttggttgggagcgttattttttttcggaagcgggtttgggcggatgttttcggcgcgtcggtgtagggggatgagggtcgcggtggttgttagcgtggggttgagcgaggggtttgttggttttcggagcggtcgtttttttcgttcgtcgagtttcgtttcggcggttttcggcgttcggttgttgcggttttcggggagcggggtcgtgtaggtcgcgagttcggagcgcgtcggttggatcgaggcgttgcgggtcgtcgtggtcgagttgcgcgtcggcgtcgtggtggtcgtttttatcgatacgttgtacggtttggtttgcgcggcgagttgttcggcggttttgcgcgttgtgtatcgttttaagggtcgtagcgaggttaagtttttggtcgtatgtttcggtcgcgtggtcgacgtttataggtaaggtcgtttcgattcggtttcgttaggggcggtatcgcgggaggggttttcggtgataggtttgggagattgaggcgtagagagcgggaggggtttgtttaggtttattaaggaattcggaattggaaatatgtatcgaggat

SEQ ID NO: 30786 - DNA, 1034 bp, Artificial Sequence
  chemically treated genomic DNA (Homo sapiens) CpG-island No: 30786
atcctcgatacatatttccaattccgaattccttaataaacctaaacaaacccctcccgctctctacgcctcaatctcccaaacctatcaccgaaaacccctcccgcgataccgcccctaacgaaaccgaatcgaaacgaccttacctataaacgtcgaccacgcgaccgaaacatacgaccaaaaacttaacctcgctacgacccttaaaacgatacacaacgcgcaaaaccgccgaacaactcgccgcgcaaaccaaaccgtacaacgtatcgataaaaacgaccaccacgacgccgacgcgcaactcgaccacgacgacccgcaacgcctcgatccaaccgacgcgctccgaactcgcgacctacacgaccccgctccccgaaaaccgcaacaaccgaacgccgaaaaccgccgaaacgaaactcgacgaacgaaaaaaacgaccgctccgaaaaccaacaaacccctcgctcaaccccacgctaacaaccaccgcgaccctcatccccctacaccgacgcgccgaaaacatccgcccaaacccgcttccgaaaaaaaataacgctcccaaccaacttccgatccaaaaaactcgaccccgcctctacgccgaacaacttaaaaaaaccacgacccccaaaaaaattaaaaaaaaccgataaaaacgaaacgaaacgcaaccttacgaaaccctaacgcaacgctaaaaaaaaaaacgaccgaaaaaaaaacgataatcgaaccgcgcaaacgaaaataaaataaaacccgaactcaaactaatcacgaaaataaaaaaaaacccgtcgaaacgaaaaaaaaaaacttaaccccgcgcaaacgccgaccctaaccgtctatctctcgctctctcccgaacaaaaaaactaccgacgtaaaccgcgaaaaaacgaaactaaaactcgacgaaaaaccacccccacaaccgccccgaaaaaaacgcgcccaacaactactaaacgcgataaaacaacgacaacgacaactcctaaacaccatcgcaacctacg

SEQ ID NO: 30787 - DNA, 1034 bp, Artificial Sequence
  chemically treated genomic DNA (Homo sapiens) CpG-island No: 30787
gttttcggtatatatttttagtttcggattttttggtgagtttggataagtttttttcgttttttgcgttttagttttttaagtttgttatcggaaatttttttcgcggtgtcgtttttagcggggtcgggtcggggcggttttatttgtagacgtcggttacgcggtcgaggtatacggttagaggtttggtttcgttgcgatttttgaggcggtatatagcgcgtagagtcgtcgagtagttcgtcgcgtaggttaggtcgtatagcgtatcggtggggacggttattacggcgtcggcgcgtagttcggttacggcggttcgtagcgtttcggtttagtcggcgcgtttcgggttcgcggtttgtacggtttcgtttttcgggagtcgtaatagtcgggcgtcgggggtcgtcggagcgggattcggcgggcggaagaggcgatcgtttcgggagttagtaggtttttcgtttaattttacgttggtagttatcgcggtttttatttttttgtatcgacgcgtcggagatattcgtttaggttcgttttcgggaggaagtgacgtttttagttagttttcggtttaggagattcggtttcgtttttgcgtcgggtagtttaaagggattacgatttttaggaggattgaaggagatcggtggggacggggcggggcgtagttttgcgaagttttaacgtagcgttggggaggggggcggtcgaaaggggggcggtggtcgggtcgcgtaagcggagatggaatggggttcgggtttagattggttacgggggtgagagggggttcgtcggggcgggaggaaggggtttggtttcgcgtaagcgtcggttttgatcgtttgtttttcgttttttttcgggtagggaggttgtcggcgtggatcgcgggaaggcggggttggggttcggcgggaggttatttttatagtcgtttcgggaggagcgcgtttagtagttgttggacgcggtggagtagcggtagcggtagtttttggatattatcgtagtttgcg

SEQ ID NO: 30788 - DNA, 1034 bp, Artificial Sequence
  chemically treated genomic DNA (Homo sapiens) CpG-island No: 30788
cgcaaactacgataatatccaaaaactaccgctaccgctactccaccgcgtccaacaactactaaacgcgctcctcccgaaacgactataaaaataacctcccgccgaaccccaaccccgccttcccgcgatccacgccgacaacctccctacccgaaaaaaaacgaaaaacaaacgatcaaaaccgacgcttacgcgaaaccaaaccccttcctcccgccccgacgaaccccctctcacccccgtaaccaatctaaacccgaaccccattccatctccgcttacgcgacccgaccaccgcccccctttcgaccgcccccctccccaacgctacgttaaaacttcgcaaaactacgccccgccccgtccccaccgatctccttcaatcctcctaaaaatcgtaatccctttaaactacccgacgcaaaaacgaaaccgaatctcctaaaccgaaaactaactaaaaacgtcacttcctcccgaaaacgaacctaaacgaatatctccgacgcgtcgatacaaaaaaataaaaaccgcgataactaccaacgtaaaattaaacgaaaaacctactaactcccgaaacgatcgcctcttccgcccgccgaatcccgctccgacgacccccgacgcccgactattacgactcccgaaaaacgaaaccgtacaaaccgcgaacccgaaacgcgccgactaaaccgaaacgctacgaaccgccgtaaccgaactacgcgccgacgccgtaataaccgtccccaccgatacgctatacgacctaacctacgcgacgaactactcgacgactctacgcgctatataccgcctcaaaaatcgcaacgaaaccaaacctctaaccgtatacctcgaccgcgtaaccgacgtctacaaataaaaccgccccgacccgaccccgctaaaaacgacaccgcgaaaaaaatttccgataacaaacttaaaaaactaaaacgcaaaaaacgaaaaaaacttatccaaactcaccaaaaaatccgaaactaaaaatatataccgaaaac

SEQ ID NO: 30789 - DNA, 788 bp, Artificial Sequence
  chemically treated genomic DNA (Homo sapiens) CpG-island No: 30789
gtatttcgttttttttacgggtatttacgtttcgttttgatcgtttcgtttttgtgtcgttttagggtcgtcgtcggcgtcgcgggatttgtagtatagtttgagtcgttcgtcgttggtgttgcgattgcgttggttgtcgtcggtcgattcgggaggtcgttcggacgttatttattcgttgttgtgtttgcgttgcggtcgcgagggttcggcgggcgtttgcgagtcgtgcgggtcgcgcgtggtttttttatcgcgttaggtagggttgcgggagcgagtcgttacgttgttgtatttgcggttcggcgcgcgttatatcgtgcgcgtggtcgcgtttaacggcgtttcgggttcggcggtcgtcgcgggaattatttacgcgtaggttatcgtttttatcgggttcgggggtaaggtcgttcgcgttttttatttcgaggttatcgcgtttgtcgtttttgcgtttttttggggtcgtttcgtcggttttgcgggagttttatttatttattttagagaagttattttttgtatacgtatttcgttttttttcgggatataaagttattttttcggacgttttagcgttagtcgttttttcgagtgtgcgagagggattgaggatgtaggcgtttttttattattgggttagaggggaggcgcgcggttttgttgcgtttgcgggaagtatttgtgtgttcgttttttttttggattttttgtataaagtttttgtttcgtttacggttttgtagttggtttcgtcgttgattttttaggga

SEQ ID NO: 30790 - DNA, 788 bp, Artificial Sequence
  chemically treated genomic DNA (Homo sapiens) CpG-island No: 30790
tccctaaaaaatcaacgacgaaaccaactacaaaaccgtaaacgaaacaaaaactttatacaaaaaatccaaaaaaaaaacgaacacacaaatacttcccgcaaacgcaacaaaaccgcgcgcctcccctctaacccaataataaaaaaacgcctacatcctcaatccctctcgcacactcgaaaaaacgactaacgctaaaacgtccgaaaaaataactttatatcccgaaaaaaaacgaaatacgtatacaaaaaataacttctctaaaataaataaataaaactcccgcaaaaccgacgaaacgaccccaaaaaaacgcaaaaacgacaaacgcgataacctcgaaataaaaaacgcgaacgaccttacccccgaacccgataaaaacgataacctacgcgtaaataattcccgcgacgaccgccgaacccgaaacgccgttaaacgcgaccacgcgcacgatataacgcgcgccgaaccgcaaatacaacaacgtaacgactcgctcccgcaaccctacctaacgcgataaaaaaaccacgcgcgacccgcacgactcgcaaacgcccgccgaaccctcgcgaccgcaacgcaaacacaacaacgaataaataacgtccgaacgacctcccgaatcgaccgacgacaaccaacgcaatcgcaacaccaacgacgaacgactcaaactatactacaaatcccgcgacgccgacgacgaccctaaaacgacacaaaaacgaaacgatcaaaacgaaacgtaaatacccgtaaaaaaaacgaaatac

SEQ ID NO: 30791 - DNA, 788 bp, Artificial Sequence
  chemically treated genomic DNA (Homo sapiens) CpG-island No: 30791
tttttgagaaattagcggcgaggttaattgtagagtcgtgagcgggatagaggttttgtgtaaggagtttaggagaaaggcgagtatataggtgtttttcgtagacgtaatagaatcgcgcgttttttttttggtttagtagtaaggggacgtttgtatttttagtttttttcgtatattcgggagggcgattgacgttggggcgttcgggggggtgattttgtgtttcggagaggggcggggtgcgtgtatagaggatggtttttttggggtgggtgggtggggttttcgtaggatcgacggggcggttttaagagggcgtaggggcggtaggcgcggtggtttcggggtggggggcgcggacggttttattttcgggttcggtggagacggtgatttgcgcgtaggtggttttcgcggcggtcgtcgggttcgagacgtcgttgagcgcggttacgcgtacggtgtagcgcgcgtcgggtcgtaggtgtagtagcgtggcggttcgttttcgtagttttgtttggcgcggtaggaaggttacgcgcggttcgtacggttcgtaggcgttcgtcgggttttcgcggtcgtagcgtaggtatagtagcgagtaggtgacgttcgagcggtttttcgagtcggtcggcggtagttagcgtagtcgtagtattagcggcgagcggtttaggttgtattgtaggtttcgcggcgtcgacggcggttttgaggcggtataggggcggggcggttagggcggggcgtgggtgttcgtgagaggggcgggatgt

SEQ ID NO: 30792 - DNA, 788 bp, Artificial Sequence
  chemically treated genomic DNA (Homo sapiens) CpG-island No: 30792
acatcccgcccctctcacgaacacccacgccccgccctaaccgccccgcccctataccgcctcaaaaccgccgtcgacgccgcgaaacctacaatacaacctaaaccgctcgccgctaatactacgactacgctaactaccgccgaccgactcgaaaaaccgctcgaacgtcacctactcgctactatacctacgctacgaccgcgaaaacccgacgaacgcctacgaaccgtacgaaccgcgcgtaaccttcctaccgcgccaaacaaaactacgaaaacgaaccgccacgctactacacctacgacccgacgcgcgctacaccgtacgcgtaaccgcgctcaacgacgtctcgaacccgacgaccgccgcgaaaaccacctacgcgcaaatcaccgtctccaccgaacccgaaaataaaaccgtccgcgccccccaccccgaaaccaccgcgcctaccgcccctacgccctcttaaaaccgccccgtcgatcctacgaaaaccccacccacccaccccaaaaaaaccatcctctatacacgcaccccgcccctctccgaaacacaaaatcacccccccgaacgccccaacgtcaatcgccctcccgaatatacgaaaaaaactaaaaatacaaacgtccccttactactaaaccaaaaaaaaaacgcgcgattctattacgtctacgaaaaacacctatatactcgcctttctcctaaactccttacacaaaacctctatcccgctcacgactctacaattaacctcgccgctaatttctcaaaaa

SEQ ID NO: 30793 - DNA, 594 bp, Artificial Sequence
  chemically treated genomic DNA (Homo sapiens) CpG-island No: 30793
tttcgtgattgtagtagtatttttggcgtcgcgggtatttgtaaggagatttttaacgtttattatttggaaattgaggtcgatttgggtcgtgggcgttttcgtttaggcggtagtcggtttcgtaaaatcgatacgatcgcggcggacgagagttttacgtagggcgatttgggtgagcgtaagatgaagttgaatatagaggtgcgcgagatcggatcgtttagtcggcggggtttttatttggttttttaggacgtgggcgtatgcgtggcgtttgtttcggtgcgcgtttattataagtagtgtcgcgttatcgtgcggggtttggttacgtttttagttatcgtagtcgagagcgttttttttatattggtggaagtggtcggaacgtgcgtggcgtattcggaaggggagtttggtagttttttacgtatgtattgcggcgtcgacggcgagtggttggtgtttgtgggtcgttgtagttgtagcgcgggattttaggagcgtggtgatttttgcgaaggtatttagttggttgggggtcgtggggtgggagtgtagagcgtaggtggtaattgagagagagtgtgt

SEQ ID NO: 30794 - DNA, 594 bp, Artificial Sequence
  chemically treated genomic DNA (Homo sapiens) CpG-island No: 30794
acacactctctctcaattaccacctacgctctacactcccaccccacgacccccaaccaactaaataccttcgcaaaaatcaccacgctcctaaaatcccgcgctacaactacaacgacccacaaacaccaaccactcgccgtcgacgccgcaatacatacgtaaaaaactaccaaactccccttccgaatacgccacgcacgttccgaccacttccaccaatataaaaaaaacgctctcgactacgataactaaaaacgtaaccaaaccccgcacgataacgcgacactacttataataaacgcgcaccgaaacaaacgccacgcatacgcccacgtcctaaaaaaccaaataaaaaccccgccgactaaacgatccgatctcgcgcacctctatattcaacttcatcttacgctcacccaaatcgccctacgtaaaactctcgtccgccgcgatcgtatcgattttacgaaaccgactaccgcctaaacgaaaacgcccacgacccaaatcgacctcaatttccaaataataaacgttaaaaatctccttacaaatacccgcgacgccaaaaatactactacaatcacgaaa

SEQ ID NO: 30795 - DNA, 594 bp, Artificial Sequence
  chemically treated genomic DNA (Homo sapiens) CpG-island No: 30795
gtatatttttttttaattgttatttacgttttatatttttattttacggtttttagttaattggatattttcgtagaagttattacgtttttggaatttcgcgttgtagttgtagcggtttataggtattagttattcgtcgtcggcgtcgtagtgtatgcgtggggggttgttaggtttttttttcgagtgcgttacgtacgtttcggttatttttattagtgtggagaaggcgttttcggttgcggtggttgggaacgtggttaggtttcgtacggtggcgcggtattgtttgtagtagacgcgtatcgagataagcgttacgtatgcgtttacgttttgaaaggttaggtggaaatttcgtcggttgagcggttcgatttcgcgtatttttgtgtttagttttattttgcgtttatttaggtcgttttgcgtgaagttttcgttcgtcgcgatcgtgtcgattttgcggggtcggttgtcgtttaggcggggacgtttacggtttaggtcggttttagtttttaggtagtagacgttgaaggtttttttgtaggtattcgcggcgttagggatgttgttgtagttacggag

SEQ ID NO: 30796 - DNA, 594 bp, Artificial Sequence
  chemically treated genomic DNA (Homo sapiens) CpG-island No: 30796
ctccgtaactacaacaacatccctaacgccgcgaatacctacaaaaaaaccttcaacgtctactacctaaaaactaaaaccgacctaaaccgtaaacgtccccgcctaaacgacaaccgaccccgcaaaatcgacacgatcgcgacgaacgaaaacttcacgcaaaacgacctaaataaacgcaaaataaaactaaacacaaaaatacgcgaaatcgaaccgctcaaccgacgaaatttccacctaacctttcaaaacgtaaacgcatacgtaacgcttatctcgatacgcgtctactacaaacaataccgcgccaccgtacgaaacctaaccacgttcccaaccaccgcaaccgaaaacgccttctccacactaataaaaataaccgaaacgtacgtaacgcactcgaaaaaaaaacctaacaaccccccacgcatacactacgacgccgacgacgaataactaatacctataaaccgctacaactacaacgcgaaattccaaaaacgtaataacttctacgaaaatatccaattaactaaaaaccgtaaaataaaaatataaaacgtaaataacaattaaaaaaaaatatac

SEQ ID NO: 30797 - DNA, 920 bp, Artificial Sequence
  chemically treated genomic DNA (Homo sapiens) CpG-island No: 30797
atcgacgcgcgtttttttttttttttcgtttcgttttcgttttcgttttcgtcgcgtcgtttttttttcgcgtttcggaaggtttgcgttttcgttttttagttaggcgttattatttgtcgtttaggtagttaggcgatttttttttcgcgggttacgcggtttgatttaggtttttgtttttgtggtttcgaaattcgtcgttcgttgggttttgcgttgtattcggcgtgtagttttttttcggttcgcggttatttggttcgcgtcgtttgcgttttgtgtgtcgagttcgttcgtattgcggggataggtcgggcgtcgtttacgtcgcgttttgtcgggcgtatagtttgtttgggaagcgcgcggtcgggcgggcggttatggcgcggtacgttgggaggtagcgcggcggttgtaggagcgtatagtcggttatggttcggcggcggcgtcgcgtttgtatcgttttgtttttggtgttgtttttcgttttcggtatttttatgggtttgcgtacgtttaaggtttcggacggattttcggcgttgggttcgggtttggagttggcgttttttgagcgacgtttagagggggttttcgcgttcgttgttagggtttcggtagtttttgtcgcgtcgttttcgtcgtcgtcgtcgtttcgtatcgcggattttggcggtttttttgggtcggtattcgcggaggtcgagttcgttttcgtgtagagtttgcgcgtttattcggatttgtacgttttttattattcgtggtacgggagttcgcggcgcgagggttattatatttattgggattacgttatggtgtcgtattgggattttaagatttcggttagttattttcgcggtcgttatagttttttagacgatttgggttttagtttttattcggagttg

SEQ ID NO: 30798 - DNA, 920 bp, Artificial Sequence
  chemically treated genomic DNA (Homo sapiens) CpG-island No: 30798
caactccgaataaaaactaaaacccaaatcgtctaaaaaactataacgaccgcgaaaataactaaccgaaatcttaaaatcccaatacgacaccataacgtaatcccaataaatataataaccctcgcgccgcgaactcccgtaccacgaataataaaaaacgtacaaatccgaataaacgcgcaaactctacacgaaaacgaactcgacctccgcgaataccgacccaaaaaaaccgccaaaatccgcgatacgaaacgacgacgacgacgaaaacgacgcgacaaaaactaccgaaaccctaacaacgaacgcgaaaaccccctctaaacgtcgctcaaaaaacgccaactccaaacccgaacccaacgccgaaaatccgtccgaaaccttaaacgtacgcaaacccataaaaataccgaaaacgaaaaacaacaccaaaaacaaaacgatacaaacgcgacgccgccgccgaaccataaccgactatacgctcctacaaccgccgcgctacctcccaacgtaccgcgccataaccgcccgcccgaccgcgcgcttcccaaacaaactatacgcccgacaaaacgcgacgtaaacgacgcccgacctatccccgcaatacgaacgaactcgacacacaaaacgcaaacgacgcgaaccaaataaccgcgaaccgaaaaaaaactacacgccgaatacaacgcaaaacccaacgaacgacgaatttcgaaaccacaaaaacaaaaacctaaatcaaaccgcgtaacccgcgaaaaaaaaatcgcctaactacctaaacgacaaataataacgcctaactaaaaaacgaaaacgcaaaccttccgaaacgcgaaaaaaaaacgacgcgacgaaaacgaaaacgaaaacgaaacgaaaaaaaaaaaaaaacgcgcgtcgat

SEQ ID NO: 30799 - DNA, 920 bp, Artificial Sequence
  chemically treated genomic DNA (Homo sapiens) CpG-island No: 30799
tagtttcgggtagaagttggagtttaagtcgtttggggggttgtggcggtcgcgggggtagttggtcgagattttggggttttagtgcggtattatgacgtggttttagtgaatgtagtggttttcgcgtcgcgggttttcgtattacgagtagtagaaggcgtgtaggttcgagtagacgcgtaggttttgtacgggggcgggttcggttttcgcgggtgtcggtttaggggagtcgttagggttcgcggtgcggggcggcggcggcggcgggggcggcgcggtaggggttgtcggggttttggtagcgggcgcgggggttttttttgggcgtcgtttaaagggcgttagttttaggttcgggtttagcgtcgggagttcgttcggagttttgagcgtgcgtagatttatgagggtgtcgaaggcgaagagtagtattaggaatagagcgatgtaggcgcggcgtcgtcgtcgggttatggtcgattgtgcgtttttgtagtcgtcgcgttattttttagcgtgtcgcgttatggtcgttcgttcggtcgcgcgttttttaggtagattgtgcgttcggtagagcgcggcgtgggcggcgttcggtttgttttcgtagtgcgggcgggttcggtatataggacgtaggcggcgcggattaagtggtcgcgagtcgagggggaattgtacgtcgagtgtaacgtaaggtttagcgaacggcgagtttcggggttataggagtaggggtttgagttaggtcgcgtgattcgcgaaagaagagtcgtttggttgtttgggcggtaggtggtggcgtttggttggggagcggggacgtaggtttttcggagcgcgggagagaggcggcgcggcgggggcgggggcggaggcggggcgggggggggaaagaagcgcgcgtcggt

SEQ ID NO: 30800 - DNA, 920 bp, Artificial Sequence
  chemically treated genomic DNA (Homo sapiens) CpG-island No: 30800
accgacgcgcgcttctttcccccccccgccccgcctccgcccccgcccccgccgcgccgcctctctcccgcgctccgaaaaacctacgtccccgctccccaaccaaacgccaccacctaccgcccaaacaaccaaacgactcttctttcgcgaatcacgcgacctaactcaaacccctactcctataaccccgaaactcgccgttcgctaaaccttacgttacactcgacgtacaattccccctcgactcgcgaccacttaatccgcgccgcctacgtcctatataccgaacccgcccgcactacgaaaacaaaccgaacgccgcccacgccgcgctctaccgaacgcacaatctacctaaaaaacgcgcgaccgaacgaacgaccataacgcgacacgctaaaaaataacgcgacgactacaaaaacgcacaatcgaccataacccgacgacgacgccgcgcctacatcgctctattcctaatactactcttcgccttcgacaccctcataaatctacgcacgctcaaaactccgaacgaactcccgacgctaaacccgaacctaaaactaacgccctttaaacgacgcccaaaaaaaacccccgcgcccgctaccaaaaccccgacaacccctaccgcgccgcccccgccgccgccgccgccccgcaccgcgaaccctaacgactcccctaaaccgacacccgcgaaaaccgaacccgcccccgtacaaaacctacgcgtctactcgaacctacacgccttctactactcgtaatacgaaaacccgcgacgcgaaaaccactacattcactaaaaccacgtcataataccgcactaaaaccccaaaatctcgaccaactacccccgcgaccgccacaaccccccaaacgacttaaactccaacttctacccgaaacta

SEQ ID NO: 30801 - DNA, 691 bp, Artificial Sequence
  chemically treated genomic DNA (Homo sapiens) CpG-island No: 30801
gacgtcgcgtattttttttcgttatattaggggttcgcggaggtttggtggggacgcggagttttaggggtcggtcggtgtagggatacggtcgggttgggggtggggacgcgcggttttgtttttttgtcggtttgcggtttttagggtcggttcgtacggttgttggatagcgttatgtttacgtattttcgaatttagcggtttttatttcggaatttttagttttacgcggttggggtcgagttggggttcgcgggtaggcgttttgagtattcgcgtgacggtatttgtggtggtagtattttttaagttgcggcggcggcggcggcggcgacgggggcggtagtaggggcggagcgcggcgtgcgcgttttcggttcgtagttcggtgcgtggcgtttttttttttttttttggtcgtcgggtgttcgtttttttattttttattttttatttttattttttcgtttcgtcgtttttcgtacgtgcgtttagcggcgtgcgtatgcgtagtcgaattatattcgcgtttttcgttcgttttttggtggatatcggagggaagtatggacggtcgggtcgggtcgggtcgggcggagcgtgaagtcgggttagggttcgtcgggtttgggtttatcggtttttatcggttattaagaatttgtagaaagtcgggtacggtggttcg

SEQ ID NO: 30802 - DNA, 691 bp, Artificial Sequence
  chemically treated genomic DNA (Homo sapiens) CpG-island No: 30802
cgaaccaccgtacccgactttctacaaattcttaataaccgataaaaaccgataaacccaaacccgacgaaccctaacccgacttcacgctccgcccgacccgacccgacccgaccgtccatacttccctccgatatccaccaaaaaacgaacgaaaaacgcgaatataattcgactacgcatacgcacgccgctaaacgcacgtacgaaaaacgacgaaacgaaaaaataaaaataaaaaataaaaaataaaaaaacgaacacccgacgaccaaaaaaaaaaaaaaaaacgccacgcaccgaactacgaaccgaaaacgcgcacgccgcgctccgcccctactaccgcccccgtcgccgccgccgccgccgccgcaacttaaaaaatactaccaccacaaataccgtcacgcgaatactcaaaacgcctacccgcgaaccccaactcgaccccaaccgcgtaaaactaaaaattccgaaataaaaaccgctaaattcgaaaatacgtaaacataacgctatccaacaaccgtacgaaccgaccctaaaaaccgcaaaccgacaaaaaaacaaaaccgcgcgtccccacccccaacccgaccgtatccctacaccgaccgacccctaaaactccgcgtccccaccaaacctccgcgaacccctaatataacgaaaaaaaatacgcgacgtc

SEQ ID NO: 30803 - DNA, 691 bp, Artificial Sequence
  chemically treated genomic DNA (Homo sapiens) CpG-island No: 30803
cgagttatcgtgttcggttttttgtaagtttttgatgatcgatgagagtcggtgggtttaaattcggcgggttttaattcggttttacgtttcgttcggttcggttcggttcggtcgtttatattttttttcggtgtttattagagggcgaacgggagacgcgaatgtggttcgattacgtatgcgtacgtcgttgggcgtacgtgcggagggcggcggggcgggagggtaaaggtaggaggtgagaggtgaaggggcgggtattcggcggttaggagagagagggagggcgttacgtatcggattgcgggtcgagagcgcgtacgtcgcgtttcgtttttgttgtcgttttcgtcgtcgtcgtcgtcgtcgtcgtagtttgggaggtgttgttattataggtatcgttacgcgggtgtttagggcgtttgttcgcgggttttagttcgattttagtcgcgtggagttgggagtttcggaatgggggtcgttaggttcgggggtgcgtgggtatggcgttgtttagtagtcgtgcgggtcggttttggagatcgtaggtcggtaaggaggtagggtcgcgcgtttttatttttaattcggtcgtgtttttgtatcggtcggtttttggagtttcgcgtttttattagattttcgcgggtttttggtgtgacggggggagatgcgcggcgtt

SEQ ID NO: 30804 - DNA, 691 bp, Artificial Sequence
  chemically treated genomic DNA (Homo sapiens) CpG-island No: 30804
aacgccgcgcatctccccccgtcacaccaaaaacccgcgaaaatctaataaaaacgcgaaactccaaaaaccgaccgatacaaaaacacgaccgaattaaaaataaaaacgcgcgaccctacctccttaccgacctacgatctccaaaaccgacccgcacgactactaaacaacgccatacccacgcacccccgaacctaacgacccccattccgaaactcccaactccacgcgactaaaatcgaactaaaacccgcgaacaaacgccctaaacacccgcgtaacgatacctataataacaacacctcccaaactacgacgacgacgacgacgacgacgaaaacgacaacaaaaacgaaacgcgacgtacgcgctctcgacccgcaatccgatacgtaacgccctccctctctctcctaaccgccgaatacccgccccttcacctctcacctcctacctttaccctcccgccccgccgccctccgcacgtacgcccaacgacgtacgcatacgtaatcgaaccacattcgcgtctcccgttcgccctctaataaacaccgaaaaaaaatataaacgaccgaaccgaaccgaaccgaacgaaacgtaaaaccgaattaaaacccgccgaatttaaacccaccgactctcatcgatcatcaaaaacttacaaaaaaccgaacacgataactcg

SEQ ID NO: 30805 - DNA, 609 bp, Artificial Sequence
  chemically treated genomic DNA (Homo sapiens) CpG-island No: 30805
attgggagggttcgggcgttacgtagatttgcgcggaatgagtcgttagaggtcgttggtagtcgtatagagaagtttatcgttttttattatttgggattcgacggacgtttacgcgcgtgcgtagcggttttatcgaggtattcgttttattggttgtggttggttcgtaaaagtggtattgcgtatgcgcgtttttttgcgcgagtcgggttgtcgggtgtgttttgttttttagttttcgtcgtttttgtagtatttcgggtttttttttagagcgttagttttaggagttcggaatgttcgtggaatttaataatttgtttaatattattttcgatagggcggagtaggtaagaggtttcgttggtcggaagggggcgggatttggtagggtagcggaatattgtattcgggaggcggtgcgtacgatttcggggaatggcgcgacgattcggtacggggtatttgggagttgtagttcgtagaggatcgattcggggattggattggaggtttgggttcgtcgaaagtgggtttttgggttatttcgtatatttttaacggttgtgcgtgtttttaaaagtttttgggaagcggtcgggcgcg

SEQ ID NO: 30806 - DNA, 609 bp, Artificial Sequence
  chemically treated genomic DNA (Homo sapiens) CpG-island No: 30806
cgcgcccgaccgcttcccaaaaacttttaaaaacacgcacaaccgttaaaaatatacgaaataacccaaaaacccactttcgacgaacccaaacctccaatccaatccccgaatcgatcctctacgaactacaactcccaaataccccgtaccgaatcgtcgcgccattccccgaaatcgtacgcaccgcctcccgaatacaatattccgctaccctaccaaatcccgcccccttccgaccaacgaaacctcttacctactccgccctatcgaaaataatattaaacaaattattaaattccacgaacattccgaactcctaaaactaacgctctaaaaaaaaacccgaaatactacaaaaacgacgaaaactaaaaaacaaaacacacccgacaacccgactcgcgcaaaaaaacgcgcatacgcaataccacttttacgaaccaaccacaaccaataaaacgaatacctcgataaaaccgctacgcacgcgcgtaaacgtccgtcgaatcccaaataataaaaaacgataaacttctctatacgactaccaacgacctctaacgactcattccgcgcaaatctacgtaacgcccgaaccctcccaat

SEQ ID NO: 30807 - DNA, 609 bp, Artificial Sequence
  chemically treated genomic DNA (Homo sapiens) CpG-island No: 30807
cgcgttcggtcgttttttagggatttttaaggatacgtatagtcgttgagaatatgcgagatggtttagaagtttattttcggcgggtttaagtttttagtttaattttcgggtcgattttttgcggattataatttttaggtatttcgtgtcgggtcgtcgcgttatttttcggggtcgtgcgtatcgtttttcggatgtagtatttcgttgttttgttaggtttcgttttttttcggttagcgggattttttatttgtttcgttttgtcgggggtggtgttaagtaggttattaagttttacgaatatttcgagtttttgggattagcgttttggaggagaattcggagtgttgtagagacgacggaggttggagagtaaaatatattcgatagttcggttcgcgtaaggaagcgcgtatgcgtaatgttatttttgcgagttagttatagttaatgaggcgggtgtttcgatgggatcgttgcgtacgcgcgtagacgttcgtcgagttttaggtggtaggaaacgatgggtttttttgtgcgattgttagcggtttttggcggtttatttcgcgtagatttgcgtggcgttcgagtttttttagt

SEQ ID NO: 30808 - DNA, 609 bp, Artificial Sequence
  chemically treated genomic DNA (Homo sapiens) CpG-island No: 30808
actaaaaaaactcgaacgccacgcaaatctacgcgaaataaaccgccaaaaaccgctaacaatcgcacaaaaaaacccatcgtttcctaccacctaaaactcgacgaacgtctacgcgcgtacgcaacgatcccatcgaaacacccgcctcattaactataactaactcgcaaaaataacattacgcatacgcgcttccttacgcgaaccgaactatcgaatatattttactctccaacctccgtcgtctctacaacactccgaattctcctccaaaacgctaatcccaaaaactcgaaatattcgtaaaacttaataacctacttaacaccacccccgacaaaacgaaacaaataaaaaatcccgctaaccgaaaaaaaacgaaacctaacaaaacaacgaaatactacatccgaaaaacgatacgcacgaccccgaaaaataacgcgacgacccgacacgaaatacctaaaaattataatccgcaaaaaatcgacccgaaaattaaactaaaaacttaaacccgccgaaaataaacttctaaaccatctcgcatattctcaacgactatacgtatccttaaaaatccctaaaaaacgaccgaacgcg

SEQ ID NO: 30809 - DNA, 704 bp, Artificial Sequence
  chemically treated genomic DNA (Homo sapiens) CpG-island No: 30809
gggcgggcgaggcgggagcgttttttttgttcgcgggaggggattcgcggtcggttcggagggggcgggggtagcggcgggcggcggcgaggggttgcggagtttcgtagtcgtcgggtcggtcggggcgggaggaagcgatgaatatttagagggggaggggaagggagggggtcgagcgttcgtcgcggttttttgtagttttagtcgtatgacgcgcggaggaggtagcgggagtagtcgcgggagtcgggatcgggtagtcgcgcgttgggggtgggcgtcgttcgtttcgtttcgcgaagtttttgcgcgtttagggacgcggttttttcgcggtagtcgcgttaggtttcggcgtgtggtcgcggtcgtcgtcgtcgttgttatgttttcggggaagttcggggcgggcggagcggggacgaggcggatcggttggcggaggaggaggcgaaggagacggtaggaggcggcgacgacggtgttcgggttcgggcgtacggcggggttcgattcgcgcgttcggggtacgttttagggcgcgcggggtatgaagtcggcggcgcgggaggcgcggttgttttcgcgttcgttcgggttgcgttgggcgttgtcgttgttgttgttgttgttgcgtttgggttaggtaagcgtcgggtgggttcgggcggggggtaggaggttggggcgggattggtatt

SEQ ID NO: 30810 - DNA, 704 bp, Artificial Sequence
  chemically treated genomic DNA (Homo sapiens) CpG-island No: 30810
aataccaatcccgccccaacctcctaccccccgcccgaacccacccgacgcttacctaacccaaacgcaacaacaacaacaacaacgacaacgcccaacgcaacccgaacgaacgcgaaaacaaccgcgcctcccgcgccgccgacttcataccccgcgcgccctaaaacgtaccccgaacgcgcgaatcgaaccccgccgtacgcccgaacccgaacaccgtcgtcgccgcctcctaccgtctccttcgcctcctcctccgccaaccgatccgcctcgtccccgctccgcccgccccgaacttccccgaaaacataacaacgacgacgacgaccgcgaccacacgccgaaacctaacgcgactaccgcgaaaaaaccgcgtccctaaacgcgcaaaaacttcgcgaaacgaaacgaacgacgcccacccccaacgcgcgactacccgatcccgactcccgcgactactcccgctacctcctccgcgcgtcatacgactaaaactacaaaaaaccgcgacgaacgctcgaccccctcccttcccctccccctctaaatattcatcgcttcctcccgccccgaccgacccgacgactacgaaactccgcaacccctcgccgccgcccgccgctacccccgccccctccgaaccgaccgcgaatcccctcccgcgaacaaaaaaaacgctcccgcctcgcccgccc

SEQ ID NO: 30811 - DNA, 704 bp, Artificial Sequence
  chemically treated genomic DNA (Homo sapiens) CpG-island No: 30811
aatgttagtttcgttttagttttttgtttttcgttcgagtttattcggcgtttatttggtttaggcgtagtagtagtagtagtagcggtagcgtttagcgtagttcgggcgagcgcggaggtagtcgcgtttttcgcgtcgtcggttttatgtttcgcgcgttttggaacgtgtttcggacgcgcgaatcgggtttcgtcgtgcgttcgagttcgggtatcgtcgtcgtcgttttttgtcgtttttttcgttttttttttcgttagtcggttcgtttcgttttcgtttcgttcgtttcgggttttttcggagatatggtagcggcggcggcggtcgcggttatacgtcggagtttagcgcggttgtcgcgggggggtcgcgtttttgagcgcgtaggggtttcgcggggcggagcgagcggcgtttatttttagcgcgcggttattcggtttcggttttcgcggttgttttcgttgtttttttcgcgcgttatgcggttggggttgtagggagtcgcggcgagcgttcggttttttttttttttttttttttttgaatatttatcgttttttttcgtttcggtcggttcggcggttgcggagtttcgtagtttttcgtcgtcgttcgtcgttgttttcgtttttttcgagtcggtcgcggattttttttcgcgggtagaggaagcgttttcgtttcgttcgttt

SEQ ID NO: 30812 - DNA, 704 bp, Artificial Sequence
  chemically treated genomic DNA (Homo sapiens) CpG-island No: 30812
aaacgaacgaaacgaaaacgcttcctctacccgcgaaaaaaaatccgcgaccgactcgaaaaaaacgaaaacaacgacgaacgacgacgaaaaactacgaaactccgcaaccgccgaaccgaccgaaacgaaaaaaaacgataaatattcaaaaaaaaaaaaaaaaaaaaaaaaccgaacgctcgccgcgactccctacaaccccaaccgcataacgcgcgaaaaaaacaacgaaaacaaccgcgaaaaccgaaaccgaataaccgcgcgctaaaaataaacgccgctcgctccgccccgcgaaacccctacgcgctcaaaaacgcgacccccccgcgacaaccgcgctaaactccgacgtataaccgcgaccgccgccgccgctaccatatctccgaaaaaacccgaaacgaacgaaacgaaaacgaaacgaaccgactaacgaaaaaaaaaacgaaaaaaacgacaaaaaacgacgacgacgatacccgaactcgaacgcacgacgaaacccgattcgcgcgtccgaaacacgttccaaaacgcgcgaaacataaaaccgacgacgcgaaaaacgcgactacctccgcgctcgcccgaactacgctaaacgctaccgctactactactactactacgcctaaaccaaataaacgccgaataaactcgaacgaaaaacaaaaaactaaaacgaaactaacatt

SEQ ID NO: 30813 - DNA, 631 bp, Artificial Sequence
  chemically treated genomic DNA (Homo sapiens) CpG-island No: 30813
cgttaggtatatacggcgtattttcgtttttttgcgtagtttttggttttcgcgtttcgcgggttgggcgtttaggtggttttatagtagtagttgtagggcgcgtagtaggaggtcgacgcgcgcgattatttcgtcgttttcggtgtagttcggttcggggagttattgcgcgtagggaattagtcggtagttagtcgcgttcgggatttcggggatgggattgttttgcgtcgttttcgtacggagagggattgtttcggggtttcgttagtgttttagttgcgcgttttgggtcgttttttcgttgtttttcgtcgggagtcggttagacgtcgtttagttcgggtagtgtttgttcgcgggttcgtcggtttcggggatcgagggagggaggaaggaaaggtaggcggagggggcggaggttcggtattttcgttttatttatttcgcgtcgttgttggaacgcgaggcggtttcggagtttttttcgttcgttgtatagtttcgttttgcgttcgttatcgttttgcggatcggttttttcgttcgttatttttagttgattcggatttgtttagggagggtgaaggaagaaaggtttttttttggtaagcgtggttatttaaga

SEQ ID NO: 30814 - DNA, 631 bp, Artificial Sequence
  chemically treated genomic DNA (Homo sapiens) CpG-island No: 30814
tcttaaataaccacgcttaccaaaaaaaaacctttcttccttcaccctccctaaacaaatccgaatcaactaaaaataacgaacgaaaaaaccgatccgcaaaacgataacgaacgcaaaacgaaactatacaacgaacgaaaaaaactccgaaaccgcctcgcgttccaacaacgacgcgaaataaataaaacgaaaataccgaacctccgccccctccgcctacctttccttcctccctccctcgatccccgaaaccgacgaacccgcgaacaaacactacccgaactaaacgacgtctaaccgactcccgacgaaaaacaacgaaaaaacgacccaaaacgcgcaactaaaacactaacgaaaccccgaaacaatccctctccgtacgaaaacgacgcaaaacaatcccatccccgaaatcccgaacgcgactaactaccgactaattccctacgcgcaataactccccgaaccgaactacaccgaaaacgacgaaataatcgcgcgcgtcgacctcctactacgcgccctacaactactactataaaaccacctaaacgcccaacccgcgaaacgcgaaaaccaaaaactacgcaaaaaaacgaaaatacgccgtatatacctaacg

SEQ ID NO: 30815 - DNA, 631 bp, Artificial Sequence
  chemically treated genomic DNA (Homo sapiens) CpG-island No: 30815
ttttaggtagttacgtttgttaggagaaggtttttttttttttattttttttggatagattcgggttaattggaggtggcgggcgagaggatcgattcgtagggcggtggcgggcgtagggcgaggttgtgtagcgaacggaagaggtttcgggatcgtttcgcgttttagtagcggcgcggggtgggtggggcgggagtgtcgggttttcgtttttttcgtttgttttttttttttttttttttcggttttcggggtcggcggattcgcgggtaggtattgttcgggttggacgacgtttggtcggttttcggcgaagggtagcggaggagcggtttagagcgcgtagttagggtattggcgaaatttcgggatagttttttttcgtgcgggggcggcgtagagtagttttattttcggggtttcgggcgcggttgattgtcggttggttttttgcgcgtagtagtttttcgagtcgggttgtatcggaggcggcgagatggtcgcgcgcgtcggttttttgttgcgcgttttgtagttgttattgtggggttatttggacgtttagttcgcggagcgcggaggttaggagttgcgtaaggaggcggaggtacgtcgtgtgtatttggcg

SEQ ID NO: 30816 - DNA, 631 bp, Artificial Sequence
  chemically treated genomic DNA (Homo sapiens) CpG-island No: 30816
cgccaaatacacacgacgtacctccgcctccttacgcaactcctaacctccgcgctccgcgaactaaacgtccaaataaccccacaataacaactacaaaacgcgcaacaaaaaaccgacgcgcgcgaccatctcgccgcctccgatacaacccgactcgaaaaactactacgcgcaaaaaaccaaccgacaatcaaccgcgcccgaaaccccgaaaataaaactactctacgccgcccccgcacgaaaaaaaactatcccgaaatttcgccaataccctaactacgcgctctaaaccgctcctccgctacccttcgccgaaaaccgaccaaacgtcgtccaacccgaacaatacctacccgcgaatccgccgaccccgaaaaccgaaaaaaaaaaaaaaaaaaaacaaacgaaaaaaacgaaaacccgacactcccgccccacccaccccgcgccgctactaaaacgcgaaacgatcccgaaacctcttccgttcgctacacaacctcgccctacgcccgccaccgccctacgaatcgatcctctcgcccgccacctccaattaacccgaatctatccaaaaaaaataaaaaaaaaaaaaccttctcctaacaaacgtaactacctaaaa

SEQ ID NO: 30817 - DNA, 649 bp, Artificial Sequence
  chemically treated genomic DNA (Homo sapiens) CpG-island No: 30817
gtgacgtattcggcgtagtattggggcgtttgcggcgtgatatagtataggattttgcgttttttttcgattttttttttgatttgtaggtattcgaagtaggggttggttttgtcgttgtggtagggttcgatggtatttagtttgatggcgtttacgatggcggttagcgtttgttggattatttttcgcgtttgttgcgtggacgtgtttagttgttgttgtagttgttgggtggagcgttgaaagcggcgtttgcgcggatgttgggtttgggcgtcgtcgttttcggagtcgcgggttttggttttggtgatcggggtaggggtgggggcgtattttttttcggaggggggcgggttttgtttgttttggttcgcgagtatttgcgttcggtttttggttatgcgttgagggattttttttattcggggggttttcggggtttcggtcgtgggttttggttttgcggttttcggttggatgtcgttaggagggttttcggttggggcggcggtacgggaggttttagtgtcgttttcggggtcggtatcgtttgcggtttgagtttgtgttatagtgttcggggcggggtcgttaggggtatagagggacgcggcgggggggtttttagttttagttttttggt

SEQ ID NO: 30818 - DNA, 649 bp, Artificial Sequence
  chemically treated genomic DNA (Homo sapiens) CpG-island No: 30818
accaaaaaactaaaactaaaaacccccccgccgcgtccctctatacccctaacgaccccgccccgaacactataacacaaactcaaaccgcaaacgataccgaccccgaaaacgacactaaaacctcccgtaccgccgccccaaccgaaaaccctcctaacgacatccaaccgaaaaccgcaaaaccaaaacccacgaccgaaaccccgaaaaccccccgaataaaaaaaatccctcaacgcataaccaaaaaccgaacgcaaatactcgcgaaccaaaacaaacaaaacccgcccccctccgaaaaaaaatacgcccccacccctaccccgatcaccaaaaccaaaacccgcgactccgaaaacgacgacgcccaaacccaacatccgcgcaaacgccgctttcaacgctccacccaacaactacaacaacaactaaacacgtccacgcaacaaacgcgaaaaataatccaacaaacgctaaccgccatcgtaaacgccatcaaactaaataccatcgaaccctaccacaacgacaaaaccaacccctacttcgaatacctacaaatcaaaaaaaaaatcgaaaaaaaacgcaaaatcctatactatatcacgccgcaaacgccccaatactacgccgaatacgtcac

SEQ ID NO: 30819 - DNA, 649 bp, Artificial Sequence
  chemically treated genomic DNA (Homo sapiens) CpG-island No: 30819
attagggggttgaggttgaaggttttttcgtcgcgtttttttgtgtttttgacggtttcgtttcgaatattgtggtataagtttaggtcgtagacggtgtcggtttcgaggacgatattgaggtttttcgtgtcgtcgttttagtcgaaggtttttttggcggtatttagtcggaagtcgtagaattaaaatttacggtcgaagtttcgaaggtttttcgagtggaggagattttttagcgtatgattaggaatcgggcgtagatgttcgcgaattagagtaagtagggttcgttttttttcgagaaggagtgcgtttttatttttgtttcggttattagggttaaggttcgcggtttcgaggacgacgacgtttaggtttagtattcgcgtaaacgtcgtttttagcgttttatttagtagttgtagtagtagttgaatacgtttacgtagtagacgcgggaggtgatttagtagacgttggtcgttatcgtggacgttattaagttggatgttatcgagttttattatagcgatagggttaatttttatttcgaatatttgtagattaggaagaagatcgaggagaagcgtaagattttgtgttgtattacgtcgtaggcgttttagtgttacgtcgagtacgttat

SEQ ID NO: 30820 - DNA, 649 bp, Artificial Sequence
  chemically treated genomic DNA (Homo sapiens) CpG-island No: 30820
ataacgtactcgacgtaacactaaaacgcctacgacgtaatacaacacaaaatcttacgcttctcctcgatcttcttcctaatctacaaatattcgaaataaaaattaaccctatcgctataataaaactcgataacatccaacttaataacgtccacgataacgaccaacgtctactaaatcacctcccgcgtctactacgtaaacgtattcaactactactacaactactaaataaaacgctaaaaacgacgtttacgcgaatactaaacctaaacgtcgtcgtcctcgaaaccgcgaaccttaaccctaataaccgaaacaaaaataaaaacgcactccttctcgaaaaaaaacgaaccctacttactctaattcgcgaacatctacgcccgattcctaatcatacgctaaaaaatctcctccactcgaaaaaccttcgaaacttcgaccgtaaattttaattctacgacttccgactaaataccgccaaaaaaaccttcgactaaaacgacgacacgaaaaacctcaatatcgtcctcgaaaccgacaccgtctacgacctaaacttataccacaatattcgaaacgaaaccgtcaaaaacacaaaaaaacgcgacgaaaaaaccttcaacctcaaccccctaat

SEQ ID NO: 30821 - DNA, 1714 bp, Artificial Sequence
  chemically treated genomic DNA (Homo sapiens) CpG-island No: 30821
ttatttcgtagatacgtattattttttatttcgtagatacgcgttattttttatttcgtagatacgcgttatttattttttatttcgtagatacgcgttattttttatttcgtagatacgcgttattttttatttcgtagatatgcgttatttattttttatttcgtagatacgtattattttttatttcgtagatacgcgttatttattttttattttatagatacgcgttatttattttttatttcgtagatacgcgttatttattttttatttcgtagatacgcgttatttattttttatttcgtagatacgcgttatttattttttatttcgtagatacgcgttatttattttttatttcgtagatacgcgttatttattttttatttcgtagatacgcgttattttttatttcgtagatacgttatttattttttatttcgtagatacgtattattttttatttcgtagatacgcgttatttattttttatttcgtagatacgcgttatttattttttatttcgtagatacgcgttatttattttttatttcgtagatacgcgttattttttatttcgtagatacgcgttatttattttttttttcgtagatacgcgttatttattttttttttcgtagatacgtgttattttttatttcgtagatacgcgttatttattttttatttcgtagatacgcgttatttattttttatttcgtagatacgcgttattttttatttcgtagatacgcgttatttattttttatttcgtagatacgcgttatttattttttatttcgtagatacgcgttatttattttttatttcgtagatacgcgttattttttatttcgtagatacgcgttatttattttttatttcgtagatacgcgttattttttatttcgtagatacgcgttatttattttttatttcgtagatacgcgttatttattttttatttcgtagatacgcgttatttattttttatttcgtagatacgcgttattttttatttcgtagatacgcgttatttattttttatttcgtagatacgcgttattttttatttcgtagatacgcgttatttattttttatttcgtagatacgcgttatttattttttatttcgtagatacgcgttattttttatttcgtagatacgcgttattttttatttcgtagatacgcgttatttattttttatttcgtagatacgtattattttttattgtgtagatacgtgttattttttatttcgtagatacgcgttatttattttttatttcgtagatacgcgttattttttatttcgtagatacgcgttatttattttttatttcgtagatacgcgttattttttattttatagatatgcgttattttttatttcgtagatacgcgttatttattttttatttcgtagatacgcgttattttttattttatagatacgcgttatttattttttatttcgtagatacgtgcgttattttttaggagggagacggtgcgatatatatagcgtttgggacgtggggagggggacggtgcgatatatatagcgttcgggacgtggggagggggtagtgtgatatatatagcgttcgggacgtggggagggggatagtgcgatatatatagtattcgggacgtggggagggggacggtgcgatatatatattgtttttttttattagtaagttt

SEQ ID NO: 30822 - DNA, 1714 bp, Artificial Sequence
  chemically treated genomic DNA (Homo sapiens) CpG-island No: 30822
aaacttactaataaaaaaaaacaatatatatatcgcaccgtccccctccccacgtcccgaatactatatatatcgcactatccccctccccacgtcccgaacgctatatatatcacactaccccctccccacgtcccgaacgctatatatatcgcaccgtccccctccccacgtcccaaacgctatatatatcgcaccgtctccctcctaaaaaataacgcacgtatctacgaaataaaaaataaataacgcgtatctataaaataaaaaataacgcgtatctacgaaataaaaaataaataacgcgtatctacgaaataaaaaataacgcatatctataaaataaaaaataacgcgtatctacgaaataaaaaataaataacgcgtatctacgaaataaaaaataacgcgtatctacgaaataaaaaataaataacgcgtatctacgaaataaaaaataacacgtatctacacaataaaaaataatacgtatctacgaaataaaaaataaataacgcgtatctacgaaataaaaaataacgcgtatctacgaaataaaaaataacgcgtatctacgaaataaaaaataaataacgcgtatctacgaaataaaaaataaataacgcgtatctacgaaataaaaaataacgcgtatctacgaaataaaaaataaataacgcgtatctacgaaataaaaaataacgcgtatctacgaaataaaaaataaataacgcgtatctacgaaataaaaaataaataacgcgtatctacgaaataaaaaataaataacgcgtatctacgaaataaaaaataacgcgtatctacgaaataaaaaataaataacgcgtatctacgaaataaaaaataacgcgtatctacgaaataaaaaataaataacgcgtatctacgaaataaaaaataaataacgcgtatctacgaaataaaaaataaataacgcgtatctacgaaataaaaaataacgcgtatctacgaaataaaaaataaataacgcgtatctacgaaataaaaaataaataacgcgtatctacgaaataaaaaataacacgtatctacgaaaaaaaaaataaataacgcgtatctacgaaaaaaaaaataaataacgcgtatctacgaaataaaaaataacgcgtatctacgaaataaaaaataaataacgcgtatctacgaaataaaaaataaataacgcgtatctacgaaataaaaaataaataacgcgtatctacgaaataaaaaataatacgtatctacgaaataaaaaataaataacgtatctacgaaataaaaaataacgcgtatctacgaaataaaaaataaataacgcgtatctacgaaataaaaaataaataacgcgtatctacgaaataaaaaataaataacgcgtatctacgaaataaaaaataaataacgcgtatctacgaaataaaaaataaataacgcgtatctacgaaataaaaaataaataacgcgtatctataaaataaaaaataaataacgcgtatctacgaaataaaaaataatacgtatctacgaaataaaaaataaataacgcatatctacgaaataaaaaataacgcgtatctacgaaataaaaaataacgcgtatctacgaaataaaaaataaataacgcgtatctacgaaataaaaaataacgcgtatctacgaaataaaaaataatacgtatctacgaaataa

SEQ ID NO: 30823 - DNA, 1714 bp, Artificial Sequence
  chemically treated genomic DNA (Homo sapiens) CpG-island No: 30823
aggtttattgatggggaaaggtagtgtgtgtgtcgtatcgtttttttttttacgtttcgagtgttgtgtgtgtcgtattgtttttttttttacgtttcgagcgttgtgtgtgttatattgttttttttttacgtttcgagcgttgtgtgtgtcgtatcgtttttttttttacgttttaagcgttgtgtgtgtcgtatcgttttttttttgggaggtagcgtacgtgtttgcggagtgggaggtaggtggcgcgtgtttgtggagtgggaggtggcgcgtgtttgcggagtgggaggtaagtggcgcgtgtttgcggagtgggaggtggcgtatgtttgtggaatgggaggtggcgcgtgtttgcggagtgggaggtaggtggcgcgtgtttgcggagtgggaggtggcgcgtgtttgcggagtgggaggtaggtggcgcgtgtttgcggagtgggaggtggtacgtgtttgtatagtgggaggtggtgcgtgtttgcggagtgggaggtaggtggcgcgtgtttgcggagtgggaggtggcgcgtgtttgcggagtgggaggtggcgcgtgtttgcggagtgggaggtaagtggcgcgtgtttgcggagtgggaggtgggtggcgcgtgtttgcggagtgggaggtggcgcgtgtttgcggagtgggaggtaggtggcgcgtgtttgcggagtgggaggtggcgcgtgtttgcggagtgggaggtgggtggcgcgtgtttgcggagtgggaggtgggtggcgcgtgtttgcggagtgggaggtgggtggcgcgtgtttgcggagtgggaggtggcgcgtgtttgcggagtgggaggtaggtggcgcgtgtttgcggagtgggaggtggcgcgtgtttgcggagtgggaggtgggtggcgcgtgtttgcggagtgggaggtgggtggcgcgtgtttgcggagtgggaggtgggtggcgcgtgtttgcggagtgggaggtggcgcgtgtttgcggagtgggaggtaagtggcgcgtgtttgcggagtgggaggtaggtggcgcgtgtttgcggagtgggaggtggtacgtgtttgcggagggggaggtaggtggcgcgtgtttgcggagggggaggtaagtggcgcgtgtttgcggagtgggaggtggcgcgtgtttgcggagtgggaggtaggtggcgcgtgtttgcggagtgggaggtaggtggcgcgtgtttgcggagtgggaggtaggtggcgcgtgtttgcggagtgggaggtggtgcgtgtttgcggagtgggaggtaagtggcgtgtttgcggagtgggaggtggcgcgtgtttgcggagtgggaggtagatggcgcgtgtttgcggagtgggaggtgggtggcgcgtgtttgcggagtgggaggtgggtggcgcgtgtttgcggagtgggaggtgggtggcgcgtgtttgcggagtgggaggtgggtggcgcgtgtttgcggagtgggaggtgggtggcgcgtgtttgtggagtgggaggtgggtggcgcgtgtttgcggagtgggaggtggtgcgtgtttgcggagtgggaggtaagtggcgtatgtttgcggagtgggaggtggcgcgtgtttgcggagtgggaggtggcgcgtgtttgcggagtgggaggtaggtggcgcgtgtttgcggagtgggaggtggcgcgtgtttgcggagtgggaggtagtgcgtgtttgcggagtga

SEQ ID NO: 30824 - DNA, 1714 bp, Artificial Sequence
  chemically treated genomic DNA (Homo sapiens) CpG-island No: 30824
tcactccgcaaacacgcactacctcccactccgcaaacacgcgccacctcccactccgcaaacacgcgccacctacctcccactccgcaaacacgcgccacctcccactccgcaaacacgcgccacctcccactccgcaaacatacgccacttacctcccactccgcaaacacgcaccacctcccactccgcaaacacgcgccacccacctcccactccacaaacacgcgccacccacctcccactccgcaaacacgcgccacccacctcccactccgcaaacacgcgccacccacctcccactccgcaaacacgcgccacccacctcccactccgcaaacacgcgccacccacctcccactccgcaaacacgcgccatctacctcccactccgcaaacacgcgccacctcccactccgcaaacacgccacttacctcccactccgcaaacacgcaccacctcccactccgcaaacacgcgccacctacctcccactccgcaaacacgcgccacctacctcccactccgcaaacacgcgccacctacctcccactccgcaaacacgcgccacctcccactccgcaaacacgcgccacttacctccccctccgcaaacacgcgccacctacctccccctccgcaaacacgtaccacctcccactccgcaaacacgcgccacctacctcccactccgcaaacacgcgccacttacctcccactccgcaaacacgcgccacctcccactccgcaaacacgcgccacccacctcccactccgcaaacacgcgccacccacctcccactccgcaaacacgcgccacccacctcccactccgcaaacacgcgccacctcccactccgcaaacacgcgccacctacctcccactccgcaaacacgcgccacctcccactccgcaaacacgcgccacccacctcccactccgcaaacacgcgccacccacctcccactccgcaaacacgcgccacccacctcccactccgcaaacacgcgccacctcccactccgcaaacacgcgccacctacctcccactccgcaaacacgcgccacctcccactccgcaaacacgcgccacccacctcccactccgcaaacacgcgccacttacctcccactccgcaaacacgcgccacctcccactccgcaaacacgcgccacctcccactccgcaaacacgcgccacctacctcccactccgcaaacacgcaccacctcccactatacaaacacgtaccacctcccactccgcaaacacgcgccacctacctcccactccgcaaacacgcgccacctcccactccgcaaacacgcgccacctacctcccactccgcaaacacgcgccacctcccattccacaaacatacgccacctcccactccgcaaacacgcgccacttacctcccactccgcaaacacgcgccacctcccactccacaaacacgcgccacctacctcccactccgcaaacacgtacgctacctcccaaaaaaaaaacgatacgacacacacaacgcttaaaacgtaaaaaaaaaaacgatacgacacacacaacgctcgaaacgtaaaaaaaaaacaatataacacacacaacgctcgaaacgtaaaaaaaaaaacaatacgacacacacaacactcgaaacgtaaaaaaaaaaacgatacgacacacacactacctttccccatcaataaacct

SEQ ID NO: 30825 - DNA, 655 bp, Artificial Sequence
  chemically treated genomic DNA (Homo sapiens) CpG-island No: 30825
agttttttttcgttcgttttatagacgtcgcgtaggtttcgagttttcgagcggcggttttagaattcgcgggttattcgggagtttttttcgtagtattagtcgaaagtttttagtgtcgaggagggcgggtagttgtttttttcgatttcgtttcgttcgcgcggacgttttcggttttacgcggggattatttcgggattttcgtcggatttcgcgcgttcgcggttaatttgcgtgtatttgcgtttcgcgttacgttttcggcgttttacgtttagtttttattgggtttcgttttttagtggttttaagtttcgttttttcgttggttatcgtaagtttcgtttttcgaggtttcgtttttgtaaggttcgtttttttacgatttaggtttcgtttattacggttagttcgggtttaggtttcgtttcgatacgatttaggtttcgttttcggttagtttcgtttttcgcgcgtttcgtttagtaattttcgttgaattcggcgcggtttttttagcgttgttttacgtcgtagtttagcgtttggagttcgcgcgtttcgagtttttgttcgtttatgcgtagttgggttatttaggtgtatttatttttttgttgtttcgtcgttttttttgtttttatttcgttta

SEQ ID NO: 30826 - DNA, 655 bp, Artificial Sequence
  chemically treated genomic DNA (Homo sapiens) CpG-island No: 30826
taaacgaaataaaaacaaaaaaaacgacgaaacaacaaaaaaataaatacacctaaataacccaactacgcataaacgaacaaaaactcgaaacgcgcgaactccaaacgctaaactacgacgtaaaacaacgctaaaaaaaccgcgccgaattcaacgaaaattactaaacgaaacgcgcgaaaaacgaaactaaccgaaaacgaaacctaaatcgtatcgaaacgaaacctaaacccgaactaaccgtaataaacgaaacctaaatcgtaaaaaaacgaaccttacaaaaacgaaacctcgaaaaacgaaacttacgataaccaacgaaaaaacgaaacttaaaaccactaaaaaacgaaacccaataaaaactaaacgtaaaacgccgaaaacgtaacgcgaaacgcaaatacacgcaaattaaccgcgaacgcgcgaaatccgacgaaaatcccgaaataatccccgcgtaaaaccgaaaacgtccgcgcgaacgaaacgaaatcgaaaaaaacaactacccgccctcctcgacactaaaaactttcgactaatactacgaaaaaaactcccgaataacccgcgaattctaaaaccgccgctcgaaaactcgaaacctacgcgacgtctataaaacgaacgaaaaaaaact

SEQ ID NO: 30827 - DNA, 655 bp, Artificial Sequence
  chemically treated genomic DNA (Homo sapiens) CpG-island No: 30827
taggcggggtgggggtagggagggcggcgggatagtaaggaagtgggtgtatttgggtgatttagttgcgtatgagcgggtaggggttcggggcgcgcggattttaggcgttggattgcggcgtggagtagcgttggggaaatcgcgtcgggtttagcgaggattgttgggcggggcgcgcgaggagcgaagttggtcgggggcggggtttgagtcgtgtcggggcggggtttagattcgggttggtcgtgatgggcggggtttgagtcgtgaaggggcgggttttgtaggggcggggtttcgaggggcggagtttgcggtgattagcgagggggcggggtttagagttattaagaagcgggatttagtgagggttaaacgtggggcgtcgggggcgtggcgcggggcgtaggtgtacgtaggttggtcgcgggcgcgcggggttcggcgggagtttcggggtggttttcgcgtggggtcgggggcgttcgcgcgggcggggcgaggtcggggagggtagttgttcgtttttttcggtattgggagttttcggttggtattgcgggaggagttttcgggtgattcgcgggttttgaaatcgtcgttcgggagttcggggtttgcgcggcgtttatggggcgagcgagggagaatt

SEQ ID NO: 30828 - DNA, 655 bp, Artificial Sequence
  chemically treated genomic DNA (Homo sapiens) CpG-island No: 30828
aattctccctcgctcgccccataaacgccgcgcaaaccccgaactcccgaacgacgatttcaaaacccgcgaatcacccgaaaactcctcccgcaataccaaccgaaaactcccaataccgaaaaaaacgaacaactaccctccccgacctcgccccgcccgcgcgaacgcccccgaccccacgcgaaaaccaccccgaaactcccgccgaaccccgcgcgcccgcgaccaacctacgtacacctacgccccgcgccacgcccccgacgccccacgtttaaccctcactaaatcccgcttcttaataactctaaaccccgccccctcgctaatcaccgcaaactccgcccctcgaaaccccgcccctacaaaacccgccccttcacgactcaaaccccgcccatcacgaccaacccgaatctaaaccccgccccgacacgactcaaaccccgcccccgaccaacttcgctcctcgcgcgccccgcccaacaatcctcgctaaacccgacgcgatttccccaacgctactccacgccgcaatccaacgcctaaaatccgcgcgccccgaacccctacccgctcatacgcaactaaatcacccaaatacacccacttccttactatcccgccgccctccctacccccaccccgccta

SEQ ID NO: 30829 - DNA, 624 bp, Artificial Sequence
  chemically treated genomic DNA (Homo sapiens) CpG-island No: 30829
tttagtttcgggtttacgcgttgttattggtttttttcgatcgttcggttttatttttagacgtcgcgattggttatttcgcggggtttcgtttcgtttttttggaaagtttttggaaatttgttaaagtatttttttttattgtttagggttttagattcggcgacggggttcgcgtatttcgttcgggttttatcgtttagttcgcggttttaggaagacgttgttttcgggaagggttggaacgcggtagataaaggattaggtagtagttcgtttcgtttcgttcgtttggttcgtttttttcgttttcgtaggcggttcgcgttattgttttttagtttttgttttgcgttcgcgcgtttcgggagtttatttagtacgcgtttcgcgtttattggttttttttagtcgtcgtcgtttagtcgagtttttatttcggagtcgtcgttgtcgcggggatatggttttttgcgtttaggggtaagcgcggttttttgtttttttttcggttattacgaggggcgtacgggagaataggggtttcgtgttagttgtcgggtattgggagggtttgacgggttagaggtgattgagcgtagacggattttaggagtaaggttt

SEQ ID NO: 30830 - DNA, 624 bp, Artificial Sequence
  chemically treated genomic DNA (Homo sapiens) CpG-island No: 30830
aaaccttactcctaaaatccgtctacgctcaatcacctctaacccgtcaaaccctcccaatacccgacaactaacacgaaacccctattctcccgtacgcccctcgtaataaccgaaaaaaaaacaaaaaaccgcgcttacccctaaacgcaaaaaaccatatccccgcgacaacgacgactccgaaataaaaactcgactaaacgacgacgactaaaaaaaaccaataaacgcgaaacgcgtactaaataaactcccgaaacgcgcgaacgcaaaacaaaaactaaaaaacaataacgcgaaccgcctacgaaaacgaaaaaaacgaaccaaacgaacgaaacgaaacgaactactacctaatcctttatctaccgcgttccaacccttcccgaaaacaacgtcttcctaaaaccgcgaactaaacgataaaacccgaacgaaatacgcgaaccccgtcgccgaatctaaaaccctaaacaataaaaaaaaatactttaacaaatttccaaaaactttccaaaaaaacgaaacgaaaccccgcgaaataaccaatcgcgacgtctaaaaataaaaccgaacgatcgaaaaaaaccaataacaacgcgtaaacccgaaactaaa

SEQ ID NO: 30831 - DNA, 624 bp, Artificial Sequence
  chemically treated genomic DNA (Homo sapiens) CpG-island No: 30831
gagttttgtttttgaggttcgtttgcgtttagttatttttggttcgttaagtttttttaatgttcggtagttagtacgaagtttttgttttttcgtgcgtttttcgtggtggtcgggaagggggtagagagtcgcgtttatttttgaacgtagaggattatgttttcgcggtagcggcgatttcggagtggggattcggttggacggcggcggttggagggaattagtgggcgcggagcgcgtgttgggtaggttttcggggcgcgcgggcgtaggatagggattgagaggtagtggcgcggatcgtttgcgagggcgaggggggcgggttagacgagcggggcggggcgagttgttgtttaattttttgtttgtcgcgttttagtttttttcggaagtagcgtttttttagaatcgcgggttgagcggtggggttcgggcggggtgcgcgggtttcgtcgtcgggtttggggttttgagtagtgaaaggaaatattttgatagatttttaagaattttttaggaaaacggggcggggtttcgcgaggtgattaatcgcgacgtttgaaggtggagtcgagcggtcggggagggttaatagtagcgcgtggattcggggttgaa

SEQ ID NO: 30832 - DNA, 624 bp, Artificial Sequence
  chemically treated genomic DNA (Homo sapiens) CpG-island No: 30832
ttcaaccccgaatccacgcgctactattaaccctccccgaccgctcgactccaccttcaaacgtcgcgattaatcacctcgcgaaaccccgccccgttttcctaaaaaattcttaaaaatctatcaaaatatttcctttcactactcaaaaccccaaacccgacgacgaaacccgcgcaccccgcccgaaccccaccgctcaacccgcgattctaaaaaaacgctacttccgaaaaaaactaaaacgcgacaaacaaaaaattaaacaacaactcgccccgccccgctcgtctaacccgcccccctcgccctcgcaaacgatccgcgccactacctctcaatccctatcctacgcccgcgcgccccgaaaacctacccaacacgcgctccgcgcccactaattccctccaaccgccgccgtccaaccgaatccccactccgaaatcgccgctaccgcgaaaacataatcctctacgttcaaaaataaacgcgactctctacccccttcccgaccaccacgaaaaacgcacgaaaaaacaaaaacttcgtactaactaccgaacattaaaaaaacttaacgaaccaaaaataactaaacgcaaacgaacctcaaaaacaaaactc

SEQ ID NO: 30833 - DNA, 940 bp, Artificial Sequence
  chemically treated genomic DNA (Homo sapiens) CpG-island No: 30833
  misc_feature (421)..(421): n is either a, c, g or t
tttttcgcgggtcgtatttgttaaggtcgtatcgttagcgttttttgtcgttttttttgtatagagattcgcgtttattttcgtattcgtattcgtattcgtatttgtttttatttcgcgttcgtttcgcgtcgaggtcgcgtagtttgcgggtagtggcgggggtacgaggatgcgaatttaggcggggtcgggagttgggcgcgttttttagaattttcgttacggttaggtttgagttttatttatttacgtcgtattttttttttttcgtgggggtttatatggtcgtgtcgggcgcggtttcgcgggcgcggcgatcgggcgataacgcggcggggacggtcgcgggttcggttgtggcgtatcgcgagtcgaggcggggacggttaggcggcgcgggttagtggggcggcgtatnttttataggtcgttcgggatgtcgtcgttattttcgttacgtttggatcgcgaggtttcgcgggtggtttagtagtttttggcggcgcgggcgaaggttcgttatttgttcgtcgtcgttgttttcgtgtcgtcgtttgtttttttatagtttcgtcgttcggttttcggcgtcgtcgcggttcggttcgttttagcgggttcgtaggacgttcgcgtatgcgttattttttgtcgcgtaggggttcgcgttgttcgggttcgcgtcgtttcgagttcgcgcgcgaatttacgcgtcgttgttgcgcgttagcggagggaaattcgcgagaagttattggattgttcggtttcggatcggtttttagaatcgttggttcggggtttttagttgtagtaaatttcggagggggcgaagtcggttaggtgggcgattttttttattcggattttttattcgttttcgtttttagtgttttttgtttgcgtttcgagatggttataggttttttggtcggag

SEQ ID NO: 30834 - DNA, 940 bp, Artificial Sequence
  chemically treated genomic DNA (Homo sapiens) CpG-island No: 30834
  misc_feature (520)..(520): n is either a, c, g or t
ctccgaccaaaaaacctataaccatctcgaaacgcaaacaaaaaacactaaaaacgaaaacgaataaaaaatccgaataaaaaaaatcgcccacctaaccgacttcgccccctccgaaatttactacaactaaaaaccccgaaccaacgattctaaaaaccgatccgaaaccgaacaatccaataacttctcgcgaatttccctccgctaacgcgcaacaacgacgcgtaaattcgcgcgcgaactcgaaacgacgcgaacccgaacaacgcgaacccctacgcgacaaaaaataacgcatacgcgaacgtcctacgaacccgctaaaacgaaccgaaccgcgacgacgccgaaaaccgaacgacgaaactataaaaaaacaaacgacgacacgaaaacaacgacgacgaacaaataacgaaccttcgcccgcgccgccaaaaactactaaaccacccgcgaaacctcgcgatccaaacgtaacgaaaataacgacgacatcccgaacgacctataaaanatacgccgccccactaacccgcgccgcctaaccgtccccgcctcgactcgcgatacgccacaaccgaacccgcgaccgtccccgccgcgttatcgcccgatcgccgcgcccgcgaaaccgcgcccgacacgaccatataaacccccacgaaaaaaaaaaaatacgacgtaaataaataaaactcaaacctaaccgtaacgaaaattctaaaaaacgcgcccaactcccgaccccgcctaaattcgcatcctcgtacccccgccactacccgcaaactacgcgacctcgacgcgaaacgaacgcgaaataaaaacaaatacgaatacgaatacgaatacgaaaataaacgcgaatctctatacaaaaaaaacgacaaaaaacgctaacgatacgaccttaacaaatacgacccgcgaaaaa

SEQ ID NO: 30835 - DNA, 940 bp, Artificial Sequence
  chemically treated genomic DNA (Homo sapiens) CpG-island No: 30835
  misc_feature (520)..(520): n is either a, c, g or t
tttcgattaggaggtttgtggttatttcggggcgtaggtaggaggtattggaagcggaagcgagtggggagttcgggtagagggagtcgtttatttgatcggtttcgtttttttcggggtttgttgtagttgagggtttcggattagcgattttagaagtcggttcggggtcgggtagtttaatagtttttcgcggattttttttcgttggcgcgtagtagcggcgcgtggattcgcgcgcgggttcgggacggcgcgagttcgggtagcgcgagtttttgcgcggtagggagtggcgtatgcgcgggcgttttgcgagttcgttggggcgagtcgagtcgcggcggcgtcgggagtcgggcggcggagttgtgaagaagtaagcggcggtacgggagtagcggcgacggataggtggcgagttttcgttcgcgtcgttaggggttgttgggttattcgcggagtttcgcggtttagacgtggcgggggtggcggcggtatttcggacggtttgtgaggnatgcgtcgttttattggttcgcgtcgtttgatcgttttcgtttcgattcgcggtgcgttatagtcgggttcgcggtcgttttcgtcgcgttgtcgttcggtcgtcgcgttcgcggggtcgcgttcggtacggttatgtggatttttacggaggaggagaaatacggcgtaggtaggtgaggtttaggtttggtcgtggcgggggttttgggggacgcgtttagttttcggtttcgtttggattcgtattttcgtgttttcgttattgttcgtaggttgcgcggtttcggcgcggggcgagcgcggggtgggggtaggtgcgggtgcgggtgcgggtgcgggggtgggcgcgggtttttgtgtagagagggcggtagggggcgttggcggtgcggttttggtaggtgcggttcgcgggagg

SEQ ID NO: 30836 - DNA, 940 bp, Artificial Sequence
  chemically treated genomic DNA (Homo sapiens) CpG-island No: 30836
  misc_feature (421)..(421): n is either a, c, g or t
cctcccgcgaaccgcacctaccaaaaccgcaccgccaacgccccctaccgccctctctacacaaaaacccgcgcccacccccgcacccgcacccgcacccgcacctacccccaccccgcgctcgccccgcgccgaaaccgcgcaacctacgaacaataacgaaaacacgaaaatacgaatccaaacgaaaccgaaaactaaacgcgtcccccaaaacccccgccacgaccaaacctaaacctcacctacctacgccgtatttctcctcctccgtaaaaatccacataaccgtaccgaacgcgaccccgcgaacgcgacgaccgaacgacaacgcgacgaaaacgaccgcgaacccgactataacgcaccgcgaatcgaaacgaaaacgatcaaacgacgcgaaccaataaaacgacgcatncctcacaaaccgtccgaaataccgccgccacccccgccacgtctaaaccgcgaaactccgcgaataacccaacaacccctaacgacgcgaacgaaaactcgccacctatccgtcgccgctactcccgtaccgccgcttacttcttcacaactccgccgcccgactcccgacgccgccgcgactcgactcgccccaacgaactcgcaaaacgcccgcgcatacgccactccctaccgcgcaaaaactcgcgctacccgaactcgcgccgtcccgaacccgcgcgcgaatccacgcgccgctactacgcgccaacgaaaaaaaatccgcgaaaaactattaaactacccgaccccgaaccgacttctaaaatcgctaatccgaaaccctcaactacaacaaaccccgaaaaaaacgaaaccgatcaaataaacgactccctctacccgaactccccactcgcttccgcttccaatacctcctacctacgccccgaaataaccacaaacctcctaatcgaaa

SEQ ID NO: 30837 - DNA, 1157 bp, Artificial Sequence
  chemically treated genomic DNA (Homo sapiens) CpG-island No: 30837
gcggcgtcgatgtcggcgtagaggtttttttcggagggtttgttcgagttgacgtcgtatttcgagtagtcgtaggagaagatgttgtagttgatgcgggagtcgaggttaatgtagaagttgtatatttggtttaggtttacggcgttgtcgtgcgagaagagtagcgtgtagcggttggagggcgcgtagcgtacgaatatgtagtcgagtcggttgtttcgggtcgtgcgcgagaagaagatttcgacggcgtttagttcgcgttgcgagtattgttagtcggcgcgttcgttgaggtgtaggttgtacgtatcgggtttcgcgttcgcgtttttttcgggttgttgcggtgtcggttgggtcgcggcggcggcggcggtagtttgggtcggggtcggggcggacgcgtcggcgtcgcgttgtttcggcgttagtatcgtgtaggtgggttcgggcggtaggaaggttagtttggcggcgatgcggttcgggtagggcgggtagtagaagagttagtatagtttatttagcgagaagtcgtttattttggggtttggttcgggtatcgggacggtttggtgttcgtcgtcggttcggttggttggttggttggttggttcgggaggacggaggacggacgcgcggcgagggagttggtaggcgagcgcggagggcggttgtagttcgttcgttcggcggtaggaggaggcggaggcggaggagggtaggaggcggggtcggttcggcgggcgcggcgttcggagttcgggcgggttagcggcggtttcggaatttaggcgaggcgcgggcggttcgggttcgcgcgcggtatataaagtcggcggcggcgtttatggtcggttcgtgcgcgtcgtttttcgttttcgttttcgttttcgtacgttcgtcgtcgtcgtcgtcgtcgtcgttattttcgggttatcgcgcggcggcgtcgtcgttgggacgcggcgtagagtcgggtatcggggcggggcgttgcgggtaagggcgcgggtatttttttcggtttgggaagtattttttcgatttgcggtcgacgggggtttttaggcggtttcggggttcggagaagttgggtgtcggggttgggggttttgcgttcggatagttgggtcgatttgtagagggga

SEQ ID NO: 30838 - DNA, 1157 bp, Artificial Sequence
  chemically treated genomic DNA (Homo sapiens) CpG-island No: 30838
tcccctctacaaatcgacccaactatccgaacgcaaaacccccaaccccgacacccaacttctccgaaccccgaaaccgcctaaaaacccccgtcgaccgcaaatcgaaaaaatacttcccaaaccgaaaaaaatacccgcgcccttacccgcaacgccccgccccgatacccgactctacgccgcgtcccaacgacgacgccgccgcgcgataacccgaaaataacgacgacgacgacgacgacgacgaacgtacgaaaacgaaaacgaaaacgaaaaacgacgcgcacgaaccgaccataaacgccgccgccgactttatataccgcgcgcgaacccgaaccgcccgcgcctcgcctaaattccgaaaccgccgctaacccgcccgaactccgaacgccgcgcccgccgaaccgaccccgcctcctaccctcctccgcctccgcctcctcctaccgccgaacgaacgaactacaaccgccctccgcgctcgcctaccaactccctcgccgcgcgtccgtcctccgtcctcccgaaccaaccaaccaaccaaccaaccgaaccgacgacgaacaccaaaccgtcccgatacccgaaccaaaccccaaaataaacgacttctcgctaaataaactatactaactcttctactacccgccctacccgaaccgcatcgccgccaaactaaccttcctaccgcccgaacccacctacacgatactaacgccgaaacaacgcgacgccgacgcgtccgccccgaccccgacccaaactaccgccgccgccgccgcgacccaaccgacaccgcaacaacccgaaaaaaacgcgaacgcgaaacccgatacgtacaacctacacctcaacgaacgcgccgactaacaatactcgcaacgcgaactaaacgccgtcgaaatcttcttctcgcgcacgacccgaaacaaccgactcgactacatattcgtacgctacgcgccctccaaccgctacacgctactcttctcgcacgacaacgccgtaaacctaaaccaaatatacaacttctacattaacctcgactcccgcatcaactacaacatcttctcctacgactactcgaaatacgacgtcaactcgaacaaaccctccgaaaaaaacctctacgccgacatcgacgccgc

SEQ ID NO: 30839 - DNA, 1157 bp, Artificial Sequence
  chemically treated genomic DNA (Homo sapiens) CpG-island No: 30839
ttttttttgtagatcggtttagttgttcgggcgtagagtttttagtttcggtatttagttttttcgggtttcggagtcgtttggaagttttcgtcggtcgtaggtcgagaaggtgttttttaggtcggggaaggtgttcgcgtttttgttcgtagcgtttcgtttcgatgttcggttttgcgtcgcgttttagcggcggcgtcgtcgcgcggtaattcggaagtggcggcggcggcggcggcggcggcgggcgtgcgggagcgggaacgggagcggggggcggcgcgtacgagtcggttatggacgtcgtcgtcggttttgtgtgtcgcgcgcgggttcgggtcgttcgcgtttcgtttgggtttcggggtcgtcgttgattcgttcgggtttcgagcgtcgcgttcgtcgggtcggtttcgttttttgttttttttcgttttcgtttttttttgtcgtcgggcgggcgggttgtagtcgtttttcgcgttcgtttgttagttttttcgtcgcgcgttcgtttttcgttttttcgggttagttagttagttagttagtcgggtcggcggcgggtattaggtcgtttcgatgttcgagttaggttttaggatgaacggtttttcgttgggtgagttgtgttggtttttttgttgttcgttttgttcgagtcgtatcgtcgttaagttggtttttttgtcgttcgagtttatttatacggtgttggcgtcggagtagcgcggcgtcggcgcgttcgtttcggtttcggtttaggttatcgtcgtcgtcgtcgcggtttagtcggtatcgtagtagttcgaggagggcgcgggcgcggggttcggtgcgtgtagtttgtattttagcgagcgcgtcgattggtagtattcgtagcgcgagttggacgtcgtcgaggtttttttttcgcgtacggttcgggataatcggttcggttgtatgttcgtgcgttgcgcgttttttagtcgttatacgttgtttttttcgtacggtaacgtcgtggatttgggttagatgtgtagtttttatattggtttcggttttcgtattaattgtaatatttttttttacgattattcgggatacggcgttagttcgggtaagtttttcgagaagaatttttacgtcgatatcgacgtcgt

SEQ ID NO: 30840 - DNA, 1157 bp, Artificial Sequence
  chemically treated genomic DNA (Homo sapiens) CpG-island No: 30840
acgacgtcgatatcgacgtaaaaattcttctcgaaaaacttacccgaactaacgccgtatcccgaataatcgtaaaaaaaaatattacaattaatacgaaaaccgaaaccaatataaaaactacacatctaacccaaatccacgacgttaccgtacgaaaaaaacaacgtataacgactaaaaaacgcgcaacgcacgaacatacaaccgaaccgattatcccgaaccgtacgcgaaaaaaaaacctcgacgacgtccaactcgcgctacgaatactaccaatcgacgcgctcgctaaaatacaaactacacgcaccgaaccccgcgcccgcgccctcctcgaactactacgataccgactaaaccgcgacgacgacgacgataacctaaaccgaaaccgaaacgaacgcgccgacgccgcgctactccgacgccaacaccgtataaataaactcgaacgacaaaaaaaccaacttaacgacgatacgactcgaacaaaacgaacaacaaaaaaaccaacacaactcacccaacgaaaaaccgttcatcctaaaacctaactcgaacatcgaaacgacctaatacccgccgccgacccgactaactaactaactaactaacccgaaaaaacgaaaaacgaacgcgcgacgaaaaaactaacaaacgaacgcgaaaaacgactacaacccgcccgcccgacgacaaaaaaaaacgaaaacgaaaaaaaacaaaaaacgaaaccgacccgacgaacgcgacgctcgaaacccgaacgaatcaacgacgaccccgaaacccaaacgaaacgcgaacgacccgaacccgcgcgcgacacacaaaaccgacgacgacgtccataaccgactcgtacgcgccgccccccgctcccgttcccgctcccgcacgcccgccgccgccgccgccgccgccgccacttccgaattaccgcgcgacgacgccgccgctaaaacgcgacgcaaaaccgaacatcgaaacgaaacgctacgaacaaaaacgcgaacaccttccccgacctaaaaaacaccttctcgacctacgaccgacgaaaacttccaaacgactccgaaacccgaaaaaactaaataccgaaactaaaaactctacgcccgaacaactaaaccgatctacaaaaaaaa

SEQ ID NO: 30841 - DNA, 984 bp, Artificial Sequence
  chemically treated genomic DNA (Homo sapiens) CpG-island No: 30841
cgagtgcgtgtgaaaagaagtcgaagtttttttttcgaggtcgggattattttcgcgggaggcgacgtttttttgcgttaagcgaaggagcgtaggttcggcggtttcgcgtacgttttttttacgtcgtttttttgttttatagggtttggtttatcgtttcgtacgtggtttgttttagttcggttttatttttttcggggttcgttttagggttcgtttcgtttggtcgcgggtttaataattgttttagttgtagcgttaggggttgcggtttcgttatcgttattagttttcggtttatttcgtttcgcgtacgtaaatgtgcggtttaattttcggtttcgaagttttttttttgtcggattttttcgttttgattcgatttttcgatttcgttagagatcgcgcggaggttattttatagttttggatcggttattttcgggaggcgcgcgggagggggcggggtttgcgcgttattgcgggcgttgttagtatgaaggcggaagcgcgtagaaggttgaagggattggagtcgtatgggcgcgtgtgcgcgtgcgcgtgcgagtgcgcgggaaggggcggtgcggaagcgcgttaaggtacgtgatcgtttttgtcgttgagatgcgattgcgatgcgcgcggttagtgtttttttgtataaaatatgtttcgagatttgtgcgagattcgtttaggaataaagtatagcgtagtcgtggtttacggtggttgatttgggaaggaggagggagtagggtttaagttgttcgaatcgcgggtgcgtattcgggtacgtagagattgggatttaaagtaggtttgttatttcgtaatttatagtagtttgaggtcgggtatacgtttttcgttttttagcggttaggatttgggaattttatgttagggatacgtacgtgtaagtgtgtggcggattgttggcgttttttttaatgggaatatttaggaatcgttgtg

SEQ ID NO: 30842 - DNA, 984 bp, Artificial Sequence
  chemically treated genomic DNA (Homo sapiens) CpG-island No: 30842
cacaacgattcctaaatattcccattaaaaaaaacgccaacaatccgccacacacttacacgtacgtatccctaacataaaattcccaaatcctaaccgctaaaaaacgaaaaacgtatacccgacctcaaactactataaattacgaaataacaaacctactttaaatcccaatctctacgtacccgaatacgcacccgcgattcgaacaacttaaaccctactccctcctccttcccaaatcaaccaccgtaaaccacgactacgctatactttattcctaaacgaatctcgcacaaatctcgaaacatattttatacaaaaaaacactaaccgcgcgcatcgcaatcgcatctcaacgacaaaaacgatcacgtaccttaacgcgcttccgcaccgccccttcccgcgcactcgcacgcgcacgcgcacacgcgcccatacgactccaatcccttcaaccttctacgcgcttccgccttcatactaacaacgcccgcaataacgcgcaaaccccgccccctcccgcgcgcctcccgaaaataaccgatccaaaactataaaataacctccgcgcgatctctaacgaaatcgaaaaatcgaatcaaaacgaaaaaatccgacaaaaaaaaaacttcgaaaccgaaaattaaaccgcacatttacgtacgcgaaacgaaataaaccgaaaactaataacgataacgaaaccgcaacccctaacgctacaactaaaacaattattaaacccgcgaccaaacgaaacgaaccctaaaacgaaccccgaaaaaaataaaaccgaactaaaacaaaccacgtacgaaacgataaaccaaaccctataaaacaaaaaaacgacgtaaaaaaaacgtacgcgaaaccgccgaacctacgctccttcgcttaacgcaaaaaaacgtcgcctcccgcgaaaataatcccgacctcgaaaaaaaaacttcgacttcttttcacacgcactcg

SEQ ID NO: 30843 - DNA, 984 bp, Artificial Sequence
  chemically treated genomic DNA (Homo sapiens) CpG-island No: 30843
tatagcgatttttaagtatttttattaagaaagacgttagtagttcgttatatatttatacgtgcgtatttttgatataggatttttaaattttggtcgttgaagggcgggaggcgtgtgttcggttttagattattataaattgcgaaatgataaatttgttttgggttttagtttttgcgtgttcgagtgcgtattcgcgattcgagtagtttaagttttattttttttttttttttaaattagttatcgtgggttacggttacgttatgttttatttttaagcgaatttcgtataaatttcgaggtatattttgtataaggggatattggtcgcgcgtatcgtaatcgtattttagcgatagaagcggttacgtgttttggcgcgttttcgtatcgttttttttcgcgtattcgtacgcgtacgcgtatacgcgtttatacggttttaatttttttaattttttgcgcgttttcgtttttatgttagtaacgttcgtagtgacgcgtaggtttcgttttttttcgcgcgtttttcggaagtggtcggtttagagttgtggggtggttttcgcgcggtttttggcggagtcggggaatcggattaaggcgagaggattcggtagggaaggagtttcggggtcgggggttgggtcgtatatttacgtgcgcgaagcggagtggatcgggagttggtgacgatggcggggtcgtagtttttggcgttgtaattggaatagttgttgaattcgcgattaagcgaggcggattttgaagcggatttcgaggaaggtgaggtcggattggggtaggttacgtgcggagcggtgggttaggttttgtggggtaagggggcggcgtgggaggggcgtgcgcgaggtcgtcgggtttgcgttttttcgtttggcgtagaggaacgtcgtttttcgcgagggtggtttcggtttcgggaggagggtttcggtttttttttatacgtattcg

SEQ ID NO: 30844 - DNA, 984 bp, Artificial Sequence
  chemically treated genomic DNA (Homo sapiens) CpG-island No: 30844
cgaatacgtataaaaaaaaaccgaaaccctcctcccgaaaccgaaaccaccctcgcgaaaaacgacgttcctctacgccaaacgaaaaaacgcaaacccgacgacctcgcgcacgcccctcccacgccgcccccttaccccacaaaacctaacccaccgctccgcacgtaacctaccccaatccgacctcaccttcctcgaaatccgcttcaaaatccgcctcgcttaatcgcgaattcaacaactattccaattacaacgccaaaaactacgaccccgccatcgtcaccaactcccgatccactccgcttcgcgcacgtaaatatacgacccaacccccgaccccgaaactccttccctaccgaatcctctcgccttaatccgattccccgactccgccaaaaaccgcgcgaaaaccaccccacaactctaaaccgaccacttccgaaaaacgcgcgaaaaaaaacgaaacctacgcgtcactacgaacgttactaacataaaaacgaaaacgcgcaaaaaattaaaaaaattaaaaccgtataaacgcgtatacgcgtacgcgtacgaatacgcgaaaaaaaacgatacgaaaacgcgccaaaacacgtaaccgcttctatcgctaaaatacgattacgatacgcgcgaccaatatccccttatacaaaatatacctcgaaatttatacgaaattcgcttaaaaataaaacataacgtaaccgtaacccacgataactaatttaaaaaaaaaaaaaaaataaaacttaaactactcgaatcgcgaatacgcactcgaacacgcaaaaactaaaacccaaaacaaatttatcatttcgcaatttataataatctaaaaccgaacacacgcctcccgcccttcaacgaccaaaatttaaaaatcctatatcaaaaatacgcacgtataaatatataacgaactactaacgtctttcttaataaaaatacttaaaaatcgctata

SEQ ID NO: 30845 - DNA, 570 bp, Artificial Sequence
  chemically treated genomic DNA (Homo sapiens) CpG-island No: 30845
  misc_feature (184)..(184): n is either a, c, g or t
gggggggtgggataggtggttttcgtagttcgttttatcgttgatcgatagcgacgagaagggcgggttgggttcgaagatttcggtcgatatggagtgtagaggttcgggtaggttgggttcggggttgggcgagttttcgggtgggtgcgttaggatgtcggtaaatcgttgcgtttcgttngacgggtggtggttcggtagcgggtgttttaggttatttaggggcgtttcggacggtttagatgacggtacgaagggtaggtttattggtgtttgggtttgcgaggacggggggttttgcgggaagaagtcgtagttgttttcgggttcgtagtattcgttttggtaatttgcggagcggcggggagggcgtaggacgttagggttcggtcgggggggtcggcgggatcgaaagggagggaagacgcgatttcggcgggttgaggaaggttacgcggggaattcgcggatcgcggggagttttcgcgggtttgggtgtagggaggaggttgggcgtaagttcgggagttgttttttattagttattttcgttatttagggtcgtga

SEQ ID NO: 30846 - DNA, 570 bp, Artificial Sequence
  chemically treated genomic DNA (Homo sapiens) CpG-island No: 30846
  misc_feature (387)..(387): n is either a, c, g or t
tcacgaccctaaataacgaaaataactaataaaaaacaactcccgaacttacgcccaacctcctccctacacccaaacccgcgaaaactccccgcgatccgcgaattccccgcgtaaccttcctcaacccgccgaaatcgcgtcttccctccctttcgatcccgccgacccccccgaccgaaccctaacgtcctacgccctccccgccgctccgcaaattaccaaaacgaatactacgaacccgaaaacaactacgacttcttcccgcaaaaccccccgtcctcgcaaacccaaacaccaataaacctacccttcgtaccgtcatctaaaccgtccgaaacgcccctaaataacctaaaacacccgctaccgaaccaccacccgtcnaacgaaacgcaacgatttaccgacatcctaacgcacccacccgaaaactcgcccaaccccgaacccaacctacccgaacctctacactccatatcgaccgaaatcttcgaacccaacccgcccttctcgtcgctatcgatcaacgataaaacgaactacgaaaaccacctatcccaccccccc

SEQ ID NO: 30847 - DNA, 570 bp, Artificial Sequence
  chemically treated genomic DNA (Homo sapiens) CpG-island No: 30847
  misc_feature (387)..(387): n is either a, c, g or t
ttacggttttgaataacgggggtagttggtaaggggtagttttcgggtttgcgtttagttttttttttgtatttaggttcgcgagggtttttcgcgattcgcgagtttttcgcgtggttttttttagttcgtcgaggtcgcgttttttttttttttcggtttcgtcggttttttcggtcgggttttgacgttttgcgtttttttcgtcgtttcgtagattattagagcgagtattacgggttcgggggtaattacgattttttttcgtaaggtttttcgttttcgtaggtttagatattagtggatttatttttcgtgtcgttatttgggtcgttcgggacgtttttgggtggtttggagtattcgttgtcgggttattattcgttnagcgaggcgtagcggtttatcgatattttggcgtatttattcggggattcgtttagtttcgagtttagtttgttcgggtttttgtattttatgtcggtcgaggttttcggatttagttcgtttttttcgtcgttgtcggttaacggtggggcgagttacggaaattatttgttttattttttt

SEQ ID NO: 30848 - DNA, 570 bp, Artificial Sequence
  chemically treated genomic DNA (Homo sapiens) CpG-island No: 30848
  misc_feature (184)..(184): n is either a, c, g or t
aaaaaaataaaacaaataatttccgtaactcgccccaccgttaaccgacaacgacgaaaaaaacgaactaaatccgaaaacctcgaccgacataaaatacaaaaacccgaacaaactaaactcgaaactaaacgaatccccgaataaatacgccaaaatatcgataaaccgctacgcctcgctnaacgaataataacccgacaacgaatactccaaaccacccaaaaacgtcccgaacgacccaaataacgacacgaaaaataaatccactaatatctaaacctacgaaaacgaaaaaccttacgaaaaaaaatcgtaattacccccgaacccgtaatactcgctctaataatctacgaaacgacgaaaaaaacgcaaaacgtcaaaacccgaccgaaaaaaccgacgaaaccgaaaaaaaaaaaaaacgcgacctcgacgaactaaaaaaaaccacgcgaaaaactcgcgaatcgcgaaaaaccctcgcgaacctaaatacaaaaaaaaaactaaacgcaaacccgaaaactaccccttaccaactacccccgttattcaaaaccgtaa

SEQ ID NO: 30849 - DNA, 683 bp, Artificial Sequence
  chemically treated genomic DNA (Homo sapiens) CpG-island No: 30849
cgatgcgtagattagacggaagttgaaacgggggaaatgttcggggaagcggagtcgtagtgaatttgggttggtagggaatttcgttgtgtagatggaatatttttttcggacgaacggggaagttgttttagagaatttggtttgcgtttcgtggaatcgtggggttttagggttttgttaacgtttttttgttgatttcgttcgtatcgtttagtaattttaaggtttataggtagtttttcgttttgtcgtcggcgttattatgttatggaaatcgaagtcgcggagattcgtagtgcgattcgttggcgttttgttttgattcgtgggtgtcgggattttaacgttttttttatatttttttgtatatatatatgtgggtttttcgttgcgggtcggaggagcgtaggggattagttagtttcggcgcgtcgtcggttttcgtcggtcgtttttagatttcgacgcggggtagggtagaggatggagaaggcggttttgcgatttagggggcgggtttcgcgggttcggattcggtttcgcgttttttttgcggattcggtatttttcggcggaagacgatcggtattcggtaggtttttggtattttcgtaagcgttaaaagtcgtgtggtatggggtttttattttttttattcggatttttaggcgttttttagt

SEQ ID NO: 30850 - DNA, 683 bp, Artificial Sequence
  chemically treated genomic DNA (Homo sapiens) CpG-island No: 30850
actaaaaaacgcctaaaaatccgaataaaaaaaataaaaaccccataccacacgacttttaacgcttacgaaaataccaaaaacctaccgaataccgatcgtcttccgccgaaaaataccgaatccgcaaaaaaaacgcgaaaccgaatccgaacccgcgaaacccgccccctaaatcgcaaaaccgccttctccatcctctaccctaccccgcgtcgaaatctaaaaacgaccgacgaaaaccgacgacgcgccgaaactaactaatcccctacgctcctccgacccgcaacgaaaaacccacatatatatatacaaaaaaatataaaaaaaacgttaaaatcccgacacccacgaatcaaaacaaaacgccaacgaatcgcactacgaatctccgcgacttcgatttccataacataataacgccgacgacaaaacgaaaaactacctataaaccttaaaattactaaacgatacgaacgaaatcaacaaaaaaacgttaacaaaaccctaaaaccccacgattccacgaaacgcaaaccaaattctctaaaacaacttccccgttcgtccgaaaaaaatattccatctacacaacgaaattccctaccaacccaaattcactacgactccgcttccccgaacatttcccccgtttcaacttccgtctaatctacgcatcg

SEQ ID NO: 30851 - DNA, 683 bp, Artificial Sequence
  chemically treated genomic DNA (Homo sapiens) CpG-island No: 30851
gttgggaggcgtttgggggttcgggtggaagaagtggggattttatgttatacggtttttggcgtttgcgggggtgttagaagtttatcgagtatcggtcgtttttcgtcgggaagtgtcgggttcgtaggaggagcgcgaagtcgagttcgagttcgcggagttcgttttttagatcgtagaatcgttttttttattttttgttttgtttcgcgtcggggtttgggagcgatcggcggaggtcggcggcgcgtcggagttgattagttttttacgttttttcggttcgtagcggggagtttatatgtgtatgtgtaagaaggtgtggagaaggcgttagggtttcggtatttacgggttagggtagaacgttaacgagtcgtattgcgggttttcgcggtttcggtttttatgatatggtgacgtcggcggtaaggcggggggttgtttgtgggttttgaggttgttgggcggtgcgggcggagttagtaaaggggcgttggtaaagttttaaaattttacggttttacggagcgtaagttagattttttgaagtagttttttcgttcgttcgaagagggtattttatttgtatagcgggattttttgttagtttaggtttattgcgatttcgttttttcgagtatttttttcgttttagttttcgtttggtttgcgtatcg

SEQ ID NO: 30852 - DNA, 683 bp, Artificial Sequence
  chemically treated genomic DNA (Homo sapiens) CpG-island No: 30852
cgatacgcaaaccaaacgaaaactaaaacgaaaaaaatactcgaaaaaacgaaatcgcaataaacctaaactaacaaaaaatcccgctatacaaataaaataccctcttcgaacgaacgaaaaaactacttcaaaaaatctaacttacgctccgtaaaaccgtaaaattttaaaactttaccaacgcccctttactaactccgcccgcaccgcccaacaacctcaaaacccacaaacaaccccccgccttaccgccgacgtcaccatatcataaaaaccgaaaccgcgaaaacccgcaatacgactcgttaacgttctaccctaacccgtaaataccgaaaccctaacgccttctccacaccttcttacacatacacatataaactccccgctacgaaccgaaaaaacgtaaaaaactaatcaactccgacgcgccgccgacctccgccgatcgctcccaaaccccgacgcgaaacaaaacaaaaaataaaaaaaacgattctacgatctaaaaaacgaactccgcgaactcgaactcgacttcgcgctcctcctacgaacccgacacttcccgacgaaaaacgaccgatactcgataaacttctaacacccccgcaaacgccaaaaaccgtataacataaaatccccacttcttccacccgaacccccaaacgcctcccaac

SEQ ID NO: 30853 - DNA, 1147 bp, Artificial Sequence
  chemically treated genomic DNA (Homo sapiens) CpG-island No: 30853
gcggcggtcgtcggggtggtcgtggtcgtagtcgagggatgtttggttttggaatagtatttcggtgttttgcgcgatgcgcgttatgttgggttagtcggtggtagcgtcgttcgtgtagttgtaggggtagtaggggaagtagatgttgtcgttttagagaaaggcgtttacgaagtgtaggttgttcgcgttttcgtatagtttgaggcgttttagtttttgcgtggttaggttgcgttttttcgtgtttttgagcgcgatggtcgtgtcgtggtcggatgtcgcggggttgtagcggttcgtcgttttcggtttaggtagtacgtaggtggcggttatcgttaggtattagcggttgtttcggttcgcgcggtatattacgtcggtcgtcgagttttgcgggtggtacgatattatttcggtgtcgttgcgtagggagttgcggtttaggttgtttaggggtcgtatttcgtaggcgtttcggtcgaaggtttagtcggtgagtagtagtttttcgaggtcggtcgttttttcgcggtagggtagtagtagtttgttgaagttgttttcgggtcggggtcgcgcggggggcgttagcgagatcggttttgtgtagttgttcgtttggtttcggtataggcgcgagaggttgtgttttaggttgtagtttagttggtttaggtagttgtcgttcgttataaatacgtcgtttttttggttcgtcgcgatggtttcgatggtttgtttcgatcgttatacgggttcgttcgcgtttcggtcgggagtcgttagtgttagtagataggcgagtaggggtagtggcgttgcggggcgcggggggcgcggcggcgttttttttcgggagatttttatggggttgggggggtcgttttcgggtagggcgcgcggcggcgacggcggtttaggcgcgcggtaacggagacgcgggcggcggcggcggcggtttttgcgcgcgttcgggttttcgcggtcgttttattttcgtagttcgtttaggaaggagagcggggagggcggcgcgcggtaggttcgtttcggtagtttgtgtagcggcggtggcggtagtaagttttgcgcgtttcggtatcgtttttttttcgttttttttcgtcggagagttttt

SEQ ID NO: 30854 - DNA, 1147 bp, Artificial Sequence
  chemically treated genomic DNA (Homo sapiens) CpG-island No: 30854
aaaaactctccgacgaaaaaaaacgaaaaaaaaacgataccgaaacgcgcaaaacttactaccgccaccgccgctacacaaactaccgaaacgaacctaccgcgcgccgccctccccgctctccttcctaaacgaactacgaaaataaaacgaccgcgaaaacccgaacgcgcgcaaaaaccgccgccgccgccgcccgcgtctccgttaccgcgcgcctaaaccgccgtcgccgccgcgcgccctacccgaaaacgacccccccaaccccataaaaatctcccgaaaaaaaacgccgccgcgccccccgcgccccgcaacgccactacccctactcgcctatctactaacactaacgactcccgaccgaaacgcgaacgaacccgtataacgatcgaaacaaaccatcgaaaccatcgcgacgaaccaaaaaaacgacgtatttataacgaacgacaactacctaaaccaactaaactacaacctaaaacacaacctctcgcgcctataccgaaaccaaacgaacaactacacaaaaccgatctcgctaacgccccccgcgcgaccccgacccgaaaacaacttcaacaaactactactaccctaccgcgaaaaaacgaccgacctcgaaaaactactactcaccgactaaaccttcgaccgaaacgcctacgaaatacgacccctaaacaacctaaaccgcaactccctacgcaacgacaccgaaataatatcgtaccacccgcaaaactcgacgaccgacgtaatataccgcgcgaaccgaaacaaccgctaatacctaacgataaccgccacctacgtactacctaaaccgaaaacgacgaaccgctacaaccccgcgacatccgaccacgacacgaccatcgcgctcaaaaacacgaaaaaacgcaacctaaccacgcaaaaactaaaacgcctcaaactatacgaaaacgcgaacaacctacacttcgtaaacgcctttctctaaaacgacaacatctacttcccctactacccctacaactacacgaacgacgctaccaccgactaacccaacataacgcgcatcgcgcaaaacaccgaaatactattccaaaaccaaacatccctcgactacgaccacgaccaccccgacgaccgccgc

SEQ ID NO: 30855 - DNA, 1147 bp, Artificial Sequence
  chemically treated genomic DNA (Homo sapiens) CpG-island No: 30855
aggaatttttcggcgaaggagggcgaggaggaaacggtgtcggagcgcgtagggtttgttgtcgttatcgtcgttgtataggttgtcggagcgagtttgtcgcgcgtcgtttttttcgtttttttttttgggcgagttgcggggatggggcggtcgcgggagttcgagcgcgcgtaggaatcgtcgtcgtcgtcgttcgcgttttcgttgtcgcgcgtttgagtcgtcgtcgtcgtcgcgcgttttgttcgggggcggtttttttagttttatggaggtttttcggaggaaggcgtcgtcgcgtttttcgcgtttcgtagcgttattgtttttgttcgtttatttgttggtattggcggttttcggtcggggcgcggacgagttcgtgtggcggtcggagtaagttatcggagttatcgcggcgagttaggaggacggcgtgtttgtggcgagcggtagttgtttggattagttggattatagtttggagtatagtttttcgcgtttgtatcgggattaagcgggtaattgtatagagtcggtttcgttggcgtttttcgcgcggtttcggttcgggagtagttttagtaagttgttgttgttttatcgcgagggggcggtcggtttcggggggttgttgtttatcggttggattttcgatcggggcgtttgcgaggtgcggtttttgggtaatttgagtcgtaattttttgcgtaacggtatcgaggtggtgtcgtgttattcgtagggttcgacggtcggcgtggtgtatcgcgcgggtcggaataatcgttggtatttggcggtggtcgttatttacgtgttgtttgagtcggagacggcgagtcgttgtaatttcgcggtattcgattacgatacggttatcgcgtttaaggatacggaggggcgtagtttggttacgtaggagttggggcgttttaagttgtgcgagggcgcgggtagtttgtatttcgtggacgtttttttttggaacggtagtatttattttttttattatttttataattatacgagcggcgttgttatcggttggtttagtatggcgcgtatcgcgtagagtatcgaggtgttgttttagggttaggtatttttcgattgcggttacggttatttcgacggtcgtcgt

SEQ ID NO: 30856 - DNA, 1147 bp, Artificial Sequence
  chemically treated genomic DNA (Homo sapiens) CpG-island No: 30856
acgacgaccgtcgaaataaccgtaaccgcaatcgaaaaatacctaaccctaaaacaacacctcgatactctacgcgatacgcgccatactaaaccaaccgataacaacgccgctcgtataattataaaaataataaaaaaaataaatactaccgttccaaaaaaaaacgtccacgaaatacaaactacccgcgccctcgcacaacttaaaacgccccaactcctacgtaaccaaactacgcccctccgtatccttaaacgcgataaccgtatcgtaatcgaataccgcgaaattacaacgactcgccgtctccgactcaaacaacacgtaaataacgaccaccgccaaataccaacgattattccgacccgcgcgatacaccacgccgaccgtcgaaccctacgaataacacgacaccacctcgataccgttacgcaaaaaattacgactcaaattacccaaaaaccgcacctcgcaaacgccccgatcgaaaatccaaccgataaacaacaaccccccgaaaccgaccgccccctcgcgataaaacaacaacaacttactaaaactactcccgaaccgaaaccgcgcgaaaaacgccaacgaaaccgactctatacaattacccgcttaatcccgatacaaacgcgaaaaactatactccaaactataatccaactaatccaaacaactaccgctcgccacaaacacgccgtcctcctaactcgccgcgataactccgataacttactccgaccgccacacgaactcgtccgcgccccgaccgaaaaccgccaataccaacaaataaacgaacaaaaacaataacgctacgaaacgcgaaaaacgcgacgacgccttcctccgaaaaacctccataaaactaaaaaaaccgcccccgaacaaaacgcgcgacgacgacgacgactcaaacgcgcgacaacgaaaacgcgaacgacgacgacgacgattcctacgcgcgctcgaactcccgcgaccgccccatccccgcaactcgcccaaaaaaaaaaacgaaaaaaacgacgcgcgacaaactcgctccgacaacctatacaacgacgataacgacaacaaaccctacgcgctccgacaccgtttcctcctcgccctccttcgccgaaaaattcct

SEQ ID NO: 30857 - DNA, 525 bp, Artificial Sequence
  chemically treated genomic DNA (Homo sapiens) CpG-island No: 30857
ttgtggcgcggtcgtaggtcggtttcgtatttatttgtcgttttatcggttttcgttttatttgcgcgtcgtttttttggggcggtttttggcgttttcgttttcgttcgtcgggtttggtttttacgggtcgagtgcgggaagtcggggcggtttatttgtcgcgagcggttgttaggcgcggcgagtttagcgtcgaggcgtttttaaagggcgggatcggcgtttagtaatgttttttaggcgggtgcgttttcgaataaagtcggggtgtacggttttttttcgcgcggttggatttaaagtcgttgttcggggttgttgggtttaagagcggtcgtcgttttttttgtttttttttagaagggttcgcgtgttttcgttgttcgtcgtttaatattcgtttttttttttgtatcgaatatttcgggtttattgacgcgtcgtttttattttaagttttaaatttttaaagtgtaggagataattgttacgttattttgtaaaaaatgttaacgtttgata

SEQ ID NO: 30858 - DNA, 525 bp, Artificial Sequence
  chemically treated genomic DNA (Homo sapiens) CpG-island No: 30858
tatcaaacgttaacattttttacaaaataacgtaacaattatctcctacactttaaaaatttaaaacttaaaataaaaacgacgcgtcaataaacccgaaatattcgatacaaaaaaaaaaacgaatattaaacgacgaacaacgaaaacacgcgaacccttctaaaaaaaaacaaaaaaaacgacgaccgctcttaaacccaacaaccccgaacaacgactttaaatccaaccgcgcgaaaaaaaaccgtacaccccgactttattcgaaaacgcacccgcctaaaaaacattactaaacgccgatcccgccctttaaaaacgcctcgacgctaaactcgccgcgcctaacaaccgctcgcgacaaataaaccgccccgacttcccgcactcgacccgtaaaaaccaaacccgacgaacgaaaacgaaaacgccaaaaaccgccccaaaaaaacgacgcgcaaataaaacgaaaaccgataaaacgacaaataaatacgaaaccgacctacgaccgcgccacaa

SEQ ID NO: 30859 - DNA, 525 bp, Artificial Sequence
  chemically treated genomic DNA (Homo sapiens) CpG-island No: 30859
tattagacgttagtattttttgtagggtgacgtgatagttgttttttgtattttgaaggtttggggtttaggatggagacggcgcgttagtgagttcgaagtgttcggtgtaggaggaagagcgggtgttgggcggcggatagcgggggtacgcgggtttttttggggagaagtaggaggggcggcggtcgtttttggatttagtagtttcgggtagcgattttgggtttagtcgcgcggggagaggtcgtgtatttcgattttgttcgggggcgtattcgtttgaaagatattgttgggcgtcggtttcgttttttggggacgtttcggcgttggattcgtcgcgtttggtagtcgttcgcggtagatgggtcgtttcggtttttcgtattcggttcgtgggaattaggttcggcgggcgggggcgagggcgttaggaatcgttttaggggagcggcgcgtagatggggcgggggtcggtgaggcggtagatgggtgcgaggtcggtttgcggtcgcgttataa

SEQ ID NO: 30860 - DNA, 525 bp, Artificial Sequence
  chemically treated genomic DNA (Homo sapiens) CpG-island No: 30860
ttataacgcgaccgcaaaccgacctcgcacccatctaccgcctcaccgacccccgccccatctacgcgccgctcccctaaaacgattcctaacgccctcgcccccgcccgccgaacctaattcccacgaaccgaatacgaaaaaccgaaacgacccatctaccgcgaacgactaccaaacgcgacgaatccaacgccgaaacgtccccaaaaaacgaaaccgacgcccaacaatatctttcaaacgaatacgcccccgaacaaaatcgaaatacacgacctctccccgcgcgactaaacccaaaatcgctacccgaaactactaaatccaaaaacgaccgccgcccctcctacttctccccaaaaaaacccgcgtacccccgctatccgccgcccaacacccgctcttcctcctacaccgaacacttcgaactcactaacgcgccgtctccatcctaaaccccaaaccttcaaaatacaaaaaacaactatcacgtcaccctacaaaaaatactaacgtctaata

SEQ ID NO: 30861 - DNA, 556 bp, Artificial Sequence
  chemically treated genomic DNA (Homo sapiens) CpG-island No: 30861
tcgaagttggaattttcgggggtcgagggttgtcggttcgggtttcgtttagtatttttaacggcgagattagcgttttgacggtcgaggtgagatttagattcgattattagattatttttatatcgacggggaaacggaggttagagagggcgtgggcgtttgtattattttcgttttatttttgcgggtatttggttatgcgggggtgtttaaggagtttggaaaaagcgttttttcgtcgtgttttttggggaagggggcgttcgttgcgttcggagcggcgttttttttaattcgtcggttttattttttttcgtttttataggcggtatgcgtttttgcggacgatcgtattttgtgtcgttgaagcgttttttttagggatcggcggattttagttatttagggggtaagaggaattacgtgttttgtgggttttttttaacgcgtttcgtcggatttgagggagaataagatcgatcggcggttattgcgtttttaattgtatttagtttggggttgaggttgaggtattggcgaggagagggcgttt

SEQ ID NO: 30862 - DNA, 556 bp, Artificial Sequence
  chemically treated genomic DNA (Homo sapiens) CpG-island No: 30862
aaacgccctctcctcgccaatacctcaacctcaaccccaaactaaatacaattaaaaacgcaataaccgccgatcgatcttattctccctcaaatccgacgaaacgcgttaaaaaaaacccacaaaacacgtaattcctcttaccccctaaataactaaaatccgccgatccctaaaaaaaacgcttcaacgacacaaaatacgatcgtccgcaaaaacgcataccgcctataaaaacgaaaaaaaataaaaccgacgaattaaaaaaaacgccgctccgaacgcaacgaacgcccccttccccaaaaaacacgacgaaaaaacgctttttccaaactccttaaacacccccgcataaccaaatacccgcaaaaataaaacgaaaataatacaaacgcccacgccctctctaacctccgtttccccgtcgatataaaaataatctaataatcgaatctaaatctcacctcgaccgtcaaaacgctaatctcgccgttaaaaatactaaacgaaacccgaaccgacaaccctcgacccccgaaaattccaacttcga

SEQ ID NO: 30863 - DNA, 556 bp, Artificial Sequence
  chemically treated genomic DNA (Homo sapiens) CpG-island No: 30863
gagcgtttttttttcgttagtgttttagttttagttttaggttggatgtagttaagggcgtagtggtcgtcgatcggttttgtttttttttagattcggcgaggcgcgttgggggagatttatagagtacgtaattttttttgttttttggatggttggggttcgtcggtttttgggggaggcgttttagcgatataagatgcgatcgttcgtaggaacgtatgtcgtttgtgaaaacgagaagaaatgagatcggcgggttggaagggacgtcgtttcgagcgtagcgaacgtttttttttttaggaagtacgacgggggagcgttttttttaggttttttaggtattttcgtatagttaggtattcgtaaggatgggacggaagtggtgtaagcgtttacgttttttttggttttcgttttttcgtcggtataaggatgatttagtggtcggatttggattttatttcggtcgttagggcgttgatttcgtcgttgagggtgttgagcggagttcggatcggtagttttcggttttcgggggttttaatttcgg

SEQ ID NO: 30864 - DNA, 556 bp, Artificial Sequence
  chemically treated genomic DNA (Homo sapiens) CpG-island No: 30864
ccgaaattaaaacccccgaaaaccgaaaactaccgatccgaactccgctcaacaccctcaacgacgaaatcaacgccctaacgaccgaaataaaatccaaatccgaccactaaatcatccttataccgacgaaaaaacgaaaaccaaaaaaaacgtaaacgcttacaccacttccgtcccatccttacgaatacctaactatacgaaaatacctaaaaaacctaaaaaaaacgctcccccgtcgtacttcctaaaaaaaaaaacgttcgctacgctcgaaacgacgtcccttccaacccgccgatctcatttcttctcgttttcacaaacgacatacgttcctacgaacgatcgcatcttatatcgctaaaacgcctcccccaaaaaccgacgaaccccaaccatccaaaaaacaaaaaaaattacgtactctataaatctcccccaacgcgcctcgccgaatctaaaaaaaaacaaaaccgatcgacgaccactacgcccttaactacatccaacctaaaactaaaactaaaacactaacgaaaaaaaaacgctc

SEQ ID NO: 30865 - DNA, 814 bp, Artificial Sequence
  chemically treated genomic DNA (Homo sapiens) CpG-island No: 30865
aaagacgcgggagacgcggtatttatcggcgagtagttcgggttaggtcgagttcgcgtttagcgtttcgcgttcgtcgcgttttttatatcgggaattgttcgtatttgttcgatacgtcgggatgcgttgcggggttcgcgacgtcggcgttttttacggcgtcgcgttcgtcgttcgcgagttaggaagttatcgcggtttgcggtttttcgttatcgtcgttcgtttttttttttagggatacggcgagttggttgaaagcgtaaaggagcgagtagaagtcgtaggttatatatagtattacgacgcgtaggtagcgtcgtatcgtttcggtcgcgtttttttttcgtcgtcgtcgtcgcgttcgtttcgacgaattggagcggagggaggggtatcgcgtagtcgcgggcgtaataagttttttattcgtagtcgtcgtcgtcgttttgcgttcgttttttttttttttttttcgtttattatttaggcgagcgtagtcgcggtttcggagtcgaaggattattcgttcggaagtttggatatcgtttttgtcgtcgcgcgtttaagggttagcggtagcgacgtaatttcgtttttttttcgggcgggagggttggacgcgtcggcgtagttcgcgtgggagggacgtagggttggcgcgtagagggtggtgtgagtgcgcggaacgcggcgcgtttgagggttatagttagcgtaggtcgacgcgtaggtgaatgggagttttgtgggtttcgatcgtcgagagagggggagcgaaagttttagggttttggaggtagttgattta

SEQ ID NO: 30866 - DNA, 814 bp, Artificial Sequence
  chemically treated genomic DNA (Homo sapiens) CpG-island No: 30866
taaatcaactacctccaaaaccctaaaactttcgctccccctctctcgacgatcgaaacccacaaaactcccattcacctacgcgtcgacctacgctaactataaccctcaaacgcgccgcgttccgcgcactcacaccaccctctacgcgccaaccctacgtccctcccacgcgaactacgccgacgcgtccaaccctcccgcccgaaaaaaaaacgaaattacgtcgctaccgctaacccttaaacgcgcgacgacaaaaacgatatccaaacttccgaacgaataatccttcgactccgaaaccgcgactacgctcgcctaaataataaacgaaaaaaaaaaaaaaaaaacgaacgcaaaacgacgacgacgactacgaataaaaaacttattacgcccgcgactacgcgatacccctccctccgctccaattcgtcgaaacgaacgcgacgacgacgacgaaaaaaaaacgcgaccgaaacgatacgacgctacctacgcgtcgtaatactatatataacctacgacttctactcgctcctttacgctttcaaccaactcgccgtatccctaaaaaaaaaaacgaacgacgataacgaaaaaccgcaaaccgcgataacttcctaactcgcgaacgacgaacgcgacgccgtaaaaaacgccgacgtcgcgaaccccgcaacgcatcccgacgtatcgaacaaatacgaacaattcccgatataaaaaacgcgacgaacgcgaaacgctaaacgcgaactcgacctaacccgaactactcgccgataaataccgcgtctcccgcgtcttt

SEQ ID NO: 30867 - DNA, 814 bp, Artificial Sequence
  chemically treated genomic DNA (Homo sapiens) CpG-island No: 30867
taggttaattgtttttagagttttgaggttttcgttttttttttttcggcggtcgagatttatagggtttttatttatttgcgcgtcggtttgcgttagttatagtttttaggcgcgtcgcgtttcgcgtatttatattattttttgcgcgttagttttgcgttttttttacgcgaattgcgtcggcgcgtttagttttttcgttcgggggaggggcggggttgcgtcgttgtcgttgatttttgagcgcgcggcggtagaggcggtgtttaggttttcgggcgggtagtttttcggtttcggagtcgcgattgcgttcgtttaggtggtgggcggggagggaaggaagggagcgggcgtaaggcggcggcggcggttgcgggtgaggaatttgttgcgttcgcggttgcgcggtgttttttttttcgttttagttcgtcggggcgggcgcggcggcggcggcgaaggaggagcgcggtcggggcgatgcggcgttatttgcgcgtcgtggtgttgtgtgtggtttgcggtttttgttcgtttttttacgtttttagttagttcgtcgtgtttttggaagaaggaacgggcggcggtggcgggaagtcgtaggtcgcggtggttttttggttcgcgggcggcggacgcggcgtcgtgagaggcgtcggcgtcgcgggtttcgtagcgtatttcggcgtgtcggataggtacgggtagttttcggtgtgggggacgcggcgggcgcggggcgttgggcgcgggttcggtttagttcgggttgttcgtcggtgggtgtcgcgtttttcgcgttttt

SEQ ID NO: 30868 - DNA, 814 bp, Artificial Sequence
  chemically treated genomic DNA (Homo sapiens) CpG-island No: 30868
aaaaacgcgaaaaacgcgacacccaccgacgaacaacccgaactaaaccgaacccgcgcccaacgccccgcgcccgccgcgtcccccacaccgaaaactacccgtacctatccgacacgccgaaatacgctacgaaacccgcgacgccgacgcctctcacgacgccgcgtccgccgcccgcgaaccaaaaaaccaccgcgacctacgacttcccgccaccgccgcccgttccttcttccaaaaacacgacgaactaactaaaaacgtaaaaaaacgaacaaaaaccgcaaaccacacacaacaccacgacgcgcaaataacgccgcatcgccccgaccgcgctcctccttcgccgccgccgccgcgcccgccccgacgaactaaaacgaaaaaaaaaacaccgcgcaaccgcgaacgcaacaaattcctcacccgcaaccgccgccgccgccttacgcccgctcccttccttccctccccgcccaccacctaaacgaacgcaatcgcgactccgaaaccgaaaaactacccgcccgaaaacctaaacaccgcctctaccgccgcgcgctcaaaaatcaacgacaacgacgcaaccccgcccctcccccgaacgaaaaaactaaacgcgccgacgcaattcgcgtaaaaaaaacgcaaaactaacgcgcaaaaaataatataaatacgcgaaacgcgacgcgcctaaaaactataactaacgcaaaccgacgcgcaaataaataaaaaccctataaatctcgaccgccgaaaaaaaaaaaacgaaaacctcaaaactctaaaaacaattaaccta

SEQ ID NO: 30869 - DNA, 553 bp, Artificial Sequence
  chemically treated genomic DNA (Homo sapiens) CpG-island No: 30869
cggtcgcgtagtatttattagtcgtcgcgatcggttttcgtcggattaggttattaattaggtcggagtagtagtttaagaagtcgatgtagaggagtcgcgggtcggttagtttgggcgggggtaggtttcgggttttattcggtagaaatcgtaagggttttgggtttcgtcgtgcgattatggtgacgtcgtttttatttgaggtttggttttagattacgaattataaggaaaattacgacgattattattcgggtttaagcggttagtttttttttttttttttgcgcgtcggatttacgggtacggtatagcgcggtatagcgtttaaacgtttttcggtacgtgttgttgcgggaatcgggtacgaaaagtttcgggttattaagttttattttgttcgttcgttcgcgttaattttttggtgggagtgggatttacgggtttggtaacgcggggtcgaggagtattttaaacgagttaaattgggcgaagattaggagatattgattttttttttttttaatttttttaattagtaatagttttt

SEQ ID NO: 30870 - DNA, 553 bp, Artificial Sequence
  chemically treated genomic DNA (Homo sapiens) CpG-island No: 30870
aaaaactattactaattaaaaaaattaaaaaaaaaaaaaatcaatatctcctaatcttcgcccaatttaactcgtttaaaatactcctcgaccccgcgttaccaaacccgtaaatcccactcccaccaaaaaattaacgcgaacgaacgaacaaaataaaacttaataacccgaaacttttcgtacccgattcccgcaacaacacgtaccgaaaaacgtttaaacgctataccgcgctataccgtacccgtaaatccgacgcgcaaaaaaaaaaaaaaaaactaaccgcttaaacccgaataataatcgtcgtaattttccttataattcgtaatctaaaaccaaacctcaaataaaaacgacgtcaccataatcgcacgacgaaacccaaaacccttacgatttctaccgaataaaacccgaaacctacccccgcccaaactaaccgacccgcgactcctctacatcgacttcttaaactactactccgacctaattaataacctaatccgacgaaaaccgatcgcgacgactaataaatactacgcgaccg

SEQ ID NO: 30871 - DNA, 553 bp, Artificial Sequence
  chemically treated genomic DNA (Homo sapiens) CpG-island No: 30871
agaggttattgttggttgggaaagttgggagaaaagaaaattagtattttttagttttcgtttagtttggttcgtttggggtatttttcgatttcgcgttattaggttcgtgaattttatttttattagagaattagcgcgggcggacgagtaaagtgaaatttagtagttcggaatttttcgtgttcggttttcgtagtaatacgtatcgggaagcgtttgggcgttgtatcgcgttgtgtcgtgttcgtgagttcggcgcgtagaggaggaggagaaagttgatcgtttaggttcgggtagtggtcgtcgtggttttttttgtagttcgtggtttgagattaggttttaagtggaaacggcgttattatgatcgtacggcggaatttagaatttttacggtttttgtcggatgaggttcggagtttgttttcgtttaagttgatcgattcgcggtttttttatatcggttttttgggttattgtttcggtttgattgataatttgattcggcggaggtcgatcgcgacggttggtgagtgttgcgcggtcg

SEQ ID NO: 30872 - DNA, 553 bp, Artificial Sequence
  chemically treated genomic DNA (Homo sapiens) CpG-island No: 30872
cgaccgcgcaacactcaccaaccgtcgcgatcgacctccgccgaatcaaattatcaatcaaaccgaaacaataacccaaaaaaccgatataaaaaaaccgcgaatcgatcaacttaaacgaaaacaaactccgaacctcatccgacaaaaaccgtaaaaattctaaattccgccgtacgatcataataacgccgtttccacttaaaacctaatctcaaaccacgaactacaaaaaaaaccacgacgaccactacccgaacctaaacgatcaactttctcctcctcctctacgcgccgaactcacgaacacgacacaacgcgatacaacgcccaaacgcttcccgatacgtattactacgaaaaccgaacacgaaaaattccgaactactaaatttcactttactcgtccgcccgcgctaattctctaataaaaataaaattcacgaacctaataacgcgaaatcgaaaaataccccaaacgaaccaaactaaacgaaaactaaaaaatactaattttcttttctcccaactttcccaaccaacaataacctct

SEQ ID NO: 30873 - DNA, 613 bp, Artificial Sequence
  chemically treated genomic DNA (Homo sapiens) CpG-island No: 30873
tcggttagcgtgaagtaggggttggttcggcgcgtgttggaggcggcgcggtagtcgttggagcgtgagtagtgtttggcgttgttggcgttgggcgcgcgtttttacgtgggcggcgcggaggagttgtcgcgtcgcgtgggttgttagttgttgtacgtggtcggtcgttattatttcgacgttttcgtcgagttttttagcgcgcgtcgcgtgttgcgtttgttgtagggtggcgtcggtttttcgggttttcgcgcgttcgtttgcgtgtagttgggtttgtagttgttgttcgaggggtttgcggtcgacgaggtgttcgcgttgttgcggcgcgaggtgttgcgtatcgtgtgcgagcgttcgggtttcgcggtttgcgcgtaggtggtacggttgttggttcgttattcgcgttgtgtgttcgacggattttatcgtttgtttttttgttagtagttggtgcgttgtttcggtcgttttcgttgtttagtcgaaggcgaggagggcgtcgtggagtttttagagtaggtttagtaggtgagcgggtttttggcgtagttgtggcgcgtatagttcgtcgttattttgttttgttttaaagagttgt

SEQ ID NO: 30874 - DNA, 613 bp, Artificial Sequence
  chemically treated genomic DNA (Homo sapiens) CpG-island No: 30874
acaactctttaaaacaaaacaaaataacgacgaactatacgcgccacaactacgccaaaaacccgctcacctactaaacctactctaaaaactccacgacgccctcctcgccttcgactaaacaacgaaaacgaccgaaacaacgcaccaactactaacaaaaaaacaaacgataaaatccgtcgaacacacaacgcgaataacgaaccaacaaccgtaccacctacgcgcaaaccgcgaaacccgaacgctcgcacacgatacgcaacacctcgcgccgcaacaacgcgaacacctcgtcgaccgcaaacccctcgaacaacaactacaaacccaactacacgcaaacgaacgcgcgaaaacccgaaaaaccgacgccaccctacaacaaacgcaacacgcgacgcgcgctaaaaaactcgacgaaaacgtcgaaataataacgaccgaccacgtacaacaactaacaacccacgcgacgcgacaactcctccgcgccgcccacgtaaaaacgcgcgcccaacgccaacaacgccaaacactactcacgctccaacgactaccgcgccgcctccaacacgcgccgaaccaacccctacttcacgctaaccga

SEQ ID NO: 30875 - DNA, 613 bp, Artificial Sequence
  chemically treated genomic DNA (Homo sapiens) CpG-island No: 30875
atagttttttgaggtagggtaggatggcggcgggttgtgcgcgttatagttgcgttaggagttcgtttatttgttgggtttgttttaggaattttacggcgtttttttcgttttcggttgggtagcggaagcggtcgaggtaacgtattagttgttggtagaagagtaggcggtggggttcgtcgggtatatagcgcgggtggcgagttagtagtcgtgttatttgcgcgtaggtcgcggggttcgggcgttcgtatacggtgcgtagtatttcgcgtcgtagtagcgcgaatatttcgtcggtcgtaggtttttcgggtagtagttgtagatttagttgtacgtaggcgagcgcgcgggggttcggggggtcggcgttattttgtagtaggcgtagtacgcgacgcgcgttgaagaattcggcgaagacgtcggggtggtggcggtcggttacgtgtagtagttggtagtttacgcggcgcggtagttttttcgcgtcgtttacgtagaggcgcgcgtttagcgttagtagcgttaggtattgtttacgttttagcggttgtcgcgtcgtttttagtacgcgtcgaattagtttttgttttacgttgatcgg

SEQ ID NO: 30876 - DNA, 613 bp, Artificial Sequence
  chemically treated genomic DNA (Homo sapiens) CpG-island No: 30876
ccgatcaacgtaaaacaaaaactaattcgacgcgtactaaaaacgacgcgacaaccgctaaaacgtaaacaatacctaacgctactaacgctaaacgcgcgcctctacgtaaacgacgcgaaaaaactaccgcgccgcgtaaactaccaactactacacgtaaccgaccgccaccaccccgacgtcttcgccgaattcttcaacgcgcgtcgcgtactacgcctactacaaaataacgccgaccccccgaacccccgcgcgctcgcctacgtacaactaaatctacaactactacccgaaaaacctacgaccgacgaaatattcgcgctactacgacgcgaaatactacgcaccgtatacgaacgcccgaaccccgcgacctacgcgcaaataacacgactactaactcgccacccgcgctatatacccgacgaaccccaccgcctactcttctaccaacaactaatacgttacctcgaccgcttccgctacccaaccgaaaacgaaaaaaacgccgtaaaattcctaaaacaaacccaacaaataaacgaactcctaacgcaactataacgcgcacaacccgccgccatcctaccctacctcaaaaaactat

SEQ ID NO: 30877 - DNA, 540 bp, Artificial Sequence
  chemically treated genomic DNA (Homo sapiens) CpG-island No: 30877
gtggtttacgcggttggatatggttttttgtcgtttgcgttcgtttgtcgggttggggtgggggcgttcgggatttttcgtttgaaggtcggtgcgtttcgttcggggttcgttgcgttttaagggtttcggagattttgagttgcggttcgggatagagttgtcggattcgggttgttcggttgagtcgcgtttttcgtcgttcgtttaaggaagtagtgatcgggcggtgatagttgttagggtcgcggtcgtcgtttcgtttttttttttttttcgtagttttagtaggcggggtcgacgagtcgtcgtcgcgtttattcgtgttgtagacgtgtagtttattcgcgatgtttttatttttttttttaaagatgattattagttttcggatggttatcgttcggtgttcgtgtcgggcgcgggggatcggtttcgtgaaggaagaaattcgtttttagttgaggaggttgggagtcgttatttttttaattttcgtttttttgtttataatgtatcgttttcgttttaatcggttgt

SEQ ID NO: 30878 - DNA, 540 bp, Artificial Sequence
  chemically treated genomic DNA (Homo sapiens) CpG-island No: 30878
acaaccgattaaaacgaaaacgatacattataaacaaaaaaacgaaaattaaaaaaataacgactcccaacctcctcaactaaaaacgaatttcttccttcacgaaaccgatcccccgcgcccgacacgaacaccgaacgataaccatccgaaaactaataatcatctttaaaaaaaaaaataaaaacatcgcgaataaactacacgtctacaacacgaataaacgcgacgacgactcgtcgaccccgcctactaaaactacgaaaaaaaaaaaaaaacgaaacgacgaccgcgaccctaacaactatcaccgcccgatcactacttccttaaacgaacgacgaaaaacgcgactcaaccgaacaacccgaatccgacaactctatcccgaaccgcaactcaaaatctccgaaacccttaaaacgcaacgaaccccgaacgaaacgcaccgaccttcaaacgaaaaatcccgaacgcccccaccccaacccgacaaacgaacgcaaacgacaaaaaaccatatccaaccgcgtaaaccac

SEQ ID NO: 30879 - DNA, 540 bp, Artificial Sequence
  chemically treated genomic DNA (Homo sapiens) CpG-island No: 30879
gtagtcggttgaggcgggagcggtgtattgtgggtagaggggcgggggttgggaagatggcggtttttagtttttttaattggaggcgagtttttttttttacggggtcggtttttcgcgttcggtacggatatcgagcggtggttattcgggagttgatgattatttttggagggggaaatgagggtatcgcggatgagttgtacgtttataatacgggtaggcgcggcggcggttcgtcggtttcgtttgttggagttgcggagggggaggggaggcgaggcggcggtcgcggttttgatagttgttatcgttcggttattgtttttttgggcgggcggcggggagcgcggtttagtcgggtagttcgggttcggtagttttgtttcggatcgtagtttaggattttcggggtttttggggcgtaacggatttcgagcggggcgtatcggtttttaggcgggggatttcggacgtttttattttagttcgataggcggacgtaggcgatagaagattatgtttaatcgcgtgggttat

SEQ ID NO: 30880 - DNA, 540 bp, Artificial Sequence
  chemically treated genomic DNA (Homo sapiens) CpG-island No: 30880
ataacccacgcgattaaacataatcttctatcgcctacgtccgcctatcgaactaaaataaaaacgtccgaaatcccccgcctaaaaaccgatacgccccgctcgaaatccgttacgccccaaaaaccccgaaaatcctaaactacgatccgaaacaaaactaccgaacccgaactacccgactaaaccgcgctccccgccgcccgcccaaaaaaacaataaccgaacgataacaactatcaaaaccgcgaccgccgcctcgcctcccctccccctccgcaactccaacaaacgaaaccgacgaaccgccgccgcgcctacccgtattataaacgtacaactcatccgcgataccctcatttccccctccaaaaataatcatcaactcccgaataaccaccgctcgatatccgtaccgaacgcgaaaaaccgaccccgtaaaaaaaaaaactcgcctccaattaaaaaaactaaaaaccgccatcttcccaacccccgcccctctacccacaatacaccgctcccgcctcaaccgactac

SEQ ID NO: 30881 - DNA, 2476 bp, Artificial Sequence
  chemically treated genomic DNA (Homo sapiens) CpG-island No: 30881
  misc_feature (1031)..(1031): n is either a, c, g or t
tatttgcgcgcggttatttttagcgttcgcgtttagggcgggggttcggtcggtgcgcgcgtgcgcgtaattttattaggttttttcgtttatttattttttttttttcgaggtagagcgttttcgaagttaatttatatacgatcggtcggaggtagaacggtagtttttcggcggtcggtcggcgtacgcgttatatcggttcgaatttatcgcgatcgtttatacggttcgcgcgtattcgttagaggggagtacgggacgtgcgtttatcgagagtaggcgggcgttttttttcgcgtgggaggggcgcgtttcgtttcgttttatttaaatcgtttcgaattttatatcgacgagtttttttaggatttacgcgcggatatcgcggcggcgatcggaggagggggcgtcgggggcgggaacgatatattatcgttcggtttcgggtatttgagggataattcggagcgttttaggagtatcgtaagggtttaggcggagtcgacgttcgcgtaaattttttcgagagggtagtacgacgggtcggcggggacggtatttttatcgtcgcggaggggggtcgttcgtaagtcgataattattggaggcgatagcgagggttgtttgtcgcgttagaggatttcgtcggttcgtttcgcgacgtagaaggcggcgggcgggacggcgaggtcgggtcggggttcgtattttacgtttttttatacgtatcgtcggcgggcggggagaggagagacgaggggattttcgcggggcggagcgagaaggacggtttcgttcgttacgaacgttcgtttttcgttcgtcgcggttcggattcggttcgggagagtacgacgttattatatcgattaagaagagtttttcgggagcggaggtcggtcggtcggttagcgagtcgatcggtttcggttaattttttatttcggggaaggggcggcggataatttcgcggagacgagaacgtttgatacgtacggtacggagttagcggggtggggttgtcgcgntcgtttttcgggcgttcgtagcggagagcgtacgggggtacggtggttttcgtcgtttttttcgtcgttttcgggtgggttagagattcggattcgggtcggtatcgggagtcgggacgttcggacgcgcgagagagtagtaggttcgcgggtttcggtaggcggtttaagtaggagcgcggtcggttagtcgggttatcggtaggttagagtttcgcgcgtattcggaggtttaatttttttagcgataggtcgttagaggatagcgtgttagtaataattcggcggtttaaaatgtcgattcggagcgaaagatatatttttttcggggtcgggaggtcgcgttatcgattacgtcgtcggtttaggcgacgcgcgatacggatatttgtttttaaaaacgttattatcgtagttatatacggagcgttcggggttttttggttaattttaggatatacgcgggagtagcgtcgggtcgggggacgttttttcggtcgttcgtgttatacgtagggggtcggttcgtgtttttagagcgggagtcggaagtattttcggtcggttttttttacgatcgggatatacgagggatcgaaggtcggttaggcgcgatttttttggtcgtacgcgcgtttatggagcgtttttcgatttcgtacggggattttttagaaaggatcgcggtagagggatcgcggttcggttcggggatcgtttttcggtattcgggggacgggggcgggatagttttcggttttttacggggattttgaaacgaattcggtcgtcgttttagacggttaggatgagcgcggattcgcgatcgggtcgggaagggggtttttagtttttcgcgttacgcgcggggggttttcgcgggtcgcgggtcgggtttttggagttacggcgcgttggtcgatcgggtcgggtagatttacgttcgtttcgggtttagaagcgtagcgatagttttttttttatataaatttgtacgttagagttgtgatttataagcgacgcgttatagttttggcgttatcgggttagtcgggttgacgatcgcgggtttttcggagttttgtttattttatagcggggacggggttttttttttgtagttgttatcgtagtttcggaagtcgagagtacgattttaaagcggtcgttagatggagttcgataatcgtcgcggacgttagcgagatagattcggttggtagggcggttcgtggatcgcgaaagcgaaatcgtgagtcgagaagtttttttcgaggtcgaaaacgtagtttttttgttttaattttatataaacggtgtttaaaacgcgtttttgtttcgatcgcgatagagttagaagataatttacggcgcgtgggtgtttggagatgtttttttgaagtacggagggagggagggagggagggagggagggagaaagaata

SEQ ID NO: 30882 - DNA, 2476 bp, Artificial Sequence
  chemically treated genomic DNA (Homo sapiens) CpG-island No: 30882
  misc_feature (1446)..(1446): n is either a, c, g or t
tattctttctccctccctccctccctccctccctccctccgtacttcaaaaaaacatctccaaacacccacgcgccgtaaattatcttctaactctatcgcgatcgaaacaaaaacgcgttttaaacaccgtttatataaaattaaaacaaaaaaactacgttttcgacctcgaaaaaaacttctcgactcacgatttcgctttcgcgatccacgaaccgccctaccaaccgaatctatctcgctaacgtccgcgacgattatcgaactccatctaacgaccgctttaaaatcgtactctcgacttccgaaactacgataacaactacaaaaaaaaaaccccgtccccgctataaaataaacaaaactccgaaaaacccgcgatcgtcaacccgactaacccgataacgccaaaactataacgcgtcgcttataaatcacaactctaacgtacaaatttatataaaaaaaaaactatcgctacgcttctaaacccgaaacgaacgtaaatctacccgacccgatcgaccaacgcgccgtaactccaaaaacccgacccgcgacccgcgaaaaccccccgcgcgtaacgcgaaaaactaaaaacccccttcccgacccgatcgcgaatccgcgctcatcctaaccgtctaaaacgacgaccgaattcgtttcaaaatccccgtaaaaaaccgaaaactatcccgcccccgtcccccgaataccgaaaaacgatccccgaaccgaaccgcgatccctctaccgcgatcctttctaaaaaatccccgtacgaaatcgaaaaacgctccataaacgcgcgtacgaccaaaaaaatcgcgcctaaccgaccttcgatccctcgtatatcccgatcgtaaaaaaaaccgaccgaaaatacttccgactcccgctctaaaaacacgaaccgaccccctacgtataacacgaacgaccgaaaaaacgtcccccgacccgacgctactcccgcgtatatcctaaaattaaccaaaaaaccccgaacgctccgtatataactacgataataacgtttttaaaaacaaatatccgtatcgcgcgtcgcctaaaccgacgacgtaatcgataacgcgacctcccgaccccgaaaaaaatatatctttcgctccgaatcgacattttaaaccgccgaattattactaacacgctatcctctaacgacctatcgctaaaaaaattaaacctccgaatacgcgcgaaactctaacctaccgataacccgactaaccgaccgcgctcctacttaaaccgcctaccgaaacccgcgaacctactactctctcgcgcgtccgaacgtcccgactcccgataccgacccgaatccgaatctctaacccacccgaaaacgacgaaaaaaacgacgaaaaccaccgtacccccgtacgctctccgctacgaacgcccgaaaaacgancgcgacaaccccaccccgctaactccgtaccgtacgtatcaaacgttctcgtctccgcgaaattatccgccgccccttccccgaaataaaaaattaaccgaaaccgatcgactcgctaaccgaccgaccgacctccgctcccgaaaaactcttcttaatcgatataataacgtcgtactctcccgaaccgaatccgaaccgcgacgaacgaaaaacgaacgttcgtaacgaacgaaaccgtccttctcgctccgccccgcgaaaatcccctcgtctctcctctccccgcccgccgacgatacgtataaaaaaacgtaaaatacgaaccccgacccgacctcgccgtcccgcccgccgccttctacgtcgcgaaacgaaccgacgaaatcctctaacgcgacaaacaaccctcgctatcgcctccaataattatcgacttacgaacgacccccctccgcgacgataaaaataccgtccccgccgacccgtcgtactaccctctcgaaaaaatttacgcgaacgtcgactccgcctaaacccttacgatactcctaaaacgctccgaattatccctcaaatacccgaaaccgaacgataatatatcgttcccgcccccgacgccccctcctccgatcgccgccgcgatatccgcgcgtaaatcctaaaaaaactcgtcgatataaaattcgaaacgatttaaataaaacgaaacgaaacgcgcccctcccacgcgaaaaaaaacgcccgcctactctcgataaacgcacgtcccgtactcccctctaacgaatacgcgcgaaccgtataaacgatcgcgataaattcgaaccgatataacgcgtacgccgaccgaccgccgaaaaactaccgttctacctccgaccgatcgtatataaattaacttcgaaaacgctctacctcgaaaaaaaaaaaataaataaacgaaaaaacctaataaaattacgcgcacgcgcgcaccgaccgaacccccgccctaaacgcgaacgctaaaaataaccgcgcgcaaata

SEQ ID NO: 30883 - DNA, 2476 bp, Artificial Sequence
  chemically treated genomic DNA (Homo sapiens) CpG-island No: 30883
  misc_feature (1446)..(1446): n is either a, c, g or t
tgtttttttttttttttttttttttttttttttttttttcgtgttttagagaggtatttttaaatatttacgcgtcgtgggttgttttttgattttgtcgcggtcgaggtagagacgcgttttgggtatcgtttgtgtggggttggggtagaggggttgcgttttcggtttcgggaagagtttttcgatttacggtttcgttttcgcggtttacgggtcgttttgttagtcggatttgtttcgttgacgttcgcggcggttgtcgggttttatttggcggtcgttttgagatcgtgttttcggttttcggagttgcggtggtagttgtagagggagggtttcgttttcgttgtgagataggtagagtttcggaaagttcgcggtcgttagttcggttggttcggtggcgttagagttgtggcgcgtcgtttgtgagttatagttttggcgtgtaggtttatgtgggggagaggttgtcgttgcgtttttgggttcgaggcgggcgtgggtttgttcggttcggtcgattagcgcgtcgtagttttagaggttcgattcgcgattcgcggggatttttcgcgcgtggcgcgggaggttggggatttttttttcggttcggtcgcgggttcgcgtttattttggtcgtttgaggcggcggtcgaattcgttttagagttttcgtggggagtcggggattgtttcgttttcgtttttcgggtgtcggggagcggttttcgggtcgggtcgcggtttttttgtcgcgattttttttggagagttttcgtgcggagtcggagagcgttttatgagcgcgcgtgcggttagagaggtcgcgtttggtcggttttcggtttttcgtgtgtttcggtcgtaggaggggtcggtcgaaaatgttttcggttttcgttttggagatacgggtcggttttttgcgtgtggtacgggcggtcgggagggcgtttttcggttcggcgttgttttcgcgtgtgttttggggttgattagagggtttcgggcgtttcgtgtgtggttgcgatggtggcgtttttggggataggtgttcgtgtcgcgcgtcgtttgggtcggcggcgtggtcggtgacgcgatttttcggtttcgggggaggtatatttttcgtttcgagtcggtattttgggtcgtcgggttattgttgatacgttgttttttggcgatttgtcgttggagaggttgggttttcggatgcgcgcggggttttggtttatcggtgattcggttagtcggtcgcgtttttgtttgagtcgtttgtcggggttcgcgggtttgttgttttttcgcgcgttcgagcgtttcgattttcggtgtcggttcgggttcgggtttttgatttattcgggggcggcggggaaggcggcgagggttatcgtgttttcgtgcgtttttcgttgcgggcgttcggggggcggncgcgataattttatttcgttggtttcgtgtcgtgcgtgttaggcgttttcgttttcgcggggttgttcgtcgtttttttttcggagtggggggttggtcggagtcgatcggttcgttggtcggtcggtcggttttcgttttcggggggttttttttgatcgatgtggtgacgtcgtgttttttcgggtcgggttcgagtcgcgacgggcgaggggcggacgttcgtggcgaacgggatcgtttttttcgtttcgtttcgcgggggttttttcgtttttttttttttcgttcgtcggcggtgcgtgtgggaaggcgtggggtgcggatttcggttcgatttcgtcgtttcgttcgtcgttttttgcgtcgcggggcgggtcggcggggttttttgacgcggtagatagttttcgttgtcgtttttagtggttgtcgatttgcgggcggttttttttcgcggcggtgggggtgtcgttttcgtcggttcgtcgtgttgttttttcgggggggtttgcgcgagcgtcggtttcgtttgggtttttgcggtgtttttggagcgtttcgggttgttttttaggtgttcgaggtcgaacggtggtgtgtcgttttcgttttcggcgttttttttttcggtcgtcgtcgcggtgttcgcgcgtgggttttgagggagttcgtcggtgtggggttcgaggcggtttgagtgagacgagacgagacgcgttttttttacgcggggaagggcgttcgtttgttttcggtgagcgtacgtttcgtgtttttttttggcgggtgcgcgcgggtcgtgtgagcgatcgcggtgggttcgggtcggtgtgacgcgtgcgtcggtcggtcgtcgaggggttgtcgttttgttttcgatcggtcgtgtgtgggttgatttcggaggcgttttgtttcggaaggaaggaggtgggtggacgggggggtttggtggggttgcgcgtacgcgcgtatcggtcgggttttcgttttgaacgcgaacgttagaggtggtcgcgcgtaggtg

SEQ ID NO: 30884 - DNA, 2476 bp, Artificial Sequence
  chemically treated genomic DNA (Homo sapiens) CpG-island No: 30884
  misc_feature (1031)..(1031): n is either a, c, g or t
cacctacgcgcgaccacctctaacgttcgcgttcaaaacgaaaacccgaccgatacgcgcgtacgcgcaaccccaccaaacccccccgtccacccacctccttccttccgaaacaaaacgcctccgaaatcaacccacacacgaccgatcgaaaacaaaacgacaacccctcgacgaccgaccgacgcacgcgtcacaccgacccgaacccaccgcgatcgctcacacgacccgcgcgcacccgccaaaaaaaaacacgaaacgtacgctcaccgaaaacaaacgaacgcccttccccgcgtaaaaaaaacgcgtctcgtctcgtctcactcaaaccgcctcgaaccccacaccgacgaactccctcaaaacccacgcgcgaacaccgcgacgacgaccgaaaaaaaaaacgccgaaaacgaaaacgacacaccaccgttcgacctcgaacacctaaaaaacaacccgaaacgctccaaaaacaccgcaaaaacccaaacgaaaccgacgctcgcgcaaacccccccgaaaaaacaacacgacgaaccgacgaaaacgacacccccaccgccgcgaaaaaaaaccgcccgcaaatcgacaaccactaaaaacgacaacgaaaactatctaccgcgtcaaaaaaccccgccgacccgccccgcgacgcaaaaaacgacgaacgaaacgacgaaatcgaaccgaaatccgcaccccacgccttcccacacgcaccgccgacgaacgaaaaaaaaaaaaacgaaaaaacccccgcgaaacgaaacgaaaaaaacgatcccgttcgccacgaacgtccgcccctcgcccgtcgcgactcgaacccgacccgaaaaaacacgacgtcaccacatcgatcaaaaaaaaccccccgaaaacgaaaaccgaccgaccgaccaacgaaccgatcgactccgaccaaccccccactccgaaaaaaaaacgacgaacaaccccgcgaaaacgaaaacgcctaacacgcacgacacgaaaccaacgaaataaaattatcgcgnccgccccccgaacgcccgcaacgaaaaacgcacgaaaacacgataaccctcgccgccttccccgccgcccccgaataaatcaaaaacccgaacccgaaccgacaccgaaaatcgaaacgctcgaacgcgcgaaaaaacaacaaacccgcgaaccccgacaaacgactcaaacaaaaacgcgaccgactaaccgaatcaccgataaaccaaaaccccgcgcgcatccgaaaacccaacctctccaacgacaaatcgccaaaaaacaacgtatcaacaataacccgacgacccaaaataccgactcgaaacgaaaaatatacctcccccgaaaccgaaaaatcgcgtcaccgaccacgccgccgacccaaacgacgcgcgacacgaacacctatccccaaaaacgccaccatcgcaaccacacacgaaacgcccgaaaccctctaatcaaccccaaaacacacgcgaaaacaacgccgaaccgaaaaacgccctcccgaccgcccgtaccacacgcaaaaaaccgacccgtatctccaaaacgaaaaccgaaaacattttcgaccgacccctcctacgaccgaaacacacgaaaaaccgaaaaccgaccaaacgcgacctctctaaccgcacgcgcgctcataaaacgctctccgactccgcacgaaaactctccaaaaaaaatcgcgacaaaaaaaccgcgacccgacccgaaaaccgctccccgacacccgaaaaacgaaaacgaaacaatccccgactccccacgaaaactctaaaacgaattcgaccgccgcctcaaacgaccaaaataaacgcgaacccgcgaccgaaccgaaaaaaaaatccccaacctcccgcgccacgcgcgaaaaatccccgcgaatcgcgaatcgaacctctaaaactacgacgcgctaatcgaccgaaccgaacaaacccacgcccgcctcgaacccaaaaacgcaacgacaacctctcccccacataaacctacacgccaaaactataactcacaaacgacgcgccacaactctaacgccaccgaaccaaccgaactaacgaccgcgaactttccgaaactctacctatctcacaacgaaaacgaaaccctccctctacaactaccaccgcaactccgaaaaccgaaaacacgatctcaaaacgaccgccaaataaaacccgacaaccgccgcgaacgtcaacgaaacaaatccgactaacaaaacgacccgtaaaccgcgaaaacgaaaccgtaaatcgaaaaactcttcccgaaaccgaaaacgcaacccctctaccccaaccccacacaaacgatacccaaaacgcgtctctacctcgaccgcgacaaaatcaaaaaacaacccacgacgcgtaaatatttaaaaatacctctctaaaacacgaaaaaaaaaaaaaaaaaaaaaaaaaaaaaaaaaaaaaca

SEQ ID NO: 30885 - DNA, 513 bp, Artificial Sequence
  chemically treated genomic DNA (Homo sapiens) CpG-island No: 30885
gtagacgtcgtttttgttttattttggttgggtagcgcgtttagtattcggcgcggtttcggatcgtacgttcggagagagttttgagatttgtttatcgtttattcgcggtttttgtcggtcgtttatattttggggcggtttcgagtagtcgagtcggtaggattcggtcgtttcgtatttttgcgaggtttattcggagtcgttgttcgagttggggtcgggacgacgtttcgtcgatcgcgtttgtagcgggtgtcgttgattcgttcgtcgtatttgtagattttgttttagtttagtttttcggtatttttttcgcgtttcgtagtcgttttagttttagtttcgtttcgttttttcggtttcggtttttttcgtttttggttttttttgtttttagcgatgttaatcgtcggttttattattttttgtttcgtatagttttttcgaattcgtttttttttttgtagttttttttttttttttttggcgttttcgttcgggtaggtg

SEQ ID NO: 30886 - DNA, 513 bp, Artificial Sequence
  chemically treated genomic DNA (Homo sapiens) CpG-island No: 30886
cacctacccgaacgaaaacgccaaaaaaaaaaaaaaaaaactacaaaaaaaaaaacgaattcgaaaaaactatacgaaacaaaaaataataaaaccgacgattaacatcgctaaaaacaaaaaaaaccaaaaacgaaaaaaaccgaaaccgaaaaaacgaaacgaaactaaaactaaaacgactacgaaacgcgaaaaaaataccgaaaaactaaactaaaacaaaatctacaaatacgacgaacgaatcaacgacacccgctacaaacgcgatcgacgaaacgtcgtcccgaccccaactcgaacaacgactccgaataaacctcgcaaaaatacgaaacgaccgaatcctaccgactcgactactcgaaaccgccccaaaatataaacgaccgacaaaaaccgcgaataaacgataaacaaatctcaaaactctctccgaacgtacgatccgaaaccgcgccgaatactaaacgcgctacccaaccaaaataaaacaaaaacgacgtctac

SEQ ID NO: 30887 - DNA, 513 bp, Artificial Sequence
  chemically treated genomic DNA (Homo sapiens) CpG-island No: 30887
tatttgttcgggcgggggcgttagaggggaagaggggggattgtagggaaaggggcgggttcggggggattgtgcggggtaggaggtggtggagtcggcggttggtatcgttggaggtagaggggattaggagcgggagaagtcggggtcggaaaggcgaggcggggttggggttggggcggttgcggggcgcgggggagatgtcgaggggttgggttggggtagggtttgtaggtgcggcgggcggattagcggtattcgttgtagacgcggtcggcgaaacgtcgtttcggttttagttcgagtagcggtttcgggtggatttcgtagggatgcggagcggtcggattttgtcgattcgattgttcggggtcgttttagggtgtgggcggtcggtagggatcgcgggtgagcggtgggtaggttttaggatttttttcggacgtgcggttcggggtcgcgtcgggtgttgggcgcgttatttagttaaggtgaggtaggagcggcgtttgt

SEQ ID NO: 30888 - DNA, 513 bp, Artificial Sequence
  chemically treated genomic DNA (Homo sapiens) CpG-island No: 30888
acaaacgccgctcctacctcaccttaactaaataacgcgcccaacacccgacgcgaccccgaaccgcacgtccgaaaaaaatcctaaaacctacccaccgctcacccgcgatccctaccgaccgcccacaccctaaaacgaccccgaacaatcgaatcgacaaaatccgaccgctccgcatccctacgaaatccacccgaaaccgctactcgaactaaaaccgaaacgacgtttcgccgaccgcgtctacaacgaataccgctaatccgcccgccgcacctacaaaccctaccccaacccaacccctcgacatctcccccgcgccccgcaaccgccccaaccccaaccccgcctcgcctttccgaccccgacttctcccgctcctaatcccctctacctccaacgataccaaccgccgactccaccacctcctaccccgcacaatccccccgaacccgcccctttccctacaatcccccctcttcccctctaacgcccccgcccgaacaaata

SEQ ID NO: 30889 - DNA, 619 bp, Artificial Sequence
  chemically treated genomic DNA (Homo sapiens) CpG-island No: 30889
gtcggggaggtgtacgttggtttttggggtcgtttggcggaatgtttttttttttcgtagtggggcggggtttgggggggcgtggtttgtcggcgggtttttgaggtattggggtttcgtggttttcgtcgatttaacgttttttttcgttgtaggcgggtttttggggtacggagcggagcgtattttggcggtgttcgtgcgtattgacgtttagggtcgtttggtgttttacgtggtgtcggtagttacgtttagagtaggggtacgagttcgtagggtcgtttcggttcggatttcgagttttttcggaggtaacgaggaggagtttggtagttattttttttataatgttacggtttttggtcgagatttgtatttgcggttggggtttaacgttcgtttcgtggcgttcggggttattatggagtggtagggcgagaagggtattattcgcgtggagtttttgttcgggagttgtttttacgtcggagacgtggtcggtttattcgaagttttttttgtggcgtttagtaattgcgatgggttggtgagtacgtatttttttagttttttttttttcgttgttttcgtttgggttttggaaaagggttatttg

SEQ ID NO: 30890 - DNA, 619 bp, Artificial Sequence
  chemically treated genomic DNA (Homo sapiens) CpG-island No: 30890
caaataacccttttccaaaacccaaacgaaaacaacgaaaaaaaaaaaactaaaaaaatacgtactcaccaacccatcgcaattactaaacgccacaaaaaaaacttcgaataaaccgaccacgtctccgacgtaaaaacaactcccgaacaaaaactccacgcgaataatacccttctcgccctaccactccataataaccccgaacgccacgaaacgaacgttaaaccccaaccgcaaatacaaatctcgaccaaaaaccgtaacattataaaaaaaataactaccaaactcctcctcgttacctccgaaaaaactcgaaatccgaaccgaaacgaccctacgaactcgtacccctactctaaacgtaactaccgacaccacgtaaaacaccaaacgaccctaaacgtcaatacgcacgaacaccgccaaaatacgctccgctccgtaccccaaaaacccgcctacaacgaaaaaaaacgttaaatcgacgaaaaccacgaaaccccaatacctcaaaaacccgccgacaaaccacgcccccccaaaccccgccccactacgaaaaaaaaaaacattccgccaaacgaccccaaaaaccaacgtacacctccccgac

SEQ ID NO: 30891 - DNA, 619 bp, Artificial Sequence
  chemically treated genomic DNA (Homo sapiens) CpG-island No: 30891
taggtaatttttttttaaaatttaggcgagagtagcggagagaaaggagttagagaagtgcgtatttattagtttatcgtagttgttgagcgttatagaggaggtttcggataggtcggttacgttttcgacgtagagatagttttcgagtaggggttttacgcgggtggtgtttttttcgttttgttattttatagtggtttcgggcgttacgaggcgggcgttgggttttagtcgtaggtgtaggtttcggttaaagatcgtgatattgtagaagaggtgattgttaggttttttttcgttgttttcgggaaagttcggggttcggatcggggcggttttgcgggttcgtatttttgttttggacgtagttgtcgatattacgtgggatattaagcggttttgggcgttagtgcgtacgggtatcgttaggatgcgtttcgtttcgtgttttaggggttcgtttgtaacgggaaggggcgttagatcggcggagattacggagttttagtgttttagagattcgtcggtaagttacgtttttttagatttcgttttattgcgaagggaaggggtatttcgttaggcgattttagaagttagcgtgtattttttcggt

SEQ ID NO: 30892 - DNA, 619 bp, Artificial Sequence
  chemically treated genomic DNA (Homo sapiens) CpG-island No: 30892
accgaaaaaatacacgctaacttctaaaatcgcctaacgaaataccccttcccttcgcaataaaacgaaatctaaaaaaacgtaacttaccgacgaatctctaaaacactaaaactccgtaatctccgccgatctaacgccccttcccgttacaaacgaacccctaaaacacgaaacgaaacgcatcctaacgatacccgtacgcactaacgcccaaaaccgcttaatatcccacgtaatatcgacaactacgtccaaaacaaaaatacgaacccgcaaaaccgccccgatccgaaccccgaactttcccgaaaacaacgaaaaaaaacctaacaatcacctcttctacaatatcacgatctttaaccgaaacctacacctacgactaaaacccaacgcccgcctcgtaacgcccgaaaccactataaaataacaaaacgaaaaaaacaccacccgcgtaaaacccctactcgaaaactatctctacgtcgaaaacgtaaccgacctatccgaaacctcctctataacgctcaacaactacgataaactaataaatacgcacttctctaactcctttctctccgctactctcgcctaaattttaaaaaaaaattaccta

SEQ ID NO: 30893 - DNA, 521 bp, Artificial Sequence
  chemically treated genomic DNA (Homo sapiens) CpG-island No: 30893
ttatcgagtagttcgtattacgtaggtttagtatttttcgtttatcgtaggaaacgtcgcggacggttcggggtgttttgttcggcgttttatttttttcggggtcggggaagcggcgtgattaggaaagttatttcggaatatagtcggattttgcgttattagttggagttcgtcgggattttatttcgcgggttgggcgggggcggattcgggggcggggcggggaggggtcggtttggaaaggcggaagtttttagtttaggggtggttgtagaattcggatttcggagttatacgttttacggagcggggcgtcgggagacggcgggcgagaaaattcggcgttcggaagttcgtgttttttttgacgtaagggttcgagacgtagtcgtcgtcggtcgagcgttcggttagaagcgatattagacggagttttcggagttttttcgtttttatttcgtcgggttttggagtcgtagtttttttagttgtttttttcgtggttatggagtgtttat

SEQ ID NO: 30894 - DNA, 521 bp, Artificial Sequence
  chemically treated genomic DNA (Homo sapiens) CpG-island No: 30894
ataaacactccataaccacgaaaaaaacaactaaaaaaactacgactccaaaacccgacgaaataaaaacgaaaaaactccgaaaactccgtctaatatcgcttctaaccgaacgctcgaccgacgacgactacgtctcgaacccttacgtcaaaaaaaacacgaacttccgaacgccgaattttctcgcccgccgtctcccgacgccccgctccgtaaaacgtataactccgaaatccgaattctacaaccacccctaaactaaaaacttccgcctttccaaaccgacccctccccgccccgcccccgaatccgcccccgcccaacccgcgaaataaaatcccgacgaactccaactaataacgcaaaatccgactatattccgaaataactttcctaatcacgccgcttccccgaccccgaaaaaaataaaacgccgaacaaaacaccccgaaccgtccgcgacgtttcctacgataaacgaaaaatactaaacctacgtaatacgaactactcgataa

SEQ ID NO: 30895 - DNA, 521 bp, Artificial Sequence
  chemically treated genomic DNA (Homo sapiens) CpG-island No: 30895
gtggatattttatggttacgaggagggtagttgggaggattgcggttttaggattcggcgaggtgggggcggaggaatttcggaggtttcgtttggtgtcgtttttagtcgggcgttcggtcgacggcggttgcgtttcgagtttttgcgttaaagaaagtacgggttttcggacgtcgggttttttcgttcgtcgtttttcggcgtttcgtttcgtagaacgtgtaatttcgagattcgggttttgtagttatttttagattggaggttttcgtttttttaggtcggttttttttcgtttcgttttcgggttcgttttcgtttagttcgcggggtggggtttcggcgagttttagttggtggcgtagagttcggttgtgtttcgaagtgatttttttagttacgtcgttttttcggtttcgggaagggtggggcgtcgagtagggtatttcgggtcgttcgcggcgttttttgcggtgggcggaggatattgaatttacgtggtgcggattattcggtgg

SEQ ID NO: 30896 - DNA, 521 bp, Artificial Sequence
  chemically treated genomic DNA (Homo sapiens) CpG-island No: 30896
ccaccgaataatccgcaccacgtaaattcaatatcctccgcccaccgcaaaaaacgccgcgaacgacccgaaataccctactcgacgccccacccttcccgaaaccgaaaaaacgacgtaactaaaaaaatcacttcgaaacacaaccgaactctacgccaccaactaaaactcgccgaaaccccaccccgcgaactaaacgaaaacgaacccgaaaacgaaacgaaaaaaaaccgacctaaaaaaacgaaaacctccaatctaaaaataactacaaaacccgaatctcgaaattacacgttctacgaaacgaaacgccgaaaaacgacgaacgaaaaaacccgacgtccgaaaacccgtactttctttaacgcaaaaactcgaaacgcaaccgccgtcgaccgaacgcccgactaaaaacgacaccaaacgaaacctccgaaattcctccgcccccacctcgccgaatcctaaaaccgcaatcctcccaactaccctcctcgtaaccataaaatatccac

SEQ ID NO: 30897 - DNA, 701 bp, Artificial Sequence
  chemically treated genomic DNA (Homo sapiens) CpG-island No: 30897
cgttttggtgttgtagcggtgagtgcggttacgggtcggtttcgtagcgtattcgaggtcgcggttttgtcgggtttgtcgtttaggggtcgtaggcggtcggcgcgcggattcggggaggggcgagggcgagtcgggttcggcgggttggggagggtacgcgatgaggcgggcgcgtgcgggagcggcggcggtttttttgtttttcgaggttcgacggtcgggttagcgaaggagagggtcgcgaggggcgggagttcgcggaggtttcgagcgcgtgggggtagcggtaggcggggattttggttagttgcgtgcgtttttgtttcgttttgtcgtggtcgggggttgtgttcgttcgtgttgcggggtcgtttgtggggcgggtgttcggttttcgaggggcggtcgtacgtgtggcggggttcgcgtcgcgttttttcgtagatagggcgggaagagcgtcgtttttcgggcgtagttttgtttgggttgcggggcgcgcggggtttttttttttcgtcgaattcggttcgggttttttttttttttttcgtaggttcgggtatttcgaaatttcgagaggcgttgggagttcgggcggcggaggtcggggttttttattcgttagggatggtgaagtttgaaaataggttgcgggttgagaagttcggaggttgagttaatagttgttttggagg

SEQ ID NO: 30898 - DNA, 701 bp, Artificial Sequence
  chemically treated genomic DNA (Homo sapiens) CpG-island No: 30898
cctccaaaacaactattaactcaacctccgaacttctcaacccgcaacctattttcaaacttcaccatccctaacgaataaaaaaccccgacctccgccgcccgaactcccaacgcctctcgaaatttcgaaatacccgaacctacgaaaaaaaaaaaaaaaacccgaaccgaattcgacgaaaaaaaaaaaccccgcgcgccccgcaacccaaacaaaactacgcccgaaaaacgacgctcttcccgccctatctacgaaaaaacgcgacgcgaaccccgccacacgtacgaccgcccctcgaaaaccgaacacccgccccacaaacgaccccgcaacacgaacgaacacaacccccgaccacgacaaaacgaaacaaaaacgcacgcaactaaccaaaatccccgcctaccgctacccccacgcgctcgaaacctccgcgaactcccgcccctcgcgaccctctccttcgctaacccgaccgtcgaacctcgaaaaacaaaaaaaccgccgccgctcccgcacgcgcccgcctcatcgcgtaccctccccaacccgccgaacccgactcgccctcgcccctccccgaatccgcgcgccgaccgcctacgacccctaaacgacaaacccgacaaaaccgcgacctcgaatacgctacgaaaccgacccgtaaccgcactcaccgctacaacaccaaaacg

SEQ ID NO: 30899 - DNA, 701 bp, Artificial Sequence
  chemically treated genomic DNA (Homo sapiens) CpG-island No: 30899
tttttaaagtagttgttggtttagttttcgagttttttagttcgtagtttgtttttaaattttattatttttgacggatgaaagatttcgattttcgtcgttcgagtttttagcgtttttcggggtttcgaggtgttcgagtttgcggagaagggaaaggaaattcgggtcgggttcggcggaggagaggagtttcgcgcgtttcgtagtttagataaagttgcgttcggagagcggcgtttttttcgttttgtttgcggagaagcgcggcgcgggtttcgttatacgtgcggtcgtttttcgggggtcggatattcgttttataggcgatttcgtaatacggacgggtatagttttcggttacggtagggcggggtaagggcgtacgtagttggttagggttttcgtttgtcgttgtttttacgcgttcgaggttttcgcggattttcgtttttcgcggttttttttttcgttggttcggtcgtcgggtttcgggaaataaaggagtcgtcgtcgttttcgtacgcgttcgttttatcgcgtattttttttagttcgtcgggttcggttcgttttcgttttttttcgagttcgcgcgtcggtcgtttgcggtttttagacggtaggttcggtagagtcgcggtttcgggtgcgttgcggggtcggttcgtggtcgtatttatcgttgtagtattaggacg

SEQ ID NO: 30900 - DNA, 701 bp, Artificial Sequence
  chemically treated genomic DNA (Homo sapiens) CpG-island No: 30900
cgtcctaatactacaacgataaatacgaccacgaaccgaccccgcaacgcacccgaaaccgcgactctaccgaacctaccgtctaaaaaccgcaaacgaccgacgcgcgaactcgaaaaaaaacgaaaacgaaccgaacccgacgaactaaaaaaaatacgcgataaaacgaacgcgtacgaaaacgacgacgactcctttatttcccgaaacccgacgaccgaaccaacgaaaaaaaaaaccgcgaaaaacgaaaatccgcgaaaacctcgaacgcgtaaaaacaacgacaaacgaaaaccctaaccaactacgtacgcccttaccccgccctaccgtaaccgaaaactatacccgtccgtattacgaaatcgcctataaaacgaatatccgacccccgaaaaacgaccgcacgtataacgaaacccgcgccgcgcttctccgcaaacaaaacgaaaaaaacgccgctctccgaacgcaactttatctaaactacgaaacgcgcgaaactcctctcctccgccgaacccgacccgaatttcctttcccttctccgcaaactcgaacacctcgaaaccccgaaaaacgctaaaaactcgaacgacgaaaatcgaaatctttcatccgtcaaaaataataaaatttaaaaacaaactacgaactaaaaaactcgaaaactaaaccaacaactactttaaaaa

SEQ ID NO: 30901 - DNA, 559 bp, Artificial Sequence
  chemically treated genomic DNA (Homo sapiens) CpG-island No: 30901
gtttattaggaagtcgtcgttcgttatgatcgcgtagtcgcgcgttatttgtattggggtgaaggacgttgaatttagcgttagcgattcggtgtggataatgttttgtgtcgggaagtcgaagcgttgtagatattttgtagcgtagtcgacgtttatcgttcgtattgcgcgtattattattacgtttttcgattgatttagtttttgacgtaagcgaattggattagtatattgcggtggtgagtttttcggttgttagttagaatcggtatttgtattttagcgagaaattggtatatcgtttaatatatttgttagcgttagatttttatttatcgtcgcggtgtaaaggaacggtttgatgttggaatttatttgacgtagtgtttgggtggcgcggttaaatttgttttgattgaaattaaagttatcgattagcgttataacggtatcgttttgcggattgatcgatattagcgtcgagtttatttttcggtaatttgtgttagtttatttattggttattttcggggtttttaattgacgattagaatgt

SEQ ID NO: 30902 - DNA, 559 bp, Artificial Sequence
  chemically treated genomic DNA (Homo sapiens) CpG-island No: 30902
acattctaatcgtcaattaaaaaccccgaaaataaccaataaataaactaacacaaattaccgaaaaataaactcgacgctaatatcgatcaatccgcaaaacgataccgttataacgctaatcgataactttaatttcaatcaaaacaaatttaaccgcgccacccaaacactacgtcaaataaattccaacatcaaaccgttcctttacaccgcgacgataaataaaaatctaacgctaacaaatatattaaacgatataccaatttctcgctaaaatacaaataccgattctaactaacaaccgaaaaactcaccaccgcaatatactaatccaattcgcttacgtcaaaaactaaatcaatcgaaaaacgtaataataatacgcgcaatacgaacgataaacgtcgactacgctacaaaatatctacaacgcttcgacttcccgacacaaaacattatccacaccgaatcgctaacgctaaattcaacgtccttcaccccaatacaaataacgcgcgactacgcgatcataacgaacgacgacttcctaataaac

SEQ ID NO: 30903 - DNA, 559 bp, Artificial Sequence
  chemically treated genomic DNA (Homo sapiens) CpG-island No: 30903
gtattttggtcgttagttgggggtttcgaaaatggttaatgggtgggttggtataagttgtcggaaagtgaattcggcgttggtgtcgattaattcgtaaaacggtgtcgttatggcgttggtcggtggttttgattttaattagagtaagtttaatcgcgttatttaggtattgcgttaggtgggttttaatattaaatcgtttttttatatcgcggcgatggataaaggtttgacgttggtaagtatgttgaacgatgtgttaatttttcgttgggatgtaagtgtcggttttgattggtagtcgaagaatttattatcgtagtatgttggtttaattcgtttacgttaggggttgggttagtcgaaaaacgtggtgatggtacgcgtaatgcgggcgatgggcgtcgattacgttgtagaatatttgtaacgtttcggtttttcggtataaaatattgtttatatcgaatcgttggcgttgggtttagcgttttttattttaatgtaggtggcgcgcggttacgcggttatggcgaacggcggttttttggtggat

SEQ ID NO: 30904 - DNA, 559 bp, Artificial Sequence
  chemically treated genomic DNA (Homo sapiens) CpG-island No: 30904
atccaccaaaaaaccgccgttcgccataaccgcgtaaccgcgcgccacctacattaaaataaaaaacgctaaacccaacgccaacgattcgatataaacaatattttataccgaaaaaccgaaacgttacaaatattctacaacgtaatcgacgcccatcgcccgcattacgcgtaccatcaccacgtttttcgactaacccaacccctaacgtaaacgaattaaaccaacatactacgataataaattcttcgactaccaatcaaaaccgacacttacatcccaacgaaaaattaacacatcgttcaacatacttaccaacgtcaaacctttatccatcgccgcgatataaaaaaacgatttaatattaaaacccacctaacgcaatacctaaataacgcgattaaacttactctaattaaaatcaaaaccaccgaccaacgccataacgacaccgttttacgaattaatcgacaccaacgccgaattcactttccgacaacttataccaacccacccattaaccattttcgaaacccccaactaacgaccaaaatac

SEQ ID NO: 30905 - DNA, 656 bp, Artificial Sequence
  chemically treated genomic DNA (Homo sapiens) CpG-island No: 30905
aatgcgatataacgtggcgggaggagtttaagggacgaggaaaggcgagtgttttgtttgcgtagacgtaaggttgggtattttttcgggagtgagggttgttgggtttgatgacgtggtttggtaacgtttttatcgtcgttgtttttcgggaatttggcgtcgtcggaattgatcgcggtttagtttcgacgcgtgtgtgttagtgagtcggagtcggcgacggcggtagtggcggttcggtttgtaggagttcgacggggtttttgttatgggggagtgacgcgtttgtattcgttgtttcgcggtagcggcgagatatgaggagatttcgcgataggggtagcggcggcggttcgtgagtttcgggatggaggagaaatacggcggggacgtgttggtcggtttcggcggcggcggcggttttgggtcggtggacgtatttagcgttcggtaagggatcgattcggaaggtagcgatcggtcgggtggtttaggatgtatttttttcggttttttttcggttttcgttgatagttcgggacgtttcggggtcggcgcgttttttttttttgtttgtttttttgcgcgtaggttgttttcgggtttttcgggtttttcgggtgtttgttgtagaaggaaggcgttaaagttaa

SEQ ID NO: 30906 - DNA, 656 bp, Artificial Sequence
  chemically treated genomic DNA (Homo sapiens) CpG-island No: 30906
ttaactttaacgccttccttctacaacaaacacccgaaaaacccgaaaaacccgaaaacaacctacgcgcaaaaaaacaaacaaaaaaaaaaaacgcgccgaccccgaaacgtcccgaactatcaacgaaaaccgaaaaaaaaccgaaaaaaatacatcctaaaccacccgaccgatcgctaccttccgaatcgatcccttaccgaacgctaaatacgtccaccgacccaaaaccgccgccgccgccgaaaccgaccaacacgtccccgccgtatttctcctccatcccgaaactcacgaaccgccgccgctacccctatcgcgaaatctcctcatatctcgccgctaccgcgaaacaacgaatacaaacgcgtcactcccccataacaaaaaccccgtcgaactcctacaaaccgaaccgccactaccgccgtcgccgactccgactcactaacacacacgcgtcgaaactaaaccgcgatcaattccgacgacgccaaattcccgaaaaacaacgacgataaaaacgttaccaaaccacgtcatcaaacccaacaaccctcactcccgaaaaaatacccaaccttacgtctacgcaaacaaaacactcgcctttcctcgtcccttaaactcctcccgccacgttatatcgcatt

SEQ ID NO: 30907 - DNA, 656 bp, Artificial Sequence
  chemically treated genomic DNA (Homo sapiens) CpG-island No: 30907
ttggttttagcgttttttttttgtagtaggtattcgaagagttcggggagttcggaggtagtttgcgcgtagggaggtaggtagagggagagggcgcgtcgatttcgggacgtttcgggttgttagcggagatcggagggaggtcggagaaagtgtattttgagttattcggtcggtcgttgtttttcggatcggttttttatcgagcgttgggtacgtttatcggtttaaggtcgtcgtcgtcgtcggggtcggttagtacgttttcgtcgtattttttttttatttcggggtttacgagtcgtcgtcgttgtttttgtcgcggggtttttttatgtttcgtcgttgtcgcggaatagcgggtgtaggcgcgttatttttttatggtagagatttcgtcgggtttttgtaggtcgggtcgttattgtcgtcgtcgtcggtttcggtttattagtatatacgcgtcgggattaggtcgcgattagtttcggcggcgttaggttttcgggaagtagcggcggtagggacgttgttaagttacgttattaggtttagtaatttttattttcgggggagtgtttagttttgcgtttgcgtaagtagaatattcgttttttttcgttttttaggtttttttcgttacgttgtgtcgtatt

SEQ ID NO: 30908 - DNA, 656 bp, Artificial Sequence
  chemically treated genomic DNA (Homo sapiens) CpG-island No: 30908
aatacgacacaacgtaacgaaaaaaacctaaaaaacgaaaaaaaacgaatattctacttacgcaaacgcaaaactaaacactcccccgaaaataaaaattactaaacctaataacgtaacttaacaacgtccctaccgccgctacttcccgaaaacctaacgccgccgaaactaatcgcgacctaatcccgacgcgtatatactaataaaccgaaaccgacgacgacgacaataacgacccgacctacaaaaacccgacgaaatctctaccataaaaaaataacgcgcctacacccgctattccgcgacaacgacgaaacataaaaaaaccccgcgacaaaaacaacgacgacgactcgtaaaccccgaaataaaaaaaaaatacgacgaaaacgtactaaccgaccccgacgacgacgacgaccttaaaccgataaacgtacccaacgctcgataaaaaaccgatccgaaaaacaacgaccgaccgaataactcaaaatacactttctccgacctccctccgatctccgctaacaacccgaaacgtcccgaaatcgacgcgccctctccctctacctacctccctacgcgcaaactacctccgaactccccgaactcttcgaatacctactacaaaaaaaaaacgctaaaaccaa

SEQ ID NO: 30909 - DNA, 714 bp, Artificial Sequence
  chemically treated genomic DNA (Homo sapiens) CpG-island No: 30909
agtacgcggggttagttgttcgattattttcgagattttgaagggatagtgggttagatttagggttcgtttttttttacgtttcgttatcgtttttttttcgattggttgatcgggggtattatagttaattttagacggcgattggttaggttatcgttagggtcgttttattcgtatacgtttaagattaataaggttttggcggaggagcgggggatttcggtagtaggtataggatttatttgttaagatgttgtacggttgtcgtaaggttcgaattttcggcgtcggatttattttattgttcggtttaataggtttaaagttttatttttatatatattcgcgggcgtcgttattggtttttcgtagaggcgcggttatcgttttgtttttgttatcgtttttatttttcgacgtcgtcgttatagttagtatcgtttttatcgtttaagatgcggaaacgcgataaattgttttatttgaacgattttattagtagacgttattttgttgtttattatgattttcgagaaggggtagttttcggggcgcgagcgagtcgcggcgattattggagtttcgggtagttgtgggcggtgttttttcggacgttacggaggcggagatcggattgggttttttttcgtcgtggggttggtttcgttttttgtgtttgatttcgtttattttttttttttattaggattt

SEQ ID NO: 30910 - DNA, 714 bp, Artificial Sequence
  chemically treated genomic DNA (Homo sapiens) CpG-island No: 30910
aaatcctaataaaaaaaaaaaataaacgaaatcaaacacaaaaaacgaaaccaaccccacgacgaaaaaaaacccaatccgatctccgcctccgtaacgtccgaaaaaacaccgcccacaactacccgaaactccaataatcgccgcgactcgctcgcgccccgaaaactaccccttctcgaaaatcataataaacaacaaaataacgtctactaataaaatcgttcaaataaaacaatttatcgcgtttccgcatcttaaacgataaaaacgatactaactataacgacgacgtcgaaaaataaaaacgataacaaaaacaaaacgataaccgcgcctctacgaaaaaccaataacgacgcccgcgaatatatataaaaataaaactttaaacctattaaaccgaacaataaaataaatccgacgccgaaaattcgaaccttacgacaaccgtacaacatcttaacaaataaatcctatacctactaccgaaatcccccgctcctccgccaaaaccttattaatcttaaacgtatacgaataaaacgaccctaacgataacctaaccaatcgccgtctaaaattaactataatacccccgatcaaccaatcgaaaaaaaaacgataacgaaacgtaaaaaaaaacgaaccctaaatctaacccactatcccttcaaaatctcgaaaataatcgaacaactaaccccgcgtact

SEQ ID NO: 30911 - DNA, 714 bp, Artificial Sequence
  chemically treated genomic DNA (Homo sapiens) CpG-island No: 30911
ggattttagtagggagaaggggtgggcggggttaggtatagggggcggagttagttttacggcggaggagagtttagttcggttttcgttttcgtgacgttcggggaagtatcgtttatagttgttcgggattttagtgatcgtcgcggttcgttcgcgtttcggaaattgttttttttcgggggttatgatgggtagtaagatggcgtttgttagtagggtcgtttaggtaaagtaatttgtcgcgttttcgtattttgggcggtagggacggtgttgattatggcgacggcgtcggggagtaaaggcggtggtagaggtagagcggtgatcgcgtttttgcggagggttagtgacggcgttcgcgggtgtgtgtgaggatgggattttgagtttgttggatcgggtagtgaggtgggttcggcgtcgagggttcgagttttgcggtaatcgtgtagtattttggtaggtaggttttgtatttattgtcgggatttttcgttttttcgttaggattttgttagttttaggcgtgtgcgggtgaggcgattttggcggtagtttggttaatcgtcgtttaggattggttgtggtgttttcgattagttaatcggaaggaaggcggtagcggggcgtggaaggaagcgaattttggatttgatttattgtttttttaaggtttcgggaatggtcgggtaattggtttcgcgtatt

SEQ ID NO: 30912 - DNA, 714 bp, Artificial Sequence
  chemically treated genomic DNA (Homo sapiens) CpG-island No: 30912
aatacgcgaaaccaattacccgaccattcccgaaaccttaaaaaaacaataaatcaaatccaaaattcgcttccttccacgccccgctaccgccttccttccgattaactaatcgaaaacaccacaaccaatcctaaacgacgattaaccaaactaccgccaaaatcgcctcacccgcacacgcctaaaactaacaaaatcctaacgaaaaaacgaaaaatcccgacaataaatacaaaacctacctaccaaaatactacacgattaccgcaaaactcgaaccctcgacgccgaacccacctcactacccgatccaacaaactcaaaatcccatcctcacacacacccgcgaacgccgtcactaaccctccgcaaaaacgcgatcaccgctctacctctaccaccgcctttactccccgacgccgtcgccataatcaacaccgtccctaccgcccaaaatacgaaaacgcgacaaattactttacctaaacgaccctactaacaaacgccatcttactacccatcataacccccgaaaaaaaacaatttccgaaacgcgaacgaaccgcgacgatcactaaaatcccgaacaactataaacgatacttccccgaacgtcacgaaaacgaaaaccgaactaaactctcctccgccgtaaaactaactccgccccctatacctaaccccgcccaccccttctccctactaaaatcc

SEQ ID NO: 30913 - DNA, 524 bp, Artificial Sequence
  chemically treated genomic DNA (Homo sapiens) CpG-island No: 30913
tcgttttggttttgtcgcggcggcggggagaagagggtgggacggtttgattttcgtagttaatgaaagtagtgagtttttggttcgatatttagcgcgattttttagtggttatttttcgggtaacgggttacggattttcggtatttcgagataattgttaggcggagggtgagtttcggtttttgggcggcgggtgcggattgggatgggcgcggagttaggtggcgtgagtttgtagtttttcgtgttcggagtgcgcgcgttatagtggagttcgtcgcgtcgttgatcgggtgcgcgttgttttttttgttttgggtgcgcgggaaggggttgggtgttcgcgcgttttttttttttgtcgtttttggtattttttatatttattaacgtttgtgcgtcgggtggtgtggaagcgtagtatcgtcggtgggatagttagaaatagaagagtacgtttggcgtggtaggggtttagagttacgggaatacgggtgatagggatagcgggatttaaggta

SEQ ID NO: 30914 - DNA, 524 bp, Artificial Sequence
  chemically treated genomic DNA (Homo sapiens) CpG-island No: 30914
taccttaaatcccgctatccctatcacccgtattcccgtaactctaaacccctaccacgccaaacgtactcttctatttctaactatcccaccgacgatactacgcttccacaccacccgacgcacaaacgttaataaatataaaaaataccaaaaacgacaaaaaaaaaaaacgcgcgaacacccaaccccttcccgcgcacccaaaacaaaaaaaacaacgcgcacccgatcaacgacgcgacgaactccactataacgcgcgcactccgaacacgaaaaactacaaactcacgccacctaactccgcgcccatcccaatccgcacccgccgcccaaaaaccgaaactcaccctccgcctaacaattatctcgaaataccgaaaatccgtaacccgttacccgaaaaataaccactaaaaaatcgcgctaaatatcgaaccaaaaactcactactttcattaactacgaaaatcaaaccgtcccaccctcttctccccgccgccgcgacaaaaccaaaacga

SEQ ID NO: 30915 - DNA, 524 bp, Artificial Sequence
  chemically treated genomic DNA (Homo sapiens) CpG-island No: 30915
tgttttaagtttcgttgtttttgttattcgtgttttcgtggttttgggtttttgttacgttaggcgtgtttttttgtttttggttgttttatcggcgatgttgcgtttttatattattcggcgtataggcgttggtagatgtggaaggtattaagagcggtaggaggaaggggcgcgcggatatttagttttttttcgcgtatttagagtaggaagagtagcgcgtattcggttagcgacgcggcgggttttattgtggcgcgcgtatttcgagtacggagggttgtaggtttacgttatttggtttcgcgtttattttaattcgtattcgtcgtttaggaatcggggtttatttttcgtttgataattgtttcggggtgtcgagggttcgtggttcgttgttcgggaggtgattattgaggagtcgcgttgggtatcggattaggaatttattgtttttattggttgcggaggttagatcgttttattttttttttttcgtcgtcgcggtaaggttagggcga

SEQ ID NO: 30916 - DNA, 524 bp, Artificial Sequence
  chemically treated genomic DNA (Homo sapiens) CpG-island No: 30916
tcgccctaaccttaccgcgacgacgaaaaaaaaaaaataaaacgatctaacctccgcaaccaataaaaacaataaattcctaatccgatacccaacgcgactcctcaataatcacctcccgaacaacgaaccacgaaccctcgacaccccgaaacaattatcaaacgaaaaataaaccccgattcctaaacgacgaatacgaattaaaataaacgcgaaaccaaataacgtaaacctacaaccctccgtactcgaaatacgcgcgccacaataaaacccgccgcgtcgctaaccgaatacgcgctactcttcctactctaaatacgcgaaaaaaaactaaatatccgcgcgccccttcctcctaccgctcttaataccttccacatctaccaacgcctatacgccgaataatataaaaacgcaacatcgccgataaaacaaccaaaaacaaaaaaacacgcctaacgtaacaaaaacccaaaaccacgaaaacacgaataacaaaaacaacgaaacttaaaaca

SEQ ID NO: 30917 - DNA, 589 bp, Artificial Sequence
  chemically treated genomic DNA (Homo sapiens) CpG-island No: 30917
tgcgtttggaaaggcgttcgttcgtggcgcgtattttcgggttttcgtaagcgatttcggtgatagggataatcgtttcggttttagcgattgtagatagattgggacgagacggttggaggtttttttttaagggatgttggaggggttgcgtcgtattttgcgtttggttttggcgcgcggttttaggtcgtggtatttagcgttttatgggtcgtgcgtcggggtttggttatatcgtttgttttcgtttttagtcgcgcgtttcgtgttattgcggttttttgaagtttcgtgttttcgtagtttttttatggttagtttcgttttttttttttgcggtttttgttcgttaggtatttcgaattcgggcgtttgcggaaggggggaggattggaattcgggtttcggtagttcgcgggtttggtcgggcgttttgtcgtcgttttttgtattattttttttcgttttgttttttatttcgtttttagcgaggcgttttttttttttcgtatttttgttcgaaatttggagttttagtttgtaatttttattttttcgaggttttcgttgtttaggtttagtattt

SEQ ID NO: 30918 - DNA, 589 bp, Artificial Sequence
  chemically treated genomic DNA (Homo sapiens) CpG-island No: 30918
aaatactaaacctaaacaacgaaaacctcgaaaaaataaaaattacaaactaaaactccaaatttcgaacaaaaatacgaaaaaaaaaaaacgcctcgctaaaaacgaaataaaaaacaaaacgaaaaaaaataatacaaaaaacgacgacaaaacgcccgaccaaacccgcgaactaccgaaacccgaattccaatcctccccccttccgcaaacgcccgaattcgaaatacctaacgaacaaaaaccgcaaaaaaaaaaaacgaaactaaccataaaaaaactacgaaaacacgaaacttcaaaaaaccgcaataacacgaaacgcgcgactaaaaacgaaaacaaacgatataaccaaaccccgacgcacgacccataaaacgctaaataccacgacctaaaaccgcgcgccaaaaccaaacgcaaaatacgacgcaacccctccaacatcccttaaaaaaaaacctccaaccgtctcgtcccaatctatctacaatcgctaaaaccgaaacgattatccctatcaccgaaatcgcttacgaaaacccgaaaatacgcgccacgaacgaacgcctttccaaacgca

SEQ ID NO: 30919 - DNA, 589 bp, Artificial Sequence
  chemically treated genomic DNA (Homo sapiens) CpG-island No: 30919
gggtgttagatttgggtagcgggaatttcgaagaggtggagattgtaggttgggattttagatttcgggtagggatgcggggaagggaagacgtttcgttggaggcggaatggagggtaaggcgaaggaggatggtgtaggaaacggcgataaggcgttcggttaggttcgcgagttatcgagattcgggttttaatttttttttttttcgtaaacgttcgggttcgaggtatttggcgggtaagggtcgtagaggagagaagcggggttggttatggggaggttgcggggatacggggttttaaaaaatcgtagtggtacggagcgcgcggttggaagcgaaagtaggcggtgtggttaagtttcggcgtacggtttatagggcgttgggtattacgatttggggtcgcgcgttagggttaggcgtagggtacgacgtaatttttttagtattttttggggaggagtttttaatcgtttcgttttagtttgtttgtagtcgttaaaatcgaagcggttgtttttgttatcggggtcgtttgcggaggttcgagaatgcgcgttacgaacgagcgtttttttaagcgta

SEQ ID NO: 30920 - DNA, 589 bp, Artificial Sequence
  chemically treated genomic DNA (Homo sapiens) CpG-island No: 30920
tacgcttaaaaaaacgctcgttcgtaacgcgcattctcgaacctccgcaaacgaccccgataacaaaaacaaccgcttcgattttaacgactacaaacaaactaaaacgaaacgattaaaaactcctccccaaaaaatactaaaaaaattacgtcgtaccctacgcctaaccctaacgcgcgaccccaaatcgtaatacccaacgccctataaaccgtacgccgaaacttaaccacaccgcctactttcgcttccaaccgcgcgctccgtaccactacgattttttaaaaccccgtatccccgcaacctccccataaccaaccccgcttctctcctctacgacccttacccgccaaatacctcgaacccgaacgtttacgaaaaaaaaaaaaattaaaacccgaatctcgataactcgcgaacctaaccgaacgccttatcgccgtttcctacaccatcctccttcgccttaccctccattccgcctccaacgaaacgtcttcccttccccgcatccctacccgaaatctaaaatcccaacctacaatctccacctcttcgaaattcccgctacccaaatctaacaccc

SEQ ID NO: 30921 - DNA, 608 bp, Artificial Sequence
  chemically treated genomic DNA (Homo sapiens) CpG-island No: 30921
ttcgatacggttcgattttaacgatttttatcgtttttttttttttcgtatcgttcgtattggtacgttcggcgtagggttcgttatttgttcggtttgtcgacggttatttttatcgatggtagtcgttttttatatttttttttttcgtatttttttttttttattcgtatttttttttttaatttatcgcgattcgaggggttattcgtttacgtcgacgcgatttcgtacgatttgacgtttttatttcgtttcgtcggcgattttttatttatttttttatcgcgattcgattcgtaacgttattcgtatttgttttcgtatttcgttcgtttaattgttatcgttgtacgtttttattattttttttcgtttattggtcgtcgaattttagttagttttcgacggttttcggatagttattttcgataattcgttattatttcgtcgaatttcggttacgcgaaatacgttaattgtatttgtgttattttcgtttattatttttatcgaattcgttttatcgtatagttcgagtatcgtcgaaatcgtaatttggttttagatcgtatttcgcgcgtttcggtcgattttcgtgcgttacg

SEQ ID NO: 30922 - DNA, 608 bp, Artificial Sequence
  chemically treated genomic DNA (Homo sapiens) CpG-island No: 30922
cgtaacgcacgaaaatcgaccgaaacgcgcgaaatacgatctaaaaccaaattacgatttcgacgatactcgaactatacgataaaacgaattcgataaaaataataaacgaaaataacacaaatacaattaacgtatttcgcgtaaccgaaattcgacgaaataataacgaattatcgaaaataactatccgaaaaccgtcgaaaactaactaaaattcgacgaccaataaacgaaaaaaaataataaaaacgtacaacgataacaattaaacgaacgaaatacgaaaacaaatacgaataacgttacgaatcgaatcgcgataaaaaaataaataaaaaatcgccgacgaaacgaaataaaaacgtcaaatcgtacgaaatcgcgtcgacgtaaacgaataacccctcgaatcgcgataaattaaaaaaaaaaatacgaataaaaaaaaaaaaatacgaaaaaaaaaaatataaaaaacgactaccatcgataaaaataaccgtcgacaaaccgaacaaataacgaaccctacgccgaacgtaccaatacgaacgatacgaaaaaaaaaaaaacgataaaaatcgttaaaatcgaaccgtatcgaa

SEQ ID NO: 30923 - DNA, 608 bp, Artificial Sequence
  chemically treated genomic DNA (Homo sapiens) CpG-island No: 30923
cgtgacgtacgggagtcgatcgaggcgcgcgagatgcgatttggagttagattgcgatttcgacgatattcgagttatgcgatagggcgggttcggtggaggtgatagacgagagtggtataagtgtagttggcgtatttcgcgtagtcggggttcgacgaggtggtggcgagttatcgaaggtgattgttcgggggtcgtcgagggttggttgaggttcgacggttaatagacgagagaagatggtaagagcgtatagcggtagtagttgggcgagcggagtgcggaggtaggtgcgagtagcgttgcgagtcggatcgcggtggagagatgggtgggaggtcgtcgacggggcggggtggagacgttaagtcgtacggggtcgcgtcggcgtgagcgggtggtttttcgagtcgcggtgggttagggaggggagtgcgggtgaagagaggggagtgcgggggaggagggtatggggagcggttgttatcggtggggatggtcgtcggtagatcgagtagatagcgggttttgcgtcgggcgtgttagtgcggacggtgcggagaggagggaagcggtgaggatcgttagagtcgaatcgtgtcgga

SEQ ID NO: 30924 - DNA, 608 bp, Artificial Sequence
  chemically treated genomic DNA (Homo sapiens) CpG-island No: 30924
tccgacacgattcgactctaacgatcctcaccgcttccctcctctccgcaccgtccgcactaacacgcccgacgcaaaacccgctatctactcgatctaccgacgaccatccccaccgataacaaccgctccccataccctcctcccccgcactcccctctcttcacccgcactcccctccctaacccaccgcgactcgaaaaaccacccgctcacgccgacgcgaccccgtacgacttaacgtctccaccccgccccgtcgacgacctcccacccatctctccaccgcgatccgactcgcaacgctactcgcacctacctccgcactccgctcgcccaactactaccgctatacgctcttaccatcttctctcgtctattaaccgtcgaacctcaaccaaccctcgacgacccccgaacaatcaccttcgataactcgccaccacctcgtcgaaccccgactacgcgaaatacgccaactacacttataccactctcgtctatcacctccaccgaacccgccctatcgcataactcgaatatcgtcgaaatcgcaatctaactccaaatcgcatctcgcgcgcctcgatcgactcccgtacgtcacg

SEQ ID NO: 30925 - DNA, 708 bp, Artificial Sequence
  chemically treated genomic DNA (Homo sapiens) CpG-island No: 30925
ttcggtttttttttttttacgttatttcgttttttttatcgttaacgttttattcgttttttatttttaattcgtcggcgtttttattttttttttcgtattggtttttattcgtttattttttcgtttcgaggtttttttattttatttttatattttatttatcgtttttatttttttattataaacgtttttttttttttttcgtttcgcgttaatacgtttatcgtcgtttttttttttttataaatttaggcgtttttcgcgttttttttttattatatattttaagcgcggcgttcggttttatttttataattagttattttcggcgttttttcgtttaatataaatttatcgcgcgttcgtttttttgtcgtttattaatagttcgggcgggtcgcgcgtcgtttttttttattaaatatcgtggtttttcgtttttaattatataacggttttttcgtttttttttttttcgaaaatttacgggttttttttcggttttttttattaattttaatcgttcgttttttttttttattttaataatttagttttcgcgtcgggtcgtttcgtattttttaattagtcgggcgcgtttcgttcgttttattattttcgttttgcgttttcgtttttttttttttttttattattcgcgaaggtttattttcgatggtgtagttttttcgatatgtagatggg

SEQ ID NO: 30926 - DNA, 708 bp, Artificial Sequence
  chemically treated genomic DNA (Homo sapiens) CpG-island No: 30926
cccatctacatatcgaaaaaactacaccatcgaaaataaaccttcgcgaataataaaaaaaaaaaaaaaaacgaaaacgcaaaacgaaaataataaaacgaacgaaacgcgcccgactaattaaaaaatacgaaacgacccgacgcgaaaactaaattattaaaataaaaaaaaaaaacgaacgattaaaattaataaaaaaaaccgaaaaaaaacccgtaaattttcgaaaaaaaaaaaaacgaaaaaaccgttatataattaaaaacgaaaaaccacgatatttaataaaaaaaaacgacgcgcgacccgcccgaactattaataaacgacaaaaaaacgaacgcgcgataaatttatattaaacgaaaaaacgccgaaaataactaattataaaaataaaaccgaacgccgcgcttaaaatatataataaaaaaaaaacgcgaaaaacgcctaaatttataaaaaaaaaaaaacgacgataaacgtattaacgcgaaacgaaaaaaaaaaaaaaacgtttataataaaaaaataaaaacgataaataaaatataaaaataaaataaaaaaacctcgaaacgaaaaaataaacgaataaaaaccaatacgaaaaaaaaaataaaaacgccgacgaattaaaaataaaaaacgaataaaacgttaacgataaaaaaaacgaaataacgtaaaaaaaaaaaaaccgaa

SEQ ID NO: 30927 - DNA, 708 bp, Artificial Sequence
  chemically treated genomic DNA (Homo sapiens) CpG-island No: 30927
tttatttgtatatcgggggggttatattatcgggggtgggttttcgcgggtggtaggggaggggggggaggcggggacgtagggcgggggtggtggggcgggcggggcgcgttcggttggttggggggtgcggggcgattcggcgcgagggttgggttgttggggtggagggggggggcgggcggttggggttagtgaggagggtcgggggggggttcgtgggttttcggggagggggggggcgggggggtcgttgtgtggttgggagcggggggttacggtgtttggtgaggagaggcggcgcgcggttcgttcgagttgttgataggcggtaaggaggcggacgcgcggtgggtttgtgttaggcggggaggcgtcgggggtggttgattgtgagggtggggtcgggcgtcgcgtttgagatgtgtgatgaggggagggcgcgggaggcgtttgggtttgtgggagagggggggcggcggtgggcgtattggcgcggggcgaagggggggggggggcgtttgtagtgggggggtgggggcggtggatggggtgtgggagtggggtgggggggtttcggggcggggaggtaggcgggtgggggttagtgcggggaggggggtgggagcgtcggcgggttgggagtggggggcgggtggggcgttgacggtggggaggacgggatggcgtgaggggagggaggtcggg

SEQ ID NO: 30928 - DNA, 708 bp, Artificial Sequence
  chemically treated genomic DNA (Homo sapiens) CpG-island No: 30928
cccgacctccctcccctcacgccatcccgtcctccccaccgtcaacgccccacccgccccccactcccaacccgccgacgctcccacccccctccccgcactaacccccacccgcctacctccccgccccgaaacccccccaccccactcccacaccccatccaccgcccccacccccccactacaaacgcccccccccccccttcgccccgcgccaatacgcccaccgccgccccccctctcccacaaacccaaacgcctcccgcgccctcccctcatcacacatctcaaacgcgacgcccgaccccaccctcacaatcaaccacccccgacgcctccccgcctaacacaaacccaccgcgcgtccgcctccttaccgcctatcaacaactcgaacgaaccgcgcgccgcctctcctcaccaaacaccgtaaccccccgctcccaaccacacaacgacccccccgccccccccctccccgaaaacccacgaacccccccccgaccctcctcactaaccccaaccgcccgccccccccctccaccccaacaacccaaccctcgcgccgaatcgccccgcaccccccaaccaaccgaacgcgccccgcccgccccaccacccccgccctacgtccccgcctcccccccctcccctaccacccgcgaaaacccacccccgataatataacccccccgatatacaaataaa

SEQ ID NO: 30929 - DNA, 584 bp, Artificial Sequence
  chemically treated genomic DNA (Homo sapiens) CpG-island No: 30929
cgcgggcggcgggtttagttttggggttcgtatttcgttgggttattttttcggtcggagtcgggggggttacgcggtttcggaataaagtttcgcgggaggagttgttttgagtcgacgggtaagcgttagtttttcgcgggttagagcgttacgtgttaggattcgttgaatgcgcggtgtacgggcgtagtaacggtagtcgagtagttttcgtatttattgtcgtttttggagattcgtatagttacgttttttcgaggtcgtcgtcggtcgcgttaacgtttgtgcgtttgcgcgttcgcgaaagtttcgtttttttaggtttttagcgcgcggggtcgcgtttttttatgatcgtcgtcgtagtgtgtggtatttagcgggggcgcgcggcgggttcgaggacgcgcgaaacggcggcggcggcggcggttaggggggagtcggggcggtcgttgcggggcgcgtttttaagaggcggcggcggtttagggtgtttcgtcggtttcggcgtcgggaataggcggtggcgttgttcgcggtggcgggggttgtagacggagcgtgttggtattaggatt

SEQ ID NO: 30930 - DNA, 584 bp, Artificial Sequence
  chemically treated genomic DNA (Homo sapiens) CpG-island No: 30930
aatcctaataccaacacgctccgtctacaacccccgccaccgcgaacaacgccaccgcctattcccgacgccgaaaccgacgaaacaccctaaaccgccgccgcctcttaaaaacgcgccccgcaacgaccgccccgactcccccctaaccgccgccgccgccgccgtttcgcgcgtcctcgaacccgccgcgcgcccccgctaaataccacacactacgacgacgatcataaaaaaacgcgaccccgcgcgctaaaaacctaaaaaaacgaaactttcgcgaacgcgcaaacgcacaaacgttaacgcgaccgacgacgacctcgaaaaaacgtaactatacgaatctccaaaaacgacaataaatacgaaaactactcgactaccgttactacgcccgtacaccgcgcattcaacgaatcctaacacgtaacgctctaacccgcgaaaaactaacgcttacccgtcgactcaaaacaactcctcccgcgaaactttattccgaaaccgcgtaacccccccgactccgaccgaaaaaataacccaacgaaatacgaaccccaaaactaaacccgccgcccgcg

SEQ ID NO: 30931 - DNA, 584 bp, Artificial Sequence
  chemically treated genomic DNA (Homo sapiens) CpG-island No: 30931
ggttttggtattaatacgtttcgtttataattttcgttatcgcgggtagcgttatcgtttattttcggcgtcgagatcgacgggatattttgggtcgtcgtcgttttttgagagcgcgtttcgtaacggtcgtttcggtttttttttggtcgtcgtcgtcgtcgtcgtttcgcgcgttttcgagttcgtcgcgcgttttcgttaaatattatatattgcggcggcggttatgaggaggcgcggtttcgcgcgttgggagtttgggggggcggggttttcgcgggcgcgtaggcgtataggcgttggcgcggtcggcggcggtttcgggggggcgtaattgtgcgggtttttaaaggcggtagtaggtgcgggggttattcggttatcgttgttgcgttcgtgtatcgcgtatttaacggattttggtacgtggcgttttggttcgcgagaagttagcgtttgttcgtcggtttaaggtagtttttttcgcggagttttgtttcggggtcgcgtgattttttcggtttcgatcggaggggtagtttagcgggatgcgagttttagggttgggttcgtcgttcgcg

SEQ ID NO: 30932 - DNA, 584 bp, Artificial Sequence
  chemically treated genomic DNA (Homo sapiens) CpG-island No: 30932
cgcgaacgacgaacccaaccctaaaactcgcatcccgctaaactacccctccgatcgaaaccgaaaaaatcacgcgaccccgaaacaaaactccgcgaaaaaaactaccttaaaccgacgaacaaacgctaacttctcgcgaaccaaaacgccacgtaccaaaatccgttaaatacgcgatacacgaacgcaacaacgataaccgaataacccccgcacctactaccgcctttaaaaacccgcacaattacgcccccccgaaaccgccgccgaccgcgccaacgcctatacgcctacgcgcccgcgaaaaccccgcccccccaaactcccaacgcgcgaaaccgcgcctcctcataaccgccgccgcaatatataatatttaacgaaaacgcgcgacgaactcgaaaacgcgcgaaacgacgacgacgacgacgaccaaaaaaaaaccgaaacgaccgttacgaaacgcgctctcaaaaaacgacgacgacccaaaatatcccgtcgatctcgacgccgaaaataaacgataacgctacccgcgataacgaaaattataaacgaaacgtattaataccaaaacc

SEQ ID NO: 30933 - DNA, 553 bp, Artificial Sequence
  chemically treated genomic DNA (Homo sapiens) CpG-island No: 30933
  misc_feature (62)..(62): n is either a, c, g or t
  misc_feature (161)..(161): n is either a, c, g or t
  misc_feature (193)..(193): n is either a, c, g or t
  misc_feature (391)..(391): n is either a, c, g or t
  misc_feature (443)..(444): n is either a, c, g or t
  misc_feature (464)..(464): n is either a, c, g or t
  misc_feature (519)..(519): n is either a, c, g or t
  misc_feature (525)..(525): n is either a, c, g or t
  misc_feature (535)..(535): n is either a, c, g or t
  misc_feature (550)..(550): n is either a, c, g or t
ggggacgacgggagggcgcgttaggaagggcgtacgaaggggttagagggtcgggggttcgngttagtattagaggcgtacgtcggagatcgggcgagcgatcgggagaagggagcggtcggaacggggggaattagacgcggtcgcgggacgggtcggtngcgagtcgtcggggaatttcgagagttttcgngtcggtcgcggaggaaacgggggtcgggagaggggttttaagggaagaggggaaatcggtcgcggcgggggcgacgggggaacggggggcgagggaatcgtacgggagcggggtttataaggcgatacgggggaggagaaaggagggtatttttttttcgacgggggcgggagagggggaggaaagaggggggcgcgngagaaaggggcgagaggagggggatcgttcgcggcggcgggggcgggggggnngtcgcgtcgaggggcggggntcgagagatcggtatcgcggggatagcgtcggcgcgcgagcgggggagggggcgnaggagngggggtagtntagggcggagggcgntcg

SEQ ID NO: 30934 - DNA, 553 bp, Artificial Sequence
  chemically treated genomic DNA (Homo sapiens) CpG-island No: 30934
  misc_feature (4)..(4): n is either a, c, g or t
  misc_feature (19)..(19): n is either a, c, g or t
  misc_feature (29)..(29): n is either a, c, g or t
  misc_feature (35)..(35): n is either a, c, g or t
  misc_feature (90)..(90): n is either a, c, g or t
  misc_feature (110)..(111): n is either a, c, g or t
  misc_feature (163)..(163): n is either a, c, g or t
  misc_feature (361)..(361): n is either a, c, g or t
  misc_feature (393)..(393): n is either a, c, g or t
  misc_feature (492)..(492): n is either a, c, g or t
cgancgccctccgccctanactacccccnctcctncgccccctcccccgctcgcgcgccgacgctatccccgcgataccgatctctcganccccgcccctcgacgcgacnncccccccgcccccgccgccgcgaacgatccccctcctctcgcccctttctcncgcgcccccctctttcctccccctctcccgcccccgtcgaaaaaaaaataccctcctttctcctcccccgtatcgccttataaaccccgctcccgtacgattccctcgccccccgttcccccgtcgcccccgccgcgaccgatttcccctcttcccttaaaacccctctcccgacccccgtttcctccgcgaccgacncgaaaactctcgaaattccccgacgactcgcnaccgacccgtcccgcgaccgcgtctaattccccccgttccgaccgctcccttctcccgatcgctcgcccgatctccgacgtacgcctctaatactaacncgaacccccgaccctctaaccccttcgtacgcccttcctaacgcgccctcccgtcgtcccc

SEQ ID NO: 30935 - DNA, 553 bp, Artificial Sequence
  chemically treated genomic DNA (Homo sapiens) CpG-island No: 30935
  misc_feature (4)..(4): n is either a, c, g or t
  misc_feature (19)..(19): n is either a, c, g or t
  misc_feature (29)..(29): n is either a, c, g or t
  misc_feature (35)..(35): n is either a, c, g or t
  misc_feature (90)..(90): n is either a, c, g or t
  misc_feature (110)..(111): n is either a, c, g or t
  misc_feature (163)..(163): n is either a, c, g or t
  misc_feature (361)..(361): n is either a, c, g or t
  misc_feature (393)..(393): n is either a, c, g or t
  misc_feature (492)..(492): n is either a, c, g or t
cggncgtttttcgttttgngttgtttttntttttncgttttttttttcgttcgcgcgtcggcgttgttttcgcggtgtcggtttttcggntttcgtttttcggcgcggtnnttttttcgttttcgtcgtcgcgggcggttttttttttttcgttttttttttncgcgttttttttttttttttttttttttcgttttcgtcggggggggggtgttttttttttttttttttcgtgtcgttttgtgggtttcgttttcgtgcggttttttcgtttttcgttttttcgtcgttttcgtcgcggtcggttttttttttttttttggggtttttttttcggttttcgtttttttcgcggtcggtncgggggttttcggggtttttcggcggttcgtngtcggttcgtttcgcggtcgcgtttggtttttttcgtttcggtcgtttttttttttcggtcgttcgttcggttttcggcgtgcgtttttggtgttggtncgggttttcggttttttggttttttcgtgcgttttttttggcgcgttttttcgtcgttttt

SEQ ID NO: 30936 - DNA, 553 bp, Artificial Sequence
  chemically treated genomic DNA (Homo sapiens) CpG-island No: 30936
  misc_feature (62)..(62): n is either a, c, g or t
  misc_feature (161)..(161): n is either a, c, g or t
  misc_feature (193)..(193): n is either a, c, g or t
  misc_feature (391)..(391): n is either a, c, g or t
  misc_feature (443)..(444): n is either a, c, g or t
  misc_feature (464)..(464): n is either a, c, g or t
  misc_feature (519)..(519): n is either a, c, g or t
  misc_feature (525)..(525): n is either a, c, g or t
  misc_feature (535)..(535): n is either a, c, g or t
  misc_feature (550)..(550): n is either a, c, g or t
aaaaacgacgaaaaaacgcgccaaaaaaaacgcacgaaaaaaccaaaaaaccgaaaacccgnaccaacaccaaaaacgcacgccgaaaaccgaacgaacgaccgaaaaaaaaaaacgaccgaaacgaaaaaaaccaaacgcgaccgcgaaacgaaccgacnacgaaccgccgaaaaaccccgaaaacccccgnaccgaccgcgaaaaaaacgaaaaccgaaaaaaaaaccccaaaaaaaaaaaaaaaaccgaccgcgacgaaaacgacgaaaaaacgaaaaacgaaaaaaccgcacgaaaacgaaacccacaaaacgacacgaaaaaaaaaaaaaaaaaacaccccccccccgacgaaaacgaaaaaaaaaaaaaaaaaaaaaaaacgcgnaaaaaaaaaacgaaaaaaaaaaaaccgcccgcgacgacgaaaacgaaaaaannaccgcgccgaaaaacgaaanccgaaaaaccgacaccgcgaaaacaacgccgacgcgcgaacgaaaaaaaaaacgnaaaaanaaaaacaacncaaaacgaaaaacgnccg

SEQ ID NO: 30937 - DNA, 867 bp, Artificial Sequence
  chemically treated genomic DNA (Homo sapiens) CpG-island No: 30937
tttggatattcgtatttcgtatgttacggattcggcgggtaatcggttgtcggattcggagttgtattcggatagtatatttatagtgtggtcggataatcgtatcgcggaggatgcgtattatgtttatcgttacgatgaatacggtaggttgacggagaagacggatcgtatttcggcgggtgtgatacggacggacgacgagcggatttattattattattacgatagttagtatcgtttggtgttttatacgcggatatagtatggcgagttattggtcgagagtcgttatttttacgattcgttgggacggcgaatggtaaaacgggtttggcggcgggagcgtgatttgacggggtggatgtcgttgtcgcgtaaatcggaggtgacgtggtatggttgggacggagataggttgacgacggtgtagattgatattatacgtatttagacggtatacgagtcgggaagttttacgtcgtttatacgggtcgagatagagaacggcgagcggtaaaaagcgtaacggcgtagtttggtagagacgttttagtaggaagggagtgagaacggttacggcgtggtgttttcggttgaattggtgcggttgttggataggttggaggaagaaattcgggtagttcgcgtgagtagtgaaagtcgggcgtggtttgcgtagtgcgggttgacggtggagtaattggttagataggtggagtcggaatatatatcggcgcgaaaagtttatttttattattgcgattatcggggattgtcgttggcgtttattagcgaagacggtaatacggcgtggagcgcggaatatgatgaatggggtaattagtttaatgaggagaattcgta

SEQ ID NO: 30938 - DNA, 867 bp, Artificial Sequence
  chemically treated genomic DNA (Homo sapiens) CpG-island No: 30938
tacgaattctcctcattaaactaattaccccattcatcatattccgcgctccacgccgtattaccgtcttcgctaataaacgccaacgacaatccccgataatcgcaataataaaaataaacttttcgcgccgatatatattccgactccacctatctaaccaattactccaccgtcaacccgcactacgcaaaccacgcccgactttcactactcacgcgaactacccgaatttcttcctccaacctatccaacaaccgcaccaattcaaccgaaaacaccacgccgtaaccgttctcactcccttcctactaaaacgtctctaccaaactacgccgttacgctttttaccgctcgccgttctctatctcgacccgtataaacgacgtaaaacttcccgactcgtataccgtctaaatacgtataatatcaatctacaccgtcgtcaacctatctccgtcccaaccataccacgtcacctccgatttacgcgacaacgacatccaccccgtcaaatcacgctcccgccgccaaacccgttttaccattcgccgtcccaacgaatcgtaaaaataacgactctcgaccaataactcgccatactatatccgcgtataaaacaccaaacgatactaactatcgtaataataataataaatccgctcgtcgtccgtccgtatcacacccgccgaaatacgatccgtcttctccgtcaacctaccgtattcatcgtaacgataaacataatacgcatcctccgcgatacgattatccgaccacactataaatatactatccgaatacaactccgaatccgacaaccgattacccgccgaatccgtaacatacgaaatacgaatatccaaa

SEQ ID NO: 30939 - DNA, 867 bp, Artificial Sequence
  chemically treated genomic DNA (Homo sapiens) CpG-island No: 30939
tgcgggttttttttattaagttggttgttttatttattatatttcgcgttttacgtcgtattgtcgttttcgttgataagcgttagcggtagttttcggtggtcgtagtgataaagatgagtttttcgcgtcggtgtgtatttcggttttatttgtttggttagttgttttatcgttagttcgtattgcgtaagttacgttcggtttttattgtttacgcggattgttcggatttttttttttagtttgtttagtagtcgtattagtttagtcgggaatattacgtcgtggtcgtttttattttttttttgttggagcgtttttgttaggttgcgtcgttgcgttttttatcgttcgtcgttttttgtttcgattcgtatgagcggcgtgaagtttttcggttcgtatatcgtttggatacgtgtggtgttagtttgtatcgtcgttagtttgttttcgttttagttatattacgttattttcggtttacgcgatagcgatatttatttcgttaggttacgttttcgtcgttagattcgttttgttattcgtcgttttagcgggtcgtagaggtagcggttttcgattagtggttcgttatgttgtattcgcgtgtagaatattaggcggtgttggttgtcgtagtggtagtggtgggttcgttcgtcgttcgttcgtattatattcgtcgggatgcggttcgtttttttcgttagtttgtcgtatttatcgtggcggtagatatagtgcgtatttttcgcgatgcggttattcggttatattgtgagtgtattgttcgggtgtagtttcgggttcggtagtcggttgttcgtcgggttcgtggtatacgggatgcggatgtttagg

SEQ ID NO: 30940 - DNA, 867 bp, Artificial Sequence
  chemically treated genomic DNA (Homo sapiens) CpG-island No: 30940
cctaaacatccgcatcccgtataccacgaacccgacgaacaaccgactaccgaacccgaaactacacccgaacaatacactcacaatataaccgaataaccgcatcgcgaaaaatacgcactatatctaccgccacgataaatacgacaaactaacgaaaaaaacgaaccgcatcccgacgaatataatacgaacgaacgacgaacgaacccaccactaccactacgacaaccaacaccgcctaatattctacacgcgaatacaacataacgaaccactaatcgaaaaccgctacctctacgacccgctaaaacgacgaataacaaaacgaatctaacgacgaaaacgtaacctaacgaaataaatatcgctatcgcgtaaaccgaaaataacgtaatataactaaaacgaaaacaaactaacgacgatacaaactaacaccacacgtatccaaacgatatacgaaccgaaaaacttcacgccgctcatacgaatcgaaacaaaaaacgacgaacgataaaaaacgcaacgacgcaacctaacaaaaacgctccaacaaaaaaaaaataaaaacgaccacgacgtaatattcccgactaaactaatacgactactaaacaaactaaaaaaaaaaatccgaacaatccgcgtaaacaataaaaaccgaacgtaacttacgcaatacgaactaacgataaaacaactaaccaaacaaataaaaccgaaatacacaccgacgcgaaaaactcatctttatcactacgaccaccgaaaactaccgctaacgcttatcaacgaaaacgacaatacgacgtaaaacgcgaaatataataaataaaacaaccaacttaataaaaaaaacccgca

SEQ ID NO: 30941 - DNA, 950 bp, Artificial Sequence
  chemically treated genomic DNA (Homo sapiens) CpG-island No: 30941
tcgatttggcgtttgcggtcgaattcggtttttagcggtaggatcgataggtagttcgattgtacgtcgtagtcgtcgtaattttcgtatacggtcgggttgattattatgcggcgcgtcgggtcggggaagacggttttgttaggtttgttttttttgcggcggcgacgtttttcggcggcgtatgtttggtcgtatattagtatcgttacgtcggggatgacgcgtaagtcgcgttggatgatatcgagttcgtttcgatggtgtacggttacgtcgtcgggtagttttatttgcgtatagtttttcggttgggtcggtgacgattacggttttgcgcgcgttttcgtttattatttgttgtacgatttgcggtacggatagggtgtcgtttatcggttggtcggtcggttatcgcgatcgcgtcgttgtataggattttataggtgatgttggtgcgcgtagttacggtttggcggatcgtttagcgaattcgaatggtaaaaggtttcgtcgtttaaggttttggaatacgtgcggtttgtttatgaagcgcgaggacgcgatttagttgacgttttcgtcgtttatatgtaataggtaattcgtgtcgcgttttatttaggtgattatgaagtggtagtcgatgtcggtataggttcgtttgtttttcggtatacgggtttaggtattgtgcgggtagttttagtagaagttcggcgtgcgttttacgtcgtcggtatcgttggagggtagcggtagcgggcgtaggaagttcggtaagtatgcgtgttaggtcgagttgcgggaagcgcggcgttagttagtgtatgacggtcggcgtgatgcgcgaagatcgtagttcgtttagtttcgatagtagcggttattatttcgttaggttttgtcgattagggagggagggtttatttgtgggtaggatatagaat

SEQ ID NO: 30942 - DNA, 950 bp, Artificial Sequence
  chemically treated genomic DNA (Homo sapiens) CpG-island No: 30942
attctatatcctacccacaaataaaccctccctccctaatcgacaaaacctaacgaaataataaccgctactatcgaaactaaacgaactacgatcttcgcgcatcacgccgaccgtcatacactaactaacgccgcgcttcccgcaactcgacctaacacgcatacttaccgaacttcctacgcccgctaccgctaccctccaacgataccgacgacgtaaaacgcacgccgaacttctactaaaactacccgcacaatacctaaacccgtataccgaaaaacaaacgaacctataccgacatcgactaccacttcataatcacctaaataaaacgcgacacgaattacctattacatataaacgacgaaaacgtcaactaaatcgcgtcctcgcgcttcataaacaaaccgcacgtattccaaaaccttaaacgacgaaaccttttaccattcgaattcgctaaacgatccgccaaaccgtaactacgcgcaccaacatcacctataaaatcctatacaacgacgcgatcgcgataaccgaccgaccaaccgataaacgacaccctatccgtaccgcaaatcgtacaacaaataataaacgaaaacgcgcgcaaaaccgtaatcgtcaccgacccaaccgaaaaactatacgcaaataaaactacccgacgacgtaaccgtacaccatcgaaacgaactcgatatcatccaacgcgacttacgcgtcatccccgacgtaacgatactaatatacgaccaaacatacgccgccgaaaaacgtcgccgccgcaaaaaaaacaaacctaacaaaaccgtcttccccgacccgacgcgccgcataataatcaacccgaccgtatacgaaaattacgacgactacgacgtacaatcgaactacctatcgatcctaccgctaaaaaccgaattcgaccgcaaacgccaaatcga

SEQ ID NO: 30943 - DNA, 950 bp, Artificial Sequence
  chemically treated genomic DNA (Homo sapiens) CpG-island No: 30943
gttttatattttgtttataggtaagttttttttttttggtcggtaaggtttggcgagatggtaatcgttgttgtcggagttgggcgagttgcgattttcgcgtattacgtcggtcgttatgtattggttggcgtcgcgtttttcgtagttcgatttggtacgtatgtttgtcggattttttgcgttcgttgtcgttgttttttaacggtgtcgacggcgtaaagcgtacgtcgaatttttgttagggttgttcgtataatatttagattcgtgtgtcggaaggtagacgaatttatgtcggtatcggttgttattttatggttatttggatgaagcgcgatacgaattatttgttatatatgggcggcgaaggcgttagttgggtcgcgttttcgcgttttatggataagtcgtacgtgttttagaattttgggcgacgggattttttattattcgggttcgttggacgattcgttaggtcgtggttgcgcgtattaatattatttataagattttgtataacgacgcggtcgcgatgatcggtcggttagtcggtggacggtattttgttcgtgtcgtagatcgtgtagtaggtggtgagcgaaggcgcgcgtaagatcgtggtcgttatcgatttagtcggaaaattatgcgtaagtgaagttgttcgacggcgtgatcgtgtattatcggagcgagttcgatgttatttagcgcgatttgcgcgttattttcggcgtgacggtgttggtgtacgattagatatgcgtcgtcgagaagcgtcgtcgtcgtaagaagaataagtttggtaagatcgtttttttcgattcggcgcgtcgtatggtgattaattcggtcgtgtgcgaaggttgcggcgattgcggcgtgtagtcgaattgtttgtcgattttgtcgttggagatcgaattcggtcgtaagcgttagatcga

SEQ ID NO: 30944 - DNA, 950 bp, Artificial Sequence
  chemically treated genomic DNA (Homo sapiens) CpG-island No: 30944
tcgatctaacgcttacgaccgaattcgatctccaacgacaaaatcgacaaacaattcgactacacgccgcaatcgccgcaaccttcgcacacgaccgaattaatcaccatacgacgcgccgaatcgaaaaaaacgatcttaccaaacttattcttcttacgacgacgacgcttctcgacgacgcatatctaatcgtacaccaacaccgtcacgccgaaaataacgcgcaaatcgcgctaaataacatcgaactcgctccgataatacacgatcacgccgtcgaacaacttcacttacgcataattttccgactaaatcgataacgaccacgatcttacgcgcgccttcgctcaccacctactacacgatctacgacacgaacaaaataccgtccaccgactaaccgaccgatcatcgcgaccgcgtcgttatacaaaatcttataaataatattaatacgcgcaaccacgacctaacgaatcgtccaacgaacccgaataataaaaaatcccgtcgcccaaaattctaaaacacgtacgacttatccataaaacgcgaaaacgcgacccaactaacgccttcgccgcccatatataacaaataattcgtatcgcgcttcatccaaataaccataaaataacaaccgataccgacataaattcgtctaccttccgacacacgaatctaaatattatacgaacaaccctaacaaaaattcgacgtacgctttacgccgtcgacaccgttaaaaaacaacgacaacgaacgcaaaaaatccgacaaacatacgtaccaaatcgaactacgaaaaacgcgacgccaaccaatacataacgaccgacgtaatacgcgaaaatcgcaactcgcccaactccgacaacaacgattaccatctcgccaaaccttaccgaccaaaaaaaaaaaacttacctataaacaaaatataaaac

SEQ ID NO: 30945 - DNA, 549 bp, Artificial Sequence
  chemically treated genomic DNA (Homo sapiens) CpG-island No: 30945
gtcggcgggttaatgattttgatcgtatcgcgtgtattcggggattttttcggtttcgttaataatatttcgtcgtagtgtcgggatttgttttttttttgggggtcgggggtttggttttttgatatgcgtttttcggaggtttagtcgtttttacggttttttcgcgcgcgtacgacgttagagtcggagttacgatttattcgttttttcggatgtatttgatatttgtttattcggcgtttttcggcgcggcgtgcgtaatcgtcgttgtttttatttacgtatttttttgcgttgttatgtatatttttttttattaattttttatcgcggcgttcgatatttatttattttcgatttattcgttagttacgcgtatagtttttagataatgtgtttcgtgtttgtcgcgtttttaatattttatcgttcgttcgtttttttatcgtcgttttttatatttttaatttgttttattcgattacgtttgatatttatagtcgcgttattttgaacgtttagttcgtatatatttatttcgttatt

SEQ ID NO: 30946 - DNA, 549 bp, Artificial Sequence
  chemically treated genomic DNA (Homo sapiens) CpG-island No: 30946
aataacgaaataaatatatacgaactaaacgttcaaaataacgcgactataaatatcaaacgtaatcgaataaaacaaattaaaaatataaaaaacgacgataaaaaaacgaacgaacgataaaatattaaaaacgcgacaaacacgaaacacattatctaaaaactatacgcgtaactaacgaataaatcgaaaataaataaatatcgaacgccgcgataaaaaattaataaaaaaaaatatacataacaacgcaaaaaaatacgtaaataaaaacaacgacgattacgcacgccgcgccgaaaaacgccgaataaacaaatatcaaatacatccgaaaaaacgaataaatcgtaactccgactctaacgtcgtacgcgcgcgaaaaaaccgtaaaaacgactaaacctccgaaaaacgcatatcaaaaaaccaaacccccgacccccaaaaaaaaaacaaatcccgacactacgacgaaatattattaacgaaaccgaaaaaatccccgaatacacgcgatacgatcaaaatcattaacccgccgac

SEQ ID NO: 30947 - DNA, 549 bp, Artificial Sequence
  chemically treated genomic DNA (Homo sapiens) CpG-island No: 30947
agtggcgaggtgagtatatacgagttagacgtttagaatggcgcgattatggatattagacgtgatcgagtgaagtaggttaaggatgtggggaacggcgatgagagagcgagcgaacggtggagtattgaaagcgcggtaagtacgggatatattatttagaggttatacgcgtggttgacgagtgggtcgagagtaagtgagtatcggacgtcgcgatgagaagttgatgaagaagagtgtatatagtagcgtaggaaggtgcgtaggtgggagtagcggcgattacgtacgtcgcgtcgagagacgtcgagtgagtaaatgttaagtatattcgaggagacgagtaggtcgtggtttcgattttaacgtcgtgcgcgcgcgagggaatcgtaagaacggttaagttttcgggaagcgtatgttagggagttaggttttcggtttttaagggaggagtaggtttcggtattgcggcgaagtgttgttgacggaatcgggaaaattttcgggtatacgcgatgcggttagggttattggttcgtcggt

SEQ ID NO: 30948 - DNA, 549 bp, Artificial Sequence
  chemically treated genomic DNA (Homo sapiens) CpG-island No: 30948
accgacgaaccaataaccctaaccgcatcgcgtatacccgaaaattttcccgattccgtcaacaacacttcgccgcaataccgaaacctactcctcccttaaaaaccgaaaacctaactccctaacatacgcttcccgaaaacttaaccgttcttacgattccctcgcgcgcgcacgacgttaaaatcgaaaccacgacctactcgtctcctcgaatatacttaacatttactcactcgacgtctctcgacgcgacgtacgtaatcgccgctactcccacctacgcaccttcctacgctactatatacactcttcttcatcaacttctcatcgcgacgtccgatactcacttactctcgacccactcgtcaaccacgcgtataacctctaaataatatatcccgtacttaccgcgctttcaatactccaccgttcgctcgctctctcatcgccgttccccacatccttaacctacttcactcgatcacgtctaatatccataatcgcgccattctaaacgtctaactcgtatatactcacctcgccact

SEQ ID NO: 30949 - DNA, 616 bp, Artificial Sequence
  chemically treated genomic DNA (Homo sapiens) CpG-island No: 30949
tgtatagttcgttgttgtcggtgtgatcgttattgagaaatagcgtcggtaatgcgttatagatatttagtttttttgaggcgtgaattaacgtgtcgacgcgatagttgtattagggatcgtttagtttaatcgttattttaatggtataaattttcgttacggtgtttgtttcgttattttttagtacgaatatatagttttgtttatttttgggtagttcgttttgttaggttttgattgttttttcgatacgcgtcgaaagcgtggttttattggcgggaagcgacgttaggtcgtcgttcgttttgttggtaagttgtattagcgtcgagatatttgatcgtttaacgggacggatgattattatgatgaatttcggttaataaagtgttcgtaagtagttgtaaagcgatttagttcggtcgttatttttttttcgttgatattgagcgtaggcgtaaaacgtattacgttgttattcgtaattagtattattacgtttgttttcgtcgttttttgagagatttgtttcgtttgttcggcgtaatcggtatttagtatatagttaattagtaaatttaagtcgcgaattttattgaataaattatagcgg

SEQ ID NO: 30950 - DNA, 616 bp, Artificial Sequence
  chemically treated genomic DNA (Homo sapiens) CpG-island No: 30950
ccgctataatttattcaataaaattcgcgacttaaatttactaattaactatatactaaataccgattacgccgaacaaacgaaacaaatctctcaaaaaacgacgaaaacaaacgtaataatactaattacgaataacaacgtaatacgttttacgcctacgctcaatatcaacgaaaaaaaaataacgaccgaactaaatcgctttacaactacttacgaacactttattaaccgaaattcatcataataatcatccgtcccgttaaacgatcaaatatctcgacgctaatacaacttaccaacaaaacgaacgacgacctaacgtcgcttcccgccaataaaaccacgctttcgacgcgtatcgaaaaaacaatcaaaacctaacaaaacgaactacccaaaaataaacaaaactatatattcgtactaaaaaataacgaaacaaacaccgtaacgaaaatttataccattaaaataacgattaaactaaacgatccctaatacaactatcgcgtcgacacgttaattcacgcctcaaaaaaactaaatatctataacgcattaccgacgctatttctcaataacgatcacaccgacaacaacgaactataca

SEQ ID NO: 30951 - DNA, 616 bp, Artificial Sequence
  chemically treated genomic DNA (Homo sapiens) CpG-island No: 30951
tcgttatggtttgtttagtgaagttcgcggtttaggtttgttgattggttgtgtattgaatgtcgattacgtcgggtaagcgaaatagattttttaggaagcggcgaaagtaggcgtgatggtattgattgcgggtggtaacgtggtgcgttttgcgtttgcgtttaatgttagcgaagaagaggtgacgatcggattggatcgttttgtagttgtttgcgaatattttgttagtcgaggtttattatgatggttattcgtttcgttgagcgattagatgtttcggcgttgatgtagtttgttagtaaaacgggcggcggtttgacgtcgtttttcgttaatgaagttacgttttcggcgcgtatcgaaagggtaattaaaatttggtaaggcgaattgtttaaaagtgagtagggttatgtgttcgtgttggaagatagcgagataggtatcgtggcggggatttgtgttattgaggtggcggttgggttgaacgatttttggtataattatcgcgtcggtacgttggtttacgttttaaaagagttgaatgtttataacgtattgtcgacgttgttttttagtaacgattatatcggtagtagcgagttgtgta

SEQ ID NO: 30952 - DNA, 616 bp, Artificial Sequence
  chemically treated genomic DNA (Homo sapiens) CpG-island No: 30952
tacacaactcgctactaccgatataatcgttactaaaaaacaacgtcgacaatacgttataaacattcaactcttttaaaacgtaaaccaacgtaccgacgcgataattataccaaaaatcgttcaacccaaccgccacctcaataacacaaatccccgccacgatacctatctcgctatcttccaacacgaacacataaccctactcacttttaaacaattcgccttaccaaattttaattaccctttcgatacgcgccgaaaacgtaacttcattaacgaaaaacgacgtcaaaccgccgcccgttttactaacaaactacatcaacgccgaaacatctaatcgctcaacgaaacgaataaccatcataataaacctcgactaacaaaatattcgcaaacaactacaaaacgatccaatccgatcgtcacctcttcttcgctaacattaaacgcaaacgcaaaacgcaccacgttaccacccgcaatcaataccatcacgcctactttcgccgcttcctaaaaaatctatttcgcttacccgacgtaatcgacattcaatacacaaccaatcaacaaacctaaaccgcgaacttcactaaacaaaccataacga

SEQ ID NO: 30953 - DNA, 1159 bp, Artificial Sequence
  chemically treated genomic DNA (Homo sapiens) CpG-island No: 30953
tgtcgggtacgggcggtatttgtatattcgttatatgtgtacgcgttgattatatattaaacgtattagggggttgcgcgtttatacgcgcgttaacgtgttcgtaggttcgttattttttcggtgttcggtcgacgtcgtggcgcggtgcgtgcgtaaatataaatgtatatggacgtgtgcgtacgtcgtcgatcgtttattaggtacgcggattttcggattattcgttcggagcggtttcgtttttcggtttagttttgtcgaggtttggggcgtttttttttcggtcgttcgttcgattgttcgtttgtatcgcggggtcgttcggttttcggtcgttattcggataaaaggggtggggggggttttcgtttcgatttcgggggattcgcggtttcgcgggggcggcgtattttcgatcggtggttcggtttttattttcgttcgtcgcgagtttttgggattcggacgtcgggtatcgtcgtcgggaaagcgggtcgggtttgcggttcggagggggcgtatagtcggtacgcgtttacgtcgttcgttttcgttcggcggttacgcgggatatatttcgttcgtggtttcggttttcgttcggtttcggcgtcgcgtatttcgaattgttagtgggtcgtttgtagtagttgtttcgtttggtcggtcgcgtagttcgtcgttagtacgaattggttgattatgatttggtgtttgagttcgtttatgtttacggatatggcgtcgtcgcgttgttcgtttcggtttttttttttcgttcgcgttttcgttttacgcgtttattattagcgagtcggtttcggttaatataaatatttattgtgcggttttgatttatcgcgtttcgtttcgtttcgtcggcgtcgcggtatgttgggatatgtagtttttacggtgcgtcgggcgtttcgggggagcggggtcggtattttaggggacgcgaagttcgggaaggggcgtgtttgagtatcgagcgttcgttgtgcggatgttcgggtcgtaattcgagtcgggcgcgtttacgtcgttttcgttgttttcggtggtattcgtgtttttgttttggtacggatgggggttcgttggcgggggttacgtttgtgtatgggcgtaaatgtttgattataggatt

SEQ ID NO: 30954 - DNA, 1159 bp, Artificial Sequence
  chemically treated genomic DNA (Homo sapiens) CpG-island No: 30954
aatcctataatcaaacatttacgcccatacacaaacgtaacccccgccaacgaacccccatccgtaccaaaacaaaaacacgaataccaccgaaaacaacgaaaacgacgtaaacgcgcccgactcgaattacgacccgaacatccgcacaacgaacgctcgatactcaaacacgccccttcccgaacttcgcgtcccctaaaataccgaccccgctcccccgaaacgcccgacgcaccgtaaaaactacatatcccaacataccgcgacgccgacgaaacgaaacgaaacgcgataaatcaaaaccgcacaataaatatttatattaaccgaaaccgactcgctaataataaacgcgtaaaacgaaaacgcgaacgaaaaaaaaaaaccgaaacgaacaacgcgacgacgccatatccgtaaacataaacgaactcaaacaccaaatcataatcaaccaattcgtactaacgacgaactacgcgaccgaccaaacgaaacaactactacaaacgacccactaacaattcgaaatacgcgacgccgaaaccgaacgaaaaccgaaaccacgaacgaaatatatcccgcgtaaccgccgaacgaaaacgaacgacgtaaacgcgtaccgactatacgccccctccgaaccgcaaacccgacccgctttcccgacgacgatacccgacgtccgaatcccaaaaactcgcgacgaacgaaaataaaaaccgaaccaccgatcgaaaatacgccgcccccgcgaaaccgcgaatcccccgaaatcgaaacgaaaaccccccccaccccttttatccgaataacgaccgaaaaccgaacgaccccgcgatacaaacgaacaatcgaacgaacgaccgaaaaaaaaacgccccaaacctcgacaaaactaaaccgaaaaacgaaaccgctccgaacgaataatccgaaaatccgcgtacctaataaacgatcgacgacgtacgcacacgtccatatacatttatatttacgcacgcaccgcgccacgacgtcgaccgaacaccgaaaaaataacgaacctacgaacacgttaacgcgcgtataaacgcgcaaccccctaatacgtttaatatataatcaacgcgtacacatataacgaatatacaaataccgcccgtacccgaca

SEQ ID NO: 30955 - DNA, 1159 bp, Artificial Sequence
  chemically treated genomic DNA (Homo sapiens) CpG-island No: 30955
gattttgtggttaggtatttgcgtttatgtatagacgtggttttcgttagcggatttttattcgtgttagagtaggggtacgggtgttatcgagagtaacgaggacgacgtggacgcgttcggttcgggttacggttcggatattcgtatagcgggcgttcggtgtttagatacgttttttttcgggtttcgcgttttttagggtgtcggtttcgttttttcggggcgttcggcgtatcgtggggattatatattttagtatgtcgcggcgtcggcggagcgaggcgaggcgcggtgagttagagtcgtatagtaaatatttgtattagtcggagtcggttcgttaatggtggacgcgtgaggcggaggcgcgggcggaggagggaggtcggagcgggtagcgcggcggcgttatgttcgtgaatatggacgagtttaagtattaggttatgattaattagttcgtgttgacggcgggttgcgcggtcgattaggcgaagtaattgttgtaggcggtttattggtagttcgaggtgcgcggcgtcggagtcgggcgagggtcggggttacgggcggagtgtgtttcgcgtggtcgtcgggcgggggcggacggcgtggacgcgtgtcggttgtgcgtttttttcgggtcgtagattcgattcgttttttcgacggcggtgttcggcgttcggattttaagggttcgcggcgggcggaggtgggaatcgggttatcggtcggggatacgtcgttttcgcggggtcgcgagtttttcgggatcgagacggggattttttttattttttttgttcgggtaacggtcgagggtcgggcggtttcgcggtgtagacggatagtcgggcgggcggtcggaaggaggacgttttaggtttcggtagagttgggtcggagggcggagtcgtttcgggcgagtggttcgagggttcgcgtgtttggtgggcggtcggcggcgtgcgtatacgtttatgtgtatttgtgtttacgtacgtatcgcgttacggcgtcggtcgggtatcggggaggtggcggatttgcgggtacgttggcgcgcgtgtgaacgcgtagttttttggtgcgtttggtgtgtgattaacgcgtatatatgtggcgggtgtgtagatgtcgttcgtgttcggta

SEQ ID NO: 30956 - DNA, 1159 bp, Artificial Sequence
  chemically treated genomic DNA (Homo sapiens) CpG-island No: 30956
taccgaacacgaacgacatctacacacccgccacatatatacgcgttaatcacacaccaaacgcaccaaaaaactacgcgttcacacgcgcgccaacgtacccgcaaatccgccacctccccgatacccgaccgacgccgtaacgcgatacgtacgtaaacacaaatacacataaacgtatacgcacgccgccgaccgcccaccaaacacgcgaaccctcgaaccactcgcccgaaacgactccgccctccgacccaactctaccgaaacctaaaacgtcctccttccgaccgcccgcccgactatccgtctacaccgcgaaaccgcccgaccctcgaccgttacccgaacaaaaaaaataaaaaaaatccccgtctcgatcccgaaaaactcgcgaccccgcgaaaacgacgtatccccgaccgataacccgattcccacctccgcccgccgcgaacccttaaaatccgaacgccgaacaccgccgtcgaaaaaacgaatcgaatctacgacccgaaaaaaacgcacaaccgacacgcgtccacgccgtccgcccccgcccgacgaccacgcgaaacacactccgcccgtaaccccgaccctcgcccgactccgacgccgcgcacctcgaactaccaataaaccgcctacaacaattacttcgcctaatcgaccgcgcaacccgccgtcaacacgaactaattaatcataacctaatacttaaactcgtccatattcacgaacataacgccgccgcgctacccgctccgacctccctcctccgcccgcgcctccgcctcacgcgtccaccattaacgaaccgactccgactaatacaaatatttactatacgactctaactcaccgcgcctcgcctcgctccgccgacgccgcgacatactaaaatatataatccccacgatacgccgaacgccccgaaaaaacgaaaccgacaccctaaaaaacgcgaaacccgaaaaaaaacgtatctaaacaccgaacgcccgctatacgaatatccgaaccgtaacccgaaccgaacgcgtccacgtcgtcctcgttactctcgataacacccgtacccctactctaacacgaataaaaatccgctaacgaaaaccacgtctatacataaacgcaaatacctaaccacaaaatc

SEQ ID NO: 30957 - DNA, 925 bp, Artificial Sequence
  chemically treated genomic DNA (Homo sapiens) CpG-island No: 30957
tggcgttggcggagtaaggtttcggggtatttttggttcgtgtggtcgtgttaagggtgttattgcggatggacggggttatgcgggtcgggtcggttttttggggagaaacgggtgggcgtaaggggatcggcgttatcgagggtggagaaatcgtagggaatttcggttgttcgttttggggcgttaaggaagatgttcgtcgtttataatgttaattttgagttattacggtatcgattagtcgtttaggttttttcgtcggaggcggggtcgtcgtttagggtgtgcgattattgggtgacggttgacgcgtatcgtttttttttgtatatcgttcgtagtatttttcgacgacgtatcgcggcgttgcgaggggttcggtttcggggcgcgtcggcgattggcgggggaatcggattcgggggcgcggtcgttcgcggattggcgaggtacggcgggggcgggttcgcgtatgtttttaagtggtagcggcggggacggggttagtgttaagatgtcgacggcggcggtttcggagttgaagtagattagtcgggtggaggcgatgcgtttagggtcgggttggagttattcgtgttacgttatgttgtacgtcgttaattttgggtagtttttcggtcgtatttttatgcgtttttcggtgttggtgaggacgggcgagggcgcgggcgagggtgtcggcgcgggcgggttcgggcgggggcgttcgtcgatttcgcggttgtgattcgcgtttttttgtagatgtagatgcgtttcgacgggttgttgggttttttcgggggtttcgtggatcggcgtttttggtcgttggaggacggtttgaatcgggtgttgggtttgggtttgggttgtttgcgttttatcgaggtcgattatttgagttcgtatttgatcgagg

SEQ ID NO: 30958 - DNA, 925 bp, Artificial Sequence
  chemically treated genomic DNA (Homo sapiens) CpG-island No: 30958
cctcgatcaaatacgaactcaaataatcgacctcgataaaacgcaaacaacccaaacccaaacccaacacccgattcaaaccgtcctccaacgaccaaaaacgccgatccacgaaacccccgaaaaaacccaacaacccgtcgaaacgcatctacatctacaaaaaaacgcgaatcacaaccgcgaaatcgacgaacgcccccgcccgaacccgcccgcgccgacaccctcgcccgcgccctcgcccgtcctcaccaacaccgaaaaacgcataaaaatacgaccgaaaaactacccaaaattaacgacgtacaacataacgtaacacgaataactccaacccgaccctaaacgcatcgcctccacccgactaatctacttcaactccgaaaccgccgccgtcgacatcttaacactaaccccgtccccgccgctaccacttaaaaacatacgcgaacccgcccccgccgtacctcgccaatccgcgaacgaccgcgcccccgaatccgattcccccgccaatcgccgacgcgccccgaaaccgaacccctcgcaacgccgcgatacgtcgtcgaaaaatactacgaacgatatacaaaaaaaaacgatacgcgtcaaccgtcacccaataatcgcacaccctaaacgacgaccccgcctccgacgaaaaaacctaaacgactaatcgataccgtaataactcaaaattaacattataaacgacgaacatcttccttaacgccccaaaacgaacaaccgaaattccctacgatttctccaccctcgataacgccgatccccttacgcccacccgtttctccccaaaaaaccgacccgacccgcataaccccgtccatccgcaataacacccttaacacgaccacacgaaccaaaaataccccgaaaccttactccgccaacgcca

SEQ ID NO: 30959 - DNA, 925 bp, Artificial Sequence
  chemically treated genomic DNA (Homo sapiens) CpG-island No: 30959
tttcggttaggtgcgagtttaggtagtcggtttcggtgaggcgtaggtagtttaggtttaggtttagtattcggtttaggtcgttttttagcgattagaagcgtcggtttacgaagttttcggggaagtttagtagttcgtcgaaacgtatttgtatttgtaagggagcgcgggttatagtcgcggggtcgacggacgttttcgttcgggttcgttcgcgtcggtattttcgttcgcgttttcgttcgtttttattagtatcgagaagcgtatggggatgcggtcgaagagttgtttagggttggcggcgtatagtatggcgtggtacgagtggttttagttcggttttaggcgtatcgtttttattcggttgatttgttttagtttcggaatcgtcgtcgtcgatattttggtattgatttcgttttcgtcgttgttatttaagagtatgcgcgagttcgttttcgtcgtgtttcgttaattcgcgggcggtcgcgttttcgggttcggttttttcgttaatcgtcggcgcgtttcgggatcgagtttttcgtagcgtcgcggtgcgtcgtcgagaggtgttgcgggcggtgtgtaaaggagggcggtgcgcgttagtcgttatttaatagtcgtatattttgggcggcggtttcgttttcgacgggagagtttagacgattggtcggtgtcgtggtggtttaaggttgatattgtgggcgacgaatattttttttggcgttttaaagcggatagtcgaaattttttgcggtttttttattttcgatggcgtcgatttttttgcgtttattcgtttttttttaggaggtcgattcggttcgtatggtttcgtttattcgtaatggtatttttggtacgattatacgagttagagatgtttcggagttttgtttcgttagcgtta

SEQ ID NO: 30960 - DNA, 925 bp, Artificial Sequence
  chemically treated genomic DNA (Homo sapiens) CpG-island No: 30960
taacgctaacgaaacaaaactccgaaacatctctaactcgtataatcgtaccaaaaataccattacgaataaacgaaaccatacgaaccgaatcgacctcctaaaaaaaaacgaataaacgcaaaaaaatcgacgccatcgaaaataaaaaaaccgcaaaaaatttcgactatccgctttaaaacgccaaaaaaaatattcgtcgcccacaatatcaaccttaaaccaccacgacaccgaccaatcgtctaaactctcccgtcgaaaacgaaaccgccgcccaaaatatacgactattaaataacgactaacgcgcaccgccctcctttacacaccgcccgcaacacctctcgacgacgcaccgcgacgctacgaaaaactcgatcccgaaacgcgccgacgattaacgaaaaaaccgaacccgaaaacgcgaccgcccgcgaattaacgaaacacgacgaaaacgaactcgcgcatactcttaaataacaacgacgaaaacgaaatcaataccaaaatatcgacgacgacgattccgaaactaaaacaaatcaaccgaataaaaacgatacgcctaaaaccgaactaaaaccactcgtaccacgccatactatacgccgccaaccctaaacaactcttcgaccgcatccccatacgcttctcgatactaataaaaacgaacgaaaacgcgaacgaaaataccgacgcgaacgaacccgaacgaaaacgtccgtcgaccccgcgactataacccgcgctcccttacaaatacaaatacgtttcgacgaactactaaacttccccgaaaacttcgtaaaccgacgcttctaatcgctaaaaaacgacctaaaccgaatactaaacctaaacctaaactacctacgcctcaccgaaaccgactacctaaactcgcacctaaccgaaa

SEQ ID NO: 30961 - DNA, 573 bp, Artificial Sequence
  chemically treated genomic DNA (Homo sapiens) CpG-island No: 30961
gtggggtcgcgcgaaggttcggggtagtaacgaggttcggagggggtcgagtagggcgtttcgtttcgagttttcgttttcgcgttcgtcgggttcgcgttttagcgcgtgtttagtagttcgcgtttggggtcgggcgtttatcggatttcggagggtagcgataggtcgagttcgtttggatgtcgatgttttttattttcgcgatgcggcggttgagaatggagtttatggtgcgcggcgttgtcgggtagaggggttagggtcggaacgggagcggcgatagcggcggggtttttacgcggatatggttcggattaggtcgtacggacgttcgtttacggtcgcggaggcgtttcgagtttttattttcggttcggttcggggatcgacgttacggcggtttttcgtttttcggtttcggggtacgtcgggaaatggagttttttcgtcgtcgaaggcgtcgggaagtagcgcgggaagttcgtttgggaattattttttttaggatgtttcgtttttaggttttttgacgggttgataagtatttcgggataaattaaatggatttaa

SEQ ID NO: 30962 - DNA, 573 bp, Artificial Sequence
  chemically treated genomic DNA (Homo sapiens) CpG-island No: 30962
ttaaatccatttaatttatcccgaaatacttatcaacccgtcaaaaaacctaaaaacgaaacatcctaaaaaaaataattcccaaacgaacttcccgcgctacttcccgacgccttcgacgacgaaaaaactccatttcccgacgtaccccgaaaccgaaaaacgaaaaaccgccgtaacgtcgatccccgaaccgaaccgaaaataaaaactcgaaacgcctccgcgaccgtaaacgaacgtccgtacgacctaatccgaaccatatccgcgtaaaaaccccgccgctatcgccgctcccgttccgaccctaacccctctacccgacaacgccgcgcaccataaactccattctcaaccgccgcatcgcgaaaataaaaaacatcgacatccaaacgaactcgacctatcgctaccctccgaaatccgataaacgcccgaccccaaacgcgaactactaaacacgcgctaaaacgcgaacccgacgaacgcgaaaacgaaaactcgaaacgaaacgccctactcgaccccctccgaacctcgttactaccccgaaccttcgcgcgaccccac

SEQ ID NO: 30963 - DNA, 573 bp, Artificial Sequence
  chemically treated genomic DNA (Homo sapiens) CpG-island No: 30963
ttaggtttatttggtttgtttcggagtgtttgttaattcgttagagggtttgggaacggagtattttgggaaagatagtttttagacgggtttttcgcgttgtttttcggcgttttcggcggcgagaggattttatttttcgacgtgtttcgggatcgggaggcggagggtcgtcgtggcgtcggttttcgggtcgagtcgggggtgggggttcgaggcgttttcgcggtcgtggacgagcgttcgtgcggtttggttcgggttatgttcgcgtgaggatttcgtcgttgtcgtcgttttcgtttcggttttggtttttttgttcggtagcgtcgcgtattatgggttttatttttagtcgtcgtatcgcgggggtggaggatatcgatatttaggcgaattcggtttatcgttatttttcgaagttcggtgagcgttcggttttaggcgcggattgttaggtacgcgttggaacgcggattcggcgggcgcgggggcggggattcggggcggggcgttttgttcggtttttttcgggtttcgttgttatttcgagttttcgcgcggttttat

SEQ ID NO: 30964 - DNA, 573 bp, Artificial Sequence
  chemically treated genomic DNA (Homo sapiens) CpG-island No: 30964
ataaaaccgcgcgaaaactcgaaataacaacgaaacccgaaaaaaaccgaacaaaacgccccgccccgaatccccgcccccgcgcccgccgaatccgcgttccaacgcgtacctaacaatccgcgcctaaaaccgaacgctcaccgaacttcgaaaaataacgataaaccgaattcgcctaaatatcgatatcctccacccccgcgatacgacgactaaaaataaaacccataatacgcgacgctaccgaacaaaaaaaccaaaaccgaaacgaaaacgacgacaacgacgaaatcctcacgcgaacataacccgaaccaaaccgcacgaacgctcgtccacgaccgcgaaaacgcctcgaacccccacccccgactcgacccgaaaaccgacgccacgacgaccctccgcctcccgatcccgaaacacgtcgaaaaataaaatcctctcgccgccgaaaacgccgaaaaacaacgcgaaaaacccgtctaaaaactatctttcccaaaatactccgttcccaaaccctctaacgaattaacaaacactccgaaacaaaccaaataaacctaa

SEQ ID NO: 30965 - DNA, 727 bp, Artificial Sequence
  chemically treated genomic DNA (Homo sapiens) CpG-island No: 30965
gttgcgtttagttcgtgaatgtcggtatggatatgtttatggtgtcggacgattggaaggtttttatcgttagtattattaaataggtagaaagcggcgaaatttcgatggcgcgtatcgacgacgtcgtgattcgtatcgtgcgcgtgaagttgcgcgtcgggttgttcggtaagcggttttcgattaatgtttatgtcggtaaggacgcggtattgtaagatcgcgttttggcgcggcgcgtcgtacgttagtcgttggtgttgttgaagaacgagggtttaacgttgtcgttggtaaagggtaagaagattttggtggtcggtaagatcgtcgatagtatttcgaattagatcggcggttggtcgtttatttggtagggtacggttaatattaacgtcgatttttcgaacgtcgatagtattttggtcggaattcgcgaagcggtcggcgtcgcgtatgtggtttatagcgtcgatgcggtaggcgtgaacgtggtcgattacgacgcggtgatcgtcgtgatcggcgaaatttcgtatgtcgaaggcgacggcgatatcggttcgatcggtacgttgcgttatagcggtcgttatacggaagatttggtcgtgttgcgggcggttgtcggtaaggtttattttgggggtttcgtgttaatgtatcggtcggtcgtgttgtttaatatatattggtgtagtttttttattatattttgtcgtcg

SEQ ID NO: 30966 - DNA, 727 bp, Artificial Sequence
  chemically treated genomic DNA (Homo sapiens) CpG-island No: 30966
cgacgacaaaatataataaaaaaactacaccaatatatattaaacaacacgaccgaccgatacattaacacgaaacccccaaaataaaccttaccgacaaccgcccgcaacacgaccaaatcttccgtataacgaccgctataacgcaacgtaccgatcgaaccgatatcgccgtcgccttcgacatacgaaatttcgccgatcacgacgatcaccgcgtcgtaatcgaccacgttcacgcctaccgcatcgacgctataaaccacatacgcgacgccgaccgcttcgcgaattccgaccaaaatactatcgacgttcgaaaaatcgacgttaatattaaccgtaccctaccaaataaacgaccaaccgccgatctaattcgaaatactatcgacgatcttaccgaccaccaaaatcttcttaccctttaccaacgacaacgttaaaccctcgttcttcaacaacaccaacgactaacgtacgacgcgccgcgccaaaacgcgatcttacaataccgcgtccttaccgacataaacattaatcgaaaaccgcttaccgaacaacccgacgcgcaacttcacgcgcacgatacgaatcacgacgtcgtcgatacgcgccatcgaaatttcgccgctttctacctatttaataatactaacgataaaaaccttccaatcgtccgacaccataaacatatccataccgacattcacgaactaaacgcaac

SEQ ID NO: 30967 - DNA, 727 bp, Artificial Sequence
  chemically treated genomic DNA (Homo sapiens) CpG-island No: 30967
cggcgataaaatgtaatgaagaaattatattaatgtatattaaataatacggtcggtcggtatattaatacggggtttttaggataggttttgtcggtaatcgttcgtagtacggttaggtttttcgtatggcggtcgttgtggcgtagcgtgtcggtcgggtcgatgtcgtcgtcgttttcggtatacggggtttcgtcgattacggcgattatcgcgtcgtagtcggttacgtttacgtttgtcgtatcggcgttgtaggttatatgcgcggcgtcggtcgtttcgcggatttcggttaggatgttgtcggcgttcgggaagtcggcgttggtattggtcgtgttttgttaggtgagcgattagtcgtcggtttggttcgagatgttgtcggcggttttgtcgattattaggatttttttgttttttgttagcggtagcgttgggttttcgttttttagtagtattagcgattggcgtacggcgcgtcgcgttagggcgcggttttgtaatgtcgcgtttttgtcggtataggtattggtcgaaggtcgtttgtcgaatagttcggcgcgtagttttacgcgtacgatgcgggttacggcgtcgtcgatgcgcgttatcgggatttcgtcgttttttatttgtttggtggtgttggcgatgaaggttttttagtcgttcggtattatgaatatgtttatgtcggtatttacggattgggcgtagt

SEQ ID NO: 30968 - DNA, 727 bp, Artificial Sequence
  chemically treated genomic DNA (Homo sapiens) CpG-island No: 30968
actacgcccaatccgtaaataccgacataaacatattcataataccgaacgactaaaaaaccttcatcgccaacaccaccaaacaaataaaaaacgacgaaatcccgataacgcgcatcgacgacgccgtaacccgcatcgtacgcgtaaaactacgcgccgaactattcgacaaacgaccttcgaccaatacctataccgacaaaaacgcgacattacaaaaccgcgccctaacgcgacgcgccgtacgccaatcgctaatactactaaaaaacgaaaacccaacgctaccgctaacaaaaaacaaaaaaatcctaataatcgacaaaaccgccgacaacatctcgaaccaaaccgacgactaatcgctcacctaacaaaacacgaccaataccaacgccgacttcccgaacgccgacaacatcctaaccgaaatccgcgaaacgaccgacgccgcgcatataacctacaacgccgatacgacaaacgtaaacgtaaccgactacgacgcgataatcgccgtaatcgacgaaaccccgtataccgaaaacgacgacgacatcgacccgaccgacacgctacgccacaacgaccgccatacgaaaaacctaaccgtactacgaacgattaccgacaaaacctatcctaaaaaccccgtattaatataccgaccgaccgtattatttaatatacattaatataatttcttcattacattttatcgccg

SEQ ID NO: 30969 - DNA, 776 bp, Artificial Sequence
  chemically treated genomic DNA (Homo sapiens) CpG-island No: 30969
cggtttcgaacgtttttcgtcgtttcgttcggtcgtagtcggtttttcgtgtttttcgttcggcgtttattggtcgtcgtcgtttcgaggttgtttagcgtttttttttagtttttgttcggggggtagcgggttttgttcgtcgttttttcgttagaagggcggttagggttgggataggaatgaattttttgcgggttcggtatttttttttagtttggggcgtcggtagcgcggcgggtagtgttgggattcgtggcgttcgcgttttagttttcgtttcgggtcgttatttttcggcggggttcgcggggcgtaggttgttttgtcgttggggtttcggttcgtttgtattgtgacgtgggtagtagttggggcgggtagtgtttcggttttcgttcggggacgcggtgattttttttttttttttcgattgtcggagttcgtggtggtggtgttggggggcggggtcggcgtgggtagagttgcgggggttgtcgcggaggtcgttttaggagggagggggcggatcggggtgtgaggtgagcggtcgtaatgagtattcgtaggagtaaggggttcggcgcgggtttttagggcgggaggttttgacgcggggaggaggcggtcgggcggttaagggtttttttggggagtgtgcggaggtcgggacggagtagcgcgtaattagggagaggataggtcgggttggtggagatgcggggagagattagttaaagttaaagagttaaagtaaaggtgttgcggggaggata

SEQ ID NO: 30970 - DNA, 776 bp, Artificial Sequence
  chemically treated genomic DNA (Homo sapiens) CpG-island No: 30970
tatcctccccgcaacacctttactttaactctttaactttaactaatctctccccgcatctccaccaacccgacctatcctctccctaattacgcgctactccgtcccgacctccgcacactccccaaaaaaacccttaaccgcccgaccgcctcctccccgcgtcaaaacctcccgccctaaaaacccgcgccgaaccccttactcctacgaatactcattacgaccgctcacctcacaccccgatccgccccctccctcctaaaacgacctccgcgacaacccccgcaactctacccacgccgaccccgccccccaacaccaccaccacgaactccgacaatcgaaaaaaaaaaaaaaaatcaccgcgtccccgaacgaaaaccgaaacactacccgccccaactactacccacgtcacaatacaaacgaaccgaaaccccaacgacaaaacaacctacgccccgcgaaccccgccgaaaaataacgacccgaaacgaaaactaaaacgcgaacgccacgaatcccaacactacccgccgcgctaccgacgccccaaactaaaaaaaaataccgaacccgcaaaaaattcattcctatcccaaccctaaccgcccttctaacgaaaaaacgacgaacaaaacccgctaccccccgaacaaaaactaaaaaaaaacgctaaacaacctcgaaacgacgacgaccaataaacgccgaacgaaaaacacgaaaaaccgactacgaccgaacgaaacgacgaaaaacgttcgaaaccg

SEQ ID NO: 30971 - DNA, 776 bp, Artificial Sequence
  chemically treated genomic DNA (Homo sapiens) CpG-island No: 30971
tgtttttttcgtagtatttttgttttggttttttagttttggttggttttttttcgtatttttattagttcggtttattttttttttagttacgcgttgtttcgtttcggttttcgtatattttttagggaggtttttggtcgttcggtcgtttttttttcgcgttagggtttttcgttttggaggttcgcgtcgggttttttgtttttgcgagtgtttattacggtcgtttattttatatttcggttcgtttttttttttttagggcggttttcgcggtagttttcgtagttttgtttacgtcgatttcgttttttagtattattattacgggtttcggtagtcggaaaaaaaaaagaaaattatcgcgttttcgagcggagatcgaggtattgttcgttttagttgttgtttacgttatagtgtaggcggatcggagttttagcggtagagtagtttgcgtttcgcgggtttcgtcgaagagtagcggttcggggcgggggttggagcgcgggcgttacgagttttagtattgttcgtcgcgttgtcggcgttttaggttggaggaggatgtcggattcgtagggaatttatttttgttttagttttggtcgtttttttgacggaggagcggcgggtaaaattcgttgtttttcgagtagaagttgaggggagacgttaggtagtttcggggcgacggcggttagtgggcgtcgagcgaggagtacgaagaatcggttgcggtcgggcgaggcggcgggaagcgttcggagtcg

SEQ ID NO: 30972 - DNA, 776 bp, Artificial Sequence
  chemically treated genomic DNA (Homo sapiens) CpG-island No: 30972
cgactccgaacgcttcccgccgcctcgcccgaccgcaaccgattcttcgtactcctcgctcgacgcccactaaccgccgtcgccccgaaactacctaacgtctcccctcaacttctactcgaaaaacaacgaattttacccgccgctcctccgtcaaaaaaacgaccaaaactaaaacaaaaataaattccctacgaatccgacatcctcctccaacctaaaacgccgacaacgcgacgaacaatactaaaactcgtaacgcccgcgctccaacccccgccccgaaccgctactcttcgacgaaacccgcgaaacgcaaactactctaccgctaaaactccgatccgcctacactataacgtaaacaacaactaaaacgaacaatacctcgatctccgctcgaaaacgcgataattttcttttttttttccgactaccgaaacccgtaataataatactaaaaaacgaaatcgacgtaaacaaaactacgaaaactaccgcgaaaaccgccctaaaaaaaaaaaaacgaaccgaaatataaaataaacgaccgtaataaacactcgcaaaaacaaaaaacccgacgcgaacctccaaaacgaaaaaccctaacgcgaaaaaaaaacgaccgaacgaccaaaaacctccctaaaaaatatacgaaaaccgaaacgaaacaacgcgtaactaaaaaaaaaataaaccgaactaataaaaatacgaaaaaaaaccaaccaaaactaaaaaaccaaaacaaaaatactacgaaaaaaaca

SEQ ID NO: 30973 - DNA, 663 bp, Artificial Sequence
  chemically treated genomic DNA (Homo sapiens) CpG-island No: 30973
tttatttcgtttcggtcgaattttgtgttgggtattggttttttaaggagttgttacgatggcgtcgttggtttcgttcggcggggagggtcgagaggtacgggaggggttggtggtggttgcgggtaaggggaaagcggggggggttgggggggggggtttgggtttatttttagtttcgggtcgggttacgtgacgggagtgacgttttcgaatgttgttgttggtggcggcggcgagcggagtcggaggagtcgtcgttaaagatggaggagtcgtcgaggaggtgttgtcgtcgttgtcgtcgtcgttgttgtcgtcgtcgttcgcgaagtcggagttcgagtcgtagcgggtgagcgcgtcgtttcggtttagattttatttttttcggatttcgggacgcgaggcggcgttttttttttttgttgtttttgttcgcgggtttttagcgcgcgcgtcgcgtttcgcgtttttttttttttttttcggttttgggagttagtcggcgtttttcgggagtatcggtagttcgtgagcgggatatcggggttgttgcgcgcgtttttttttgttttttttagataggggcgttttttttataggtaagggaggggttcgttttttcgcgttttgcgtttttaaatggttcggagatcggtt

SEQ ID NO: 30974 - DNA, 663 bp, Artificial Sequence
  chemically treated genomic DNA (Homo sapiens) CpG-island No: 30974
aaccgatctccgaaccatttaaaaacgcaaaacgcgaaaaaacgaacccctcccttacctataaaaaaaacgcccctatctaaaaaaaacaaaaaaaaacgcgcgcaacaaccccgatatcccgctcacgaactaccgatactcccgaaaaacgccgactaactcccaaaaccgaaaaaaaaaaaaaaaaacgcgaaacgcgacgcgcgcgctaaaaacccgcgaacaaaaacaacaaaaaaaaaaaacgccgcctcgcgtcccgaaatccgaaaaaaataaaatctaaaccgaaacgacgcgctcacccgctacgactcgaactccgacttcgcgaacgacgacgacaacaacgacgacgacaacgacgacaacacctcctcgacgactcctccatctttaacgacgactcctccgactccgctcgccgccgccaccaacaacaacattcgaaaacgtcactcccgtcacgtaacccgacccgaaactaaaaataaacccaaacccccccccccaaccccccccgctttccccttacccgcaaccaccaccaacccctcccgtacctctcgaccctccccgccgaacgaaaccaacgacgccatcgtaacaactccttaaaaaaccaatacccaacacaaaattcgaccgaaacgaaataaa

SEQ ID NO: 30975 - DNA, 663 bp, Artificial Sequence
  chemically treated genomic DNA (Homo sapiens) CpG-island No: 30975
ggtcggttttcgagttatttgggggcgtagggcgcgagaaggcgggttttttttttatttgtagggaaggcgtttttgtttgggaggggtagggaggggcgcgcgtagtaatttcgatgtttcgtttacgggttgtcgatgttttcggggggcgtcggttggtttttagggtcgggaggaaggaaggggggcgcggagcgcggcgcgcgcgttgggagttcgcggatagagatagtaggaggagggggcgtcgtttcgcgtttcggggttcggggaagatgggatttgggtcggggcggcgcgtttattcgttgcggttcgagtttcggtttcgcgggcggcggcggtagtagcggcggcggtagcggcggtagtattttttcgacggtttttttatttttggcggcggttttttcggtttcgttcgtcgtcgttattaataataatattcggagacgttattttcgttacgtgattcgattcggagttaaaaatagatttagatttttttttttagtttttttcgttttttttttgttcgtagttattattaatttttttcgtgtttttcggtttttttcgtcgggcggggttagcgacgttatcgtgatagttttttaaagggttagtgtttagtatagggttcggtcgagacggggtgga

SEQ ID NO: 30976 - DNA, 663 bp, Artificial Sequence
  chemically treated genomic DNA (Homo sapiens) CpG-island No: 30976
tccaccccgtctcgaccgaaccctatactaaacactaaccctttaaaaaactatcacgataacgtcgctaaccccgcccgacgaaaaaaaccgaaaaacacgaaaaaaattaataataactacgaacaaaaaaaaaacgaaaaaaactaaaaaaaaaaatctaaatctatttttaactccgaatcgaatcacgtaacgaaaataacgtctccgaatattattattaataacgacgacgaacgaaaccgaaaaaaccgccgccaaaaataaaaaaaccgtcgaaaaaatactaccgccgctaccgccgccgctactaccgccgccgcccgcgaaaccgaaactcgaaccgcaacgaataaacgcgccgccccgacccaaatcccatcttccccgaaccccgaaacgcgaaacgacgccccctcctcctactatctctatccgcgaactcccaacgcgcgcgccgcgctccgcgccccccttccttcctcccgaccctaaaaaccaaccgacgccccccgaaaacatcgacaacccgtaaacgaaacatcgaaattactacgcgcgcccctccctacccctcccaaacaaaaacgccttccctacaaataaaaaaaaaacccgccttctcgcgccctacgcccccaaataactcgaaaaccgacc

SEQ ID NO: 30977 - DNA, 620 bp, Artificial Sequence
  chemically treated genomic DNA (Homo sapiens) CpG-island No: 30977
gacgtcgattagggagttggcggtgaagcgtcgggtttcgcgttgggatcgtcggtcggcgagttggtgcgaatcgaggttaggaacgcgcgttttagttatcggtttttttattttcgcgtgtagaatagttgcgggtgttagtttcggtcgttcggtttaggttcggtagcggttttttgcgttattaggatattttttattttatcgtggcggtattcgtagatcgaagtatatttgattttttttattgatgtcgatgaaggtcgggacgtttatggtgtaggttcgggtatagcggatattttattcgtaagattacgtcgatcggaaaagggaattgggtcgcgcgacgttgttggcgtaattgttttcgggttattttgagcggcgatttgttggggcggggttttgagagttaattttatcgcgcgttttcgtcgcggaatgtagtagggcgtggtagacgcgttcgggttggtttagtgggtgggatttattgggtttttatttagcgacgtttgtcgcggtttttagtttttaggttcgtgtagttaattgtattgatgttgtttttcgttggcgtttttttaagtttatttttttttgaaatgttaagt

SEQ ID NO: 30978 - DNA, 620 bp, Artificial Sequence
  chemically treated genomic DNA (Homo sapiens) CpG-island No: 30978
acttaacatttcaaaaaaaaataaacttaaaaaaacgccaacgaaaaacaacatcaatacaattaactacacgaacctaaaaactaaaaaccgcgacaaacgtcgctaaataaaaacccaataaatcccacccactaaaccaacccgaacgcgtctaccacgccctactacattccgcgacgaaaacgcgcgataaaattaactctcaaaaccccgccccaacaaatcgccgctcaaaataacccgaaaacaattacgccaacaacgtcgcgcgacccaattcccttttccgatcgacgtaatcttacgaataaaatatccgctatacccgaacctacaccataaacgtcccgaccttcatcgacatcaataaaaaaaatcaaatatacttcgatctacgaataccgccacgataaaataaaaaatatcctaataacgcaaaaaaccgctaccgaacctaaaccgaacgaccgaaactaacacccgcaactattctacacgcgaaaataaaaaaaccgataactaaaacgcgcgttcctaacctcgattcgcaccaactcgccgaccgacgatcccaacgcgaaacccgacgcttcaccgccaactccctaatcgacgtc

SEQ ID NO: 30979 - DNA, 620 bp, Artificial Sequence
  chemically treated genomic DNA (Homo sapiens) CpG-island No: 30979
gtttaatattttaagggaaggtggatttagggaggcgttagcgggaggtaatattaatgtagttagttatacgggtttgaaaattggaggtcgcgataagcgtcgttgagtggaggtttagtaagttttatttattaggttagttcgagcgcgtttgttacgttttgttgtatttcgcggcgagagcgcgcgataggattggtttttaaggtttcgttttaataggtcgtcgtttagggtgattcggaagtagttgcgttagtagcgtcgcgcggtttagttttttttttcggtcggcgtggttttgcgagtggagtgttcgttgtgttcgggtttgtattatgagcgtttcggtttttatcgatattagtgaagaagattaggtgtgtttcggtttacgggtgtcgttacggtggggtgggggatgttttagtagcgtaagggatcgttgtcgagtttgggtcgggcggtcggggttgatattcgtagttgttttatacgcgagaatggggaggtcggtggttggggcgcgcgtttttggtttcgattcgtattagttcgtcggtcggcggttttagcgcggggttcgacgttttatcgttagttttttggtcggcgtt

SEQ ID NO: 30980 - DNA, 620 bp, Artificial Sequence
  chemically treated genomic DNA (Homo sapiens) CpG-island No: 30980
aacgccgaccaaaaaactaacgataaaacgtcgaaccccgcgctaaaaccgccgaccgacgaactaatacgaatcgaaaccaaaaacgcgcgccccaaccaccgacctccccattctcgcgtataaaacaactacgaatatcaaccccgaccgcccgacccaaactcgacaacgatcccttacgctactaaaacatcccccaccccaccgtaacgacacccgtaaaccgaaacacacctaatcttcttcactaatatcgataaaaaccgaaacgctcataatacaaacccgaacacaacgaacactccactcgcaaaaccacgccgaccgaaaaaaaaaactaaaccgcgcgacgctactaacgcaactacttccgaatcaccctaaacgacgacctattaaaacgaaaccttaaaaaccaatcctatcgcgcgctctcgccgcgaaatacaacaaaacgtaacaaacgcgctcgaactaacctaataaataaaacttactaaacctccactcaacgacgcttatcgcgacctccaattttcaaacccgtataactaactacattaatattacctcccgctaacgcctccctaaatccaccttcccttaaaatattaaac

SEQ ID NO: 30981 - DNA, 696 bp, Artificial Sequence
  chemically treated genomic DNA (Homo sapiens) CpG-island No: 30981
taatgcgcggcgcgagcgtcggtcgcgattcgttttttttcgcgagagttcggcggggatataagggggagttgcgggttaggcggcggttttttagcgtcgcgtagggtcggggattgcgcggcggtgttaggtcgggcgtgggcgagagtacgaacgggttgtttgcgggttgagagcgtcgagttgttattatgggtgattacgtttggagttttttaaaggattttttggtcgggggcgtcgtcgttgtcgtttttaagatcgcggtcgtttttatcgagagggttaaattgttgttgtaggtgaggatcgcgcggtgtaagaggcgggcgcgggcgcggcgggtcgggcggggcgcgcgatgcggcgcgagttgtagggcgcggggcgtcgcggaaaatttgcgttaggttttagggtcgggcgttcgttcgttcgttcgtttttcgttcgcgggggaagaaggtgttttttgcgtagagataggtttagcgttagtcgtagatttttggtgtcgggtggcgttcggcgttcgggtgtttatatatggaaatttattcggagtcggtttacgtgtgttagattttgcgttcgtgatagtacgggcgtgtatttaggttcggaggtatttagtgattgttagtatttttggtatcgttttatgcgtacgtatttttataataaaaatattaa

SEQ ID NO: 30982 - DNA, 696 bp, Artificial Sequence
  chemically treated genomic DNA (Homo sapiens) CpG-island No: 30982
ttaatatttttattataaaaatacgtacgcataaaacgataccaaaaatactaacaatcactaaatacctccgaacctaaatacacgcccgtactatcacgaacgcaaaatctaacacacgtaaaccgactccgaataaatttccatatataaacacccgaacgccgaacgccacccgacaccaaaaatctacgactaacgctaaacctatctctacgcaaaaaacaccttcttcccccgcgaacgaaaaacgaacgaacgaacgaacgcccgaccctaaaacctaacgcaaattttccgcgacgccccgcgccctacaactcgcgccgcatcgcgcgccccgcccgacccgccgcgcccgcgcccgcctcttacaccgcgcgatcctcacctacaacaacaatttaaccctctcgataaaaacgaccgcgatcttaaaaacgacaacgacgacgcccccgaccaaaaaatcctttaaaaaactccaaacgtaatcacccataataacaactcgacgctctcaacccgcaaacaacccgttcgtactctcgcccacgcccgacctaacaccgccgcgcaatccccgaccctacgcgacgctaaaaaaccgccgcctaacccgcaactcccccttatatccccgccgaactctcgcgaaaaaaaacgaatcgcgaccgacgctcgcgccgcgcatta

SEQ ID NO: 30983 - DNA, 696 bp, Artificial Sequence
  chemically treated genomic DNA (Homo sapiens) CpG-island No: 30983
ttgatgtttttattgtaaaggtgcgtgcgtataagacggtgttaaaaatattggtaattattaggtgttttcgggtttgagtgtacgttcgtgttgttacgggcgtaggatttggtatacgtaaatcggtttcgggtgggtttttatatatagatattcgaacgtcgggcgttattcgatattaggaatttgcgattgacgttggatttgtttttacgtagagggtatttttttttttcgcgggcggggggcgggcgggcgggcgggcgttcggttttggggtttggcgtagatttttcgcggcgtttcgcgttttgtagttcgcgtcgtatcgcgcgtttcgttcggttcgtcgcgttcgcgttcgttttttgtatcgcgcggtttttatttgtagtagtagtttgattttttcgatgggggcgatcgcggttttggagacggtagcggcgacgttttcggttaggaagttttttaggaagttttaagcgtgattatttatggtgatagttcgacgtttttagttcgtaggtagttcgttcgtgttttcgtttacgttcggtttggtatcgtcgcgtagttttcgattttgcgcgacgttagggggtcgtcgtttggttcgtagtttttttttatattttcgtcgggttttcgcgagaggaggcgggtcgcggtcggcgttcgcgtcgcgtattg

SEQ ID NO: 30984 - DNA, 696 bp, Artificial Sequence
  chemically treated genomic DNA (Homo sapiens) CpG-island No: 30984
caatacgcgacgcgaacgccgaccgcgacccgcctcctctcgcgaaaacccgacgaaaatataaaaaaaaactacgaaccaaacgacgaccccctaacgtcgcgcaaaatcgaaaactacgcgacgataccaaaccgaacgtaaacgaaaacacgaacgaactacctacgaactaaaaacgtcgaactatcaccataaataatcacgcttaaaacttcctaaaaaacttcctaaccgaaaacgtcgccgctaccgtctccaaaaccgcgatcgcccccatcgaaaaaatcaaactactactacaaataaaaaccgcgcgatacaaaaaacgaacgcgaacgcgacgaaccgaacgaaacgcgcgatacgacgcgaactacaaaacgcgaaacgccgcgaaaaatctacgccaaaccccaaaaccgaacgcccgcccgcccgcccgccccccgcccgcgaaaaaaaaaaataccctctacgtaaaaacaaatccaacgtcaatcgcaaattcctaatatcgaataacgcccgacgttcgaatatctatatataaaaacccacccgaaaccgatttacgtataccaaatcctacgcccgtaacaacacgaacgtacactcaaacccgaaaacacctaataattaccaatatttttaacaccgtcttatacgcacgcacctttacaataaaaacatcaa

SEQ ID NO: 30985 - DNA, 581 bp, Artificial Sequence
  chemically treated genomic DNA (Homo sapiens) CpG-island No: 30985
atcggtcgtagtatttagttttcggtatcgcggtgaggatcgcgttcgcgttacgcgcgtcgaaaggatttcgcgagtttttgtaggtaacgggttcggtgtagttcggagtttagattaggtagttgttgagttatgttcgggcgagatcggtgttttttagggtgggaggtttagaaatttaggcgcgcgagtttttgggtagtggtaagggcgggttgggagtcgggttcggcgagtttaaaggaggttttcgggttgtagaggtttcggtaggttgttttcgttttacgagtttttttttttgcggttttttggattgcggcgacgaagcgtcggggttggggttttagtcgtttggggatgcgttgcgcgtttagggcggtttcggggttttgaggcgggattgagggtgcgggagggcggaagggggcgcggacgtttcggaatttacggttcgggttgaattagggtttggaagattttcgggaaagtacgggcgttttgtgttcgggatgtgtgttgcgggtcggattgggggttaggttgagaagggggtattaagatttattttattttat

SEQ ID NO: 30986 - DNA, 581 bp, Artificial Sequence
  chemically treated genomic DNA (Homo sapiens) CpG-island No: 30986
ataaaataaaataaatcttaatacccccttctcaacctaacccccaatccgacccgcaacacacatcccgaacacaaaacgcccgtactttcccgaaaatcttccaaaccctaattcaacccgaaccgtaaattccgaaacgtccgcgcccccttccgccctcccgcaccctcaatcccgcctcaaaaccccgaaaccgccctaaacgcgcaacgcatccccaaacgactaaaaccccaaccccgacgcttcgtcgccgcaatccaaaaaaccgcaaaaaaaaaaactcgtaaaacgaaaacaacctaccgaaacctctacaacccgaaaacctcctttaaactcgccgaacccgactcccaacccgcccttaccactacccaaaaactcgcgcgcctaaatttctaaacctcccaccctaaaaaacaccgatctcgcccgaacataactcaacaactacctaatctaaactccgaactacaccgaacccgttacctacaaaaactcgcgaaatcctttcgacgcgcgtaacgcgaacgcgatcctcaccgcgataccgaaaactaaatactacgaccgat

SEQ ID NO: 30987 - DNA, 581 bp, Artificial Sequence
  chemically treated genomic DNA (Homo sapiens) CpG-island No: 30987
ataaaataaagtaaattttagtgttttttttttaatttaatttttagttcgattcgtagtatatatttcggatatagaacgttcgtattttttcgagggttttttaagttttggtttagttcggatcgtgagtttcggagcgttcgcgttttttttcgttttttcgtatttttagtttcgttttagggtttcgaagtcgttttgggcgcgtagcgtatttttaggcgattggagttttagtttcgacgtttcgtcgtcgtagtttaggagatcgtaggagaaggggttcgtggggcggagatagtttgtcggggtttttgtagttcgggagttttttttggattcgtcgaattcgatttttaattcgtttttattattgtttagaggttcgcgcgtttgggtttttgagttttttattttgaaggatatcgatttcgttcggatataatttagtaattgtttggtttgggtttcggattgtatcgagttcgttatttgtaggagttcgcggagttttttcggcgcgcgtggcgcgggcgcggtttttatcgcggtgtcgggaattgagtgttgcggtcggt

SEQ ID NO: 30988 - DNA, 581 bp, Artificial Sequence
  chemically treated genomic DNA (Homo sapiens) CpG-island No: 30988
accgaccgcaacactcaattcccgacaccgcgataaaaaccgcgcccgcgccacgcgcgccgaaaaaactccgcgaactcctacaaataacgaactcgatacaatccgaaacccaaaccaaacaattactaaattatatccgaacgaaatcgatatccttcaaaataaaaaactcaaaaacccaaacgcgcgaacctctaaacaataataaaaacgaattaaaaatcgaattcgacgaatccaaaaaaaactcccgaactacaaaaaccccgacaaactatctccgccccacgaaccccttctcctacgatctcctaaactacgacgacgaaacgtcgaaactaaaactccaatcgcctaaaaatacgctacgcgcccaaaacgacttcgaaaccctaaaacgaaactaaaaatacgaaaaaacgaaaaaaaacgcgaacgctccgaaactcacgatccgaactaaaccaaaacttaaaaaaccctcgaaaaaatacgaacgttctatatccgaaatatatactacgaatcgaactaaaaattaaattaaaaaaaaaacactaaaatttactttattttat

SEQ ID NO: 30989 - DNA, 1520 bp, Artificial Sequence
  chemically treated genomic DNA (Homo sapiens) CpG-island No: 30989
cgcgggatgggcgcgcggttggtgtttgggttgttgtttttttttgtcgttttcgtttagtttggcggtcgttaagtagttttttcggtatcggttggtcgaggagggtttcgtcgacgttcgtatcggtaacgtggttttagatttgggtatcgtgatcggatcgggtgaggtgatttttagtttggagttcggtttcgagtatttgaagatcgataattttattggcgagttgagtacgagcgagcggcgtatcgatcgcgagaagttgttttagtgttagatgattttcgacgagaacgagtgttttttggatttcgaggtgtcggtgatcgggttttcgtagagttgggtggatttgtttgagggttaggttatcgtgtttgatattaacgataatacgtttattttttcgtcgttcgtgtttacgtttacggtggaggagaatcggtcggtgggtatattttatttgttgtttatagttatcgatcgcgatttcggtcgtaacggtatcgagcgttacgagttgttttaggagttcggaggcggcggtagcggcggcgagagtcggcgcgtcggggcggtcgatagcgtttttttatttcgggggcggcgggaacggcgcgagcggcggcggttcgggaggttttaagcggcggttggacgtattagagggcggcggcggtattaatttcggcggtcgtagtagcgtgttcgagttgtaggtggcggatatttcggacggcgagaagtagtcgtagttgatcgtgaagggggcgttggatcgcgagtagcgcgatttttacgagttgattttgcgagtgcgcgacggcggcgattcgtttcgtttttcgtaggttattttacgggtttttattatcgacgtgaacgataatagttttcgtttcgagaagagcgtgtacgaggtcgatttggttgagaatagcgtttcggggatttttattttgtaattgcgcgtagtcgatttggacgtgggggttaacgggtagatcgaatacgtgttcggggcggttatcgagtcggtgaggcggttgttgcgttttgacgagacgttcggttggtttagcgttttgtatcggatcgatcgcgaggaggtgaattagttgcgttttacggttatggttcgcgatcgcgggtagttttttaagatcgataaggttatcgtggtttttaatattaaagacgagaacgataacgtgtcgtttattgaaattcgtaagattgggcgtattttttttaaggacggggtggttaacgtggtcgaggacgttttggtcgatatttttatcgttttggtgtaggtgttcgatcgagattaaggcgagaacggggtggttatttgtatcgtggtgggcgacgtgtttttttagtttaagttagttagcgatatcgagggcgattagaataagaaaaagtattttttgtatatttcgatttttttggattatgaggttattcgggagtttaacgtggttatcgtggcggtggatttaggtagt

SEQ ID NO: 30990 - DNA, 1520 bp, Artificial Sequence
  chemically treated genomic DNA (Homo sapiens) CpG-island No: 30990
actacctaaatccaccgccacgataaccacgttaaactcccgaataacctcataatccaaaaaaatcgaaatatacaaaaaatactttttcttattctaatcgccctcgatatcgctaactaacttaaactaaaaaaacacgtcgcccaccacgatacaaataaccaccccgttctcgccttaatctcgatcgaacacctacaccaaaacgataaaaatatcgaccaaaacgtcctcgaccacgttaaccaccccgtccttaaaaaaaatacgcccaatcttacgaatttcaataaacgacacgttatcgttctcgtctttaatattaaaaaccacgataaccttatcgatcttaaaaaactacccgcgatcgcgaaccataaccgtaaaacgcaactaattcacctcctcgcgatcgatccgatacaaaacgctaaaccaaccgaacgtctcgtcaaaacgcaacaaccgcctcaccgactcgataaccgccccgaacacgtattcgatctacccgttaacccccacgtccaaatcgactacgcgcaattacaaaataaaaatccccgaaacgctattctcaaccaaatcgacctcgtacacgctcttctcgaaacgaaaactattatcgttcacgtcgataataaaaacccgtaaaataacctacgaaaaacgaaacgaatcgccgccgtcgcgcactcgcaaaatcaactcgtaaaaatcgcgctactcgcgatccaacgcccccttcacgatcaactacgactacttctcgccgtccgaaatatccgccacctacaactcgaacacgctactacgaccgccgaaattaataccgccgccgccctctaatacgtccaaccgccgcttaaaacctcccgaaccgccgccgctcgcgccgttcccgccgcccccgaaataaaaaaacgctatcgaccgccccgacgcgccgactctcgccgccgctaccgccgcctccgaactcctaaaacaactcgtaacgctcgataccgttacgaccgaaatcgcgatcgataactataaacaacaaataaaatatacccaccgaccgattctcctccaccgtaaacgtaaacacgaacgacgaaaaaataaacgtattatcgttaatatcaaacacgataacctaaccctcaaacaaatccacccaactctacgaaaacccgatcaccgacacctcgaaatccaaaaaacactcgttctcgtcgaaaatcatctaacactaaaacaacttctcgcgatcgatacgccgctcgctcgtactcaactcgccaataaaattatcgatcttcaaatactcgaaaccgaactccaaactaaaaatcacctcacccgatccgatcacgatacccaaatctaaaaccacgttaccgatacgaacgtcgacgaaaccctcctcgaccaaccgataccgaaaaaactacttaacgaccgccaaactaaacgaaaacgacaaaaaaaaacaacaacccaaacaccaaccgcgcgcccatcccgcg

SEQ ID NO: 30991 - DNA, 1520 bp, Artificial Sequence
  chemically treated genomic DNA (Homo sapiens) CpG-island No: 30991
gttgtttgagtttatcgttacgatgattacgttgaattttcgggtggttttatagtttagaggggtcgaggtgtgtaagaagtatttttttttgttttggtcgttttcggtgtcgttggttggtttgagttggaagggtacgtcgtttattacggtgtaggtgattatttcgttttcgttttggtttcggtcggatatttgtattagagcgatgggggtgtcgattagaacgttttcggttacgttggttatttcgtttttgagggggatgcgtttaattttgcggattttaatggacggtacgttgtcgttttcgtttttgatgttaaggattacggtggttttgtcggttttggggggttgttcgcggtcgcgggttatgatcgtgaagcgtagttggtttattttttcgcggtcgattcggtgtaggacgttgagttagtcggacgtttcgttaaggcgtagtagtcgttttatcgattcggtggtcgtttcgaatacgtattcgatttgttcgttgatttttacgtttaagtcggttgcgcgtagttgtaggatgggggttttcggggcgttgtttttagttaagtcggtttcgtatacgtttttttcgaagcgggggttgttgtcgtttacgtcggtgatgaggattcgtaggatggtttgcgaggagcgaggcgggtcgtcgtcgtcgcgtattcgtagggttagttcgtaggagtcgcgttgttcgcggtttagcgttttttttacgattagttgcggttgtttttcgtcgttcggggtgttcgttatttgtagttcgaatacgttgttgcggtcgtcggggttggtgtcgtcgtcgttttttgatgcgtttagtcgtcgtttggagtttttcgagtcgtcgtcgttcgcgtcgttttcgtcgttttcggggtaggggggcgttgtcggtcgtttcggcgcgtcggttttcgtcgtcgttgtcgtcgttttcgggtttttggagtagttcgtagcgttcgatgtcgttgcggtcgaagtcgcggtcggtggttgtgggtagtaggtaaagtgtgtttatcggtcgatttttttttatcgtgagcgtgagtacgggcgacgggaaggtgggcgtgttgtcgttgatgttaagtacgatgatttgatttttaaataggtttatttagttttgcgagggttcgattatcgatatttcgaagtttaggaagtattcgttttcgtcgaagattatttgatattggggtagtttttcgcggtcgatgcgtcgttcgttcgtgtttagttcgttagtgaggttgtcgatttttaggtattcggaatcggattttaggttgaaagttattttattcgattcggttacgatgtttaggtttgaagttacgttgtcgatgcggacgtcggcggggtttttttcggttagtcggtatcggaggagttgtttggcggtcgttaggttgagcgagagcggtaggaggaggtagtagtttaagtattagtcgcgcgtttatttcgcg

SEQ ID NO: 30992 - DNA, 1520 bp, Artificial Sequence
  chemically treated genomic DNA (Homo sapiens) CpG-island No: 30992
cgcgaaataaacgcgcgactaatacttaaactactacctcctcctaccgctctcgctcaacctaacgaccgccaaacaactcctccgataccgactaaccgaaaaaaaccccgccgacgtccgcatcgacaacgtaacttcaaacctaaacatcgtaaccgaatcgaataaaataactttcaacctaaaatccgattccgaatacctaaaaatcgacaacctcactaacgaactaaacacgaacgaacgacgcatcgaccgcgaaaaactaccccaatatcaaataatcttcgacgaaaacgaatacttcctaaacttcgaaatatcgataatcgaaccctcgcaaaactaaataaacctatttaaaaatcaaatcatcgtacttaacatcaacgacaacacgcccaccttcccgtcgcccgtactcacgctcacgataaaaaaaaatcgaccgataaacacactttacctactacccacaaccaccgaccgcgacttcgaccgcaacgacatcgaacgctacgaactactccaaaaacccgaaaacgacgacaacgacgacgaaaaccgacgcgccgaaacgaccgacaacgcccccctaccccgaaaacgacgaaaacgacgcgaacgacgacgactcgaaaaactccaaacgacgactaaacgcatcaaaaaacgacgacgacaccaaccccgacgaccgcaacaacgtattcgaactacaaataacgaacaccccgaacgacgaaaaacaaccgcaactaatcgtaaaaaaaacgctaaaccgcgaacaacgcgactcctacgaactaaccctacgaatacgcgacgacgacgacccgcctcgctcctcgcaaaccatcctacgaatcctcatcaccgacgtaaacgacaacaacccccgcttcgaaaaaaacgtatacgaaaccgacttaactaaaaacaacgccccgaaaacccccatcctacaactacgcgcaaccgacttaaacgtaaaaatcaacgaacaaatcgaatacgtattcgaaacgaccaccgaatcgataaaacgactactacgccttaacgaaacgtccgactaactcaacgtcctacaccgaatcgaccgcgaaaaaataaaccaactacgcttcacgatcataacccgcgaccgcgaacaaccccccaaaaccgacaaaaccaccgtaatccttaacatcaaaaacgaaaacgacaacgtaccgtccattaaaatccgcaaaattaaacgcatccccctcaaaaacgaaataaccaacgtaaccgaaaacgttctaatcgacacccccatcgctctaatacaaatatccgaccgaaaccaaaacgaaaacgaaataatcacctacaccgtaataaacgacgtacccttccaactcaaaccaaccaacgacaccgaaaacgaccaaaacaaaaaaaaatacttcttacacacctcgacccctctaaactataaaaccacccgaaaattcaacgtaatcatcgtaacgataaactcaaacaac

SEQ ID NO: 30993 - DNA, 874 bp, Artificial Sequence
  chemically treated genomic DNA (Homo sapiens) CpG-island No: 30993
tgtttcggaacggtttacggtcgtttaagaaggtcgatttttgtcggtttttttgttaggggaggagaaattttagattttatagcgaacgttttaggttcgttgaaacgagtttttttgtttttacgaaatttcgttttaggggtttggcgcggtgggttttttatcgtgttagtttcgtgggcgtttttcggttgttcgtttcgtttcgtgtttcggtgttcgtcgcgtgtttatttagtcgttttgagtttgtagttaggcgcggtgttgttttatgagtcgcgagtttagtaaggttattaggcgttggtagtttcgggcgacgtcgtttttttgtttttttagtcgcggttggaagttttattttttttatcgggcggttattagcggttttttttttagtagcgtttttgcgaaggttacgagcgttattattttgttttaggtggggtcggggttgtcggagagtacggaattcgttattagcgttattagttcgaagcggttttcggggtagtcgaggtaggcggagaaaaaggatcggtgaatttgtcgtaatttggcggtcgcggagcgtagtacggcggtttcgggcgtggatggcgtcggttcgggggtgtcgggttttcgggcgtagtattttaggtagtcggttagtaatagttcggtgcgttttcgtagcgggtcggttatggtggtgcgttttcgtaattggttaattatggttcggtttttgttggggggtcgggttttcgttggtttttttggttcggtcgcgttttttttagggtagggttgtcgtgtttcgtttcggttttcggttttcggttttcggtatattgttttttaggattgagagaagagtttttga

SEQ ID NO: 30994 - DNA, 874 bp, Artificial Sequence
  chemically treated genomic DNA (Homo sapiens) CpG-island No: 30994
tcaaaaactcttctctcaatcctaaaaaacaatataccgaaaaccgaaaaccgaaaaccgaaacgaaacacgacaaccctaccctaaaaaaaacgcgaccgaaccaaaaaaaccaacgaaaacccgaccccccaacaaaaaccgaaccataattaaccaattacgaaaacgcaccaccataaccgacccgctacgaaaacgcaccgaactattactaaccgactacctaaaatactacgcccgaaaacccgacacccccgaaccgacgccatccacgcccgaaaccgccgtactacgctccgcgaccgccaaattacgacaaattcaccgatcctttttctccgcctacctcgactaccccgaaaaccgcttcgaactaataacgctaataacgaattccgtactctccgacaaccccgaccccacctaaaacaaaataataacgctcgtaaccttcgcaaaaacgctactaaaaaaaaaaccgctaataaccgcccgataaaaaaaataaaacttccaaccgcgactaaaaaaacaaaaaaacgacgtcgcccgaaactaccaacgcctaataaccttactaaactcgcgactcataaaacaacaccgcgcctaactacaaactcaaaacgactaaataaacacgcgacgaacaccgaaacacgaaacgaaacgaacaaccgaaaaacgcccacgaaactaacacgataaaaaacccaccgcgccaaacccctaaaacgaaatttcgtaaaaacaaaaaaactcgtttcaacgaacctaaaacgttcgctataaaatctaaaatttctcctcccctaacaaaaaaaccgacaaaaatcgaccttcttaaacgaccgtaaaccgttccgaaaca

SEQ ID NO: 30995 - DNA, 874 bp, Artificial Sequence
  chemically treated genomic DNA (Homo sapiens) CpG-island No: 30995
ttaaaggttttttttttagttttgaaaaataatatatcgggggtcgggggtcgggggtcggggcggggtacggtagttttattttgggggaggcgcggtcgggttaagaaaattagcgaaggttcggttttttagtagaggtcggattatggttgattagttgcgggagcgtattattatggtcgattcgttgcgggagcgtatcgagttgttgttggtcgattatttggggtattgcgttcgggaattcggtattttcgagtcggcgttatttacgttcgaggtcgtcgtgttgcgtttcgcggtcgttaggttacggtagatttatcggtttttttttttcgtttatttcggttatttcgggaatcgtttcgagttggtggcgttgatggcggatttcgtgtttttcgatagtttcggttttatttggggtagagtggtgacgttcgtgattttcgtagggacgttgttggagagagggtcgttggtgatcgttcggtggaagaagtggggtttttagtcgcggttaaaggagtaggagggcgacgtcgttcgggattgttagcgtttggtggttttgttgagttcgcggtttatggggtagtatcgcgtttggttgtaggtttagggcggttgggtgagtacgcggcggatatcgggatacggggcgggacgggtagtcgggaagcgtttacgaggttggtacggtgaggaatttatcgcgttaggtttttggaacgaggtttcgtgaaagtagaaaggttcgttttagcgggtttggaacgttcgttgtgaagtttggggtttttttttttttggtagaaaggtcggtagaaatcggtttttttagacggtcgtgaatcgtttcgaagta

SEQ ID NO: 30996 - DNA, 874 bp, Artificial Sequence
  chemically treated genomic DNA (Homo sapiens) CpG-island No: 30996
tacttcgaaacgattcacgaccgtctaaaaaaaccgatttctaccgacctttctaccaaaaaaaaaaaaaccccaaacttcacaacgaacgttccaaacccgctaaaacgaacctttctactttcacgaaacctcgttccaaaaacctaacgcgataaattcctcaccgtaccaacctcgtaaacgcttcccgactacccgtcccgccccgtatcccgatatccgccgcgtactcacccaaccgccctaaacctacaaccaaacgcgatactaccccataaaccgcgaactcaacaaaaccaccaaacgctaacaatcccgaacgacgtcgccctcctactcctttaaccgcgactaaaaaccccacttcttccaccgaacgatcaccaacgaccctctctccaacaacgtccctacgaaaatcacgaacgtcaccactctaccccaaataaaaccgaaactatcgaaaaacacgaaatccgccatcaacgccaccaactcgaaacgattcccgaaataaccgaaataaacgaaaaaaaaaaaccgataaatctaccgtaacctaacgaccgcgaaacgcaacacgacgacctcgaacgtaaataacgccgactcgaaaataccgaattcccgaacgcaataccccaaataatcgaccaacaacaactcgatacgctcccgcaacgaatcgaccataataatacgctcccgcaactaatcaaccataatccgacctctactaaaaaaccgaaccttcgctaattttcttaacccgaccgcgcctcccccaaaataaaactaccgtaccccgccccgacccccgacccccgacccccgatatattatttttcaaaactaaaaaaaaaacctttaa

SEQ ID NO: 30997 - DNA, 670 bp, Artificial Sequence
  chemically treated genomic DNA (Homo sapiens) CpG-island No: 30997
tcgggagtcgatagtcgtcggtgattttggttttgttagttttatagttttgtagggttcggtattcgtcggtaagtagggggtcggcggttcgatgaatgtagtcgtttattgcgggaagggcgggcgcgattgagttggtttggtaaggttgcggtttcggggtgagtatttttagtttcgagaagtttttcggcgatgcgaggatttatgcggagtcgcgttttaatttcgtggttttcggtcgcggtcgttgtttttattttcgttcggaatgttttatatttggggaaatcgaggcgtagagcgggacggttttgggtttggcgggaagtcgcgtaaggaggtcggtagggggcgtattcggtttattttgttttttttaggtcgcgtcgttagggtttaggtagggcggtttcgggaggcgggggtcgtcgggataggaatcgtcgttcgagtcggggtgacggggaagttttattttttttttcgacgtttttttttagttttgtttcgggcgcgttgtagggttcgcgattagtcgttgttttcgttcgggttttagagtcggtgcgattttaaggtttatttttttaggcggcgttttattacggggcggcggtaaattttaggatttattttgcggatgaggaaatcgaggttattttgt

SEQ ID NO: 30998 - DNA, 670 bp, Artificial Sequence
  chemically treated genomic DNA (Homo sapiens) CpG-island No: 30998
acaaaataacctcgatttcctcatccgcaaaataaatcctaaaatttaccgccgccccgtaataaaacgccgcctaaaaaaataaaccttaaaatcgcaccgactctaaaacccgaacgaaaacaacgactaatcgcgaaccctacaacgcgcccgaaacaaaactaaaaaaaaacgtcgaaaaaaaaaataaaacttccccgtcaccccgactcgaacgacgattcctatcccgacgacccccgcctcccgaaaccgccctacctaaaccctaacgacgcgacctaaaaaaaacaaaataaaccgaatacgccccctaccgacctccttacgcgacttcccgccaaacccaaaaccgtcccgctctacgcctcgatttccccaaatataaaacattccgaacgaaaataaaaacaacgaccgcgaccgaaaaccacgaaattaaaacgcgactccgcataaatcctcgcatcgccgaaaaacttctcgaaactaaaaatactcaccccgaaaccgcaaccttaccaaaccaactcaatcgcgcccgcccttcccgcaataaacgactacattcatcgaaccgccgaccccctacttaccgacgaataccgaaccctacaaaactataaaactaacaaaaccaaaatcaccgacgactatcgactcccga

SEQ ID NO: 30999 - DNA, 670 bp, Artificial Sequence
  chemically treated genomic DNA (Homo sapiens) CpG-island No: 30999
ataaggtggtttcggtttttttattcgtaaaatgggttttagggtttgtcgtcgtttcgtgatggggcgtcgtttggggaggtgggttttgggatcgtatcgattttgaggttcgggcggaggtagcgattggtcgcgggttttgtagcgcgttcgggatagggttagggaggggcgtcggggaggaaggtgaagttttttcgttatttcggttcgggcggcggtttttgtttcggcggttttcgtttttcggagtcgttttgtttgggttttggcggcgcggtttggaagggatagggtgggtcgggtgcgttttttgtcggtttttttgcgcgatttttcgttaggtttagggtcgtttcgttttgcgtttcggtttttttagatgtgaaatatttcgggcgggggtgggggtagcggtcgcggtcggaggttacggggttggggcgcggtttcgtatgggttttcgtatcgtcgagaggtttttcgggattgagggtgtttatttcggggtcgtagttttgttaggttagtttagtcgcgttcgtttttttcgtagtggacggttgtatttatcgggtcgtcggttttttgtttatcgacgagtgtcggattttgtagagttgtaagattggtaaggttaagattatcggcggttatcggttttcgg

SEQ ID NO: 31000 - DNA, 670 bp, Artificial Sequence
  chemically treated genomic DNA (Homo sapiens) CpG-island No: 31000
ccgaaaaccgataaccgccgataatcttaaccttaccaatcttacaactctacaaaatccgacactcgtcgataaacaaaaaaccgacgacccgataaatacaaccgtccactacgaaaaaaacgaacgcgactaaactaacctaacaaaactacgaccccgaaataaacaccctcaatcccgaaaaacctctcgacgatacgaaaacccatacgaaaccgcgccccaaccccgtaacctccgaccgcgaccgctacccccacccccgcccgaaatatttcacatctaaaaaaaccgaaacgcaaaacgaaacgaccctaaacctaacgaaaaatcgcgcaaaaaaaccgacaaaaaacgcacccgacccaccctatcccttccaaaccgcgccgccaaaacccaaacaaaacgactccgaaaaacgaaaaccgccgaaacaaaaaccgccgcccgaaccgaaataacgaaaaaacttcaccttcctccccgacgcccctccctaaccctatcccgaacgcgctacaaaacccgcgaccaatcgctacctccgcccgaacctcaaaatcgatacgatcccaaaacccacctccccaaacgacgccccatcacgaaacgacgacaaaccctaaaacccattttacgaataaaaaaaccgaaaccaccttat

SEQ ID NO: 31001 - DNA, 558 bp, Artificial Sequence
  chemically treated genomic DNA (Homo sapiens) CpG-island No: 31001
tttcgtcgtcgtcgtcgcgaggggagaggcggtcgtatagtttggtttttcgcgttttgttcgtcgtcgtcgttcgcgcgggtatcgtcgttggttttcgtttcgtcgtcgagcgtattcgtttcgggtatacgtatttcgtcgttggacgtatttttcgtatttttttcgcggtttcgtcgggcgttcgagtcgggtagatgcgtcgtcgcgcgtttttcgtttcgggttcgttatcgtgttttgtcgcgcgtcgggggtttttttttcgggtttttttgggcgtttttcggttttggttttcgttcgttttttggaataatttttgaggttttagtcgttatcgtaaagtttttcgaggagattcgttttttcggtcgttgcgtaggtagggttggttgtatcgggcgggggtcggggttcgcgcgtttgggatagggcgttagagtcgacggggcgggggtcgggggttcgggggtatcgaagcgttacggggttaggtagtttggttttgttttagagcggcgggagatgggacgtttagtttttgggatttgg

SEQ ID NO: 31002 - DNA, 558 bp, Artificial Sequence
  chemically treated genomic DNA (Homo sapiens) CpG-island No: 31002
ccaaatcccaaaaactaaacgtcccatctcccgccgctctaaaacaaaaccaaactacctaaccccgtaacgcttcgatacccccgaacccccgacccccgccccgtcgactctaacgccctatcccaaacgcgcgaaccccgacccccgcccgatacaaccaaccctacctacgcaacgaccgaaaaaacgaatctcctcgaaaaactttacgataacgactaaaacctcaaaaattattccaaaaaacgaacgaaaaccaaaaccgaaaaacgcccaaaaaaacccgaaaaaaaaacccccgacgcgcgacaaaacacgataacgaacccgaaacgaaaaacgcgcgacgacgcatctacccgactcgaacgcccgacgaaaccgcgaaaaaaatacgaaaaatacgtccaacgacgaaatacgtatacccgaaacgaatacgctcgacgacgaaacgaaaaccaacgacgatacccgcgcgaacgacgacgacgaacaaaacgcgaaaaaccaaactatacgaccgcctctcccctcgcgacgacgacgacgaaa

SEQ ID NO: 31003 - DNA, 558 bp, Artificial Sequence
  chemically treated genomic DNA (Homo sapiens) CpG-island No: 31003
ttaaattttaaaggttgggcgttttatttttcgtcgttttggggtaaagttaggttgtttgatttcgtggcgtttcggtgttttcgggttttcggttttcgtttcgtcggttttggcgttttgttttagacgcgcggatttcgattttcgttcggtgtagttagttttatttgcgtagcggtcggggaggcgggttttttcgggaaattttgcggtgacggttggagttttaggggttattttaaggagcgggcgggaattagagtcggagggcgtttaggggggttcgggagaggagttttcggcgcgcggtagagtacggtggcgggttcggagcggggggcgcgcggcggcgtatttgttcggttcgggcgttcggcggagtcgcgggaggagtgcggggggtgcgtttagcggcggggtgcgtgtgttcggggcgggtgcgttcggcggcggggcggggattagcggcggtgttcgcgcgagcggcggcggcgagtagggcgcggggaattaggttgtgcggtcgttttttttttcgcggcggcggcggcgggg

SEQ ID NO: 31004 - DNA, 558 bp, Artificial Sequence
  chemically treated genomic DNA (Homo sapiens) CpG-island No: 31004
ccccgccgccgccgccgcgaaaaaaaaaacgaccgcacaacctaattccccgcgccctactcgccgccgccgctcgcgcgaacaccgccgctaatccccgccccgccgccgaacgcacccgccccgaacacacgcaccccgccgctaaacgcaccccccgcactcctcccgcgactccgccgaacgcccgaaccgaacaaatacgccgccgcgcgccccccgctccgaacccgccaccgtactctaccgcgcgccgaaaactcctctcccgaacccccctaaacgccctccgactctaattcccgcccgctccttaaaataacccctaaaactccaaccgtcaccgcaaaatttcccgaaaaaacccgcctccccgaccgctacgcaaataaaactaactacaccgaacgaaaatcgaaatccgcgcgtctaaaacaaaacgccaaaaccgacgaaacgaaaaccgaaaacccgaaaacaccgaaacgccacgaaatcaaacaacctaactttaccccaaaacgacgaaaaataaaacgcccaacctttaaaatttaa

SEQ ID NO: 31005 - DNA, 583 bp, Artificial Sequence
  chemically treated genomic DNA (Homo sapiens) CpG-island No: 31005
gataacgtttagttttttttttatatatttgtcggtagggaggcggtaacggcggtggttgtaatagcggcggtagtagagcggacggttttgtaacgcgtatgcgtttcgtagttttttttttttttttcgtttaatcgcgcgttttcgtatcgcgtcggcgtagaatcggcgtagggtagcggtgagtcggcgcgtaggtggagcgttcgttaggttggtcgagggttttcgattaggaggaggcgggagcgcggaggagcgtcgcgtcgggaatgacgtgcggttagagttcgttttttcgtagggttgcgtttgtaattatggtaacggcggcgttaggtttggttgtttatttaggtcgtgagtcgcgcgtcgttgggggtcgggtggttggtagtattttttttgcggttagcgattttttggtttcgcgcgtagtagtcggcggtatagttatttttttaggcggttaatcgcgtttcgatttttaaagtatttgtttttttagagttttagcgcgcgtagcggaagtttttggaaatttttttattttttagattttgatttttgaaattttttt

SEQ ID NO: 31006 - DNA, 583 bp, Artificial Sequence
  chemically treated genomic DNA (Homo sapiens) CpG-island No: 31006
aaaaaaatttcaaaaatcaaaatctaaaaaataaaaaaatttccaaaaacttccgctacgcgcgctaaaactctaaaaaaacaaatactttaaaaatcgaaacgcgattaaccgcctaaaaaaataactataccgccgactactacgcgcgaaaccaaaaaatcgctaaccgcaaaaaaaatactaccaaccacccgacccccaacgacgcgcgactcacgacctaaataaacaaccaaacctaacgccgccgttaccataattacaaacgcaaccctacgaaaaaacgaactctaaccgcacgtcattcccgacgcgacgctcctccgcgctcccgcctcctcctaatcgaaaaccctcgaccaacctaacgaacgctccacctacgcgccgactcaccgctaccctacgccgattctacgccgacgcgatacgaaaacgcgcgattaaacgaaaaaaaaaaaaaaaactacgaaacgcatacgcgttacaaaaccgtccgctctactaccgccgctattacaaccaccgccgttaccgcctccctaccgacaaatatataaaaaaaaaactaaacgttatc

SEQ ID NO: 31007 - DNA, 583 bp, Artificial Sequence
  chemically treated genomic DNA (Homo sapiens) CpG-island No: 31007
aaaggaattttaagagttaagatttggaaggtgggaaagtttttaaagattttcgttacgcgcgttagggttttggaggggtaggtattttagaggtcgagacgcgattggtcgtttgggaaggtggttgtgtcgtcggttgttacgcgcggggttaaggagtcgttggtcgtaggggaggtgttgttaattattcggtttttagcggcgcgcgatttacggtttgggtgagtagttaggtttggcgtcgtcgttgttatagttatagacgtagttttgcgagggggcgggttttggtcgtacgttattttcggcgcgacgttttttcgcgttttcgtttttttttggtcggagattttcggttagtttagcgggcgttttatttgcgcgtcggtttatcgttgttttgcgtcggttttgcgtcggcgcggtacgagggcgcgcggttgggcggggggggggggggaagttgcgaggcgtatgcgcgttgtagggtcgttcgttttgttgtcgtcgttgttgtagttatcgtcgttgtcgtttttttgtcggtaagtgtgtgaagaagaagttgagcgttgtt

SEQ ID NO: 31008 - DNA, 583 bp, Artificial Sequence
  chemically treated genomic DNA (Homo sapiens) CpG-island No: 31008
aacaacgctcaacttcttcttcacacacttaccgacaaaaaaacgacaacgacgataactacaacaacgacgacaacaaaacgaacgaccctacaacgcgcatacgcctcgcaacttccccccccccccccgcccaaccgcgcgccctcgtaccgcgccgacgcaaaaccgacgcaaaacaacgataaaccgacgcgcaaataaaacgcccgctaaactaaccgaaaatctccgaccaaaaaaaaacgaaaacgcgaaaaaacgtcgcgccgaaaataacgtacgaccaaaacccgccccctcgcaaaactacgtctataactataacaacgacgacgccaaacctaactactcacccaaaccgtaaatcgcgcgccgctaaaaaccgaataattaacaacacctcccctacgaccaacgactccttaaccccgcgcgtaacaaccgacgacacaaccaccttcccaaacgaccaatcgcgtctcgacctctaaaatacctacccctccaaaaccctaacgcgcgtaacgaaaatctttaaaaactttcccaccttccaaatcttaactcttaaaattccttt

SEQ ID NO: 31009 - DNA, 828 bp, Artificial Sequence
  chemically treated genomic DNA (Homo sapiens) CpG-island No: 31009
tcggcgcgtcgcgcgtagatcggacggaggggaaagttggtaagagcgcggcgttcgcgggagaaagcgttaatgggcggtcgggtgggagtagcgcgttcgttcgtttacgttacgtcggtgcgggttcggttgacgatcgcggcgtttggggacgtcggcgcgtttcgttcgttaggtgtttcgtttggaaatgtttttattagttgtcgtcggtttttcgttggagcgcgcgcgtcgagttttcgcgcggagttttcgcgggttgcggggagcggtttagcgttatcgtaggtaggtgaggtttttcgttttcgttttcgtttcggggtttcgagattttttttttttttcgaggaggcggaggtttcgcgcggtcgtcgaggggagcgggcggcggcggttgcggcgatttttcggtgcgtttcgggttgcgagttgtttttcgcggtttcggtagttatacggcgcgggcgggagtttttttagtttaggtagggagtgggtttcgtcgtataaattttgcgaggattgtttttgcgtttaaggggataaagtttgttattcgtcgttaggttttttagaggtcgttgcgtttgttgtaagttgcgggaagtagggtgcgcgggtcggcgcggggcggggggtggggggttcggagtggttaggtttgagttttggacgttcggacggcgtttcgtttagttttaggtcgtatttagggagtaagcggcgggggcgtagcgggagagaggagggagagggtcgcgggtttttatggagggcggttgggaatttagagatttatcgtttgtttttgtggttttt

SEQ ID NO: 31010 - DNA, 828 bp, Artificial Sequence
  chemically treated genomic DNA (Homo sapiens) CpG-island No: 31010
aaaaaccacaaaaacaaacgataaatctctaaattcccaaccgccctccataaaaacccgcgaccctctccctcctctctcccgctacgcccccgccgcttactccctaaatacgacctaaaactaaacgaaacgccgtccgaacgtccaaaactcaaacctaaccactccgaaccccccaccccccgccccgcgccgacccgcgcaccctacttcccgcaacttacaacaaacgcaacgacctctaaaaaacctaacgacgaataacaaactttatccccttaaacgcaaaaacaatcctcgcaaaatttatacgacgaaacccactccctacctaaactaaaaaaactcccgcccgcgccgtataactaccgaaaccgcgaaaaacaactcgcaacccgaaacgcaccgaaaaatcgccgcaaccgccgccgcccgctcccctcgacgaccgcgcgaaacctccgcctcctcgaaaaaaaaaaaaaatctcgaaaccccgaaacgaaaacgaaaacgaaaaacctcacctacctacgataacgctaaaccgctccccgcaacccgcgaaaactccgcgcgaaaactcgacgcgcgcgctccaacgaaaaaccgacgacaactaataaaaacatttccaaacgaaacacctaacgaacgaaacgcgccgacgtccccaaacgccgcgatcgtcaaccgaacccgcaccgacgtaacgtaaacgaacgaacgcgctactcccacccgaccgcccattaacgctttctcccgcgaacgccgcgctcttaccaactttcccctccgtccgatctacgcgcgacgcgccga

SEQ ID NO: 31011 - DNA, 828 bp, Artificial Sequence
  chemically treated genomic DNA (Homo sapiens) CpG-island No: 31011
aggagttatagggataagcggtgaatttttggatttttaatcgttttttatgggggttcgcggtttttttttttttttttttcgttgcgttttcgtcgtttgttttttgggtacggtttgaggttggacggagcgtcgttcgggcgtttaggatttaggtttggttatttcgagttttttatttttcgtttcgcgtcggttcgcgtattttgtttttcgtaatttgtagtaaacgtagcggtttttggagagtttagcgacgggtagtaaattttgtttttttaagcgtaagagtaattttcgtaaagtttgtgcggcggagtttattttttatttgagttggggaagttttcgttcgcgtcgtgtggttgtcggggtcgcggggagtagttcgtagttcgggacgtatcggggagtcgtcgtagtcgtcgtcgttcgtttttttcggcggtcgcgcggagttttcgttttttcggaaggggggaggggtttcggaatttcggggcgggggcgggagcgggggattttatttatttgcggtggcgttgggtcgtttttcgtagttcgcgagggtttcgcgcggaagttcggcgcgcgcgttttagcggggagtcggcgataattaatggagatatttttaggcggagtatttggcgagcggagcgcgtcggcgtttttaggcgtcgcggtcgttagtcgagttcgtatcggcgtgacgtgggcgagcgagcgcgttgtttttattcggtcgtttattaacgttttttttcgcgggcgtcgcgtttttgttaattttttttttcgttcggtttgcgcgcggcgcgtcgg

SEQ ID NO: 31012 - DNA, 828 bp, Artificial Sequence
  chemically treated genomic DNA (Homo sapiens) CpG-island No: 31012
ccgacgcgccgcgcgcaaaccgaacgaaaaaaaaaattaacaaaaacgcgacgcccgcgaaaaaaaacgttaataaacgaccgaataaaaacaacgcgctcgctcgcccacgtcacgccgatacgaactcgactaacgaccgcgacgcctaaaaacgccgacgcgctccgctcgccaaatactccgcctaaaaatatctccattaattatcgccgactccccgctaaaacgcgcgcgccgaacttccgcgcgaaaccctcgcgaactacgaaaaacgacccaacgccaccgcaaataaataaaatcccccgctcccgcccccgccccgaaattccgaaacccctccccccttccgaaaaaacgaaaactccgcgcgaccgccgaaaaaaacgaacgacgacgactacgacgactccccgatacgtcccgaactacgaactactccccgcgaccccgacaaccacacgacgcgaacgaaaacttccccaactcaaataaaaaataaactccgccgcacaaactttacgaaaattactcttacgcttaaaaaaacaaaatttactacccgtcgctaaactctccaaaaaccgctacgtttactacaaattacgaaaaacaaaatacgcgaaccgacgcgaaacgaaaaataaaaaactcgaaataaccaaacctaaatcctaaacgcccgaacgacgctccgtccaacctcaaaccgtacccaaaaaacaaacgacgaaaacgcaacgaaaaaaaaaaaaaaaaaaaccgcgaacccccataaaaaacgattaaaaatccaaaaattcaccgcttatccctataactcct

SEQ ID NO: 31013 - DNA, 962 bp, Artificial Sequence
  chemically treated genomic DNA (Homo sapiens) CpG-island No: 31013
gttattatgcgttttgaaatagtttttcggtagttttacgattttattaagtgttcgtcgtttttacgagagaggtggttatggttgcgtattgaatatgtttgggagaggtaaagatggatggcgtagtttttatttttatatttagtgttgagcgcgagtcgttcgttgtgtgtgtattatttgttgtgcgtgtgttatttgttgtgtatgtttgcgttatttgttgtgtatgtgttatttgttgtgtatgcgtgtgtcgtttgttgtgggcgcgtgagttatttgttttgtgtgtttgtgtcgtttgttgtgtttgcgttatcgtttgttgtgcgtgtgttatttgtgcgtgtgttatttgttgtgcgtgagttatttgttgtgcgtgtgttatttgtgcgtgtgttatttgttgtgcgtgcgtgtgttttttattgtgggtgtgtttattatttgttgtgcgtgtattgtttgttgtgcgtgcgtcgtttgttgtgcgtgcgtcgtttgttgtgcgtgcgtcgtttgttgtgcgtgcgtcgtttgttgtgcgagtcgtttgttgtgcgtgcgtcgtttgttgtgcgtgagtcgtttgttgtgcgtgcgtcgtttgttgtgcgtgcgtcgtttgttgtgcgtgcgtcgtttgttgtgcgtgagtcgtttgttgtgcgtgtgtcgtttgttgtgcgtgagtcgtttgttgtgcgtgtgtcgtttgttgtgcgtgtgtcgtttgttgtgcgtgtgttattttttgtgtgtgcgtgtcgtttgttgtgtatgtgtgtattgtttattgtttgttgtgtatgtatcgtttgttttgcgtgcgtgcgttatttgttgtgcgtgtgttatttgttgtgcgtgtgttatttgttgcgggtgtattatttgttgtgcgtgcgtgtgttatttgtgtttgtgtgtatcgtttgttgtgtgtgtgttgt

SEQ ID NO: 31014 - DNA, 962 bp, Artificial Sequence
  chemically treated genomic DNA (Homo sapiens) CpG-island No: 31014
acaacacacacacaacaaacgatacacacaaacacaaataacacacgcacgcacaacaaataatacacccgcaacaaataacacacgcacaacaaataacacacgcacaacaaataacgcacgcacgcaaaacaaacgatacatacacaacaaacaataaacaatacacacatacacaacaaacgacacgcacacacaaaaaataacacacgcacaacaaacgacacacgcacaacaaacgacacacgcacaacaaacgactcacgcacaacaaacgacacacgcacaacaaacgactcacgcacaacaaacgacgcacgcacaacaaacgacgcacgcacaacaaacgacgcacgcacaacaaacgactcacgcacaacaaacgacgcacgcacaacaaacgactcgcacaacaaacgacgcacgcacaacaaacgacgcacgcacaacaaacgacgcacgcacaacaaacgacgcacgcacaacaaacaatacacgcacaacaaataataaacacacccacaataaaaaacacacgcacgcacaacaaataacacacgcacaaataacacacgcacaacaaataactcacgcacaacaaataacacacgcacaaataacacacgcacaacaaacgataacgcaaacacaacaaacgacacaaacacacaaaacaaataactcacgcgcccacaacaaacgacacacgcatacacaacaaataacacatacacaacaaataacgcaaacatacacaacaaataacacacgcacaacaaataatacacacacaacgaacgactcgcgctcaacactaaatataaaaataaaaactacgccatccatctttacctctcccaaacatattcaatacgcaaccataaccacctctctcgtaaaaacgacgaacacttaataaaatcgtaaaactaccgaaaaactatttcaaaacgcataataac

SEQ ID NO: 31015 - DNA, 962 bp, Artificial Sequence
  chemically treated genomic DNA (Homo sapiens) CpG-island No: 31015
ataatatatatatagtagacgatgtatataggtatagatggtatacgtacgtatagtagatgatgtattcgtagtagatggtatacgtatagtagatgatatacgtatagtagatgacgtacgtacgtagagtagacgatgtatgtatagtagataatggataatgtatatatgtatagtagacggtacgtatatatagaagatgatatacgtatagtagacggtatacgtatagtaaacgatatacgtatagtagacgatttacgtatagtagacggtatacgtatagtagacgatttacgtatagtagacggcgtacgtatagtagacggcgtacgtatagtagacggcgtacgtatagtagacgatttacgtatagtagacgacgtacgtatagtagacgattcgtatagtaggcgacgtacgtatagtagacggcgtacgtatagtagacggcgtacgtatagtagacggcgtacgtatagtagataatgtacgtatagtagatgatgaatatatttatagtagagggtatacgtacgtatagtagatgatatacgtatagatgatatacgtatagtagatgatttacgtatagtagatgatatacgtatagatgatatacgtatagtagacgatgacgtaggtatagtagacggtataagtatatagagtagatgatttacgcgtttatagtagacgatatacgtatgtataatagatgatatatatatagtagatgacgtaggtatgtatagtagatgatatacgtatagtagatgatgtatatatagcggacgattcgcgtttagtattgggtgtgagggtagagattacgttatttatttttgttttttttaagtatatttaatgcgtaattataattatttttttcgtgagagcggcgggtatttggtgaggtcgtgaagttgtcgaggggttgttttagggcgtatggtgat

SEQ ID NO: 31016 - DNA, 962 bp, Artificial Sequence
  chemically treated genomic DNA (Homo sapiens) CpG-island No: 31016
atcaccatacgccctaaaacaacccctcgacaacttcacgacctcaccaaatacccgccgctctcacgaaaaaaataattataattacgcattaaatatacttaaaaaaaacaaaaataaataacgtaatctctaccctcacacccaatactaaacgcgaatcgtccgctatatatacatcatctactatacgtatatcatctactatacatacctacgtcatctactatatatatatcatctattatacatacgtatatcgtctactataaacgcgtaaatcatctactctatatacttataccgtctactatacctacgtcatcgtctactatacgtatatcatctatacgtatatcatctactatacgtaaatcatctactatacgtatatcatctatacgtatatcatctactatacgtacgtataccctctactataaatatattcatcatctactatacgtacattatctactatacgtacgccgtctactatacgtacgccgtctactatacgtacgccgtctactatacgtacgtcgcctactatacgaatcgtctactatacgtacgtcgtctactatacgtaaatcgtctactatacgtacgccgtctactatacgtacgccgtctactatacgtacgccgtctactatacgtaaatcgtctactatacgtataccgtctactatacgtaaatcgtctactatacgtatatcgtttactatacgtataccgtctactatacgtatatcatcttctatatatacgtaccgtctactatacatatatacattatccattatctactatacatacatcgtctactctacgtacgtacgtcatctactatacgtatatcatctactatacgtataccatctactacgaatacatcatctactatacgtacgtataccatctatacctatatacatcgtctactatatatatattat

SEQ ID NO: 31017 - DNA, 596 bp, Artificial Sequence
  chemically treated genomic DNA (Homo sapiens) CpG-island No: 31017
ggggtacgcgcggggtttggttaatggcggcggggcggtggaggttgagttgtcgtgggtagggttagtgtgagaggtgcggcgggggaggtaatgatgatggtggcggaggagaaaggcgggggagggggtgttgggcgttgagcggtggttttggtagggtttggtagggtgggggacggtcgcggggcgatttgttagggagggggtgggcgtgaggggcgtcgttcgtttgaggggttgtagatttcggttatcgcgagcgtcgtggttggtttggttgttttatgtggtttcggcggggatggaggattcggtggcggcggcggttgttgttgcggcggcgacggaggagcggttatgagaagggaacggggttagatttagttcgatagcgggattagaggtgtgaggagggggcgggagtggacgagcggcggggtcggggttcggggttcgggttggggttttttggtatcgtttgggtgatagggatcgcggacgagttatcgtttgttttcgttggggggtaggggtttgggtttcgtgcgtgaggagattgggtttcggcggattgtttttttgaggatggggga

SEQ ID NO: 31018 - DNA, 596 bp, Artificial Sequence
  chemically treated genomic DNA (Homo sapiens) CpG-island No: 31018
tcccccatcctcaaaaaaacaatccgccgaaacccaatctcctcacgcacgaaacccaaacccctaccccccaacgaaaacaaacgataactcgtccgcgatccctatcacccaaacgataccaaaaaaccccaacccgaaccccgaaccccgaccccgccgctcgtccactcccgccccctcctcacacctctaatcccgctatcgaactaaatctaaccccgttcccttctcataaccgctcctccgtcgccgccgcaacaacaaccgccgccgccaccgaatcctccatccccgccgaaaccacataaaacaaccaaaccaaccacgacgctcgcgataaccgaaatctacaacccctcaaacgaacgacgcccctcacgcccaccccctccctaacaaatcgccccgcgaccgtcccccaccctaccaaaccctaccaaaaccaccgctcaacgcccaacaccccctcccccgcctttctcctccgccaccatcatcattacctcccccgccgcacctctcacactaaccctacccacgacaactcaacctccaccgccccgccgccattaaccaaaccccgcgcgtacccc

SEQ ID NO: 31019 - DNA, 596 bp, Artificial Sequence
  chemically treated genomic DNA (Homo sapiens) CpG-island No: 31019
ttttttatttttagggaaatagttcgtcggagtttagtttttttacgtacggagtttagatttttgttttttagcggagataggcggtggttcgttcgcggtttttgttatttaggcgatattagaagattttagttcggatttcgagtttcggtttcgtcgttcgtttattttcgttttttttttatatttttaatttcgttgtcgggttgagtttggtttcgttttttttttatagtcgttttttcgtcgtcgtcgtagtagtagtcgtcgtcgttatcgagttttttattttcgtcggagttatatggaatagttaagttagttacggcgttcgcggtagtcgggatttgtagttttttaggcggacggcgttttttacgtttattttttttttgatagatcgtttcgcgatcgttttttattttattaagttttgttagagttatcgtttagcgtttagtattttttttttcgtttttttttttcgttattattattattatttttttcgtcgtattttttatattaattttatttacggtagtttaatttttatcgtttcgtcgttattggttaggtttcgcgcgtgtttt

SEQ ID NO: 31020 - DNA, 596 bp, Artificial Sequence
  chemically treated genomic DNA (Homo sapiens) CpG-island No: 31020
aaaacacgcgcgaaacctaaccaataacgacgaaacgataaaaattaaactaccgtaaataaaattaatataaaaaatacgacgaaaaaaataataataataataacgaaaaaaaaaaacgaaaaaaaaaatactaaacgctaaacgataactctaacaaaacttaataaaataaaaaacgatcgcgaaacgatctatcaaaaaaaaaataaacgtaaaaaacgccgtccgcctaaaaaactacaaatcccgactaccgcgaacgccgtaactaacttaactattccatataactccgacgaaaataaaaaactcgataacgacgacgactactactacgacgacgacgaaaaaacgactataaaaaaaaaacgaaaccaaactcaacccgacaacgaaattaaaaatataaaaaaaaaacgaaaataaacgaacgacgaaaccgaaactcgaaatccgaactaaaatcttctaatatcgcctaaataacaaaaaccgcgaacgaaccaccgcctatctccgctaaaaaacaaaaatctaaactccgtacgtaaaaaaactaaactccgacgaactatttccctaaaaataaaaaa

SEQ ID NO: 31021 - DNA, 504 bp, Artificial Sequence
  chemically treated genomic DNA (Homo sapiens) CpG-island No: 31021
tataaattcggggttagtcgtttattgttgttgttgttgttgtcgttgtcgtcgtcgtcgtcgtcgttgttttcgtcggttttgcgaattcgggattttttatgtattatatttttcgtttgttttttttcgtgttttgaaaagtgcgatcgtttttttaaggaatttttacggtaagtatggagattagaaaggggtgtggacgtgtgtgcgtatttaagaggggtgggtgcgagggcggtcggtttgtttaggaatttggttaatttttcgggttcgttttttagggattcgggcggttttttttggacgggggtagggattgggattcggattggcgcgttttggattatcgcgacggagtttttcggtatcggcgttttgcgcgtttcgtgcgttgtttcgtttaaatttttcgttttgagttttttttaatgtgttttatttggggagggggggaggtgtaagggggagggattagacgcgggaattggataagttggg

SEQ ID NO: 31022 - DNA, 504 bp, Artificial Sequence
  chemically treated genomic DNA (Homo sapiens) CpG-island No: 31022
cccaacttatccaattcccgcgtctaatccctcccccttacacctccccccctccccaaataaaacacattaaaaaaaactcaaaacgaaaaatttaaacgaaacaacgcacgaaacgcgcaaaacgccgataccgaaaaactccgtcgcgataatccaaaacgcgccaatccgaatcccaatccctacccccgtccaaaaaaaaccgcccgaatccctaaaaaacgaacccgaaaaattaaccaaattcctaaacaaaccgaccgccctcgcacccacccctcttaaatacgcacacacgtccacacccctttctaatctccatacttaccgtaaaaattccttaaaaaaacgatcgcacttttcaaaacacgaaaaaaaacaaacgaaaaatataatacataaaaaatcccgaattcgcaaaaccgacgaaaacaacgacgacgacgacgacgacaacgacaacaacaacaacaacaataaacgactaaccccgaatttata

SEQ ID NO: 31023 - DNA, 504 bp, Artificial Sequence
  chemically treated genomic DNA (Homo sapiens) CpG-island No: 31023
tttaatttgtttaattttcgcgtttggttttttttttttgtatttttttttttttttaaataaaatatattaaggaaaatttaagacggaaagtttgagcgaggtagcgtacggagcgcgtagggcgtcgatgtcgagaggtttcgtcgcgatgatttaagacgcgttagttcgagttttagtttttgttttcgtttagagggaatcgttcgaatttttaggaaacggattcggaaagttagttaggtttttgaataagtcggtcgttttcgtatttattttttttgggtacgtatatacgtttatatttttttttgatttttatatttgtcgtggaaattttttgggagaacggtcgtattttttaggatacggagggaagtaggcggagagtgtggtgtatgaaaagtttcgggttcgtagagtcggcggaggtagcggcggcggcggcggcggtagcggtagtagtagtagtagtagtaggcggttggtttcgggtttgtg

SEQ ID NO: 31024 - DNA, 504 bp, Artificial Sequence
  chemically treated genomic DNA (Homo sapiens) CpG-island No: 31024
cacaaacccgaaaccaaccgcctactactactactactactaccgctaccgccgccgccgccgccgctacctccgccgactctacgaacccgaaacttttcatacaccacactctccgcctacttccctccgtatcctaaaaaatacgaccgttctcccaaaaaatttccacgacaaatataaaaatcaaaaaaaaatataaacgtatatacgtacccaaaaaaaataaatacgaaaacgaccgacttattcaaaaacctaactaactttccgaatccgtttcctaaaaattcgaacgattccctctaaacgaaaacaaaaactaaaactcgaactaacgcgtcttaaatcatcgcgacgaaacctctcgacatcgacgccctacgcgctccgtacgctacctcgctcaaactttccgtcttaaattttccttaatatattttatttaaaaaaaaaaaaaaatacaaaaaaaaaaaaccaaacgcgaaaattaaacaaattaaa

SEQ ID NO: 31025 - DNA, 671 bp, Artificial Sequence
  chemically treated genomic DNA (Homo sapiens) CpG-island No: 31025
tgaaggttggcggttttacggttttacgtagttcggaaatttttcgggttttcgggtttttcgtattttcgttttcgtatttcgttcgtatttcggggtttcggaggttgttttatcggcgcgtcgttcgtaggtatcggcggcgttcggttgtcgtttttggggcggggcggggcgtggcgtggcggggtaggtcggaggtgcgggatttattttttgtttttgttttttggacgcgttttcgggagtcgattttttttttttcggcgttagggtcgcgggttaggaggaggagtttcgttcgcgggtatcgcggggaggcgggcggcgtacgtgcggataggcggggaatttcggcgtcgggggcggggtattcggaagcgcgcgtggatttggcgtatcgaattcgggcgggcggaggggcggttggtacggcgcggggaggcgggcgtttcgttcgggtcgcggcggtttgtggttataggtgggcgtttgcggagagggagcggtcgagcggagttcgggtttcggagatttttgtcgttacgttcggggtttcgcgtagtagagatcgggagacgcgtttgtgttttcggggaagtcgatttatttttttttcgtttttttggttgtagttgtattttcggttagagggtaggtaattttttttt

SEQ ID NO: 31026 - DNA, 671 bp, Artificial Sequence
  chemically treated genomic DNA (Homo sapiens) CpG-island No: 31026
aaaaaaaaattacctaccctctaaccgaaaatacaactacaaccaaaaaaacgaaaaaaaaataaatcgacttccccgaaaacacaaacgcgtctcccgatctctactacgcgaaaccccgaacgtaacgacaaaaatctccgaaacccgaactccgctcgaccgctccctctccgcaaacgcccacctataaccacaaaccgccgcgacccgaacgaaacgcccgcctccccgcgccgtaccaaccgcccctccgcccgcccgaattcgatacgccaaatccacgcgcgcttccgaataccccgcccccgacgccgaaattccccgcctatccgcacgtacgccgcccgcctccccgcgatacccgcgaacgaaactcctcctcctaacccgcgaccctaacgccgaaaaaaaaaaaatcgactcccgaaaacgcgtccaaaaaacaaaaacaaaaaataaatcccgcacctccgacctaccccgccacgccacgccccgccccgccccaaaaacgacaaccgaacgccgccgatacctacgaacgacgcgccgataaaacaacctccgaaaccccgaaatacgaacgaaatacgaaaacgaaaatacgaaaaacccgaaaacccgaaaaatttccgaactacgtaaaaccgtaaaaccgccaaccttca

SEQ ID NO: 31027 - DNA, 671 bp, Artificial Sequence
  chemically treated genomic DNA (Homo sapiens) CpG-island No: 31027
gaagggaagttatttgttttttggtcggaggtgtaattgtagttaaagaggcggaggggagatgggtcggttttttcggaggtatagacgcgtttttcgatttttgttacgcggagtttcgggcgtgacggtaggagttttcgggattcgggtttcgttcggtcgtttttttttcgtagacgtttatttgtgattatagatcgtcgcggttcgggcggggcgttcgttttttcgcgtcgtgttaatcgttttttcgttcgttcgggttcggtgcgttaggtttacgcgcgttttcgggtgtttcgttttcggcgtcggggtttttcgtttgttcgtacgtgcgtcgttcgttttttcgcggtgttcgcgggcgaggtttttttttttggttcgcggttttggcgtcgggaaggggaaaatcggttttcgagagcgcgtttaggaggtaggggtaggaggtgggtttcgtattttcggtttgtttcgttacgttacgtttcgtttcgttttagaggcggtagtcgggcgtcgtcggtgtttgcgggcggcgcgtcggtgggatagttttcggagtttcggggtgcggacgaggtgcggagacggaaatacgggaaattcgggaattcggaggattttcgaattacgtgagatcgtggagtcgttagttttta

SEQ ID NO: 31028 - DNA, 671 bp, Artificial Sequence
  chemically treated genomic DNA (Homo sapiens) CpG-island No: 31028
taaaaactaacgactccacgatctcacgtaattcgaaaatcctccgaattcccgaatttcccgtatttccgtctccgcacctcgtccgcaccccgaaactccgaaaactatcccaccgacgcgccgcccgcaaacaccgacgacgcccgactaccgcctctaaaacgaaacgaaacgtaacgtaacgaaacaaaccgaaaatacgaaacccacctcctacccctacctcctaaacgcgctctcgaaaaccgattttccccttcccgacgccaaaaccgcgaaccaaaaaaaaaaacctcgcccgcgaacaccgcgaaaaaacgaacgacgcacgtacgaacaaacgaaaaaccccgacgccgaaaacgaaacacccgaaaacgcgcgtaaacctaacgcaccgaacccgaacgaacgaaaaaacgattaacacgacgcgaaaaaacgaacgccccgcccgaaccgcgacgatctataatcacaaataaacgtctacgaaaaaaaaacgaccgaacgaaacccgaatcccgaaaactcctaccgtcacgcccgaaactccgcgtaacaaaaatcgaaaaacgcgtctatacctccgaaaaaaccgacccatctcccctccgcctctttaactacaattacacctccgaccaaaaaacaaataacttcccttc

SEQ ID NO: 31029 - DNA, 557 bp, Artificial Sequence
  chemically treated genomic DNA (Homo sapiens) CpG-island No: 31029
cgttatttttgtgttgttacgcggggaagttttatttgaattggggttttatgattttcggtatttttattcgaacgtagtttgcgtttttgtttggaatttggttttcgttttgaaggatttttatttagtatttttgcgggttgtcgggattttacggtttcgtaggcggagagattaggcgcgatttttgcgcgttttttttttttttgcgttttagggggtcggtttttagggggcggggtagtatcgcgcgtaaggtttgtcggttgttcggggtcgtatgacgtatttttttagttcgagtttttacgaggtcgtgggtacgatcggaagtcgtaggtgggtgaagcggaaacgttttaaatcgggatgttgcgggtcgtagcgcgtgggcggtcgtggggttttgggcgcgcgcggtgtttttggcggtgggttaggatttgcgggtcgttttcgtcggtgttgaagttttttgtgtgtatattttttttttagtatttgggacgatttaattttattgttaggaacggttgatttcgaatataggaggg

SEQ ID NO: 31030 - DNA, 557 bp, Artificial Sequence
  chemically treated genomic DNA (Homo sapiens) CpG-island No: 31030
ccctcctatattcgaaatcaaccgttcctaacaataaaattaaatcgtcccaaatactaaaaaaaaaatatacacacaaaaaacttcaacaccgacgaaaacgacccgcaaatcctaacccaccgccaaaaacaccgcgcgcgcccaaaaccccacgaccgcccacgcgctacgacccgcaacatcccgatttaaaacgtttccgcttcacccacctacgacttccgatcgtacccacgacctcgtaaaaactcgaactaaaaaaatacgtcatacgaccccgaacaaccgacaaaccttacgcgcgatactaccccgccccctaaaaaccgaccccctaaaacgcaaaaaaaaaaaaaacgcgcaaaaatcgcgcctaatctctccgcctacgaaaccgtaaaatcccgacaacccgcaaaaatactaaataaaaatccttcaaaacgaaaaccaaattccaaacaaaaacgcaaactacgttcgaataaaaataccgaaaatcataaaaccccaattcaaataaaacttccccgcgtaacaacacaaaaataacg

SEQ ID NO: 31031 - DNA, 557 bp, Artificial Sequence
  chemically treated genomic DNA (Homo sapiens) CpG-island No: 31031
tttttttgtgttcgggattaatcgtttttaatagtgaaattaggtcgttttaagtgttgaggagaaagtgtgtatataagaggttttaatatcggcggaggcgattcgtaagttttgatttatcgttagaaatatcgcgcgcgtttaagattttacggtcgtttacgcgttacggttcgtaatatttcggtttgaagcgttttcgttttatttatttgcggttttcggtcgtatttacggtttcgtgagggttcgagttggaaaagtgcgttatacgatttcgagtaatcggtaggttttgcgcgcgatgttgtttcgttttttgagggtcggttttttgaagcgtaagagaaggaggggcgcgtagggatcgcgtttagttttttcgtttgcggagtcgtggggtttcggtagttcgtaggagtgttaagtaagggttttttagggcgggaattaggttttaggtagggacgtaggttacgttcgaataaaagtatcgaaggttataaggttttagtttagatgggattttttcgcgtgatagtatagagataacg

SEQ ID NO: 31032 - DNA, 557 bp, Artificial Sequence
  chemically treated genomic DNA (Homo sapiens) CpG-island No: 31032
cgttatctctatactatcacgcgaaaaaatcccatctaaactaaaaccttataaccttcgatacttttattcgaacgtaacctacgtccctacctaaaacctaattcccgccctaaaaaacccttacttaacactcctacgaactaccgaaaccccacgactccgcaaacgaaaaaactaaacgcgatccctacgcgcccctccttctcttacgcttcaaaaaaccgaccctcaaaaaacgaaacaacatcgcgcgcaaaacctaccgattactcgaaatcgtataacgcacttttccaactcgaaccctcacgaaaccgtaaatacgaccgaaaaccgcaaataaataaaacgaaaacgcttcaaaccgaaatattacgaaccgtaacgcgtaaacgaccgtaaaatcttaaacgcgcgcgatatttctaacgataaatcaaaacttacgaatcgcctccgccgatattaaaacctcttatatacacactttctcctcaacacttaaaacgacctaatttcactattaaaaacgattaatcccgaacacaaaaaaa

SEQ ID NO: 31033 - DNA, 895 bp, Artificial Sequence
  chemically treated genomic DNA (Homo sapiens) CpG-island No: 31033
gtgttgtcgagttttcggtcggtagttgtgttcgtcgttgttttttatagtcgttttcgttgttagcgtttaatttcgttcgttacggtttcgtattcgttatttttgttcgtttgtagtcgtttttttagagattttttagtttagtagtagtattttttttatttcgcgtattttcgtagtttttatttggagtttcgggttttttttcgggtttttcggttcgtcgttttgtttagagtttattttcgcgattgttagttttcggttttagcgggggatataagaatcgtttattttttatttttcgttttttttttttttttttttatttttaaatcgttttggtttcgtttcggcggatcggaggaaggacggagttcgcgggaaggaggagggggcggttagcgttagttagtgtcgtcgtggtttcgtttttacgttttgtatcggagtggggttcgttttttattttttcggcgttttagttttgttttcgtttcgttcgtttttaggttcggtgcgtacgcgtatttggttcgattttttttttcgcggggtttataagtcgtgcgcgcgtttttacgtacggagcgacgcgtacgtttatttgtttgttttatagggtatttaggagggatttttttttggtttattcgcgtcgcgtaggcgtacgtttacgtagcgtttagacgttcgagtcgagcgtttcgttttttagtaattagtcgttagtttttttttttacgatttattttttaatttttgtttgaggttgtcgtatttggatggaacgcgtatgcgtaaggttgtttttcgtagtttcgtttttttttagtttgaaatatttgttgtttcgcggcgggggttttgtgttattttttttagggtttgg

SEQ ID NO: 31034 - DNA, 895 bp, Artificial Sequence
  chemically treated genomic DNA (Homo sapiens) CpG-island No: 31034
ccaaaccctaaaaaaaataacacaaaacccccgccgcgaaacaacaaatatttcaaactaaaaaaaaacgaaactacgaaaaacaaccttacgcatacgcgttccatccaaatacgacaacctcaaacaaaaattaaaaaataaatcgtaaaaaaaaaaactaacgactaattactaaaaaacgaaacgctcgactcgaacgtctaaacgctacgtaaacgtacgcctacgcgacgcgaataaaccaaaaaaaaatccctcctaaataccctataaaacaaacaaataaacgtacgcgtcgctccgtacgtaaaaacgcgcgcacgacttataaaccccgcgaaaaaaaaaatcgaaccaaatacgcgtacgcaccgaacctaaaaacgaacgaaacgaaaacaaaactaaaacgccgaaaaaataaaaaacgaaccccactccgatacaaaacgtaaaaacgaaaccacgacgacactaactaacgctaaccgccccctcctccttcccgcgaactccgtccttcctccgatccgccgaaacgaaaccaaaacgatttaaaaataaaaaaaaaaaaaaaaaaaacgaaaaataaaaaataaacgattcttatatcccccgctaaaaccgaaaactaacaatcgcgaaaataaactctaaacaaaacgacgaaccgaaaaacccgaaaaaaaacccgaaactccaaataaaaactacgaaaatacgcgaaataaaaaaaatactactactaaactaaaaaatctctaaaaaaacgactacaaacgaacaaaaataacgaatacgaaaccgtaacgaacgaaattaaacgctaacaacgaaaacgactataaaaaacaacgacgaacacaactaccgaccgaaaactcgacaacac

SEQ ID NO: 31035 - DNA, 895 bp, Artificial Sequence
  chemically treated genomic DNA (Homo sapiens) CpG-island No: 31035
ttaagttttgggaaaagtggtataaagttttcgtcgcgaagtagtaggtgttttaagttgagggaaggcggggttgcgagagatagttttgcgtatgcgcgttttatttaggtgcggtagttttaggtagagattaagaaatgagtcgtggaaaagggggttagcggttggttattaggagacgggacgttcggttcgggcgtttaggcgttgcgtgggcgtgcgtttgcgcggcgcggatgggttagaaaggggttttttttaggtgttttgtaaggtaggtaggtagacgtacgcgtcgtttcgtgcgtaggagcgcgcgtacggtttgtagatttcgcgagaaggaaggtcgagttaggtacgcgtgcgtatcgggtttgggggcgagcgggacggaagtaaagttggggcgtcggggaggtggaagacgagttttatttcggtatagagcgtgagggcggggttacggcggtattggttggcgttaatcgtttttttttttttttcgcgggtttcgtttttttttcgattcgtcggggcggggttaggacgatttgggggtgggaagggaggagaaaggggcggaggatggagagtgggcggtttttgtatttttcgttgaggtcgagagttgatagtcgcggggatgagttttgggtaggacggcgggtcgaggagttcggggagggattcggagttttaggtagaagttgcggaggtgcgcggggtggggagagtgttgttattggattggaaggtttttgagaaggcggttgtaagcgggtaggagtggcgggtgcggggtcgtggcgggcggagttgggcgttagtagcgggagcggttgtgaggggtagcggcgggtatagttgtcggtcggaagttcggtagtat

SEQ ID NO: 31036 - DNA, 895 bp, Artificial Sequence
  chemically treated genomic DNA (Homo sapiens) CpG-island No: 31036
atactaccgaacttccgaccgacaactatacccgccgctacccctcacaaccgctcccgctactaacgcccaactccgcccgccacgaccccgcacccgccactcctacccgcttacaaccgccttctcaaaaaccttccaatccaataacaacactctccccaccccgcgcacctccgcaacttctacctaaaactccgaatccctccccgaactcctcgacccgccgtcctacccaaaactcatccccgcgactatcaactctcgacctcaacgaaaaatacaaaaaccgcccactctccatcctccgcccctttctcctcccttcccacccccaaatcgtcctaaccccgccccgacgaatcgaaaaaaaaacgaaacccgcgaaaaaaaaaaaaaaacgattaacgccaaccaataccgccgtaaccccgccctcacgctctataccgaaataaaactcgtcttccacctccccgacgccccaactttacttccgtcccgctcgcccccaaacccgatacgcacgcgtacctaactcgaccttccttctcgcgaaatctacaaaccgtacgcgcgctcctacgcacgaaacgacgcgtacgtctacctacctaccttacaaaacacctaaaaaaaacccctttctaacccatccgcgccgcgcaaacgcacgcccacgcaacgcctaaacgcccgaaccgaacgtcccgtctcctaataaccaaccgctaacccccttttccacgactcatttcttaatctctacctaaaactaccgcacctaaataaaacgcgcatacgcaaaactatctctcgcaaccccgccttccctcaacttaaaacacctactacttcgcgacgaaaactttataccacttttcccaaaacttaa

SEQ ID NO: 31037 - DNA, 881 bp, Artificial Sequence
  chemically treated genomic DNA (Homo sapiens) CpG-island No: 31037
atgcgaggtaattattttgtcgcggttcgacggcgtagagttgggaaatcgaggcggagacgcgagaggggaggcgggcggcgcggttcgattgttttgtgttggggttcggttgtcgggtcgggagttgggagttcggacggcgtataaagaaggttatcggcgagggtgcgttcggttggcggagggcgcgggttttcggagacgtgattttggcgttataattgttagaaggcgttttagtttttttttggcgacgtgttcggttgttttacgttaaggcgttaatttcggttataggattattgaggtttaatttgagaagaattttagttcggttttattcgggtagtgggattttttcgatttataggcgcgtggttcgggttcgcggatttttttagttgggtgatacgatgttgttagcggtagttcgggatttttgcgtcggagttttatgtaataatgtggtttattgaggggttgtcggttcgcgggttttcggattagtgacgtgcgtacgtttattggttgcgcggggagggtgtgtgcgtttacggatcgttcgtcgtcgtggcgtagttaattatcgtttacggttcgcgggcgcggtcgtttagatatcggagtcggtagtttggggaggcgcgtcgggggcggggggcgggggaggggcggggcgtttgagatgggacgtgtggttcgtggttaaaggttgggacggaaaggcgtatgagttatcgtcgcgttaggttcggttatgggtggggggagcgtgatcgcggattcggggtgtggggcgattggaaaaacgggtttttggattagtatacgttttgtgcggagagatattgtttggtatttcgggattatgtgagggg

SEQ ID NO: 31038 - DNA, 881 bp, Artificial Sequence
  chemically treated genomic DNA (Homo sapiens) CpG-island No: 31038
cccctcacataatcccgaaataccaaacaatatctctccgcacaaaacgtatactaatccaaaaacccgtttttccaatcgccccacaccccgaatccgcgatcacgctccccccacccataaccgaacctaacgcgacgataactcatacgcctttccgtcccaacctttaaccacgaaccacacgtcccatctcaaacgccccgcccctcccccgccccccgcccccgacgcgcctccccaaactaccgactccgatatctaaacgaccgcgcccgcgaaccgtaaacgataattaactacgccacgacgacgaacgatccgtaaacgcacacaccctccccgcgcaaccaataaacgtacgcacgtcactaatccgaaaacccgcgaaccgacaacccctcaataaaccacattattacataaaactccgacgcaaaaatcccgaactaccgctaacaacatcgtatcacccaactaaaaaaatccgcgaacccgaaccacgcgcctataaatcgaaaaaatcccactacccgaataaaaccgaactaaaattcttctcaaattaaacctcaataatcctataaccgaaattaacgccttaacgtaaaacaaccgaacacgtcgccaaaaaaaaactaaaacgccttctaacaattataacgccaaaatcacgtctccgaaaacccgcgccctccgccaaccgaacgcaccctcgccgataaccttctttatacgccgtccgaactcccaactcccgacccgacaaccgaaccccaacacaaaacaatcgaaccgcgccgcccgcctcccctctcgcgtctccgcctcgatttcccaactctacgccgtcgaaccgcgacaaaataattacctcgcat

SEQ ID NO: 31039 - DNA, 881 bp, Artificial Sequence
  chemically treated genomic DNA (Homo sapiens) CpG-island No: 31039
ttttttatatgatttcgagatgttagatagtgttttttcgtatagggcgtgtgttggtttagaggttcgtttttttagtcgttttatatttcgggttcgcgattacgttttttttatttatagtcgagtttgacgcggcggtggtttatgcgttttttcgttttagtttttagttacggattatacgttttattttaggcgtttcgtttttttttcgtttttcgttttcggcgcgtttttttaggttgtcggtttcggtgtttgagcggtcgcgttcgcgagtcgtgagcgatgattggttgcgttacggcggcgggcggttcgtgggcgtatatatttttttcgcgtagttaatgggcgtgcgtacgttattgattcggaggttcgcgggtcggtagttttttaataagttatattgttgtatgaaatttcggcgtaggagtttcgggttgtcgttggtaatatcgtgttatttagttaagaaaattcgcgggttcgagttacgcgtttgtgaatcggagaggttttattgttcgagtggagtcgggttgagattttttttaagttgagttttagtgattttgtggtcgaagttagcgttttgacgtgggataatcggatacgtcgttaggagagaattgaggcgttttttagtagttgtgacgttaaaattacgttttcggagattcgcgtttttcgttagtcgggcgtattttcgtcggtagttttttttgtgcgtcgttcggatttttagttttcggttcggtagtcgagttttagtataaagtagtcggatcgcgtcgttcgttttttttttcgcgttttcgtttcggttttttaattttgcgtcgtcgggtcgcggtaggatgattgtttcgtat

SEQ ID NO: 31040 - DNA, 881 bp, Artificial Sequence
  chemically treated genomic DNA (Homo sapiens) CpG-island No: 31040
atacgaaacaatcatcctaccgcgacccgacgacgcaaaattaaaaaaccgaaacgaaaacgcgaaaaaaaaaacgaacgacgcgatccgactactttatactaaaactcgactaccgaaccgaaaactaaaaatccgaacgacgcacaaaaaaaactaccgacgaaaatacgcccgactaacgaaaaacgcgaatctccgaaaacgtaattttaacgtcacaactactaaaaaacgcctcaattctctcctaacgacgtatccgattatcccacgtcaaaacgctaacttcgaccacaaaatcactaaaactcaacttaaaaaaaatctcaacccgactccactcgaacaataaaacctctccgattcacaaacgcgtaactcgaacccgcgaattttcttaactaaataacacgatattaccaacgacaacccgaaactcctacgccgaaatttcatacaacaatataacttattaaaaaactaccgacccgcgaacctccgaatcaataacgtacgcacgcccattaactacgcgaaaaaaatatatacgcccacgaaccgcccgccgccgtaacgcaaccaatcatcgctcacgactcgcgaacgcgaccgctcaaacaccgaaaccgacaacctaaaaaaacgcgccgaaaacgaaaaacgaaaaaaaaacgaaacgcctaaaataaaacgtataatccgtaactaaaaactaaaacgaaaaaacgcataaaccaccgccgcgtcaaactcgactataaataaaaaaaacgtaatcgcgaacccgaaatataaaacgactaaaaaaacgaacctctaaaccaacacacgccctatacgaaaaaacactatctaacatctcgaaatcatataaaaaa

SEQ ID NO: 31041 - DNA, 989 bp, Artificial Sequence
  chemically treated genomic DNA (Homo sapiens) CpG-island No: 31041
tcgaggcgcgtgagtcggatacgaggtgcgcgttgtagggttggggaatcggggacgcgtgggttatttgtattgtttgaaaagttggttcgattttttgaagtcgttgttgagtagtatgttgatgtcggttagggttagtttcgcgttttgtaggggcgtcgtcgtcgtcgttgtcgcgttcgagttttcgtcgtttcgtcgtcgcggtcgttgttgtttcgagtcggttatgggcgtgcgaggttttgcgttgggtcgaggcgagatcgggagtagttgttgcggtttcgcgcgcgttcggagttcggttttatttgttcggagttaagcggagtcgggaggggaggggaggggaggggagaagacgggagggaagaggagggaaggatcgcggagggaggagtcgcggttcggttgcggcgcggcgtgggaggtgggcgttcggtcgtcgtcgcggggattatttagtagtattcgttcgtttttttcgcgtttttcgaagtatttaattcgcgcgggtttcgaagcggaattcgttttcgggtgttttttatttcgttaagtcggttttcgagcggcggtcgtttttattttttgtagttttcgcgtttcggtttttttcgggtttttaagtcgcgttttcgtttatcgtttaggattgttcggatatacgtacgcgagattcggagattcgagcgttttattttttttcgaaggggtcggatttaggagtcgggaggagggtaaggcgcggagggagaacgagcgtgcggatgtggaaggaaagggaaagggaaggggaatttcgttcgggtcgttatgttagcgcgcggcgttttgtttacgagtaattgaaattttacgagtaattgaaattttacgtagttcgcgttcgcgattttagattttatttcgattttggggtcgttttttaggattagggtagttaattttcgaggaggtgggcggcgggggcggggtttttg

SEQ ID NO: 31042 - DNA, 989 bp, Artificial Sequence
  chemically treated genomic DNA (Homo sapiens) CpG-island No: 31042
caaaaaccccgcccccgccgcccacctcctcgaaaattaactaccctaatcctaaaaaacgaccccaaaatcgaaataaaatctaaaatcgcgaacgcgaactacgtaaaatttcaattactcgtaaaatttcaattactcgtaaacaaaacgccgcgcgctaacataacgacccgaacgaaattccccttccctttccctttccttccacatccgcacgctcgttctccctccgcgccttaccctcctcccgactcctaaatccgaccccttcgaaaaaaaataaaacgctcgaatctccgaatctcgcgtacgtatatccgaacaatcctaaacgataaacgaaaacgcgacttaaaaacccgaaaaaaaccgaaacgcgaaaactacaaaaaataaaaacgaccgccgctcgaaaaccgacttaacgaaataaaaaacacccgaaaacgaattccgcttcgaaacccgcgcgaattaaatacttcgaaaaacgcgaaaaaaacgaacgaatactactaaataatccccgcgacgacgaccgaacgcccacctcccacgccgcgccgcaaccgaaccgcgactcctccctccgcgatccttccctcctcttccctcccgtcttctcccctcccctcccctcccctcccgactccgcttaactccgaacaaataaaaccgaactccgaacgcgcgcgaaaccgcaacaactactcccgatctcgcctcgacccaacgcaaaacctcgcacgcccataaccgactcgaaacaacaacgaccgcgacgacgaaacgacgaaaactcgaacgcgacaacgacgacgacgacgcccctacaaaacgcgaaactaaccctaaccgacatcaacatactactcaacaacgacttcaaaaaatcgaaccaacttttcaaacaatacaaataacccacgcgtccccgattccccaaccctacaacgcgcacctcgtatccgactcacgcgcctcga

SEQ ID NO: 31043 - DNA, 989 bp, Artificial Sequence
  chemically treated genomic DNA (Homo sapiens) CpG-island No: 31043
tagagatttcgttttcgtcgtttattttttcgggaattggttgttttggttttagggggcggttttagggtcgggatgaagtttggggtcgcgggcgcgggttgcgtggggttttagttattcgtggagttttagttattcgtggataaagcgtcgcgcgttagtatagcggttcgggcggagttttttttttttttttttttttttttatattcgtacgttcgtttttttttcgcgttttgtttttttttcgatttttgggttcggttttttcgggggagggtggggcgttcgggttttcgggtttcgcgtgcgtgtgttcgagtagttttgggcggtgggcgaaggcgcggtttggggattcgggaggggtcggggcgcgggggttgtaggaagtggaggcggtcgtcgttcggggatcggtttggcggggtgagagatattcggaaacggatttcgtttcggggttcgcgcgagttgggtgtttcggagggcgcgagaggagcgggcgggtgttgttgagtaattttcgcggcggcggtcggacgtttattttttacgtcgcgtcgtagtcgggtcgcggttttttttttcgcggtttttttttttttttttttttcgttttttttttttttttttttttttttttcggtttcgtttggtttcgggtaggtagagtcgggtttcgggcgcgcgcggggtcgtagtagttgttttcgatttcgtttcggtttagcgtagggtttcgtacgtttatggtcggttcggagtagtagcggtcgcggcggcgggacgacggagattcggacgcggtagcggcggcggcggcgtttttgtaggacgcggagttggttttggtcggtattaatatgttgtttaataacggttttagggagtcggattagttttttaaataatataggtgatttacgcgttttcgattttttaattttgtagcgcgtatttcgtgttcggtttacgcgtttcga

SEQ ID NO: 31044 - DNA, 989 bp, Artificial Sequence
  chemically treated genomic DNA (Homo sapiens) CpG-island No: 31044
tcgaaacgcgtaaaccgaacacgaaatacgcgctacaaaattaaaaaatcgaaaacgcgtaaatcacctatattatttaaaaaactaatccgactccctaaaaccgttattaaacaacatattaataccgaccaaaaccaactccgcgtcctacaaaaacgccgccgccgccgctaccgcgtccgaatctccgtcgtcccgccgccgcgaccgctactactccgaaccgaccataaacgtacgaaaccctacgctaaaccgaaacgaaatcgaaaacaactactacgaccccgcgcgcgcccgaaacccgactctacctacccgaaaccaaacgaaaccgaaaaaaaaaaaaaaaaaaaaaaaaaaaacgaaaaaaaaaaaaaaaaaaaaaccgcgaaaaaaaaaaccgcgacccgactacgacgcgacgtaaaaaataaacgtccgaccgccgccgcgaaaattactcaacaacacccgcccgctcctctcgcgccctccgaaacacccaactcgcgcgaaccccgaaacgaaatccgtttccgaatatctctcaccccgccaaaccgatccccgaacgacgaccgcctccacttcctacaacccccgcgccccgacccctcccgaatccccaaaccgcgccttcgcccaccgcccaaaactactcgaacacacgcacgcgaaacccgaaaacccgaacgccccaccctcccccgaaaaaaccgaacccaaaaatcgaaaaaaaaacaaaacgcgaaaaaaaaacgaacgtacgaatataaaaaaaaaaaaaaaaaaaaaaaaaactccgcccgaaccgctatactaacgcgcgacgctttatccacgaataactaaaactccacgaataactaaaaccccacgcaacccgcgcccgcgaccccaaacttcatcccgaccctaaaaccgccccctaaaaccaaaacaaccaattcccgaaaaaataaacgacgaaaacgaaatctcta

SEQ ID NO: 31045 - DNA, 589 bp, Artificial Sequence
  chemically treated genomic DNA (Homo sapiens) CpG-island No: 31045
tggtcgcgtgcgtatagatcgtggtgagtttggcggtcgtagggtagtttatttcgtttacgtcgtcggagtcgtcgcgtagtagttttaggtagattttcgcgttcggtttcgttcgggagaagagcgtcggtaagaggggttcggatcgcggtagtttcgagtatcggtagcggcgcgagcgtaataatatcgtcgtgcgtaagagtcgcgataaggttaagcggcgtaattaggagatgtagtagaagttggtggagttgtcggttgagaacgagaagttgtattagcgcgtggagtagtttacgcgggatttggtcggttttcggtagttttttaagtagttgtttagttcgttttttttgtcggtcgtcgggatagtagattgtcggtaacgcgcggtcggggcgggagagatttagtaacgatttatattttagattcgacggttcggagcggagcgcgttttgttttggcgtagttagagtcgtcgggtgttcgttgtagttttttgggatataggagcgtaaagaagttatagtttggatttattattattaaattgcgagagaagttaaacgtgtttatt

SEQ ID NO: 31046 - DNA, 589 bp, Artificial Sequence
  chemically treated genomic DNA (Homo sapiens) CpG-island No: 31046
aataaacacgtttaacttctctcgcaatttaataataataaatccaaactataacttctttacgctcctatatcccaaaaaactacaacgaacacccgacgactctaactacgccaaaacaaaacgcgctccgctccgaaccgtcgaatctaaaatataaatcgttactaaatctctcccgccccgaccgcgcgttaccgacaatctactatcccgacgaccgacaaaaaaaacgaactaaacaactacttaaaaaactaccgaaaaccgaccaaatcccgcgtaaactactccacgcgctaatacaacttctcgttctcaaccgacaactccaccaacttctactacatctcctaattacgccgcttaaccttatcgcgactcttacgcacgacgatattattacgctcgcgccgctaccgatactcgaaactaccgcgatccgaacccctcttaccgacgctcttctcccgaacgaaaccgaacgcgaaaatctacctaaaactactacgcgacgactccgacgacgtaaacgaaataaactaccctacgaccgccaaactcaccacgatctatacgcacgcgacca

SEQ ID NO: 31047 - DNA, 589 bp, Artificial Sequence
  chemically treated genomic DNA (Homo sapiens) CpG-island No: 31047
aataaatacgtttagtttttttcgtagtttagtggtggtaagtttaggttgtagtttttttgcgtttttatgttttaagaaattgtagcgggtattcggcggttttggttgcgttagggtagggcgcgtttcgtttcgggtcgtcgggtttgaggtatgggtcgttgttgagtttttttcgtttcggtcgcgcgttatcggtagtttgttgtttcggcggtcggtaggaagggcgggttgggtagttgtttgaagaattgtcggaggtcggttaggtttcgcgtgagttgttttacgcgttggtgtagtttttcgtttttagtcgatagttttattaatttttgttgtattttttggttgcgtcgtttggttttgtcgcggtttttgcgtacggcgatgttgttgcgttcgcgtcgttgtcggtattcggggttgtcgcggttcgggttttttttgtcggcgtttttttttcgggcggggtcgggcgcgggggtttgtttggggttgttgcgcggcggtttcggcgacgtgggcggggtgggttgttttgcggtcgttaagtttattacggtttgtgcgtacgcggtta

SEQ ID NO: 31048 - DNA, 589 bp, Artificial Sequence
  chemically treated genomic DNA (Homo sapiens) CpG-island No: 31048
taaccgcgtacgcacaaaccgtaataaacttaacgaccgcaaaacaacccaccccgcccacgtcgccgaaaccgccgcgcaacaaccccaaacaaacccccgcgcccgaccccgcccgaaaaaaaaacgccgacaaaaaaaacccgaaccgcgacaaccccgaataccgacaacgacgcgaacgcaacaacatcgccgtacgcaaaaaccgcgacaaaaccaaacgacgcaaccaaaaaatacaacaaaaattaataaaactatcgactaaaaacgaaaaactacaccaacgcgtaaaacaactcacgcgaaacctaaccgacctccgacaattcttcaaacaactacccaacccgcccttcctaccgaccgccgaaacaacaaactaccgataacgcgcgaccgaaacgaaaaaaactcaacaacgacccatacctcaaacccgacgacccgaaacgaaacgcgccctaccctaacgcaaccaaaaccgccgaatacccgctacaatttcttaaaacataaaaacgcaaaaaaactacaacctaaacttaccaccactaaactacgaaaaaaactaaacgtatttatt

SEQ ID NO: 31049 - DNA, 576 bp, Artificial Sequence
  chemically treated genomic DNA (Homo sapiens) CpG-island No: 31049
cgggcgcgggagttggcggcggacgttcgggtttgcggggtcggggagtagcgttcggtcggagagttcgtatttcgaggagtcggcggaggacgcggtgtcgtgatcgcgttttttttatttgttttgtttttggcgatagcgtttcgtcggtttttcggttaggacgtagtagtcgcgtttttgggtttcgatttttagggtcggtcggattcgggattttcgaggagagtagcgagaatcggttcggatttttcgaggcgttcgagtgcggtgcgggtagtttttttcgtttgttaggtcgtcgttgtttttacgtttggttttttacgttttttttcgtatttggttttacggtggaggcgcggggcgagggttttacgcgcgtgtttacggtcggggggcgtttttggacgcgcgggtttttttttacgggtttttatttttcgtttttcggcgataggagtcggtttgggacgcgcgcgttgcggttaagttttggttttgattttatttttaatttcgaggagcgaggaggttttaagtttataaataggaagaagagaaggttttgga

SEQ ID NO: 31050 - DNA, 576 bp, Artificial Sequence
  chemically treated genomic DNA (Homo sapiens) CpG-island No: 31050
tccaaaaccttctcttcttcctatttataaacttaaaacctcctcgctcctcgaaattaaaaataaaatcaaaaccaaaacttaaccgcaacgcgcgcgtcccaaaccgactcctatcgccgaaaaacgaaaaataaaaacccgtaaaaaaaaacccgcgcgtccaaaaacgccccccgaccgtaaacacgcgcgtaaaaccctcgccccgcgcctccaccgtaaaaccaaatacgaaaaaaaacgtaaaaaaccaaacgtaaaaacaacgacgacctaacaaacgaaaaaaactacccgcaccgcactcgaacgcctcgaaaaatccgaaccgattctcgctactctcctcgaaaatcccgaatccgaccgaccctaaaaatcgaaacccaaaaacgcgactactacgtcctaaccgaaaaaccgacgaaacgctatcgccaaaaacaaaacaaataaaaaaaacgcgatcacgacaccgcgtcctccgccgactcctcgaaatacgaactctccgaccgaacgctactccccgaccccgcaaacccgaacgtccgccgccaactcccgcgcccg

SEQ ID NO: 31051 - DNA, 576 bp, Artificial Sequence
  chemically treated genomic DNA (Homo sapiens) CpG-island No: 31051
tttagggtttttttttttttttgtttgtgggtttggaattttttcgtttttcggggttgggagtgaaattaaaattaggatttggtcgtagcgcgcgcgttttaggtcggtttttgtcgtcggagggcggggggtggagattcgtgggagaggattcgcgcgtttaaggacgtttttcgatcgtgggtacgcgcgtgaggttttcgtttcgcgtttttatcgtgggattagatgcgggaagaggcgtgggggattagacgtggggatagcggcggtttggtaggcggggagggttgttcgtatcgtattcgggcgtttcggggaattcgggtcggttttcgttgtttttttcggaggtttcgggttcggtcggttttgggggtcgaggtttagagacgcggttgttgcgttttggtcgaaaggtcgacgggacgttgtcgttaaaagtagagtagatgggggagacgcggttacgatatcgcgtttttcgtcggtttttcgaggtgcgggtttttcggtcggacgttatttttcgatttcgtagattcgggcgttcgtcgttagttttcgcgttcg

SEQ ID NO: 31052 - DNA, 576 bp, Artificial Sequence
  chemically treated genomic DNA (Homo sapiens) CpG-island No: 31052
cgaacgcgaaaactaacgacgaacgcccgaatctacgaaatcgaaaaataacgtccgaccgaaaaacccgcacctcgaaaaaccgacgaaaaacgcgatatcgtaaccgcgtctcccccatctactctacttttaacgacaacgtcccgtcgacctttcgaccaaaacgcaacaaccgcgtctctaaacctcgacccccaaaaccgaccgaacccgaaacctccgaaaaaaacaacgaaaaccgacccgaattccccgaaacgcccgaatacgatacgaacaaccctccccgcctaccaaaccgccgctatccccacgtctaatcccccacgcctcttcccgcatctaatcccacgataaaaacgcgaaacgaaaacctcacgcgcgtacccacgatcgaaaaacgtccttaaacgcgcgaatcctctcccacgaatctccaccccccgccctccgacgacaaaaaccgacctaaaacgcgcgcgctacgaccaaatcctaattttaatttcactcccaaccccgaaaaacgaaaaaattccaaacccacaaacaaaaaaaaaaaaaaaccctaaa

SEQ ID NO: 31053 - DNA, 547 bp, Artificial Sequence
  chemically treated genomic DNA (Homo sapiens) CpG-island No: 31053
tgttcggattgtgatttgggtaagaagagaaaggagatagcggtaattatcgatgtttttgtgattttgtaattgttttagcgtcgttttttttttgcggaaattatattcggcggtagaggtcgtagtttcggtggtttttggcggtaagaattgtttgagggcgtcggggggcgagttagggttgtcgtagtagcgaattcgatatatcgaggcggaggagtcgttatttagacggttttgtatttgttatagtcgttcgaaggtttttagaaaacgcggcggtttcgcgttttaggcgtagtcggatttcgttatcggtgtgggttaagggtacggatacgggagttgacgcgacgtttgaggtaggtcggtcgggttcgcggttatattttcgttagtcggattagcggtttcgtagggagggatttgtagtcgttttatcgattttcgggattttaagtagttatgatatcggaagtcgtggtgtattcgagttttagaagtcggaaatggaggaagagtttattatataggtcgaaggagg

SEQ ID NO: 31054 - DNA, 547 bp, Artificial Sequence
  chemically treated genomic DNA (Homo sapiens) CpG-island No: 31054
cctccttcgacctatataataaactcttcctccatttccgacttctaaaactcgaatacaccacgacttccgatatcataactacttaaaatcccgaaaatcgataaaacgactacaaatccctccctacgaaaccgctaatccgactaacgaaaatataaccgcgaacccgaccgacctacctcaaacgtcgcgtcaactcccgtatccgtacccttaacccacaccgataacgaaatccgactacgcctaaaacgcgaaaccgccgcgttttctaaaaaccttcgaacgactataacaaatacaaaaccgtctaaataacgactcctccgcctcgatatatcgaattcgctactacgacaaccctaactcgccccccgacgccctcaaacaattcttaccgccaaaaaccaccgaaactacgacctctaccgccgaatataatttccgcaaaaaaaaaacgacgctaaaacaattacaaaatcacaaaaacatcgataattaccgctatctcctttctcttcttacccaaatcacaatccgaaca

SEQ ID NO: 31055 - DNA, 547 bp, Artificial Sequence
  chemically treated genomic DNA (Homo sapiens) CpG-island No: 31055
tttttttcggtttgtatgataggttttttttttattttcggtttttgggattcgggtgtattacggttttcggtgttatggttgtttgaagtttcgggagtcggtgaggcggttgtaggtttttttttgcggagtcgttggttcggttggcggagatgtgatcgcgggttcggtcggtttgttttaggcgtcgcgttagttttcgtgttcgtgtttttaatttatatcgatggcgggattcggttgcgtttggggcgcggagtcgtcgcgttttttggaggttttcgggcggttgtggtaggtatagagtcgtttgggtagcggttttttcgtttcggtgtatcgggttcgttgttgcggtaattttggttcgtttttcggcgtttttaagtagtttttgtcgttaggaattatcggggttgcggtttttgtcgtcgagtatggttttcgtaaagagagggcggcgttggaatagttgtagggttatagaaatatcggtaattgtcgttgttttttttttttttttgtttaggttatagttcgagta

SEQ ID NO: 31056 - DNA, 547 bp, Artificial Sequence
  chemically treated genomic DNA (Homo sapiens) CpG-island No: 31056
tactcgaactataacctaaacaaaaaaaaaaaaaaaacaacgacaattaccgatatttctataaccctacaactattccaacgccgccctctctttacgaaaaccatactcgacgacaaaaaccgcaaccccgataattcctaacgacaaaaactacttaaaaacgccgaaaaacgaaccaaaattaccgcaacaacgaacccgatacaccgaaacgaaaaaaccgctacccaaacgactctatacctaccacaaccgcccgaaaacctccaaaaaacgcgacgactccgcgccccaaacgcaaccgaatcccgccatcgatataaattaaaaacacgaacacgaaaactaacgcgacgcctaaaacaaaccgaccgaacccgcgatcacatctccgccaaccgaaccaacgactccgcaaaaaaaaacctacaaccgcctcaccgactcccgaaacttcaaacaaccataacaccgaaaaccgtaatacacccgaatcccaaaaaccgaaaataaaaaaaaaacctatcatacaaaccgaaaaaaa

SEQ ID NO: 31057 - DNA, 657 bp, Artificial Sequence
  chemically treated genomic DNA (Homo sapiens) CpG-island No: 31057
tcggaggtcgtgttcgaggttaagtttaagcgtagtcgcgagtcgtttttgtcgttggggttgcggttgttgagtcgttcgcgttcggaggagcgcggtttttttcgtggggtcgaggaggaggatggtatatatcggtttagttcggcggggatttcgttggagttggtgcgacggtttgagcgtttacgttcggtgtaggattttagggttgtcggagagtttggtttcgttcgtcgtttttcgttgttattgttttagcggttgcggcggatttttttcgcgtagcgttattcggtttgggaggttcgcggcggggacggagagagttcggagggcgggagttcggcgcggggtttttcggtgttggcgatgcgtaggcggttgagttttattttggagcggttgtttagtcgattgtagcgtagtggtagtagcgaggattcggggggcgcgtcgggtcgtagtacgtcgttgttcggacggtttcgtagggttacgttcgagggcgagagtttgcggcgttttggtttttcgtataattagttggtcgtttaggtcggcgttattacgtttttcgtcgagtttttgggtttcgaggttagcgttacgtcgggttttttaggtgaggaggggtaggggtagggtagtaggtgt

SEQ ID NO: 31058 - DNA, 657 bp, Artificial Sequence
  chemically treated genomic DNA (Homo sapiens) CpG-island No: 31058
acacctactaccctacccctacccctcctcacctaaaaaacccgacgtaacgctaacctcgaaacccaaaaactcgacgaaaaacgtaataacgccgacctaaacgaccaactaattatacgaaaaaccaaaacgccgcaaactctcgccctcgaacgtaaccctacgaaaccgtccgaacaacgacgtactacgacccgacgcgccccccgaatcctcgctactaccactacgctacaatcgactaaacaaccgctccaaaataaaactcaaccgcctacgcatcgccaacaccgaaaaaccccgcgccgaactcccgccctccgaactctctccgtccccgccgcgaacctcccaaaccgaataacgctacgcgaaaaaaatccgccgcaaccgctaaaacaataacaacgaaaaacgacgaacgaaaccaaactctccgacaaccctaaaatcctacaccgaacgtaaacgctcaaaccgtcgcaccaactccaacgaaatccccgccgaactaaaccgatatataccatcctcctcctcgaccccacgaaaaaaaccgcgctcctccgaacgcgaacgactcaacaaccgcaaccccaacgacaaaaacgactcgcgactacgcttaaacttaacctcgaacacgacctccga

SEQ ID NO: 31059 - DNA, 657 bp, Artificial Sequence
  chemically treated genomic DNA (Homo sapiens) CpG-island No: 31059
gtatttgttgttttatttttgtttttttttatttgaggagttcgacgtggcgttggtttcggagtttagggattcggcggaaggcgtggtggcgtcggtttgggcggttaattggttgtgcggaaggttaaggcgtcgtagattttcgttttcggacgtggttttgcgaagtcgttcgaatagcggcgtgttgcggttcgacgcgtttttcgagttttcgttgttgttattgcgttgtaatcggttggatagtcgttttagggtgaagtttagtcgtttgcgtatcgttagtatcggggagtttcgcgtcgagttttcgtttttcgagtttttttcgttttcgtcgcgggttttttaggtcgggtggcgttgcgcgggaggggttcgtcgtagtcgttgggatagtgatagcgagaggcggcggacgaggttaggtttttcgatagttttgaggttttgtatcgagcgtgagcgtttaggtcgtcgtattagttttagcggggttttcgtcgggttgggtcggtatatgttattttttttttcggttttacggaaggggtcgcgttttttcgagcgcgaacggtttagtagtcgtagttttagcgataggggcgattcgcggttgcgtttgaatttggtttcgaatacggttttcga

SEQ ID NO: 31060 - DNA, 657 bp, Artificial Sequence
  chemically treated genomic DNA (Homo sapiens) CpG-island No: 31060
tcgaaaaccgtattcgaaaccaaattcaaacgcaaccgcgaatcgcccctatcgctaaaactacgactactaaaccgttcgcgctcgaaaaaacgcgaccccttccgtaaaaccgaaaaaaaaaataacatataccgacccaacccgacgaaaaccccgctaaaactaatacgacgacctaaacgctcacgctcgatacaaaacctcaaaactatcgaaaaacctaacctcgtccgccgcctctcgctatcactatcccaacgactacgacgaacccctcccgcgcaacgccacccgacctaaaaaacccgcgacgaaaacgaaaaaaactcgaaaaacgaaaactcgacgcgaaactccccgatactaacgatacgcaaacgactaaacttcaccctaaaacgactatccaaccgattacaacgcaataacaacaacgaaaactcgaaaaacgcgtcgaaccgcaacacgccgctattcgaacgacttcgcaaaaccacgtccgaaaacgaaaatctacgacgccttaaccttccgcacaaccaattaaccgcccaaaccgacgccaccacgccttccgccgaatccctaaactccgaaaccaacgccacgtcgaactcctcaaataaaaaaaaacaaaaataaaacaacaaatac

SEQ ID NO: 31061 - DNA, 722 bp, Artificial Sequence
  chemically treated genomic DNA (Homo sapiens) CpG-island No: 31061
cgtcgtcgtcgtcgtcgtagagttgtagttcggggtcgagggtaaggaggcgagtcgggagcgggaggttcgggagagtttcgcgggttttcgcgtttagtttttagtcgcgtttcgatttcgtcgtttcgggtttcggttcgtttttcgtatttttttttgtttttttatcgttcgtcgttgtaggcggtcggtcgtcgcgatgaaggcgagttcgggggattaggggagtttttcgtgttttttgcgtttttcgcggtttgtgcgggtggtaagtggcgtcgaggtcgagtttaagtgcgtggttttgggggagtcgtcgtttgtagtggtgtgggagaagggcgggtagtagttggcggtttcggaacgtttgagtttttcggcggacggcgcggagtacggtttgttgttgatcgtcgtattgtttatcgacgcgggggtttacgtgtgtcgcgttcgtaacgcggtcggcgaggtttacgcggcggtcgtcgttatcgtgttggagtcgtcggttttcgatttcgagttgtagttcgtcgagcgttcgttgttatcgtcggggttcggggagggcgtttcggttttttttacggggtttcgattttagtgggtgttgcggggggcggaggtggtgttgacgtgtcgggcggggggttttttcgagtttatattgtattgggagaaggacgggatggttttggacgaagtgtgggata

SEQ ID NO: 31062 - DNA, 722 bp, Artificial Sequence
  chemically treated genomic DNA (Homo sapiens) CpG-island No: 31062
tatcccacacttcgtccaaaaccatcccgtccttctcccaatacaatataaactcgaaaaaaccccccgcccgacacgtcaacaccacctccgccccccgcaacacccactaaaatcgaaaccccgtaaaaaaaaccgaaacgccctccccgaaccccgacgataacaacgaacgctcgacgaactacaactcgaaatcgaaaaccgacgactccaacacgataacgacgaccgccgcgtaaacctcgccgaccgcgttacgaacgcgacacacgtaaacccccgcgtcgataaacaatacgacgatcaacaacaaaccgtactccgcgccgtccgccgaaaaactcaaacgttccgaaaccgccaactactacccgcccttctcccacaccactacaaacgacgactcccccaaaaccacgcacttaaactcgacctcgacgccacttaccacccgcacaaaccgcgaaaaacgcaaaaaacacgaaaaactcccctaatcccccgaactcgccttcatcgcgacgaccgaccgcctacaacgacgaacgataaaaaaacaaaaaaaaatacgaaaaacgaaccgaaacccgaaacgacgaaatcgaaacgcgactaaaaactaaacgcgaaaacccgcgaaactctcccgaacctcccgctcccgactcgcctccttaccctcgaccccgaactacaactctacgacgacgacgacgacg

SEQ ID NO: 31063 - DNA, 722 bp, Artificial Sequence
  chemically treated genomic DNA (Homo sapiens) CpG-island No: 31063
tgttttatatttcgtttagggttatttcgttttttttttagtatagtgtgggttcggggaggtttttcgttcggtacgttagtattattttcgtttttcgtagtatttattgggatcgaggtttcgtgaggaagatcggggcgtttttttcggatttcggcgatggtagcgggcgttcggcgggttgtagttcggggtcggaggtcggcggttttagtacggtgacggcggtcgtcgcgtaggtttcgtcggtcgcgttgcgggcgcggtatacgtagattttcgcgtcggtgggtagtgcggcggttagtagtaggtcgtgtttcgcgtcgttcgtcgggaagtttaggcgtttcgaggtcgttagttgttgttcgttttttttttatattattataggcggcggtttttttaggattacgtatttgagttcggtttcggcgttatttattattcgtataggtcgcgggaagcgtaggaagtacggggggtttttttgatttttcgagttcgtttttatcgcggcggtcgatcgtttgtagcggcgaacggtgggggggtaggggggggtgcggagggcgagtcgaggttcggggcggcggggtcggggcgcggttggggattgggcgcggggattcgcggagttttttcgggtttttcgttttcggttcgtttttttattttcggtttcgagttgtagttttgcggcggcggcggcggcg

SEQ ID NO: 31064 - DNA, 722 bp, Artificial Sequence
  chemically treated genomic DNA (Homo sapiens) CpG-island No: 31064
cgccgccgccgccgccgcaaaactacaactcgaaaccgaaaataaaaaaacgaaccgaaaacgaaaaacccgaaaaaactccgcgaatccccgcgcccaatccccaaccgcgccccgaccccgccgccccgaacctcgactcgccctccgcacccccccctacccccccaccgttcgccgctacaaacgatcgaccgccgcgataaaaacgaactcgaaaaatcaaaaaaaccccccgtacttcctacgcttcccgcgacctatacgaataataaataacgccgaaaccgaactcaaatacgtaatcctaaaaaaaccgccgcctataataatataaaaaaaaaacgaacaacaactaacgacctcgaaacgcctaaacttcccgacgaacgacgcgaaacacgacctactactaaccgccgcactacccaccgacgcgaaaatctacgtataccgcgcccgcaacgcgaccgacgaaacctacgcgacgaccgccgtcaccgtactaaaaccgccgacctccgaccccgaactacaacccgccgaacgcccgctaccatcgccgaaatccgaaaaaaacgccccgatcttcctcacgaaacctcgatcccaataaatactacgaaaaacgaaaataatactaacgtaccgaacgaaaaacctccccgaacccacactatactaaaaaaaaaacgaaataaccctaaacgaaatataaaaca

SEQ ID NO: 31065 - DNA, 583 bp, Artificial Sequence
  chemically treated genomic DNA (Homo sapiens) CpG-island No: 31065
atttcgcgttttagtcgggtcgcgtcgaggacggtttcggcgcgagtttggtattgcgtattttggcggttcggttgtcggatttcggcgtttacgtgtgttacgttcgtaacgcgtacggttacgcgtaggcgggggcgttgttttaggtgtattagtttttcgagagttcgttcgcggatttcgacgaggttttcgcgtcggtggtggagtcgtttaagtgcgcgtttaagattttttgggtgaacgagggtaagtacgttaagtttcgttgttacgtgatgggtaagttcgagttcgagatcgaatggtattgggagggtcgttcgttgttttcggatcgtcgtcgttttatgtatcgcgatcgcgacggcggtttcgtgtttaaggtgttttattgttaggttaaggatcgtgggttttacgtttgcgtcgcgcgtaattcggcgggttagacgtttagtgtcgtgtagttgtacgtgaaaggtacggcggagttcgggatttagggaggggtttcgagtgtttttcgaggtttttcgaattttagtttttttcggtgtttagcgttgtttttaagatt

SEQ ID NO: 31066 - DNA, 583 bp, Artificial Sequence
  chemically treated genomic DNA (Homo sapiens) CpG-island No: 31066
aatcttaaaaacaacgctaaacaccgaaaaaaactaaaattcgaaaaacctcgaaaaacactcgaaacccctccctaaatcccgaactccgccgtacctttcacgtacaactacacgacactaaacgtctaacccgccgaattacgcgcgacgcaaacgtaaaacccacgatccttaacctaacaataaaacaccttaaacacgaaaccgccgtcgcgatcgcgatacataaaacgacgacgatccgaaaacaacgaacgaccctcccaataccattcgatctcgaactcgaacttacccatcacgtaacaacgaaacttaacgtacttaccctcgttcacccaaaaaatcttaaacgcgcacttaaacgactccaccaccgacgcgaaaacctcgtcgaaatccgcgaacgaactctcgaaaaactaatacacctaaaacaacgcccccgcctacgcgtaaccgtacgcgttacgaacgtaacacacgtaaacgccgaaatccgacaaccgaaccgccaaaatacgcaataccaaactcgcgccgaaaccgtcctcgacgcgacccgactaaaacgcgaaat

SEQ ID NO: 31067 - DNA, 583 bp, Artificial Sequence
  chemically treated genomic DNA (Homo sapiens) CpG-island No: 31067
agttttgggggtagcgttgggtatcgaggagggttggagttcggagggtttcggaggatattcgaggtttttttttaggtttcgggtttcgtcgtattttttacgtgtagttgtacggtattgagcgtttggttcgtcgagttgcgcgcggcgtagacgtagagtttacgatttttggtttggtagtaaagtattttgagtacgaagtcgtcgtcgcggtcgcggtatatgaggcggcggcggttcgggagtagcgggcggtttttttagtgttattcgatttcgggttcgggtttgtttattacgtagtagcggaatttggcgtgtttgttttcgtttatttagaaggttttaggcgcgtatttgagcggttttattatcggcgcgggggtttcgtcggggttcgcgggcgggttttcggggggttggtgtatttggagtagcgttttcgtttgcgcgtggtcgtgcgcgttgcgggcgtggtatacgtagacgtcggaattcggtagtcgagtcgttaggatgcgtagtgttaggttcgcgtcggggtcgttttcggcgcggttcggttggagcgcgaagt

SEQ ID NO: 31068 - DNA, 583 bp, Artificial Sequence
  chemically treated genomic DNA (Homo sapiens) CpG-island No: 31068
acttcgcgctccaaccgaaccgcgccgaaaacgaccccgacgcgaacctaacactacgcatcctaacgactcgactaccgaattccgacgtctacgtataccacgcccgcaacgcgcacgaccacgcgcaaacgaaaacgctactccaaatacaccaaccccccgaaaacccgcccgcgaaccccgacgaaacccccgcgccgataataaaaccgctcaaatacgcgcctaaaaccttctaaataaacgaaaacaaacacgccaaattccgctactacgtaataaacaaacccgaacccgaaatcgaataacactaaaaaaaccgcccgctactcccgaaccgccgccgcctcatataccgcgaccgcgacgacgacttcgtactcaaaatactttactaccaaaccaaaaatcgtaaactctacgtctacgccgcgcgcaactcgacgaaccaaacgctcaataccgtacaactacacgtaaaaaatacgacgaaacccgaaacctaaaaaaaaacctcgaatatcctccgaaaccctccgaactccaaccctcctcgatacccaacgctacccccaaaact

SEQ ID NO: 31069 - DNA, 855 bp, Artificial Sequence
  chemically treated genomic DNA (Homo sapiens) CpG-island No: 31069
ttcgtcggttcgcggtttttgggttttttaggttcgtttttcggttttttcgcgttgttcggagagggcggttgggcggcggcggggtttacggttcgcgatgttttgggggtggagggtcgagagaagagcgggggttcgtcgggttttcgaggggatggggtacgttgtagcgtggcgcgtagggattcgtgcgagcgtattagtttttttcgcgacgtggagcggcggatgcggtttagtttttgggcgaagcgtagttcgaggtttgaggtcgggttgcgttgacgcgtgcgttcgtttagcgaggtcgttttttgttggaataggcggcgtcgttcggttacgttgtttggcgttcgtagttttttttgcgaggtttcgggggtgttttacggtgcgtcgcgtttcgatttgggttgttttagagagcgggttttgcgtaggggtatttagggtcgtaggggcgtcggcggcgagtcgttgcgttttagggtgcgtcgtcgtttttcgaagaattgtagtttgtttaggatgcgggagtcggcgcgtattagtataggcgatcggtttaacgtcgataggcggtttgaggtttcgtttagtggcgtttggggtcgggatttcgcggtgttcgttagggagggttcggacgatttggattttttttttcgttttttttcggtggtggtgttttcgggtagtataggtttttgagtgcgacggtggggcgacgtgggggtggtcgcgggttgggtcgggggtttcggcggggatcgtttttcgattcgaggggacggtggggggagtagcgcggatttggaaggaggcggttgggtagggcggcgtggggtt

SEQ ID NO: 31070 - DNA, 855 bp, Artificial Sequence
  chemically treated genomic DNA (Homo sapiens) CpG-island No: 31070
aaccccacgccgccctacccaaccgcctccttccaaatccgcgctactccccccaccgtcccctcgaatcgaaaaacgatccccgccgaaacccccgacccaacccgcgaccacccccacgtcgccccaccgtcgcactcaaaaacctatactacccgaaaacaccaccaccgaaaaaaaacgaaaaaaaaaatccaaatcgtccgaaccctccctaacgaacaccgcgaaatcccgaccccaaacgccactaaacgaaacctcaaaccgcctatcgacgttaaaccgatcgcctatactaatacgcgccgactcccgcatcctaaacaaactacaattcttcgaaaaacgacgacgcaccctaaaacgcaacgactcgccgccgacgcccctacgaccctaaatacccctacgcaaaacccgctctctaaaacaacccaaatcgaaacgcgacgcaccgtaaaacacccccgaaacctcgcaaaaaaaactacgaacgccaaacaacgtaaccgaacgacgccgcctattccaacaaaaaacgacctcgctaaacgaacgcacgcgtcaacgcaacccgacctcaaacctcgaactacgcttcgcccaaaaactaaaccgcatccgccgctccacgtcgcgaaaaaaactaatacgctcgcacgaatccctacgcgccacgctacaacgtaccccatcccctcgaaaacccgacgaacccccgctcttctctcgaccctccacccccaaaacatcgcgaaccgtaaaccccgccgccgcccaaccgccctctccgaacaacgcgaaaaaaccgaaaaacgaacctaaaaaacccaaaaaccgcgaaccgacgaa

SEQ ID NO: 31071 - DNA, 855 bp, Artificial Sequence
  chemically treated genomic DNA (Homo sapiens) CpG-island No: 31071
agttttacgtcgttttgtttagtcgtttttttttaaattcgcgttgttttttttatcgttttttcgggtcgggaagcggttttcgtcgggattttcggtttagttcgcggttatttttacgtcgttttatcgtcgtatttaggagtttgtgttgttcgaggatattattatcgaagagaagcgagggaagaagtttaagtcgttcgggttttttttggcgggtatcgcggaatttcgattttagacgttattgagcgaggttttaggtcgtttgtcggcgttgggtcgatcgtttatgttggtgcgcgtcggttttcgtattttggataagttgtagtttttcgaggagcgacggcgtattttggagcgtagcgattcgtcgtcggcgtttttgcggttttgggtgtttttgcgtaaggttcgttttttggagtagtttaagtcggagcgcggcgtatcgtggggtattttcggggtttcgtaggaagaattgcgggcgttaggtagcgtggtcgagcggcgtcgtttgttttagtagaaagcggtttcgttggacgagcgtacgcgttagcgtagttcggttttagatttcgagttgcgtttcgtttaggagttgggtcgtattcgtcgttttacgtcgcgggaggagttggtgcgttcgtacgagtttttgcgcgttacgttgtagcgtgttttattttttcgagagttcggcgagttttcgtttttttttcggttttttatttttaagatatcgcgggtcgtgagtttcgtcgtcgtttagtcgtttttttcgagtagcgcggagaagtcgggggacgagtttgggaggtttaggagtcgcgggtcggcggg

SEQ ID NO: 31072 - DNA, 855 bp, Artificial Sequence
  chemically treated genomic DNA (Homo sapiens) CpG-island No: 31072
cccgccgacccgcgactcctaaacctcccaaactcgtcccccgacttctccgcgctactcgaaaaaaacgactaaacgacgacgaaactcacgacccgcgatatcttaaaaataaaaaaccgaaaaaaaaacgaaaactcgccgaactctcgaaaaaataaaacacgctacaacgtaacgcgcaaaaactcgtacgaacgcaccaactcctcccgcgacgtaaaacgacgaatacgacccaactcctaaacgaaacgcaactcgaaatctaaaaccgaactacgctaacgcgtacgctcgtccaacgaaaccgctttctactaaaacaaacgacgccgctcgaccacgctacctaacgcccgcaattcttcctacgaaaccccgaaaataccccacgatacgccgcgctccgacttaaactactccaaaaaacgaaccttacgcaaaaacacccaaaaccgcaaaaacgccgacgacgaatcgctacgctccaaaatacgccgtcgctcctcgaaaaactacaacttatccaaaatacgaaaaccgacgcgcaccaacataaacgatcgacccaacgccgacaaacgacctaaaacctcgctcaataacgtctaaaatcgaaattccgcgatacccgccaaaaaaaacccgaacgacttaaacttcttccctcgcttctcttcgataataatatcctcgaacaacacaaactcctaaatacgacgataaaacgacgtaaaaataaccgcgaactaaaccgaaaatcccgacgaaaaccgcttcccgacccgaaaaaacgataaaaaaaacaacgcgaatttaaaaaaaaacgactaaacaaaacgacgtaaaact

SEQ ID NO: 31073 - DNA, 924 bp, Artificial Sequence
  chemically treated genomic DNA (Homo sapiens) CpG-island No: 31073
tcggacgtcgttagtgtatgttagggtgggcggaatagggatgcggagcgggaagtttagaggttcgggattaggggttgggggcgggggaaagaatagggacgaggtttatagggtcgtggggcggggttcgtcggagttaggggcggggtttgtttcggtggggcgggatttgttcgagtttgggcggggtagcgaggggttcgaaagggtaattaggcgggtagatttttttgtcggatgcggacgcgggtttcgggttttagcgggcggttttcgagtttttagcgtttcgtggtttcgattttcgatacggtgtattcgaacgtagcgtcgtcgttttcgcgggcgtttatcgatcgtagttcggagagtatcgttatagtacgttttggggcggagttcggggcgtgagcggggcggggttaaagggtagttatcggtacgttttttttacgttttttttttagaagtacgcgcggttattagggttcggggaagatagtttcgtaagtttcgcgtttaaagtagtgtttagtttttatattattttgtatttatcgcgtacggttaggcggatcggttcggcgcgggttgtttttatcgcgtagttgtaggtttcggcgttagaggggtcgtagcgttatagttggagaaggcggcgcgtgtagagggtatggagtcggagtcgcgggataggcgtaagcgcgttttcgttataggggcgggagttgtagagggtcggggcgagttcggatgggtataggcgatttcggtcgtggtaggcggcgtattttttgttgatgttaagcggtttcgaggcgcgtttatgcgtgtttcgtgtttttaggttggggtcggattgtttttaagtttttggggtcgtgttaggagtttttttgaaaaagcgttattttttgggga

SEQ ID NO: 31074 - DNA, 924 bp, Artificial Sequence
  chemically treated genomic DNA (Homo sapiens) CpG-island No: 31074
tccccaaaaaataacgctttttcaaaaaaactcctaacacgaccccaaaaacttaaaaacaatccgaccccaacctaaaaacacgaaacacgcataaacgcgcctcgaaaccgcttaacatcaacaaaaaatacgccgcctaccacgaccgaaatcgcctatacccatccgaactcgccccgaccctctacaactcccgcccctataacgaaaacgcgcttacgcctatcccgcgactccgactccataccctctacacgcgccgccttctccaactataacgctacgacccctctaacgccgaaacctacaactacgcgataaaaacaacccgcgccgaaccgatccgcctaaccgtacgcgataaatacaaaataatataaaaactaaacactactttaaacgcgaaacttacgaaactatcttccccgaaccctaataaccgcgcgtacttctaaaaaaaaaacgtaaaaaaaacgtaccgataactaccctttaaccccgccccgctcacgccccgaactccgccccaaaacgtactataacgatactctccgaactacgatcgataaacgcccgcgaaaacgacgacgctacgttcgaatacaccgtatcgaaaatcgaaaccacgaaacgctaaaaactcgaaaaccgcccgctaaaacccgaaacccgcgtccgcatccgacaaaaaaatctacccgcctaattaccctttcgaacccctcgctaccccgcccaaactcgaacaaatcccgccccaccgaaacaaaccccgcccctaactccgacgaaccccgccccacgaccctataaacctcgtccctattctttcccccgcccccaacccctaatcccgaacctctaaacttcccgctccgcatccctattccgcccaccctaacatacactaacgacgtccga

SEQ ID NO: 31075 - DNA, 924 bp, Artificial Sequence
  chemically treated genomic DNA (Homo sapiens) CpG-island No: 31075
tttttaaagggtgacgtttttttaaagaggtttttggtacgattttaaaggtttggggatagttcgattttagtttgggaatacgagatacgtataaacgcgtttcgagatcgtttggtattaataaagggtgcgtcgtttgttacggtcggggtcgtttgtgtttattcgggttcgtttcgattttttgtaattttcgtttttatgacgggaacgcgtttacgtttatttcgcggtttcggttttatgttttttgtacgcgtcgttttttttagttgtgacgttgcggtttttttgacgtcgggatttatagttgcgcggtggggatagttcgcgtcggatcggttcgtttgatcgtgcgcggtgggtatagggtgatgtggaggttgggtattgttttgggcgcgagatttgcggagttgtttttttcggattttgatgatcgcgcgtgtttttagaaagggggcgtggagggggcgtgtcggtaattgttttttggtttcgtttcgtttacgtttcgggtttcgttttagagcgtattgtggcggtatttttcgagttgcggtcggtgagcgttcgcgaaggcgacggcgttacgttcgagtgtatcgtgtcggaggtcgagattacggggcgttgggagttcggaggtcgttcgttgagattcggagttcgcgttcgtattcgataggaaggtttgttcgtttggttattttttcgggtttttcgttgtttcgtttaggttcgaatagatttcgttttatcgggataagtttcgtttttggtttcgacgggtttcgttttacggttttgtgagtttcgtttttgttttttttttcgtttttagtttttagtttcggatttttaggtttttcgtttcgtatttttgtttcgtttattttagtatatattaacggcgttcga

SEQ ID NO: 31076 - DNA, 924 bp, Artificial Sequence
  chemically treated genomic DNA (Homo sapiens) CpG-island No: 31076
tcgaacgccgttaatatatactaaaataaacgaaacaaaaatacgaaacgaaaaacctaaaaatccgaaactaaaaactaaaaacgaaaaaaaaaacaaaaacgaaactcacaaaaccgtaaaacgaaacccgtcgaaaccaaaaacgaaacttatcccgataaaacgaaatctattcgaacctaaacgaaacaacgaaaaacccgaaaaaataaccaaacgaacaaaccttcctatcgaatacgaacgcgaactccgaatctcaacgaacgacctccgaactcccaacgccccgtaatctcgacctccgacacgatacactcgaacgtaacgccgtcgccttcgcgaacgctcaccgaccgcaactcgaaaaataccgccacaatacgctctaaaacgaaacccgaaacgtaaacgaaacgaaaccaaaaaacaattaccgacacgccccctccacgccccctttctaaaaacacgcgcgatcatcaaaatccgaaaaaaacaactccgcaaatctcgcgcccaaaacaatacccaacctccacatcaccctatacccaccgcgcacgatcaaacgaaccgatccgacgcgaactatccccaccgcgcaactataaatcccgacgtcaaaaaaaccgcaacgtcacaactaaaaaaaacgacgcgtacaaaaaacataaaaccgaaaccgcgaaataaacgtaaacgcgttcccgtcataaaaacgaaaattacaaaaaatcgaaacgaacccgaataaacacaaacgaccccgaccgtaacaaacgacgcaccctttattaataccaaacgatctcgaaacgcgtttatacgtatctcgtattcccaaactaaaatcgaactatccccaaacctttaaaatcgtaccaaaaacctctttaaaaaaacgtcaccctttaaaaa

SEQ ID NO: 31077 - DNA, 509 bp, Artificial Sequence
  chemically treated genomic DNA (Homo sapiens) CpG-island No: 31077
ggggtacgtatgagatggtgcgttcgcggtaaaggttgtggtcgggtttgttttatgaattttgggttttgattttgttcgcgggtatgttttcgaaggagttgcgcgagaaagggtcgtcgcgggtgttggagtcgttgaaagacgcggtgttgatcgaaagtagcgcggttaagtttatttgtcgtattttggttttttcggatttatttattcgttggagtaaggacggtaaggagttacgtgacggttttaagtatcgttacgttttcgaggattttgacgtggtggtattggtggtgcgcgacggcgagttggtagatttgggttagtatagtattaacgttattaattttttcggttagtgtttcgattcggcgcgtattttcgtggaaggtacgcgcgtttcgggcgtagcgttagggcgtagattagtattatttagttagagttcgtagttcggtttagttgcgcgtgtttatttttgggtttagttatagggttttcgt

SEQ ID NO: 31078 - DNA, 509 bp, Artificial Sequence
  chemically treated genomic DNA (Homo sapiens) CpG-island No: 31078
acgaaaaccctataactaaacccaaaaataaacacgcgcaactaaaccgaactacgaactctaactaaataatactaatctacgccctaacgctacgcccgaaacgcgcgtaccttccacgaaaatacgcgccgaatcgaaacactaaccgaaaaaattaataacgttaatactatactaacccaaatctaccaactcgccgtcgcgcaccaccaataccaccacgtcaaaatcctcgaaaacgtaacgatacttaaaaccgtcacgtaactccttaccgtccttactccaacgaataaataaatccgaaaaaaccaaaatacgacaaataaacttaaccgcgctactttcgatcaacaccgcgtctttcaacgactccaacacccgcgacgaccctttctcgcgcaactccttcgaaaacatacccgcgaacaaaatcaaaacccaaaattcataaaacaaacccgaccacaacctttaccgcgaacgcaccatctcatacgtacccc

SEQ ID NO: 31079 - DNA, 509 bp, Artificial Sequence
  chemically treated genomic DNA (Homo sapiens) CpG-island No: 31079
gcggggattttgtagttaggtttagaggtaaatacgcgtagttggatcgggttgcgggttttggttgagtggtgttggtttgcgttttggcgttgcgttcggggcgcgcgtattttttacgaggatgcgcgtcgagtcggagtattggtcgaaggggttggtgacgttgatgttgtattggtttaggtttgttagttcgtcgtcgcgtattattagtgttattacgttagggttttcgaagacgtagcggtatttgggatcgttacgtagttttttgtcgtttttattttagcggatgaatgggttcgggaaagttaaaatgcggtaagtgagtttggtcgcgttgttttcgattagtatcgcgttttttagcggttttagtattcgcggcggttttttttcgcgtagttttttcggggatatattcgcgggtagagttagggtttagagtttataagataggttcggttatagtttttatcgcgagcgtattattttatacgtgtttt

SEQ ID NO: 31080 - DNA, 509 bp, Artificial Sequence
  chemically treated genomic DNA (Homo sapiens) CpG-island No: 31080
aaaacacgtataaaataatacgctcgcgataaaaactataaccgaacctatcttataaactctaaaccctaactctacccgcgaatatatccccgaaaaaactacgcgaaaaaaaaccgccgcgaatactaaaaccgctaaaaaacgcgatactaatcgaaaacaacgcgaccaaactcacttaccgcattttaactttcccgaacccattcatccgctaaaataaaaacgacaaaaaactacgtaacgatcccaaataccgctacgtcttcgaaaaccctaacgtaataacactaataatacgcgacgacgaactaacaaacctaaaccaatacaacatcaacgtcaccaaccccttcgaccaatactccgactcgacgcgcatcctcgtaaaaaatacgcgcgccccgaacgcaacgccaaaacgcaaaccaacaccactcaaccaaaacccgcaacccgatccaactacgcgtatttacctctaaacctaactacaaaatccccgc

SEQ ID NO: 31081 - DNA, 688 bp, Artificial Sequence
  chemically treated genomic DNA (Homo sapiens) CpG-island No: 31081
gcgttcgacgtcgacgcgcgcgcgttggttagtgagtatttttatttggcgtcgtagttttcgtagttttttttcgtagagttcggttattcgcgtcggttcgcggtttttgagtcggtttatttcggcggcgagcgtcgcgttttgttgttttaggaagcgtattttttcgatgtagttggcgaagcggttattgagtttttgtagttttattttttcgttggtgcgcgtggttagaaatttttggtttatcgcgtcggttagtgagaagtttagtagttcgtttgcgtcgtaggaggagggcgtgcgggtggtttttagtcggttggttcgtagcgattttaggttttcggtttcgttcgacgtgcgcgatatttggtatacgcgggacgttatcgagttggaggagtttttagagtcgaaattcgttcgcgggaatacgggcgaatttagcggggagtcgagtgggaagttcggggtttcgtcgaaggtgcggcggtaggaggatacgcgttggttggacgagtaggtttggtttatggtgacggcgcgggcgaggttggcgggcgtacggaggaggcggcgggtaggcggtcggtcggagagtggatgcggcgaggggagatagggtttttagtcgtcggtattatttgtattttttttgatattagttttcgttttttttttt

SEQ ID NO: 31082 - DNA, 688 bp, Artificial Sequence
  chemically treated genomic DNA (Homo sapiens) CpG-island No: 31082
aaaaaaaaaaacgaaaactaatatcaaaaaaaatacaaataataccgacgactaaaaaccctatctcccctcgccgcatccactctccgaccgaccgcctacccgccgcctcctccgtacgcccgccaacctcgcccgcgccgtcaccataaaccaaacctactcgtccaaccaacgcgtatcctcctaccgccgcaccttcgacgaaaccccgaacttcccactcgactccccgctaaattcgcccgtattcccgcgaacgaatttcgactctaaaaactcctccaactcgataacgtcccgcgtataccaaatatcgcgcacgtcgaacgaaaccgaaaacctaaaatcgctacgaaccaaccgactaaaaaccacccgcacgccctcctcctacgacgcaaacgaactactaaacttctcactaaccgacgcgataaaccaaaaatttctaaccacgcgcaccaacgaaaaaataaaactacaaaaactcaataaccgcttcgccaactacatcgaaaaaatacgcttcctaaaacaacaaaacgcgacgctcgccgccgaaataaaccgactcaaaaaccgcgaaccgacgcgaataaccgaactctacgaaaaaaaactacgaaaactacgacgccaaataaaaatactcactaaccaacgcgcgcgcgtcgacgtcgaacgc

SEQ ID NO: 31083 - DNA, 688 bp, Artificial Sequence
  chemically treated genomic DNA (Homo sapiens) CpG-island No: 31083
gggaggggaggcgggggttgatgttaggagggatataaatagtgtcgacggttgggggttttgttttttttcgtcgtatttatttttcggtcggtcgtttgttcgtcgtttttttcgtgcgttcgttagtttcgttcgcgtcgttattatgagttaggtttattcgtttagttagcgcgtgtttttttatcgtcgtattttcggcggggtttcgggttttttattcggtttttcgttgagttcgttcgtgttttcgcgggcgggtttcggttttaagggtttttttagttcggtgacgtttcgcgtgtattaggtgtcgcgtacgtcgggcggggtcgggggtttggggtcgttgcgggttagtcggttggggattattcgtacgttttttttttacggcgtaggcgagttgttggattttttattggtcgacgcggtgaattaggagtttttgattacgcgtattaacgagaaggtggagttgtaggagtttaatgatcgtttcgttaattatatcgagaaggtgcgttttttggagtagtagaacgcggcgttcgtcgtcgaagtgaatcggtttaagggtcgcgagtcgacgcgagtggtcgagttttacgaggaggagttgcgggagttgcggcgttaggtggaggtgtttattaattagcgcgcgcgcgtcgacgtcgagcgt

SEQ ID NO: 31084 - DNA, 688 bp, Artificial Sequence
  chemically treated genomic DNA (Homo sapiens) CpG-island No: 31084
acgctcgacgtcgacgcgcgcgcgctaattaataaacacctccacctaacgccgcaactcccgcaactcctcctcgtaaaactcgaccactcgcgtcgactcgcgacccttaaaccgattcacttcgacgacgaacgccgcgttctactactccaaaaaacgcaccttctcgatataattaacgaaacgatcattaaactcctacaactccaccttctcgttaatacgcgtaatcaaaaactcctaattcaccgcgtcgaccaataaaaaatccaacaactcgcctacgccgtaaaaaaaaaacgtacgaataatccccaaccgactaacccgcaacgaccccaaacccccgaccccgcccgacgtacgcgacacctaatacacgcgaaacgtcaccgaactaaaaaaacccttaaaaccgaaacccgcccgcgaaaacacgaacgaactcaacgaaaaaccgaataaaaaacccgaaaccccgccgaaaatacgacgataaaaaaacacgcgctaactaaacgaataaacctaactcataataacgacgcgaacgaaactaacgaacgcacgaaaaaaacgacgaacaaacgaccgaccgaaaaataaatacgacgaaaaaaaacaaaacccccaaccgtcgacactatttatatccctcctaacatcaacccccgcctcccctccc

SEQ ID NO: 31085 - DNA, 660 bp, Artificial Sequence
  chemically treated genomic DNA (Homo sapiens) CpG-island No: 31085
cgttcgcgcgttgcggtttataattcgagatcggggtttagtttttagggtttaaaagtgggaagagatttttgtttttatttgcggtttttcgagagtagcggggagtttcggttttgcggtcggtagaagacggtttagcgaagttcgttatgggggagagtagtttgtcggacggggatacgtttcggcgtttcgtttcgaggtttcgtttttttacgcgtagcgcggggcggggttagaagagcgggttaagacgtcggaggaggtggcggcggttgggagaggcgagggttttggtcggtaagtggagttgtggagaggtttagggtggttagggttcgcggttggtcgtgagtcgcggcggatttggtgttgcgggtcgattaggttacgcgaggtggtggagtttgtttatttaggcgagtaggaatcggaagatatggttttttttgatgtagttcgtacgcgcgttggggtgtttattcgttttttagcgcgttgttttgaggatcgggttgattcgcgtttttattgagggtttggggtcgagttttgtcgttaggagaagcgatggtttttttttgaaggtcgtcgttgttttgttttcgtgtgatatagtgattttattagttggattgattattttggggattgtaa

SEQ ID NO: 31086 - DNA, 660 bp, Artificial Sequence
  chemically treated genomic DNA (Homo sapiens) CpG-island No: 31086
ttacaatccccaaaataatcaatccaactaataaaatcactatatcacacgaaaacaaaacaacgacgaccttcaaaaaaaaaccatcgcttctcctaacgacaaaactcgaccccaaaccctcaataaaaacgcgaatcaacccgatcctcaaaacaacgcgctaaaaaacgaataaacaccccaacgcgcgtacgaactacatcaaaaaaaaccatatcttccgattcctactcgcctaaataaacaaactccaccacctcgcgtaacctaatcgacccgcaacaccaaatccgccgcgactcacgaccaaccgcgaaccctaaccaccctaaacctctccacaactccacttaccgaccaaaaccctcgcctctcccaaccgccgccacctcctccgacgtcttaacccgctcttctaaccccgccccgcgctacgcgtaaaaaaacgaaacctcgaaacgaaacgccgaaacgtatccccgtccgacaaactactctcccccataacgaacttcgctaaaccgtcttctaccgaccgcaaaaccgaaactccccgctactctcgaaaaaccgcaaataaaaacaaaaatctcttcccacttttaaaccctaaaaactaaaccccgatctcgaattataaaccgcaacgcgcgaacg

SEQ ID NO: 31087 - DNA, 660 bp, Artificial Sequence
  chemically treated genomic DNA (Homo sapiens) CpG-island No: 31087
ttgtagtttttaaagtgattaatttagttagtgaaattattgtattatacggagataagataacggcggtttttaggaggagattatcgttttttttggcggtaaggttcggttttaagtttttagtaggggcgcgagttagttcggtttttagggtagcgcgttggaaggcgagtgaatattttagcgcgcgtgcgggttgtattagaggaagttatgtttttcgatttttgttcgtttaggtgggtaggttttattatttcgcgtggtttagtcggttcgtagtattaagttcgtcgcggtttacggttaatcgcgagttttggttattttgaatttttttataattttatttatcggttagaattttcgttttttttagtcgtcgttatttttttcggcgttttagttcgtttttttggtttcgtttcgcgttacgcgtagggaggcggggtttcggggcgagacgtcggagcgtgttttcgttcggtagattatttttttttatggcggatttcgttgggtcgttttttgtcggtcgtaaggtcggggtttttcgttgttttcgaaaagtcgtaggtaggagtaaggatttttttttatttttggattttgaaagttgggtttcgatttcgagttatagatcgtagcgcgcgggcg

SEQ ID NO: 31088 - DNA, 660 bp, Artificial Sequence
  chemically treated genomic DNA (Homo sapiens) CpG-island No: 31088
cgcccgcgcgctacgatctataactcgaaatcgaaacccaactttcaaaatccaaaaataaaaaaaaatccttactcctacctacgacttttcgaaaacaacgaaaaaccccgaccttacgaccgacaaaaaacgacccaacgaaatccgccataaaaaaaaataatctaccgaacgaaaacacgctccgacgtctcgccccgaaaccccgcctccctacgcgtaacgcgaaacgaaaccaaaaaaacgaactaaaacgccgaaaaaaataacgacgactaaaaaaaacgaaaattctaaccgataaataaaattataaaaaaattcaaaataaccaaaactcgcgattaaccgtaaaccgcgacgaacttaatactacgaaccgactaaaccacgcgaaataataaaacctacccacctaaacgaacaaaaatcgaaaaacataacttcctctaatacaacccgcacgcgcgctaaaatattcactcgccttccaacgcgctaccctaaaaaccgaactaactcgcgcccctactaaaaacttaaaaccgaaccttaccgccaaaaaaaacgataatctcctcctaaaaaccgccgttatcttatctccgtataatacaataatttcactaactaaattaatcactttaaaaactacaa

SEQ ID NO: 31089 - DNA, 932 bp, Artificial Sequence
  chemically treated genomic DNA (Homo sapiens) CpG-island No: 31089
gttgtcgtttcgggtcgttgtttttcggtcgtttttagataattaattttttaaattttttttttcgggggtgggggttcgtttcgaacgcggttaatataacgttttttttgttcgtataaaggggattaaacgtgtttcgcgttttttgtaattgaatttttttttttttttttaagaaaaatttataatttttgtagttacgggagtcgggttgcgtgagtgtcgcgggggaaatttttttcgttttcgttcgggggtcgggttgtcgggttcgattgttaagcgtagcggagaggcggggattttaggaagattttcggcgtttcgtcgagttcgggttggggattatttattcgatttttgaacgtgcggtgggatcgtgttggcgatacgcgtttataggacgatgtgtagcggttataggtttttgagtagttttcgatttatggtagatttcgttgttcgttatagatcgagtttttagcgtagcggacggcgttttttcggatttttggttgcgttttcgcgtcgcgtttttttcggatttcgcgtcgggtcggtagcgtagatgtgcgggttagatgtggcgttcgttcgttagttaggagggggtttggaggtcggcgaggcgcggggaggttttcggcggtcgagggaagttgtataggagttcggtttttgtttcgagcgggtgtacgcgcgggggtgtcgtcgtttcgtgcgcgcgagtgatttatttaattttaatttagcgttgcgggggaaataggaaatttttcgttaatagttgggtaggattttttttcgttcgagagtttttttttttttttcgacgtttagtttttagttttttcgtagttgttaattatgttttttagattagttttttcgagagttttggtcgatttttagttgttttttatcgtttt

SEQ ID NO: 31090 - DNA, 932 bp, Artificial Sequence
  chemically treated genomic DNA (Homo sapiens) CpG-island No: 31090
aaaacgataaaaaacaactaaaaatcgaccaaaactctcgaaaaaactaatctaaaaaacataattaacaactacgaaaaaactaaaaactaaacgtcgaaaaaaaaaaaaaaactctcgaacgaaaaaaaatcctacccaactattaacgaaaaatttcctatttcccccgcaacgctaaattaaaattaaataaatcactcgcgcgcacgaaacgacgacacccccgcgcgtacacccgctcgaaacaaaaaccgaactcctatacaacttccctcgaccgccgaaaacctccccgcgcctcgccgacctccaaaccccctcctaactaacgaacgaacgccacatctaacccgcacatctacgctaccgacccgacgcgaaatccgaaaaaaacgcgacgcgaaaacgcaaccaaaaatccgaaaaaacgccgtccgctacgctaaaaactcgatctataacgaacaacgaaatctaccataaatcgaaaactactcaaaaacctataaccgctacacatcgtcctataaacgcgtatcgccaacacgatcccaccgcacgttcaaaaatcgaataaataatccccaacccgaactcgacgaaacgccgaaaatcttcctaaaatccccgcctctccgctacgcttaacaatcgaacccgacaacccgacccccgaacgaaaacgaaaaaaatttcccccgcgacactcacgcaacccgactcccgtaactacaaaaattataaatttttcttaaaaaaaaaaaaaaaaattcaattacaaaaaacgcgaaacacgtttaatcccctttatacgaacaaaaaaaacgttatattaaccgcgttcgaaacgaacccccacccccgaaaaaaaaaatttaaaaaattaattatctaaaaacgaccgaaaaacaacgacccgaaacgacaac

SEQ ID NO: 31091 - DNA, 932 bp, Artificial Sequence
  chemically treated genomic DNA (Homo sapiens) CpG-island No: 31091
agggcggtgaggggtagttgaaagtcggttaaagttttcggaggggttggtttaggaaatatgattggtagttacgagagagttaggggttggacgtcgaggagagggagaaggttttcgggcggagagaggttttgtttagttgttggcgaggagttttttgtttttttcgtagcgttgagttgaagttgagtgagttattcgcgcgtacggagcgacgatattttcgcgcgtgtattcgttcgggataggagtcggatttttgtgtagtttttttcggtcgtcgggggttttttcgcgtttcgtcggtttttaggtttttttttggttggcgagcgggcgttatatttggttcgtatatttgcgttgtcggttcggcgcggggttcggagagggcgcggcgcggaggcgtagttaggggttcgggaaggcgtcgttcgttgcgttgggggttcggtttatgacgagtagcggggtttgttatgggtcgggggttgtttaggggtttgtggtcgttgtatatcgttttgtggacgcgtatcgttagtacgattttatcgtacgtttagaagtcgggtgagtggtttttagttcgggttcggcggggcgtcgggggtttttttggggttttcgttttttcgttgcgtttgatagtcgggttcggtaattcggttttcgggcggaaacgaggaaagtttttttcgcgatatttacgtagttcgattttcgtagttgtagggattgtgagttttttttgaaaaagagaaggaaagtttagttgtaaggggcgcggggtacgtttggttttttttgtgcgagtaggaaaggcgttgtgttggtcgcgttcgaggcgagtttttattttcggaaagggaagtttgagaagttggttatttgaaggcggtcggggagtagcggttcggagcggtagt

SEQ ID NO: 31092 - DNA, 932 bp, Artificial Sequence
  chemically treated genomic DNA (Homo sapiens) CpG-island No: 31092
actaccgctccgaaccgctactccccgaccgccttcaaataaccaacttctcaaacttccctttccgaaaataaaaactcgcctcgaacgcgaccaacacaacgcctttcctactcgcacaaaaaaaaccaaacgtaccccgcgccccttacaactaaactttccttctctttttcaaaaaaaactcacaatccctacaactacgaaaatcgaactacgtaaatatcgcgaaaaaaactttcctcgtttccgcccgaaaaccgaattaccgaacccgactatcaaacgcaacgaaaaaacgaaaaccccaaaaaaacccccgacgccccgccgaacccgaactaaaaaccactcacccgacttctaaacgtacgataaaatcgtactaacgatacgcgtccacaaaacgatatacaacgaccacaaacccctaaacaacccccgacccataacaaaccccgctactcgtcataaaccgaacccccaacgcaacgaacgacgccttcccgaacccctaactacgcctccgcgccgcgccctctccgaaccccgcgccgaaccgacaacgcaaatatacgaaccaaatataacgcccgctcgccaaccaaaaaaaaacctaaaaaccgacgaaacgcgaaaaaacccccgacgaccgaaaaaaactacacaaaaatccgactcctatcccgaacgaatacacgcgcgaaaatatcgtcgctccgtacgcgcgaataactcactcaacttcaactcaacgctacgaaaaaaacaaaaaactcctcgccaacaactaaacaaaacctctctccgcccgaaaaccttctccctctcctcgacgtccaacccctaactctctcgtaactaccaatcatatttcctaaaccaacccctccgaaaactttaaccgactttcaactacccctcaccgccct

SEQ ID NO: 31093 - DNA, 805 bp, Artificial Sequence
  chemically treated genomic DNA (Homo sapiens) CpG-island No: 31093
gtatattcgattttgtagtatttttttttacgtagtttgcgatcgggacgtttgtaggaggcgttagagttttcgcgggggttgtaatttcgcgtaagggttttcggtttttaaggtattcgtaatttttcgatttttcgggaaggttttgtacgtttcggtcgttttttgttagtagttcgtttcgttattatatttcgtcgcggtcgcgttgacgttattatttcgttttttcgttttgtttcgtcgttttcgtttcgttttttttttcggcgtgcgtcgcggttgaggtttttcgtttttagtttttgtttgtcgttttaaaatggcggatataatgagtcggcgacgcgtcggttgttcgtgaggtggttgtgaggacgaacggtcggcgaggttttatagtttaggtagaagattttcgattaagtaggaagaagaggaggaggcggtttaattgttggtcgatttttcgttagtcgtcggcgcggcgttcgtttcgtttgggttggtttttcggtagttcgttcgttcgtcgtcgggtttcgtttcggttttgcgtcgtcgttgttttttttagtcgtcgttatgaagttgatcgatagcgtgttgcggagttttcgcgtcgttaaggtgtttcgcgaaaattcggataagattaattgtttcgattttagttttaacggcgagacggttatttcgagtagcgacgacgattttatcgtgttttatgattgttaggagggtaagtgagtgcggcggaggttttgggttcgagttttagtgttttttttcggtggtttag

SEQ ID NO: 31094 - DNA, 805 bp, Artificial Sequence
  chemically treated genomic DNA (Homo sapiens) CpG-island No: 31094
ctaaaccaccgaaaaaaaacactaaaactcgaacccaaaacctccgccgcactcacttaccctcctaacaatcataaaacacgataaaatcgtcgtcgctactcgaaataaccgtctcgccgttaaaactaaaatcgaaacaattaatcttatccgaattttcgcgaaacaccttaacgacgcgaaaactccgcaacacgctatcgatcaacttcataacgacgactaaaaaaaacaacgacgacgcaaaaccgaaacgaaacccgacgacgaacgaacgaactaccgaaaaaccaacccaaacgaaacgaacgccgcgccgacgactaacgaaaaatcgaccaacaattaaaccgcctcctcctcttcttcctacttaatcgaaaatcttctacctaaactataaaacctcgccgaccgttcgtcctcacaaccacctcacgaacaaccgacgcgtcgccgactcattatatccgccattttaaaacgacaaacaaaaactaaaaacgaaaaacctcaaccgcgacgcacgccgaaaaaaaaaacgaaacgaaaacgacgaaacaaaacgaaaaaacgaaataataacgtcaacgcgaccgcgacgaaatataataacgaaacgaactactaacaaaaaacgaccgaaacgtacaaaaccttcccgaaaaatcgaaaaattacgaataccttaaaaaccgaaaacccttacgcgaaattacaacccccgcgaaaactctaacgcctcctacaaacgtcccgatcgcaaactacgtaaaaaaaaatactacaaaatcgaatatac

SEQ ID NO: 31095 - DNA, 805 bp, Artificial Sequence
  chemically treated genomic DNA (Homo sapiens) CpG-island No: 31095
ttgggttatcggagggaggtattgagattcgggtttagggttttcgtcgtatttatttgtttttttggtagttatagagtacgatggagtcgtcgtcgttattcgagatgatcgtttcgtcgttggggttgaaatcgaagtagttaattttgttcgagttttcgcggaatattttagcgacgcggaagtttcgtaatacgttgtcggttagttttatggcggcggttggggaaggtagcggcggcgtagggtcggggcggggttcggcggcgagcgggcgggttgtcgaggggttaatttaggcggggcgggcgtcgcgtcggcggttagcgggaagtcggttaatagttgggtcgttttttttttttttttttgtttggtcgagggttttttgtttggattgtggagtttcgtcgatcgttcgtttttatagttattttacggataatcggcgcgtcgtcggtttattgtgttcgttattttggggcgataggtagaagttgagggcgaggagttttagtcgcggcgtacgtcgggaaagggggcggggcgggaacggcggagtaaggcggggaggcggggtggtgacgttagcgcggtcgcggcggagtgtagtggcggggcgggttgttggtagggagcggtcgagacgtgtagggttttttcgggggatcggaaggttgcggatgttttgggagtcgggggtttttgcgcgggattgtaattttcgcgaagattttggcgttttttgtaggcgtttcgatcgtaggttgcgtgggagggggtattgtagggtcgggtatgt

SEQ ID NO: 31096 - DNA, 805 bp, Artificial Sequence
  chemically treated genomic DNA (Homo sapiens) CpG-island No: 31096
acatacccgaccctacaataccccctcccacgcaacctacgatcgaaacgcctacaaaaaacgccaaaatcttcgcgaaaattacaatcccgcgcaaaaacccccgactcccaaaacatccgcaaccttccgatcccccgaaaaaaccctacacgtctcgaccgctccctaccaacaacccgccccgccactacactccgccgcgaccgcgctaacgtcaccaccccgcctccccgccttactccgccgttcccgccccgccccctttcccgacgtacgccgcgactaaaactcctcgccctcaacttctacctatcgccccaaaataacgaacacaataaaccgacgacgcgccgattatccgtaaaataactataaaaacgaacgatcgacgaaactccacaatccaaacaaaaaaccctcgaccaaacaaaaaaaaaaaaaaaaaacgacccaactattaaccgacttcccgctaaccgccgacgcgacgcccgccccgcctaaattaacccctcgacaacccgcccgctcgccgccgaaccccgccccgaccctacgccgccgctaccttccccaaccgccgccataaaactaaccgacaacgtattacgaaacttccgcgtcgctaaaatattccgcgaaaactcgaacaaaattaactacttcgatttcaaccccaacgacgaaacgatcatctcgaataacgacgacgactccatcgtactctataactaccaaaaaaacaaataaatacgacgaaaaccctaaacccgaatctcaatacctccctccgataacccaa

SEQ ID NO: 31097 - DNA, 548 bp, Artificial Sequence
  chemically treated genomic DNA (Homo sapiens) CpG-island No: 31097
ttcgttattttttttcgtttttttgtacggtttttatttgttttcgtttcggttcggtatttgggttggttcgtcgttcggattttttttcgggttattgtcgtcgtttcgggttttcgtttttcgtttgttttttcgtattttcgtcgttttttgcgattatttatttcgcggtcgagttttttcgatgtcggttttggtttttttcgtttttattatagtattttcgacgttgttgtcgtttttcgtcgttttaatatggttttcggtcgtttcgatggttcgttttatttttgtttcggcgtcgaaatacggtggtataatttatcgcgtatggtagttttgaggatcgaagatgttgtcgttatttttattgaggacgtgagcgttgtttttggtgttgaatagagcgcgaaggttcgtcgtcgttgggttcgttttttttattttcggtcgtcgtttttatttatttttttttttttagggcgtgtttagtttcgttttttagtttttttttgtttttttagattttttgttttttttttttg

SEQ ID NO: 31098 - DNA, 548 bp, Artificial Sequence
  chemically treated genomic DNA (Homo sapiens) CpG-island No: 31098
caaaaaaaaaaaacaaaaaatctaaaaaaacaaaaaaaaactaaaaaacgaaactaaacacgccctaaaaaaaaaaaaataaataaaaacgacgaccgaaaataaaaaaaacgaacccaacgacgacgaaccttcgcgctctattcaacaccaaaaacaacgctcacgtcctcaataaaaataacgacaacatcttcgatcctcaaaactaccatacgcgataaattataccaccgtatttcgacgccgaaacaaaaataaaacgaaccatcgaaacgaccgaaaaccatattaaaacgacgaaaaacgacaacaacgtcgaaaatactataataaaaacgaaaaaaaccaaaaccgacatcgaaaaaactcgaccgcgaaataaataatcgcaaaaaacgacgaaaatacgaaaaaacaaacgaaaaacgaaaacccgaaacgacgacaataacccgaaaaaaaatccgaacgacgaaccaacccaaataccgaaccgaaacgaaaacaaataaaaaccgtacaaaaaaacgaaaaaaaataacgaa

SEQ ID NO: 31099 - DNA, 548 bp, Artificial Sequence
  chemically treated genomic DNA (Homo sapiens) CpG-island No: 31099
taggaagggggaataagagatttggaaggatagaaaaaggttgggagacggagttggatacgttttagaaggagggaggtgggtgaaggcggcgatcgaaagtggggagggcggatttaacgacggcgaattttcgcgttttgtttagtattaggagtaacgtttacgtttttaataaagatggcggtaatattttcggtttttagagttgttatgcgcgatgggttgtattatcgtgtttcggcgtcggggtagaggtggagcgaattatcggggcggtcgggagttatgttggagcggcgggaggcggtagtagcgtcggggatgttgtggtgggggcggaaaaagttagggtcggtatcggaggggttcggtcgcggagtagatggtcgtagagggcggcgggggtgcggagagataggcggagggcgggggttcggggcggcggtagtggttcgggagggggttcgagcggcgggttagtttaagtgtcggatcggggcggggataagtggaggtcgtgtagggaggcggggaaagatggcgag

SEQ ID NO: 31100 - DNA, 548 bp, Artificial Sequence
  chemically treated genomic DNA (Homo sapiens) CpG-island No: 31100
ctcgccatctttccccgcctccctacacgacctccacttatccccgccccgatccgacacttaaactaacccgccgctcgaaccccctcccgaaccactaccgccgccccgaacccccgccctccgcctatctctccgcacccccgccgccctctacgaccatctactccgcgaccgaacccctccgataccgaccctaactttttccgcccccaccacaacatccccgacgctactaccgcctcccgccgctccaacataactcccgaccgccccgataattcgctccacctctaccccgacgccgaaacacgataatacaacccatcgcgcataacaactctaaaaaccgaaaatattaccgccatctttattaaaaacgtaaacgttactcctaatactaaacaaaacgcgaaaattcgccgtcgttaaatccgccctccccactttcgatcgccgccttcacccacctccctccttctaaaacgtatccaactccgtctcccaacctttttctatccttccaaatctcttattcccccttccta

SEQ ID NO: 31101 - DNA, 540 bp, Artificial Sequence
  chemically treated genomic DNA (Homo sapiens) CpG-island No: 31101
ggggagggtagatgtttgaaaggacgtgtgtattacgcggacggggatgacggggttaggggagttgttacggttgatagttcgggggcggagtgcggagcgggtcggcgggtatttcggggcggggcgggagggcggggagtggggcggacggaattatcggggcgggaaaggaggtaacgggacgggtcgattatggcgcggtgagggagcgggaatggggaacggttcgcgggaggtttgaggtcgttggtttgtgcgttgttttcgtcgtaatttttattttcgtcgtcgtcgtcgtcgtttcgggtatgtcgtttaattgtattagtattacggcggtggcggtgcgcgttagcgttagtaagattaagattaagaagaagtatttcgtgtgttagaaagtgaagttatttcgggttagcgagtcgatttttagcgttttgatgtggggggtgaattatacggtaattagtttttgcgcgtttttttgggtttcgcgcgtttttacgttttttgtagttttggtttttgtttcgt

SEQ ID NO: 31102 - DNA, 540 bp, Artificial Sequence
  chemically treated genomic DNA (Homo sapiens) CpG-island No: 31102
acgaaacaaaaaccaaaactacaaaaaacgtaaaaacgcgcgaaacccaaaaaaacgcgcaaaaactaattaccgtataattcaccccccacatcaaaacgctaaaaatcgactcgctaacccgaaataacttcactttctaacacacgaaatacttcttcttaatcttaatcttactaacgctaacgcgcaccgccaccgccgtaatactaatacaattaaacgacatacccgaaacgacgacgacgacgacgaaaataaaaattacgacgaaaacaacgcacaaaccaacgacctcaaacctcccgcgaaccgttccccattcccgctccctcaccgcgccataatcgacccgtcccgttacctcctttcccgccccgataattccgtccgccccactccccgccctcccgccccgccccgaaatacccgccgacccgctccgcactccgcccccgaactatcaaccgtaacaactcccctaaccccgtcatccccgtccgcgtaatacacacgtcctttcaaacatctaccctcccc

SEQ ID NO: 31103 - DNA, 540 bp, Artificial Sequence
  chemically treated genomic DNA (Homo sapiens) CpG-island No: 31103
gcggggtaagggttagggttgtagggggcgtgggagcgcgcggggtttagaggggcgcgtaggagttggttatcgtgtggtttattttttatattaggacgttgaggatcggttcgttggttcggaatagttttattttttggtatacgaaatgtttttttttggttttggttttgttggcgttgacgcgtatcgttatcgtcgtggtgttggtgtagttggacgatatgttcggggcggcggcggcggcggcgaaagtaggggttgcggcggagatagcgtataagttagcggttttaggtttttcgcggatcgttttttattttcgtttttttatcgcgttatggtcggttcgtttcgttattttttttttcgtttcggtggtttcgttcgttttatttttcgttttttcgtttcgtttcgggatgttcgtcggttcgtttcgtatttcgttttcgggttgttagtcgtgatagtttttttggtttcgttattttcgttcgcgtggtatatacgtttttttaggtatttgtttttttt

SEQ ID NO: 31104 - DNA, 540 bp, Artificial Sequence
  chemically treated genomic DNA (Homo sapiens) CpG-island No: 31104
aaaaaaaacaaatacctaaaaaaacgtatataccacgcgaacgaaaataacgaaaccaaaaaaactatcacgactaacaacccgaaaacgaaatacgaaacgaaccgacgaacatcccgaaacgaaacgaaaaaacgaaaaataaaacgaacgaaaccaccgaaacgaaaaaaaaaataacgaaacgaaccgaccataacgcgataaaaaaacgaaaataaaaaacgatccgcgaaaaacctaaaaccgctaacttatacgctatctccgccgcaacccctactttcgccgccgccgccgccgccccgaacatatcgtccaactacaccaacaccacgacgataacgatacgcgtcaacgccaacaaaaccaaaaccaaaaaaaaacatttcgtataccaaaaaataaaactattccgaaccaacgaaccgatcctcaacgtcctaatataaaaaataaaccacacgataaccaactcctacgcgcccctctaaaccccgcgcgctcccacgccccctacaaccctaacccttaccccgc

SEQ ID NO: 31105 - DNA, 1146 bp, Artificial Sequence
  chemically treated genomic DNA (Homo sapiens) CpG-island No: 31105
gttcgtcgcgagttttttgttggtttttcgttttgtagggattttttttagttagttcggtcgcgttttatattcgtcgatacgtttttttcggtttaattttcgttttttaagtatcggtttcgttttataggtttcgttcgtggtttcgttcgtcgcgagttggcgtcgggtttttttagcgttcgtcggcggtcgcgtttattttcgacgttttgaggttatcgattgggtcggttcgcggggggcggagggacggagggaagatggcggtaggggtcggatattggcgtcgttttttttaatttcggagtcggcgtagatgaggtagttcggttggggttagcggcgttttggaattcgaggtggggggatttggcggtggggtttggttttgttatatgtcggcgtttcggttagagtgagcggcggcgacgtttttttttttcgtttttttttttgtcgttgcgagagcgagcgggcggcggaggcggcggcggcggcggggtcgggatggaggacgttaattttaacgtgaacgcggattaggaggtgcggaagttgtaggagttggtgaagaagttggagaagtagaacgaatagttgaggagtcgttcgggggtcgtgtagggcgtcggtttttttgggttcggtagttcggttcggtcggcgcgtttattttttttttcggcgcggcgttttttcggggttttttttggttttagcgttaagtcgggcggcgggtcgggttcgcgtgcgcggacgagtagcgaagagttgcgggacgtatttttttgttagcggcgggcgagggcggtttgttggacgaggtggagtcgttgcgttcgacgagttggagcgtttgttaggttgggaggaggaggaggagagttggtgagcgcgaggcgcgcggtaggagttgggcggggacgggttcgggggcggagagcgttttttgagggtttttttggtcgggcgtttcgttttgtgtagtcgggttcgtttttttgtggcgatttgtggtttttttgttttggtagagggaacgttagttggagttgggggttcgaggcgtgcgtaagtaatagggttgtagttcgttgttttttggattgtggattttttgagtgttggattttattgggg

SEQ ID NO: 31106 - DNA, 1146 bp, Artificial Sequence
  chemically treated genomic DNA (Homo sapiens) CpG-island No: 31106
ccccaataaaatccaacactcaaaaaatccacaatccaaaaaacaacgaactacaaccctattacttacgcacgcctcgaacccccaactccaactaacgttccctctaccaaaacaaaaaaaccacaaatcgccacaaaaaaacgaacccgactacacaaaacgaaacgcccgaccaaaaaaaccctcaaaaaacgctctccgcccccgaacccgtccccgcccaactcctaccgcgcgcctcgcgctcaccaactctcctcctcctcctcccaacctaacaaacgctccaactcgtcgaacgcaacgactccacctcgtccaacaaaccgccctcgcccgccgctaacaaaaaaatacgtcccgcaactcttcgctactcgtccgcgcacgcgaacccgacccgccgcccgacttaacgctaaaaccaaaaaaaaccccgaaaaaacgccgcgccgaaaaaaaaaataaacgcgccgaccgaaccgaactaccgaacccaaaaaaaccgacgccctacacgacccccgaacgactcctcaactattcgttctacttctccaacttcttcaccaactcctacaacttccgcacctcctaatccgcgttcacgttaaaattaacgtcctccatcccgaccccgccgccgccgccgcctccgccgcccgctcgctctcgcaacgacaaaaaaaaaaacgaaaaaaaaaaacgtcgccgccgctcactctaaccgaaacgccgacatataacaaaaccaaaccccaccgccaaatccccccacctcgaattccaaaacgccgctaaccccaaccgaactacctcatctacgccgactccgaaattaaaaaaaacgacgccaatatccgacccctaccgccatcttccctccgtccctccgccccccgcgaaccgacccaatcgataacctcaaaacgtcgaaaataaacgcgaccgccgacgaacgctaaaaaaacccgacgccaactcgcgacgaacgaaaccacgaacgaaacctataaaacgaaaccgatacttaaaaaacgaaaattaaaccgaaaaaaacgtatcgacgaatataaaacgcgaccgaactaactaaaaaaaatccctacaaaacgaaaaaccaacaaaaaactcgcgacgaac

SEQ ID NO: 31107 - DNA, 1146 bp, Artificial Sequence
  chemically treated genomic DNA (Homo sapiens) CpG-island No: 31107
ttttaatagggtttagtatttagaaggtttataatttaaaggataacgagttataattttgttatttgcgtacgtttcgaatttttaattttagttgacgttttttttgttaaagtaagaaaattataagtcgttataggagagcggattcggttatataaagcgaggcgttcgattagagggatttttagaggacgtttttcgttttcgggttcgttttcgtttagtttttgtcgcgcgtttcgcgtttattagtttttttttttttttttttagtttgataggcgttttagttcgtcgggcgtagcggttttatttcgtttagtaagtcgttttcgttcgtcgttagtaaggaggtgcgtttcgtagtttttcgttattcgttcgcgtacgcgagttcggttcgtcgttcgatttggcgttgaggttaagggaagtttcgaggagacgtcgcgtcggaggagggaatggacgcgtcgatcgaatcgggttgtcgggtttaagggagtcggcgttttgtacggttttcgagcggttttttagttgttcgttttgtttttttagtttttttattagtttttgtagttttcgtattttttggttcgcgtttacgttggagttaacgttttttatttcggtttcgtcgtcgtcgtcgttttcgtcgttcgttcgttttcgtagcgatagggaaagagacggaggaaagaggcgtcgtcgtcgtttattttagtcgaggcgtcggtatatagtaggattaggttttatcgttaggtttttttatttcgggttttaaagcgtcgttggttttagtcgaattgttttatttgcgtcggtttcgagattgggggaggcggcgttaatattcggtttttgtcgttatttttttttcgttttttcgtttttcgcgggtcggtttagtcggtgattttagagcgtcgggggtggacgcggtcgtcggcgggcgttgagaggattcggcgttagttcgcggcgggcggggttacggacggggtttatggggcggggtcggtgtttgaggggcggggattaggtcggaaggggcgtgtcggcggatgtgggacgcggtcgggttggttagggagggtttttgtagaacgggaggttagtagaaggttcgcggcgggt

SEQ ID NO: 31108 - DNA, 1146 bp, Artificial Sequence
  chemically treated genomic DNA (Homo sapiens) CpG-island No: 31108
acccgccgcgaaccttctactaacctcccgttctacaaaaaccctccctaaccaacccgaccgcgtcccacatccgccgacacgccccttccgacctaatccccgcccctcaaacaccgaccccgccccataaaccccgtccgtaaccccgcccgccgcgaactaacgccgaatcctctcaacgcccgccgacgaccgcgtccacccccgacgctctaaaatcaccgactaaaccgacccgcgaaaaacgaaaaaacgaaaaaaaaataacgacaaaaaccgaatattaacgccgcctcccccaatctcgaaaccgacgcaaataaaacaattcgactaaaaccaacgacgctttaaaacccgaaataaaaaaacctaacgataaaacctaatcctactatataccgacgcctcgactaaaataaacgacgacgacgcctctttcctccgtctctttccctatcgctacgaaaacgaacgaacgacgaaaacgacgacgacgacgaaaccgaaataaaaaacgttaactccaacgtaaacgcgaaccaaaaaatacgaaaactacaaaaactaataaaaaaactaaaaaaacaaaacgaacaactaaaaaaccgctcgaaaaccgtacaaaacgccgactcccttaaacccgacaacccgattcgatcgacgcgtccattccctcctccgacgcgacgtctcctcgaaacttcccttaacctcaacgccaaatcgaacgacgaaccgaactcgcgtacgcgaacgaataacgaaaaactacgaaacgcacctccttactaacgacgaacgaaaacgacttactaaacgaaataaaaccgctacgcccgacgaactaaaacgcctatcaaactaaaaaaaaaaaaaaaaaaactaataaacgcgaaacgcgcgacaaaaactaaacgaaaacgaacccgaaaacgaaaaacgtcctctaaaaatccctctaatcgaacgcctcgctttatataaccgaatccgctctcctataacgacttataattttcttactttaacaaaaaaaacgtcaactaaaattaaaaattcgaaacgtacgcaaataacaaaattataactcgttatcctttaaattataaaccttctaaatactaaaccctattaaaa

SEQ ID NO: 31109 - DNA, 1198 bp, Artificial Sequence
  chemically treated genomic DNA (Homo sapiens) CpG-island No: 31109
tcgggcgatggaagattttgttcgtgggatcgttacgagttatcggttattttttcgcgttcggttttcgggtttttaggtttcggtgcgtcgcgggttaggcgatagcgggggggcgtcgcgggtcgggcgagcgtggttcggtgggttcgagggtcgcgtcgagtttttcgtcgttttaaaagtttttataatgtagcgttggcgttttagtttcgttacgaggtttttttcggcgtcggcgagcgggttaggcgcgggcggggcgcggaggagcggcggttgaaattcgagcgttcggtcgaggggggcgttttcgcgtcgtttttttcgcgcgtttagtcgttgttcggcgaaggggcggagtcgtttggtcgttcggtttcgttcggttcggttcggtttttagttcggtttttagtttagaggtatcggtcgcgggagcgagcgggtcgtcgatttttacgttcgcgttttttttacgttcgcgttcgttcggcgtttcgcgtcgcgtttcgtttagcgtttgtcgtttagtttttcgtttagtttcgtcgagtttcgtttttttcgttcgcggcggcgttggagttgggggcggttttcgcggcgtttttgtcgttggtcgagcgttcgcgtatcgcggtattttcgttagtggcgtttatatttatttagcgcgggtcgggaggtgcgcggagagggaacgtcggggggtcggggtttttagtcggtgcggggcgcgcggcgcggggagcgtcggggagtgtcggggagtgcggcgcggggacgggcgttgggcggtcgcggagtttcgggtgtcgtcgcgtttttagcgtttcggtcggtttttttgggcggtttgcgggggcggcgtagttgcgaaattgagtaagtattaattttatttagcggcggcgattcgggttgcgtcggggatttcgttcgtttcgtttgtagtttcggagttgtttttcgttcggttgttttttttttcgtattttgggtatttcgttcgtttcgtttttattttgtttcgtcgcgggttttcgttttttttgcgtttattttttttggtgtgttattttttgcgttttttttcgcggtatataagtcgcggattgaaaagtacgagtttggtttttgtttttttgtttttttttagtgtttttggtaagggagtttagaggttattttt

SEQ ID NO: 31110 - DNA, 1198 bp, Artificial Sequence
  chemically treated genomic DNA (Homo sapiens) CpG-island No: 31110
aaaaataacctctaaactcccttaccaaaaacactaaaaaaaaacaaaaaaacaaaaaccaaactcgtacttttcaatccgcgacttatataccgcgaaaaaaaacgcaaaaaataacacaccaaaaaaaataaacgcaaaaaaaacgaaaacccgcgacgaaacaaaataaaaacgaaacgaacgaaatacccaaaatacgaaaaaaaaaacaaccgaacgaaaaacaactccgaaactacaaacgaaacgaacgaaatccccgacgcaacccgaatcgccgccgctaaataaaattaatacttactcaatttcgcaactacgccgcccccgcaaaccgcccaaaaaaaccgaccgaaacgctaaaaacgcgacgacacccgaaactccgcgaccgcccaacgcccgtccccgcgccgcactccccgacactccccgacgctccccgcgccgcgcgccccgcaccgactaaaaaccccgaccccccgacgttccctctccgcgcacctcccgacccgcgctaaataaatataaacgccactaacgaaaataccgcgatacgcgaacgctcgaccaacgacaaaaacgccgcgaaaaccgcccccaactccaacgccgccgcgaacgaaaaaaacgaaactcgacgaaactaaacgaaaaactaaacgacaaacgctaaacgaaacgcgacgcgaaacgccgaacgaacgcgaacgtaaaaaaaacgcgaacgtaaaaatcgacgacccgctcgctcccgcgaccgatacctctaaactaaaaaccgaactaaaaaccgaaccgaaccgaacgaaaccgaacgaccaaacgactccgccccttcgccgaacaacgactaaacgcgcgaaaaaaacgacgcgaaaacgcccccctcgaccgaacgctcgaatttcaaccgccgctcctccgcgccccgcccgcgcctaacccgctcgccgacgccgaaaaaaacctcgtaacgaaactaaaacgccaacgctacattataaaaacttttaaaacgacgaaaaactcgacgcgaccctcgaacccaccgaaccacgctcgcccgacccgcgacgcccccccgctatcgcctaacccgcgacgcaccgaaacctaaaaacccgaaaaccgaacgcgaaaaaataaccgataactcgtaacgatcccacgaacaaaatcttccatcgcccga

SEQ ID NO: 31111 - DNA, 1198 bp, Artificial Sequence
  chemically treated genomic DNA (Homo sapiens) CpG-island No: 31111
aaaagtggtttttaaatttttttgttaaggatattgggaggaagtagaaaagtaaagattaagttcgtattttttagttcgcggtttgtgtgtcgcgaggagaggcgtaaagggtgatatattaggaaaggtgaacgtagagggagcgggagttcgcggcggggtagggtgggggcggaacggacgaggtatttaaggtgcggagagaggggtaatcgggcggagggtagtttcgaggttgtaggcgggacgggcggggttttcggcgtagttcggatcgtcgtcgttaagtaaagttaatatttatttagtttcgtaattgcgtcgttttcgtaggtcgtttagaggggtcggtcggggcgttggggacgcggcggtattcggagtttcgcggtcgtttagcgttcgttttcgcgtcgtatttttcggtatttttcggcgtttttcgcgtcgcgcgtttcgtatcggttggaggtttcggtttttcggcgtttttttttcgcgtatttttcggttcgcgttaggtgagtgtggacgttattggcgggggtgtcgcggtgcgcgagcgttcggttagcggtagagacgtcgcgggagtcgtttttagttttaacgtcgtcgcgggcgggaagggcgaggttcggcgaggttgggcgaggagttgggcggtagacgttgagcggggcgcggcgcggggcgtcggacgagcgcgggcgtaggaggagcgcgggcgtaggagtcggcgattcgttcgttttcgcggtcggtgtttttgggttgggggtcgggttgggggtcgggtcgggtcgggcggggtcgggcggttaggcggtttcgttttttcgtcgggtagcggttgagcgcgcgagaggagcggcgcgggggcgtttttttcggtcgggcgttcgggttttagtcgtcgttttttcgcgtttcgttcgcgtttggttcgttcgtcggcgtcgggagagatttcgtaacggaattgggacgttagcgttgtattgtgggagtttttaaagcggcggggagttcggcgcgattttcgggtttatcgggttacgttcgttcggttcgcgacgttttttcgttgtcgtttggttcgcgacgtatcgaggtttgaggattcgaaagtcgggcgcggggagatgatcggtggttcgtgacggttttacgggtaaaattttttatcgttcgg

SEQ ID NO: 31112 - DNA, 1198 bp, Artificial Sequence
  chemically treated genomic DNA (Homo sapiens) CpG-island No: 31112
ccgaacgataaaaaattttacccgtaaaaccgtcacgaaccaccgatcatctccccgcgcccgactttcgaatcctcaaacctcgatacgtcgcgaaccaaacgacaacgaaaaaacgtcgcgaaccgaacgaacgtaacccgataaacccgaaaatcgcgccgaactccccgccgctttaaaaactcccacaatacaacgctaacgtcccaattccgttacgaaatctctcccgacgccgacgaacgaaccaaacgcgaacgaaacgcgaaaaaacgacgactaaaacccgaacgcccgaccgaaaaaaacgcccccgcgccgctcctctcgcgcgctcaaccgctacccgacgaaaaaacgaaaccgcctaaccgcccgaccccgcccgacccgacccgacccccaacccgacccccaacccaaaaacaccgaccgcgaaaacgaacgaatcgccgactcctacgcccgcgctcctcctacgcccgcgctcgtccgacgccccgcgccgcgccccgctcaacgtctaccgcccaactcctcgcccaacctcgccgaacctcgcccttcccgcccgcgacgacgttaaaactaaaaacgactcccgcgacgtctctaccgctaaccgaacgctcgcgcaccgcgacacccccgccaataacgtccacactcacctaacgcgaaccgaaaaatacgcgaaaaaaaaacgccgaaaaaccgaaacctccaaccgatacgaaacgcgcgacgcgaaaaacgccgaaaaataccgaaaaatacgacgcgaaaacgaacgctaaacgaccgcgaaactccgaataccgccgcgtccccaacgccccgaccgacccctctaaacgacctacgaaaacgacgcaattacgaaactaaataaatattaactttacttaacgacgacgatccgaactacgccgaaaaccccgcccgtcccgcctacaacctcgaaactaccctccgcccgattacccctctctccgcaccttaaatacctcgtccgttccgcccccaccctaccccgccgcgaactcccgctccctctacgttcacctttcctaatatatcaccctttacgcctctcctcgcgacacacaaaccgcgaactaaaaaatacgaacttaatctttacttttctacttcctcccaatatccttaacaaaaaaatttaaaaaccactttt

SEQ ID NO: 31113 - DNA, 515 bp, Artificial Sequence
  chemically treated genomic DNA (Homo sapiens) CpG-island No: 31113
  misc_feature (117)..(117): n is either a, c, g or t
tcgttcgggtttagcgcggcggttgaggagaaagtagggagcgatcggcggcggcgtagcggcggcgttgttttttcgttcgttcggcgtcgttgtaggtcgggttgaagcgcgatngcgagtcgcgagggtcgcggtggagttcgaggcgttcggacgtggcgaggacgtagaggtgttttgttttttttatatttcgcgaaggttagttattcgagtcgttagagtagtcgtttcggtcgtcgtcgttgttttaaaggtagttttagtttcgttgtagtttcgatttttttatatatatatatcgagagggataataaatagagtcgtcgtcgtcgtcgttacggttattttttttttgttcggtataatatcgtatatatatatttgtatatcggggagagagggagggcgcggcggtcgttttcgttgttagttagcgttatgttgtttaattcgggttttgtcgttatagtttttcggttaattttaaaattttaagttttttggagggg

SEQ ID NO: 31114 - DNA, 515 bp, Artificial Sequence
  chemically treated genomic DNA (Homo sapiens) CpG-island No: 31114
  misc_feature (399)..(399): n is either a, c, g or t
cccctccaaaaaacttaaaattttaaaattaaccgaaaaactataacgacaaaacccgaattaaacaacataacgctaactaacaacgaaaacgaccgccgcgccctccctctctccccgatatacaaatatatatatacgatattataccgaacaaaaaaaaaataaccgtaacgacgacgacgacgactctatttattatccctctcgatatatatatataaaaaaatcgaaactacaacgaaactaaaactacctttaaaacaacgacgacgaccgaaacgactactctaacgactcgaataactaaccttcgcgaaatataaaaaaaacaaaacacctctacgtcctcgccacgtccgaacgcctcgaactccaccgcgaccctcgcgactcgcnatcgcgcttcaacccgacctacaacgacgccgaacgaacgaaaaaacaacgccgccgctacgccgccgccgatcgctccctactttctcctcaaccgccgcgctaaacccgaacga

SEQ ID NO: 31115 - DNA, 515 bp, Artificial Sequence
  chemically treated genomic DNA (Homo sapiens) CpG-island No: 31115
  misc_feature (399)..(399): n is either a, c, g or t
tttttttagggggtttggaattttgggattggtcgagaggttgtggcgataaggttcggattggatagtatggcgttgattgatagcgggggcggtcgtcgcgtttttttttttttttcggtgtgtaaatgtgtgtgtgcggtgttatgtcggataagagggaggtgatcgtggcggcggcggcggcggttttgtttattgtttttttcggtgtgtgtgtgtgaggaaatcggggttgtagcgaggttaaggttgtttttgaagtagcggcggcgatcgggacgattattttggcgattcgagtggttggttttcgcggagtgtgagaaggataaggtatttttgcgttttcgttacgttcgagcgtttcgggttttatcgcggttttcgcggttcgtnatcgcgttttagttcggtttgtagcggcgtcgggcgggcgagaaggtaacgtcgtcgttgcgtcgtcgtcggtcgttttttgttttttttttagtcgtcgcgttaggttcgggcgg

SEQ ID NO: 31116 - DNA, 515 bp, Artificial Sequence
  chemically treated genomic DNA (Homo sapiens) CpG-island No: 31116
  misc_feature (117)..(117): n is either a, c, g or t
ccgcccgaacctaacgcgacgactaaaaaaaaaacaaaaaacgaccgacgacgacgcaacgacgacgttaccttctcgcccgcccgacgccgctacaaaccgaactaaaacgcgatnacgaaccgcgaaaaccgcgataaaacccgaaacgctcgaacgtaacgaaaacgcaaaaataccttatccttctcacactccgcgaaaaccaaccactcgaatcgccaaaataatcgtcccgatcgccgccgctacttcaaaaacaaccttaacctcgctacaaccccgatttcctcacacacacacaccgaaaaaaacaataaacaaaaccgccgccgccgccgccacgatcacctccctcttatccgacataacaccgcacacacacatttacacaccgaaaaaaaaaaaaaaacgcgacgaccgcccccgctatcaatcaacgccatactatccaatccgaaccttatcgccacaacctctcgaccaatcccaaaattccaaaccccctaaaaaaa

SEQ ID NO: 31117 - DNA, 539 bp, Artificial Sequence
  chemically treated genomic DNA (Homo sapiens) CpG-island No: 31117
atagtcggttcggtcgggaaggttggcgggcgttgttatttcggggttgggggtatcggagggggggtgagaggttacgtgaggttgtggtacgtgaggtgattggggggagggtgatggggggtggttttcgggtttcgtttttcgtcgtcgtcgtcgtttgcgtttcggttgtcgcgtatttggcgtaaatttatcgcgagcgttcgtaaagttattcgcgtaggcgtttcgggatcggcgttcgtcgcgcgtaatcgtagtgatagtcggcggtttggttttcgcgtagtcgcggtgagggagtattttttagcgcgtagtcgcgttggtattcgtttggaggatcgaagttttatttttttgttttgcgttagcgtattgagataaaagggcgggatttgaggtttcgcgtaggcgtttgagaaagtttgtaggggttaaggcgtagtcgtaggaagttagggattgtttatttattggtgtttgtgtgtaaattaagacgattttgttttgcgtaggcgtgttgggggtgtttt

SEQ ID NO: 31118 - DNA, 539 bp, Artificial Sequence
  chemically treated genomic DNA (Homo sapiens) CpG-island No: 31118
aaaacacccccaacacgcctacgcaaaacaaaatcgtcttaatttacacacaaacaccaataaataaacaatccctaacttcctacgactacgccttaacccctacaaactttctcaaacgcctacgcgaaacctcaaatcccgcccttttatctcaatacgctaacgcaaaacaaaaaaataaaacttcgatcctccaaacgaataccaacgcgactacgcgctaaaaaatactccctcaccgcgactacgcgaaaaccaaaccgccgactatcactacgattacgcgcgacgaacgccgatcccgaaacgcctacgcgaataactttacgaacgctcgcgataaatttacgccaaatacgcgacaaccgaaacgcaaacgacgacgacgacgaaaaacgaaacccgaaaaccaccccccatcaccctccccccaatcacctcacgtaccacaacctcacgtaacctctcaccccccctccgatacccccaaccccgaaataacaacgcccgccaaccttcccgaccgaaccgactat

SEQ ID NO: 31119 - DNA, 539 bp, Artificial Sequence
  chemically treated genomic DNA (Homo sapiens) CpG-island No: 31119
ggagtatttttaatacgtttgcgtagaatagagtcgttttagtttgtatataaatattaatggatgaatagtttttagttttttgcggttgcgttttgatttttataagtttttttaagcgtttgcgcgagattttaggtttcgtttttttgttttagtgcgttggcgtagggtagaaaggtggggtttcggttttttagacgaatgttagcgcggttgcgcgttggggggtatttttttatcgcggttgcgcgggagttaggtcgtcggttgttattgcggttgcgcgcggcgagcgtcgatttcggggcgtttgcgcgggtggttttgcgggcgttcgcggtaagtttgcgttaagtgcgcggtagtcgggacgtagacggcggcggcggcgagaggcggagttcggggattattttttattattttttttttagttattttacgtattataattttacgtaattttttatttttttttcgatatttttagtttcgggatggtagcgttcgttagttttttcggtcggatcggttgt

SEQ ID NO: 31120 - DNA, 539 bp, Artificial Sequence
  chemically treated genomic DNA (Homo sapiens) CpG-island No: 31120
acaaccgatccgaccgaaaaaactaacgaacgctaccatcccgaaactaaaaatatcgaaaaaaaaataaaaaattacgtaaaattataatacgtaaaataactaaaaaaaaaataataaaaaataatccccgaactccgcctctcgccgccgccgccgtctacgtcccgactaccgcgcacttaacgcaaacttaccgcgaacgcccgcaaaaccacccgcgcaaacgccccgaaatcgacgctcgccgcgcgcaaccgcaataacaaccgacgacctaactcccgcgcaaccgcgataaaaaaataccccccaacgcgcaaccgcgctaacattcgtctaaaaaaccgaaaccccacctttctaccctacgccaacgcactaaaacaaaaaaacgaaacctaaaatctcgcgcaaacgcttaaaaaaacttataaaaatcaaaacgcaaccgcaaaaaactaaaaactattcatccattaatatttatatacaaactaaaacgactctattctacgcaaacgtattaaaaatactcc

SEQ ID NO: 31121 - DNA, 721 bp, Artificial Sequence
  chemically treated genomic DNA (Homo sapiens) CpG-island No: 31121
gtacgtttagggggcgttcgtagggtcggcgcgtattcgtacgcgtatacgtttttgtttagttttttgttcgttttcgttttcggaggttgacgcgttcgggcgtcgttttaggtttgtgtagggcggatcggtagtcgtttggcggcgatttagggcggtgcggggtttgggcgggagtcgggaggcgcggtcggtatggaggcgttgttgttgggcgcggggttgttgttgggcgtttacgtgtttgtttattataatttggtgaaggtttcgtcgtgcggcggtatgggtaatttgcggggtcgtacggtcgtggttacgggtgagtgcggaggcgggtgagtgcgagttggcggggcgcgcggagaggaggtcgggtcggcggtagtagcggttcgtcgggtttagtttagttcggttttcgttcgcggttcgtaggcgttaatagcggtatcggaaagatgacggcgttggagttggcgcgtcggggagcgcgcgtggtgttggtttgtcgtagttaggagcgcggggaggcggttgttttcgattttcgttaggtgagaggtagcgggggcgcgtgggacggtgagtcgagaattcgtcgggatatagagaagttagtaaaggggttgcggaggattcgggtttagggaggagagcgcggcgcgggcggttgagcgcgaagagggagtgtacggagcgttggggttattcgagg

SEQ ID NO: 31122 - DNA, 721 bp, Artificial Sequence
  chemically treated genomic DNA (Homo sapiens) CpG-island No: 31122
cctcgaataaccccaacgctccgtacactccctcttcgcgctcaaccgcccgcgccgcgctctcctccctaaacccgaatcctccgcaacccctttactaacttctctatatcccgacgaattctcgactcaccgtcccacgcgcccccgctacctctcacctaacgaaaatcgaaaacaaccgcctccccgcgctcctaactacgacaaaccaacaccacgcgcgctccccgacgcgccaactccaacgccgtcatctttccgataccgctattaacgcctacgaaccgcgaacgaaaaccgaactaaactaaacccgacgaaccgctactaccgccgacccgacctcctctccgcgcgccccgccaactcgcactcacccgcctccgcactcacccgtaaccacgaccgtacgaccccgcaaattacccataccgccgcacgacgaaaccttcaccaaattataataaacaaacacgtaaacgcccaacaacaaccccgcgcccaacaacaacgcctccataccgaccgcgcctcccgactcccgcccaaaccccgcaccgccctaaatcgccgccaaacgactaccgatccgccctacacaaacctaaaacgacgcccgaacgcgtcaacctccgaaaacgaaaacgaacaaaaaactaaacaaaaacgtatacgcgtacgaatacgcgccgaccctacgaacgccccctaaacgtac

SEQ ID NO: 31123 - DNA, 721 bp, Artificial Sequence
  chemically treated genomic DNA (Homo sapiens) CpG-island No: 31123
tttcgggtgattttagcgtttcgtgtatttttttttcgcgtttagtcgttcgcgtcgcgtttttttttttggattcggatttttcgtagtttttttgttggtttttttgtgtttcggcgggttttcggtttatcgttttacgcgttttcgttgttttttatttggcggaggtcgaaggtagtcgttttttcgcgtttttggttgcggtaggttagtattacgcgcgtttttcggcgcgttagttttagcgtcgttattttttcgatgtcgttgttggcgtttgcggatcgcgggcgggagtcgagttgagttgagttcggcgggtcgttgttatcgtcggttcggtttttttttcgcgcgtttcgttagttcgtatttattcgttttcgtatttattcgtgattacggtcgtgcggtttcgtaggttgtttatgtcgtcgtacggcggggtttttattaggttgtagtagataagtacgtaagcgtttagtagtaatttcgcgtttagtagtagcgtttttatgtcggtcgcgtttttcggttttcgtttaggtttcgtatcgttttggatcgtcgttaggcggttgtcgattcgttttgtataggtttggaacggcgttcgggcgcgttagttttcgaaggcggaggcgggtaggaggttgggtaggggcgtgtgcgcgtgcgggtgcgcgtcggttttgcgagcgttttttaggcgtgt

SEQ ID NO: 31124 - DNA, 721 bp, Artificial Sequence
  chemically treated genomic DNA (Homo sapiens) CpG-island No: 31124
acacgcctaaaaaacgctcgcaaaaccgacgcgcacccgcacgcgcacacgcccctacccaacctcctacccgcctccgccttcgaaaactaacgcgcccgaacgccgttccaaacctatacaaaacgaatcgacaaccgcctaacgacgatccaaaacgatacgaaacctaaacgaaaaccgaaaaacgcgaccgacataaaaacgctactactaaacgcgaaattactactaaacgcttacgtacttatctactacaacctaataaaaaccccgccgtacgacgacataaacaacctacgaaaccgcacgaccgtaatcacgaataaatacgaaaacgaataaatacgaactaacgaaacgcgcgaaaaaaaaaccgaaccgacgataacaacgacccgccgaactcaactcaactcgactcccgcccgcgatccgcaaacgccaacaacgacatcgaaaaaataacgacgctaaaactaacgcgccgaaaaacgcgcgtaatactaacctaccgcaaccaaaaacgcgaaaaaacgactaccttcgacctccgccaaataaaaaacaacgaaaacgcgtaaaacgataaaccgaaaacccgccgaaacacaaaaaaaccaacaaaaaaactacgaaaaatccgaatccaaaaaaaaaaacgcgacgcgaacgactaaacgcgaaaaaaaaatacacgaaacgctaaaatcacccgaaa

SEQ ID NO: 31125 - DNA, 544 bp, Artificial Sequence
  chemically treated genomic DNA (Homo sapiens) CpG-island No: 31125
tttcgttcgagaacgtttacgttttttttagggttaggattttttttttttttttcgtattggtttttcgtggtttttagtatcgttgagtattcggcgttttagcgagatttttttgtttcgatagatttcgagggggcggggttcggcgggacggggcggggataagtttttttcgggttcgttcgttggtattgttgcgcggtgattggacgtttcggaaggtcgttttttaggtcgattcggggagtgacgggcggttagcggttgtttttcggcgtgtggggtgcggagtgcggggtttaaggttttagaggggtggggatttcgggtcgtagcgtcgtcgagcgcgattgttcgttgagattcggcgtttcggggtgcggtaagtttgcggttttaggtgttggttaggcgttttggtgcgttcgttggagtgtcgagagtatttgggaaatttaatttttcgtttttattttttgttttcgattttcgggtagaaaagtagttgtcgagttgttttatttttttttttatcggattt

SEQ ID NO: 31126 - DNA, 544 bp, Artificial Sequence
  chemically treated genomic DNA (Homo sapiens) CpG-island No: 31126
aaatccgataaaaaaaaaaataaaacaactcgacaactacttttctacccgaaaatcgaaaacaaaaaataaaaacgaaaaattaaatttcccaaatactctcgacactccaacgaacgcaccaaaacgcctaaccaacacctaaaaccgcaaacttaccgcaccccgaaacgccgaatctcaacgaacaatcgcgctcgacgacgctacgacccgaaatccccacccctctaaaaccttaaaccccgcactccgcaccccacacgccgaaaaacaaccgctaaccgcccgtcactccccgaatcgacctaaaaaacgaccttccgaaacgtccaatcaccgcgcaacaataccaacgaacgaacccgaaaaaaacttatccccgccccgtcccgccgaaccccgccccctcgaaatctatcgaaacaaaaaaatctcgctaaaacgccgaatactcaacgatactaaaaaccacgaaaaaccaatacgaaaaaaaaaaaaaaaatcctaaccctaaaaaaaacgtaaacgttctcgaacgaaa

SEQ ID NO: 31127 - DNA, 544 bp, Artificial Sequence
  chemically treated genomic DNA (Homo sapiens) CpG-island No: 31127
gagttcgatgggggaggaaataaaataattcggtaattgtttttttattcgaaagtcgggagtaaggagtgggggcgagaagttaagttttttaaatgttttcggtattttagcgagcgtattaagacgtttagttagtatttgaaatcgtaagtttgtcgtatttcggggcgtcgaattttagcgggtaatcgcgttcggcggcgttgcggttcggagtttttatttttttggagttttgggtttcgtatttcgtattttatacgtcggggagtagtcgttggtcgttcgttatttttcgggtcggtttggaaggcggtttttcgaagcgtttaattatcgcgtaataatgttaacgggcgggttcggggagggtttgttttcgtttcgtttcgtcgggtttcgttttttcggagtttgtcggggtaggagaatttcgttgggacgtcgagtgtttagcggtgttggaagttacgaagggttagtgcgaggggaggaggaagggttttggttttggagagggcgtgagcgttttcgggcgagg

SEQ ID NO: 31128 - DNA, 544 bp, Artificial Sequence
  chemically treated genomic DNA (Homo sapiens) CpG-island No: 31128
cctcgcccgaaaacgctcacgccctctccaaaaccaaaacccttcctcctcccctcgcactaacccttcgtaacttccaacaccgctaaacactcgacgtcccaacgaaattctcctaccccgacaaactccgaaaaaacgaaacccgacgaaacgaaacgaaaacaaaccctccccgaacccgcccgttaacattattacgcgataattaaacgcttcgaaaaaccgccttccaaaccgacccgaaaaataacgaacgaccaacgactactccccgacgtataaaatacgaaatacgaaacccaaaactccaaaaaaataaaaactccgaaccgcaacgccgccgaacgcgattacccgctaaaattcgacgccccgaaatacgacaaacttacgatttcaaatactaactaaacgtcttaatacgctcgctaaaataccgaaaacatttaaaaaacttaacttctcgcccccactccttactcccgactttcgaataaaaaaacaattaccgaattattttatttcctcccccatcgaactc

SEQ ID NO: 31129 - DNA, 1439 bp, Artificial Sequence
  chemically treated genomic DNA (Homo sapiens) CpG-island No: 31129
gtcgtgcgtcggggcggtagagtttatttttgtcgtatcgttgtttcgggtcggtagagtttatttttgtcgtatcgttgtttcgggtcgggtgtggatttaaaaatattcggcggttttaagtttgcgttgggggtgcgggcgggttcggtcgggtcgtagagggcgttaggagatcggagaaacggcggtcgtttggttttttcgtttttgtcggggttgtttttttaaattttggaggaggtagagagaaaaaaggaaagaaagagaaaagacgcggagtttcgagcggttggtggcggtgttcggtttttttatttcgttttcgcgtcgggttttgattttcgttcgtagttttcgttagtttcgggcgtttttcgtcgcgtcgtttattcgttatagttattgttaaaatagaaattagcggagtcgggcgggggttgcggcgtagtaagtgtatgtgtcgcgcggcggggagggggcgggcgcgagcgataggcgatcgtatatattcgggttttttagttttgtgcgtttttcgagtcggcggcgcgggcgcggggcgcggggcgcggggttgatagtttcggcgcgggaggcggggcgcggggaggggcggaggcgcggcgcggggagggaggagttgttcgttcgttcgttgtcgtcgtttagttttatattcgtcggcgtagtttcgttttttttttttgatagcggcgcggtcggcgaggttcgggcgcgtagggatcggcggatatcggcggcgaaggaggacgttaggattgcgtttcggagttaagtgcgggaggcgcgtagggtcggcggcgcgcggaggtgagcgggttcgcgcgtcgggttcgggcgtcggttgtcggggtcgcgatttttatagtatttcggtagtcgaggtagttcgggaggtttcggggcggcgggcgggtggttttgtttgggttgcgtcggaaagcgattgcgggggtcgttgttaggaggtcggcggttcgcgcgttttggggcgtcggttggagtaggggcgtttttcgcgcggtgggtaggaggcggggggttgcggtggttatttaggggtttcgtgcggtagttatgtaacggaggaggcgggaggagggagggagggaaggagggaggggagagttagcggagagcgagttagcgagcgggcgtcgcgttttttggttggtatcgcggttcggagcgaagtggcgcgcggggttggaaaggaatttttgcgggcgcgtgcggttcggggttcggcggcgtttgcgggttcgagcggggcgggttcgtcggtagttataggtggtttttgttaaaagttttatcgtatttttgtttggaaggcgcgggagcgttttggtgagtgacgtttttttgggatttttgtagttttatttcgcgttgtttttttttgaaaattggaa

SEQ ID NO: 31130 - DNA, 1439 bp, Artificial Sequence
  chemically treated genomic DNA (Homo sapiens) CpG-island No: 31130
ttccaattttcaaaaaaaaacaacgcgaaataaaactacaaaaatcccaaaaaaacgtcactcaccaaaacgctcccgcgccttccaaacaaaaatacgataaaacttttaacaaaaaccacctataactaccgacgaacccgccccgctcgaacccgcaaacgccgccgaaccccgaaccgcacgcgcccgcaaaaattcctttccaaccccgcgcgccacttcgctccgaaccgcgataccaaccaaaaaacgcgacgcccgctcgctaactcgctctccgctaactctcccctccctccttccctccctccctcctcccgcctcctccgttacataactaccgcacgaaacccctaaataaccaccgcaaccccccgcctcctacccaccgcgcgaaaaacgcccctactccaaccgacgccccaaaacgcgcgaaccgccgacctcctaacaacgacccccgcaatcgctttccgacgcaacccaaacaaaaccacccgcccgccgccccgaaacctcccgaactacctcgactaccgaaatactataaaaatcgcgaccccgacaaccgacgcccgaacccgacgcgcgaacccgctcacctccgcgcgccgccgaccctacgcgcctcccgcacttaactccgaaacgcaatcctaacgtcctccttcgccgccgatatccgccgatccctacgcgcccgaacctcgccgaccgcgccgctatcaaaaaaaaaaaacgaaactacgccgacgaatataaaactaaacgacgacaacgaacgaacgaacaactcctccctccccgcgccgcgcctccgcccctccccgcgccccgcctcccgcgccgaaactatcaaccccgcgccccgcgccccgcgcccgcgccgccgactcgaaaaacgcacaaaactaaaaaacccgaatatatacgatcgcctatcgctcgcgcccgccccctccccgccgcgcgacacatacacttactacgccgcaacccccgcccgactccgctaatttctattttaacaataactataacgaataaacgacgcgacgaaaaacgcccgaaactaacgaaaactacgaacgaaaatcaaaacccgacgcgaaaacgaaataaaaaaaccgaacaccgccaccaaccgctcgaaactccgcgtcttttctctttctttccttttttctctctacctcctccaaaatttaaaaaaacaaccccgacaaaaacgaaaaaaccaaacgaccgccgtttctccgatctcctaacgccctctacgacccgaccgaacccgcccgcacccccaacgcaaacttaaaaccgccgaatatttttaaatccacacccgacccgaaacaacgatacgacaaaaataaactctaccgacccgaaacaacgatacgacaaaaataaactctaccgccccgacgcacgac

SEQ ID NO: 31131 - DNA, 1439 bp, Artificial Sequence
  chemically treated genomic DNA (Homo sapiens) CpG-island No: 31131
ttttaatttttaagaaaagatagcgcgaagtgagattgtaaaagttttaggaaaacgttatttattaaaacgttttcgcgttttttaggtagaagtgcggtaaaatttttggtagaaattatttgtggttgtcgacgggttcgtttcgttcgggttcgtaggcgtcgtcgagtttcgggtcgtacgcgttcgtagaagtttttttttagtttcgcgcgttatttcgtttcgggtcgcggtgttagttaggaggcgcggcgttcgttcgttggttcgtttttcgttggttttttttttttttttttttttttttttttttttcgtttttttcgttgtatggttgtcgtacggagtttttgaatagttatcgtagtttttcgttttttgtttatcgcgcggagggcgtttttgttttagtcggcgttttaaggcgcgcggatcgtcggttttttagtaacggttttcgtaatcgtttttcggcgtagtttaagtaaagttattcgttcgtcgtttcgagatttttcgaattgtttcggttgtcgaggtgttgtggagatcgcgatttcggtagtcggcgttcgagttcggcgcgcgaattcgtttattttcgcgcgtcgtcggttttgcgcgtttttcgtatttggtttcgggacgtagttttggcgttttttttcgtcgtcggtgttcgtcggtttttgcgcgttcgagtttcgtcggtcgcgtcgttgttagagggggggggcggggttgcgtcggcgggtatggagttgagcggcggtagcgggcgagcgggtagttttttttttttcgcgtcgcgttttcgttttttttcgcgtttcgtttttcgcgtcggggttgttagtttcgcgtttcgcgtttcgcgttcgcgtcgtcggttcggggggcgtatagggttaaagggttcggatgtgtgcggtcgtttgtcgttcgcgttcgtttttttttcgtcgcgcggtatatgtatttgttgcgtcgtagttttcgttcggtttcgttaatttttattttgatagtaattgtggcgagtgggcggcgcggcggggggcgttcgggattggcggaggttgcgggcgggagttaggattcgacgcggaggcggagtgggggggtcgggtatcgttattaatcgttcggggtttcgcgttttttttttttttttttttttttttttttgttttttttaggatttaaagggatagtttcggtagaggcgagggggttaggcggtcgtcgttttttcggttttttgacgttttttgcggttcggtcggattcgttcgtatttttagcgtaggtttgggatcgtcgggtatttttaggtttatattcgattcggggtagcggtgcggtagagatgggttttgtcgattcggggtagcggtgcggtagagatgggttttgtcgtttcggcgtacggt

SEQ ID NO: 31132 - DNA, 1439 bp, Artificial Sequence
  chemically treated genomic DNA (Homo sapiens) CpG-island No: 31132
accgtacgccgaaacgacaaaacccatctctaccgcaccgctaccccgaatcgacaaaacccatctctaccgcaccgctaccccgaatcgaatataaacctaaaaatacccgacgatcccaaacctacgctaaaaatacgaacgaatccgaccgaaccgcaaaaaacgtcaaaaaaccgaaaaaacgacgaccgcctaaccccctcgcctctaccgaaactatccctttaaatcctaaaaaaaacaaaaaaaaaaaaaaaaaaaaaaaaaaaaaacgcgaaaccccgaacgattaataacgatacccgacccccccactccgcctccgcgtcgaatcctaactcccgcccgcaacctccgccaatcccgaacgccccccgccgcgccgcccactcgccacaattactatcaaaataaaaattaacgaaaccgaacgaaaactacgacgcaacaaatacatataccgcgcgacgaaaaaaaaacgaacgcgaacgacaaacgaccgcacacatccgaaccctttaaccctatacgccccccgaaccgacgacgcgaacgcgaaacgcgaaacgcgaaactaacaaccccgacgcgaaaaacgaaacgcgaaaaaaaacgaaaacgcgacgcgaaaaaaaaaaaactacccgctcgcccgctaccgccgctcaactccatacccgccgacgcaaccccgccccccccctctaacaacgacgcgaccgacgaaactcgaacgcgcaaaaaccgacgaacaccgacgacgaaaaaaaacgccaaaactacgtcccgaaaccaaatacgaaaaacgcgcaaaaccgacgacgcgcgaaaataaacgaattcgcgcgccgaactcgaacgccgactaccgaaatcgcgatctccacaacacctcgacaaccgaaacaattcgaaaaatctcgaaacgacgaacgaataactttacttaaactacgccgaaaaacgattacgaaaaccgttactaaaaaaccgacgatccgcgcgccttaaaacgccgactaaaacaaaaacgccctccgcgcgataaacaaaaaacgaaaaactacgataactattcaaaaactccgtacgacaaccatacaacgaaaaaaacgaaaaaaaaaaaaaaaaaaaaaaaaaaaaaaaaaaccaacgaaaaacgaaccaacgaacgaacgccgcgcctcctaactaacaccgcgacccgaaacgaaataacgcgcgaaactaaaaaaaaacttctacgaacgcgtacgacccgaaactcgacgacgcctacgaacccgaacgaaacgaacccgtcgacaaccacaaataatttctaccaaaaattttaccgcacttctacctaaaaaacgcgaaaacgttttaataaataacgttttcctaaaacttttacaatctcacttcgcgctatcttttcttaaaaattaaaa

SEQ ID NO: 31133 - DNA, 714 bp, Artificial Sequence
  chemically treated genomic DNA (Homo sapiens) CpG-island No: 31133
gtcggcgcggataggaatcgtagtaaaggattttttagattttcgagttgtgagcggcgatatagtcggggattttagatttcggatttttaggcgcggagttgatcggattcgggaagggagcggcgcgggtagcgcggggtagcgagacgtaagcgttcgtaggggtcggcggtttagtagaagtcgcgttcgttaagttgttcgaagcgttcgcgaggtgcgagggtgcggatagtatcggaaggcggcggacgtagcgttttcgggtttatttttttattttttttttttagttttgttcggagttttagttcggcgttcgtagaagtttttcggcggagcgcgtttgattcgggtggttcgcgcggaagtttttagcgttcgtttcgtgagtgtttcgtcgtttattttgcggcgtcgggcgtagcgtgatcgtagcgggtttcggagcggcgcggcggcgcgggcgggggtcgggtacgggcgcgcgtttcggggcgtagtcgggtgggcgggcgcggcggttgcgtttgggtcggggtcggcggttcggttatcggggtgcggggttgcggagaattttagcggtcgttacggatcgaagtttttaaagatgcggtttttcgagtgtatatcgttttcggttgtaatatatatttagtatttatagttatattaggtaggagcgatgggttggttgttgaattaagg

SEQ ID NO: 31134 - DNA, 714 bp, Artificial Sequence
  chemically treated genomic DNA (Homo sapiens) CpG-island No: 31134
ccttaattcaacaaccaacccatcgctcctacctaatataactataaatactaaatatatattacaaccgaaaacgatatacactcgaaaaaccgcatctttaaaaacttcgatccgtaacgaccgctaaaattctccgcaaccccgcaccccgataaccgaaccgccgaccccgacccaaacgcaaccgccgcgcccgcccacccgactacgccccgaaacgcgcgcccgtacccgacccccgcccgcgccgccgcgccgctccgaaacccgctacgatcacgctacgcccgacgccgcaaaataaacgacgaaacactcacgaaacgaacgctaaaaacttccgcgcgaaccacccgaatcaaacgcgctccgccgaaaaacttctacgaacgccgaactaaaactccgaacaaaactaaaaaaaaaaaataaaaaaataaacccgaaaacgctacgtccgccgccttccgatactatccgcaccctcgcacctcgcgaacgcttcgaacaacttaacgaacgcgacttctactaaaccgccgacccctacgaacgcttacgtctcgctaccccgcgctacccgcgccgctcccttcccgaatccgatcaactccgcgcctaaaaatccgaaatctaaaatccccgactatatcgccgctcacaactcgaaaatctaaaaaatcctttactacgattcctatccgcgccgac

SEQ ID NO: 31135 - DNA, 714 bp, Artificial Sequence
  chemically treated genomic DNA (Homo sapiens) CpG-island No: 31135
ttttggtttagtagttagtttatcgtttttgtttagtgtgattgtgaatattaggtgtatgttataatcgggagcggtgtatattcggggaatcgtatttttggaaatttcggttcgtagcggtcgttaggatttttcgtagtttcgtatttcggtggtcgaatcgtcggtttcggtttagacgtagtcgtcgcgttcgtttattcggttgcgtttcggggcgcgcgttcgtgttcggttttcgttcgcgtcgtcgcgtcgtttcggagttcgttgcggttacgttgcgttcggcgtcgtagggtgggcggcgaggtatttacgaggcggacgttgagggttttcgcgcgggttattcgggttaagcgcgtttcgtcgggaaatttttgcgggcgtcgggttgaagtttcgggtagggttgggaaggaaaggtaagaaggtgagttcgggggcgttgcgttcgtcgtttttcggtgttgttcgtattttcgtatttcgcgggcgtttcgggtaatttagcgggcgcggtttttgttgggtcgtcgatttttgcgagcgtttgcgtttcgttgtttcgcgttgttcgcgtcgtttttttttcgggttcggttaatttcgcgtttgggggttcggggtttggggttttcggttgtgtcgtcgtttatagttcggaggtttaggggattttttgttgcggtttttattcgcgtcgat

SEQ ID NO: 31136 - DNA, 714 bp, Artificial Sequence
  chemically treated genomic DNA (Homo sapiens) CpG-island No: 31136
atcgacgcgaataaaaaccgcaacaaaaaatcccctaaacctccgaactataaacgacgacacaaccgaaaaccccaaaccccgaacccccaaacgcgaaattaaccgaacccgaaaaaaaaacgacgcgaacaacgcgaaacaacgaaacgcaaacgctcgcaaaaatcgacgacccaacaaaaaccgcgcccgctaaattacccgaaacgcccgcgaaatacgaaaatacgaacaacaccgaaaaacgacgaacgcaacgcccccgaactcaccttcttacctttccttcccaaccctacccgaaacttcaacccgacgcccgcaaaaatttcccgacgaaacgcgcttaacccgaataacccgcgcgaaaaccctcaacgtccgcctcgtaaatacctcgccgcccaccctacgacgccgaacgcaacgtaaccgcaacgaactccgaaacgacgcgacgacgcgaacgaaaaccgaacacgaacgcgcgccccgaaacgcaaccgaataaacgaacgcgacgactacgtctaaaccgaaaccgacgattcgaccaccgaaatacgaaactacgaaaaatcctaacgaccgctacgaaccgaaatttccaaaaatacgattccccgaatatacaccgctcccgattataacatacacctaatattcacaatcacactaaacaaaaacgataaactaactactaaaccaaaa

SEQ ID NO: 31137 - DNA, 724 bp, Artificial Sequence
  chemically treated genomic DNA (Homo sapiens) CpG-island No: 31137
ttttttcgtttttgttttgggtttgttcgtgttgtttttagttcgcgtttttttcgttaggttcggagtttttcgtttagtttcgcgtcggggtttttttatatattttttcggtttttatgtttaggattttttttatttcgaatatatttttttcgttttttttattgtcgttaaaggttttcgtttttttcgcggttgcgttattattttcgtttattattttaatttttttttcgatttcggttaattttttagtgttgtcggtagttgatatagggattgcggttatttttgtttttttcgtaatttgttttattttagtagtttcgtaaatcgtcgaggaaaattcgttgcgataaatattttagtagtttttcgcgtttcgcgttcggttttattttatattagcggcgtaacggaagtcgattaatggcgggtttggattttagagtgataggaataaaaattaattatattaaggcgggcgcggcgtaatatcgttgagttcgcgggacgtaggtgggcggggtagggagggtattttaggcggaagagcgtttgggcgttttgtagttgtggcggaaaaggttaagggtgggaggggagtcggcgaggtcgtcgagtggcgcgacgttggggaggaggagggtcgttggggcggagggcgttttagggttgagggcggtttcgaggagttgatagtgtttgattttttagtagg

SEQ ID NO: 31138 - DNA, 724 bp, Artificial Sequence
  chemically treated genomic DNA (Homo sapiens) CpG-island No: 31138
cctactaaaaaatcaaacactatcaactcctcgaaaccgccctcaaccctaaaacgccctccgccccaacgaccctcctcctccccaacgtcgcgccactcgacgacctcgccgactcccctcccacccttaaccttttccgccacaactacaaaacgcccaaacgctcttccgcctaaaataccctccctaccccgcccacctacgtcccgcgaactcaacgatattacgccgcgcccgccttaatataattaatttttattcctatcactctaaaatccaaacccgccattaatcgacttccgttacgccgctaatataaaataaaaccgaacgcgaaacgcgaaaaactactaaaatatttatcgcaacgaattttcctcgacgatttacgaaactactaaaataaaacaaattacgaaaaaaacaaaaataaccgcaatccctatatcaactaccgacaacactaaaaaattaaccgaaatcgaaaaaaaaattaaaataataaacgaaaataataacgcaaccgcgaaaaaaacgaaaacctttaacgacaataaaaaaaacgaaaaaaatatattcgaaataaaaaaaatcctaaacataaaaaccgaaaaaatatataaaaaaaccccgacgcgaaactaaacgaaaaactccgaacctaacgaaaaaaacgcgaactaaaaacaacacgaacaaacccaaaacaaaaacgaaaaaa

SEQ ID NO: 31139 - DNA, 724 bp, Artificial Sequence
  chemically treated genomic DNA (Homo sapiens) CpG-island No: 31139
tttgttgggggattaggtattgttagtttttcggggtcgtttttagttttgggacgtttttcgttttaacgattttttttttttttagcgtcgcgttattcggcggtttcgtcggttttttttttatttttgatttttttcgttatagttatagaacgtttaagcgttttttcgtttagggtgttttttttgtttcgtttatttgcgtttcgcgggtttagcggtgttacgtcgcgttcgttttaatatgattggtttttgtttttgttattttaggatttaagttcgttattggtcggttttcgttacgtcgttgatgtggagtagggtcgagcgcggaacgcgaggggttgttggggtgtttgtcgtagcgggtttttttcggcggtttgcggagttgttaggatggagtaggttgcggagggagtaagggtgatcgtagtttttgtgttagttgtcgatagtattgaggagttggtcgaagtcgaagaaggagttggagtagtgggcgaagataatgacgtagtcgcgagaggagcggaggtttttggcgatagtgaggaggacggagaggatgtgttcgaggtggagaagattttggatatgaagatcgagggggtatgtggaggggtttcggcgcggggttgggcggggagtttcgggtttggcggggaggacgcgagttggaaatagtacgggtagatttaaaataggagcgggggag

SEQ ID NO: 31140 - DNA, 724 bp, Artificial Sequence
  chemically treated genomic DNA (Homo sapiens) CpG-island No: 31140
ctcccccgctcctattttaaatctacccgtactatttccaactcgcgtcctccccgccaaacccgaaactccccgcccaaccccgcgccgaaacccctccacataccccctcgatcttcatatccaaaatcttctccacctcgaacacatcctctccgtcctcctcactatcgccaaaaacctccgctcctctcgcgactacgtcattatcttcgcccactactccaactccttcttcgacttcgaccaactcctcaatactatcgacaactaacacaaaaactacgatcacccttactccctccgcaacctactccatcctaacaactccgcaaaccgccgaaaaaaacccgctacgacaaacaccccaacaacccctcgcgttccgcgctcgaccctactccacatcaacgacgtaacgaaaaccgaccaataacgaacttaaatcctaaaataacaaaaacaaaaaccaatcatattaaaacgaacgcgacgtaacaccgctaaacccgcgaaacgcaaataaacgaaacaaaaaaaacaccctaaacgaaaaaacgcttaaacgttctataactataacgaaaaaaatcaaaaataaaaaaaaaaccgacgaaaccgccgaataacgcgacgctaaaaaaaaaaaaaatcgttaaaacgaaaaacgtcccaaaactaaaaacgaccccgaaaaactaacaatacctaatcccccaacaaa

SEQ ID NO: 31141 - DNA, 654 bp, Artificial Sequence
  chemically treated genomic DNA (Homo sapiens) CpG-island No: 31141
aggtgaatttgtcggtggtggggtcgtagtggttttcgaggttggtgattacgtcgtcgaatttgagtatttcgtagtttttatgttgtcgtttgaggtcggcgtagaaggcgattttgggtttcgtgttgtaggtggcggcgttgatggtttcggtcgcgtttaggtcgggcgtttcgggcgggttcggtaggttttggcggttcggttcgtttttttcgttcgggggttttatggggtcgggtggttcgggtttttcggggggttcgcgcggattcgttttttcgggtttgtcggtttcgtttttggggttttggatgaaggtgggtagggattgtatgaggtcgcggtcgggcgtggtagcggtgttgggcgttttggtgttttcgtaggggtcgtagattatgcggtaggtgtttagtatttagtagtgcgtcgacgtgtcggtcgagtttattagtatcgggatgaggattattagtagtagtattattattatttttagcgtttcggcggcgattaggcgttttttgttgtttattagtcggtttagcgcggggcgatttttttgtttgtttttggatagaattttgaaggttgggcggggatttttttagagtcgaaaataattttttgcgaattttaatttttttg

SEQ ID NO: 31142 - DNA, 654 bp, Artificial Sequence
  chemically treated genomic DNA (Homo sapiens) CpG-island No: 31142
caaaaaaattaaaattcgcaaaaaattattttcgactctaaaaaaatccccgcccaaccttcaaaattctatccaaaaacaaacaaaaaaatcgccccgcgctaaaccgactaataaacaacaaaaaacgcctaatcgccgccgaaacgctaaaaataataataatactactactaataatcctcatcccgatactaataaactcgaccgacacgtcgacgcactactaaatactaaacacctaccgcataatctacgacccctacgaaaacaccaaaacgcccaacaccgctaccacgcccgaccgcgacctcatacaatccctacccaccttcatccaaaaccccaaaaacgaaaccgacaaacccgaaaaaacgaatccgcgcgaaccccccgaaaaacccgaaccacccgaccccataaaacccccgaacgaaaaaaacgaaccgaaccgccaaaacctaccgaacccgcccgaaacgcccgacctaaacgcgaccgaaaccatcaacgccgccacctacaacacgaaacccaaaatcgccttctacgccgacctcaaacgacaacataaaaactacgaaatactcaaattcgacgacgtaatcaccaacctcgaaaaccactacgaccccaccaccgacaaattcacct

SEQ ID NO: 31143 - DNA, 654 bp, Artificial Sequence
  chemically treated genomic DNA (Homo sapiens) CpG-island No: 31143
taggggagttggggttcgtagggggttgttttcggttttgaagaggttttcgtttaatttttaaaattttgtttaaaagtagataagaggatcgtttcgcgttgagtcggttggtgggtagtaggaggcgtttgatcgtcgtcggggcgttgggggtggtgatggtgttgttgttggtgatttttatttcggtgttggtgagttcggtcggtacgtcggcgtattattagatgttgggtatttgtcgtatggtttgcgatttttacgggggtattaaggcgtttagtatcgttgttacgttcgatcgcggttttatgtagtttttgtttatttttatttagggttttaaaggcgaggtcggtaggttcgggaaggcgggttcgcgcgggtttttcggagagttcgggttattcggttttatggggttttcgggcgagaagggcgagtcgggtcgttaaggtttgtcgggttcgttcggggcgttcggtttgaacgcggtcggggttattagcgtcgttatttatagtacggggtttaagatcgttttttacgtcggttttaagcggtagtatgaaggttacgaggtgtttaagttcgacgacgtggttattaatttcggaaattattacgattttattatcggtaagtttattt

SEQ ID NO: 31144 - DNA, 654 bp, Artificial Sequence
  chemically treated genomic DNA (Homo sapiens) CpG-island No: 31144
aaataaacttaccgataataaaatcgtaataatttccgaaattaataaccacgtcgtcgaacttaaacacctcgtaaccttcatactaccgcttaaaaccgacgtaaaaaacgatcttaaaccccgtactataaataacgacgctaataaccccgaccgcgttcaaaccgaacgccccgaacgaacccgacaaaccttaacgacccgactcgcccttctcgcccgaaaaccccataaaaccgaataacccgaactctccgaaaaacccgcgcgaacccgccttcccgaacctaccgacctcgcctttaaaaccctaaataaaaataaacaaaaactacataaaaccgcgatcgaacgtaacaacgatactaaacgccttaatacccccgtaaaaatcgcaaaccatacgacaaatacccaacatctaataatacgccgacgtaccgaccgaactcaccaacaccgaaataaaaatcaccaacaacaacaccatcaccacccccaacgccccgacgacgatcaaacgcctcctactacccaccaaccgactcaacgcgaaacgatcctcttatctacttttaaacaaaattttaaaaattaaacgaaaacctcttcaaaaccgaaaacaaccccctacgaaccccaactccccta

SEQ ID NO: 31145 - DNA, 900 bp, Artificial Sequence
  chemically treated genomic DNA (Homo sapiens) CpG-island No: 31145
ttgttgcgcgtcgagttttattttacgtcgcgttacggtagttagtgtatgtagtttaataatattatgggtatcgagaatatttgcgagttggtcgcgcgtttgttttttagcgtcgtcgagtgggttcgtaatattttttttttttcggatttgtagattatcgattaggtgtttttgttacgttttatttggagcgagttgttcgtgtttaacgcggtttagtgttttatgtcgttgtacgtggcgtcgttgttggtcgtcgtcggtttgtatgtttcgtttatgtttgtcgatcgcgtcgtggtttttatggattatattcgtattttttaggagtaggtggagaagtttaaggcgttatacgtcgatttagtcgagtatagttgttttaaagttatcgtgttgtttacgttaggtgaggttgcggtcgcggggagggtaggtcgcgtcggtagcgagcgtaggtttcgcgtcgttcgggtttggttttcggagtttttcgcgcggtcggtgcggggcgggtcgggttttcgttggatattgagtttggttcgggtttgtgattttcgcgcggtgatcggttggtcgcgtcgttgttattttgggagcgcggcggtgcgggaatcgaggcggcgcgggtgcggtcggcgggcggtcgggtttattcgttcggatttttacgtggggtcgcggttgtcgagggtgtgtgtttgaggcgggggggcggtgttgtggattcgtttggttgcgcgcgcgcgcgcgcgtgtgtgtgtgtgtgtgtgtttttgtgtgtgtgtttgtgtgtggtgcgtgttatgtgtgagttagagtttagcgtttttgggggaggcgagggaaggaagagaacgtgggaatgtggttttttattttgtgtgg

SEQ ID NO: 31146 - DNA, 900 bp, Artificial Sequence
  chemically treated genomic DNA (Homo sapiens) CpG-island No: 31146
ccacacaaaataaaaaaccacattcccacgttctcttccttccctcgcctcccccaaaaacgctaaactctaactcacacataacacgcaccacacacaaacacacacacaaaaacacacacacacacacacacgcgcgcgcgcgcgcgcaaccaaacgaatccacaacaccgcccccccgcctcaaacacacaccctcgacaaccgcgaccccacgtaaaaatccgaacgaataaacccgaccgcccgccgaccgcacccgcgccgcctcgattcccgcaccgccgcgctcccaaaataacaacgacgcgaccaaccgatcaccgcgcgaaaatcacaaacccgaaccaaactcaatatccaacgaaaacccgacccgccccgcaccgaccgcgcgaaaaactccgaaaaccaaacccgaacgacgcgaaacctacgctcgctaccgacgcgacctaccctccccgcgaccgcaacctcacctaacgtaaacaacacgataactttaaaacaactatactcgactaaatcgacgtataacgccttaaacttctccacctactcctaaaaaatacgaatataatccataaaaaccacgacgcgatcgacaaacataaacgaaacatacaaaccgacgacgaccaacaacgacgccacgtacaacgacataaaacactaaaccgcgttaaacacgaacaactcgctccaaataaaacgtaacaaaaacacctaatcgataatctacaaatccgaaaaaaaaaaaatattacgaacccactcgacgacgctaaaaaacaaacgcgcgaccaactcgcaaatattctcgatacccataatattattaaactacatacactaactaccgtaacgcgacgtaaaataaaactcgacgcgcaacaa

SEQ ID NO: 31147 - DNA, 900 bp, Artificial Sequence
  chemically treated genomic DNA (Homo sapiens) CpG-island No: 31147
ttatatagggtaagaagttatatttttacgtttttttttttttttcgttttttttagaaacgttgagttttggtttatatataatacgtattatatatagatatatatatagagatatatatatatatatatacgcgcgcgcgcgcgcgtagttagacggatttatagtatcgttttttcgttttagatatatattttcggtagtcgcggttttacgtaggggttcgggcgaataggttcggtcgttcgtcggtcgtattcgcgtcgtttcggttttcgtatcgtcgcgtttttaagatggtagcggcgcggttagtcggttatcgcgcgggggttatagattcgggttaggtttagtgtttagcgagggttcggttcgtttcgtatcggtcgcgcgggaggtttcgaaggttaggttcgggcggcgcggggtttgcgttcgttgtcggcgcggtttgtttttttcgcgatcgtagttttatttgacgtgaatagtacgatggttttgaggtagttgtattcggttgagtcgacgtgtagcgttttgagtttttttatttgtttttggaagatgcggatgtggtttatgaaggttacgacgcggtcggtagatatgggcgaggtatgtaggtcggcggcggttagtaacggcgttacgtgtagcggtatagagtattgggtcgcgttgagtacgaatagttcgttttaggtgaggcgtagtagggatatttggtcggtgatttgtagattcgggaagaaggggatgttgcgggtttattcgacggcgttgaagagtaggcgcgcggttagttcgtagatgttttcgatgtttataatgttgttgggttgtatgtattggttgtcgtagcgcgacgtggggtagggttcggcgcgtagtag

SEQ ID NO: 31148 - DNA, 900 bp, Artificial Sequence
  chemically treated genomic DNA (Homo sapiens) CpG-island No: 31148
ctactacgcgccgaaccctaccccacgtcgcgctacgacaaccaatacatacaacccaacaacattataaacatcgaaaacatctacgaactaaccgcgcgcctactcttcaacgccgtcgaataaacccgcaacatccccttcttcccgaatctacaaatcaccgaccaaatatccctactacgcctcacctaaaacgaactattcgtactcaacgcgacccaatactctataccgctacacgtaacgccgttactaaccgccgccgacctacatacctcgcccatatctaccgaccgcgtcgtaaccttcataaaccacatccgcatcttccaaaaacaaataaaaaaactcaaaacgctacacgtcgactcaaccgaatacaactacctcaaaaccatcgtactattcacgtcaaataaaactacgatcgcgaaaaaaacaaaccgcgccgacaacgaacgcaaaccccgcgccgcccgaacctaaccttcgaaacctcccgcgcgaccgatacgaaacgaaccgaaccctcgctaaacactaaacctaacccgaatctataacccccgcgcgataaccgactaaccgcgccgctaccatcttaaaaacgcgacgatacgaaaaccgaaacgacgcgaatacgaccgacgaacgaccgaacctattcgcccgaacccctacgtaaaaccgcgactaccgaaaatatatatctaaaacgaaaaaacgatactataaatccgtctaactacgcgcgcgcgcgcgcgtatatatatatatatatatctctatatatatatctatatataatacgtattatatataaaccaaaactcaacgtttctaaaaaaaacgaaaaaaaaaaaaaaacgtaaaaatataacttcttaccctatataa

SEQ ID NO: 31149 - DNA, 666 bp, Artificial Sequence
  chemically treated genomic DNA (Homo sapiens) CpG-island No: 31149
agcggggcggtcgaggtagtagcggcggtagcggcggcggcggcggaggtagcggtcggtgttcggttcgggttcggtttttgcgatttcggggcgttcggcgggtttttcgttttttttttttttttttttttttttttttttttttttttagcgcgttcgcgcgtttcgcggttttcggcgagtagttcggttttttttagcgtttttcgggtttaaagatatggtaatggtagttagtagttggcgagattcgtaggacgacgtggtcgggggtaatttcggcggttttaatttcgtagcgtaggcggttcgcggcggcggcggcggcgtcggcgagtagtagtagtaggcgggttcgggcgcgtcgtatacgtcgtagatttcgggttagttcggagcgttcgttattttcggtacggcgggggataagggttagggttcgttcggttcgggttagagttagtagtatatcgagtgcgtggtgtgcggggataagtcgagcggtaagtattacggttaatttatttgcgagggttgtaaaagtttttttaagaggagcgttcgtaggaatttaatttatatatgtcgtgttaataggaattgttttatcgattagtattatcgtaattagtgttaatattgtcgttttaagaagtgttttaa

SEQ ID NO: 31150 - DNA, 666 bp, Artificial Sequence
  chemically treated genomic DNA (Homo sapiens) CpG-island No: 31150
ttaaaacacttcttaaaacgacaatattaacactaattacgataatactaatcgataaaacaattcctattaacacgacatatataaattaaattcctacgaacgctcctcttaaaaaaacttttacaaccctcgcaaataaattaaccgtaatacttaccgctcgacttatccccgcacaccacgcactcgatatactactaactctaacccgaaccgaacgaaccctaacccttatcccccgccgtaccgaaaataacgaacgctccgaactaacccgaaatctacgacgtatacgacgcgcccgaacccgcctactactactactcgccgacgccgccgccgccgccgcgaaccgcctacgctacgaaattaaaaccgccgaaattacccccgaccacgtcgtcctacgaatctcgccaactactaactaccattaccatatctttaaacccgaaaaacgctaaaaaaaaccgaactactcgccgaaaaccgcgaaacgcgcgaacgcgctaaaaaaaaaaaaaaaaaaaaaaaaaaaaaaaaaaaaaaaacgaaaaacccgccgaacgccccgaaatcgcaaaaaccgaacccgaaccgaacaccgaccgctacctccgccgccgccgccgctaccgccgctactacctcgaccgccccgct

SEQ ID NO: 31151 - DNA, 666 bp, Artificial Sequence
  chemically treated genomic DNA (Homo sapiens) CpG-island No: 31151
ttgaggtattttttgaggcggtagtattggtattggttgcggtggtgttggtcgatgggatagtttttgttggtacggtatgtgtaagttaagtttttgcggacgttttttttgaagaaatttttgtagttttcgtaggtgaattggtcgtagtgtttgtcgttcgatttgttttcgtatattacgtattcgatgtgttgttggttttggttcgaatcgggcgggttttggtttttgtttttcgtcgtgtcgggggtggcgggcgtttcgggttggttcggggtttgcggcgtgtgcggcgcgttcgagttcgtttgttgttgttgttcgtcggcgtcgtcgtcgtcgtcgcgggtcgtttgcgttgcggggttggggtcgtcggggttgttttcggttacgtcgttttgcggatttcgttagttgttaattattattgttatatttttgggttcggggagcgttggggggagtcgagttgttcgtcgagggtcgcggggcgcgcgggcgcgttgggaggggaaggggaaggggaaggggggagggggagggggcggggggttcgtcgggcgtttcggggtcgtaggagtcgagttcgagtcggatatcggtcgttgttttcgtcgtcgtcgtcgttgtcgtcgttattgtttcggtcgtttcgtt

SEQ ID NO: 31152 - DNA, 666 bp, Artificial Sequence
  chemically treated genomic DNA (Homo sapiens) CpG-island No: 31152
aacgaaacgaccgaaacaataacgacgacaacgacgacgacgacgaaaacaacgaccgatatccgactcgaactcgactcctacgaccccgaaacgcccgacgaaccccccgccccctccccctccccccttccccttccccttcccctcccaacgcgcccgcgcgccccgcgaccctcgacgaacaactcgactccccccaacgctccccgaacccaaaaatataacaataataattaacaactaacgaaatccgcaaaacgacgtaaccgaaaacaaccccgacgaccccaaccccgcaacgcaaacgacccgcgacgacgacgacgacgccgacgaacaacaacaacaaacgaactcgaacgcgccgcacacgccgcaaaccccgaaccaacccgaaacgcccgccacccccgacacgacgaaaaacaaaaaccaaaacccgcccgattcgaaccaaaaccaacaacacatcgaatacgtaatatacgaaaacaaatcgaacgacaaacactacgaccaattcacctacgaaaactacaaaaatttcttcaaaaaaaacgtccgcaaaaacttaacttacacataccgtaccaacaaaaactatcccatcgaccaacaccaccgcaaccaataccaatactaccgcctcaaaaaatacctcaa

SEQ ID NO: 31153 - DNA, 574 bp, Artificial Sequence
  chemically treated genomic DNA (Homo sapiens) CpG-island No: 31153
gttcggcgttatcggtataataaaaagagtaaagtgtgtgatttttttcgtcggttgtttttcgttttttagcgttgtttttttgaatggttggttgcgttcggttttggatttggtttttcgatattcgcgcgttttgatcgtcggcggtagtttcgtttagcgttttgttcggtttatcgcgtttttcgtattttcgagttcggcgagggttttcgtcgggatagcggcggcgtcgcgggcggtttcggttttcgttcgcgtttcggttgcggtttcgatttttgttcggatttcggttcgggtttcggtttttttagcggcgttcgtcgtagtagtttcggcggtagttttagcggcgtttgtagtcgcgatttttttttttttcgtcgtcgtcgtcgttttcgttttcgtcggttttttttatgtcggtttagttcgcgcgttgcgcgtagttcgagcggtcggcgggcgggcgttcggcgcgggtgagcgattgtgtgtgcgagtgtgtgtgtgcgcgggggtgcgggcgaggcggagggcgagagtgtgcgcgcgttttgggttatat

SEQ ID NO: 31154 - DNA, 574 bp, Artificial Sequence
  chemically treated genomic DNA (Homo sapiens) CpG-island No: 31154
atataacccaaaacgcgcgcacactctcgccctccgcctcgcccgcacccccgcgcacacacacactcgcacacacaatcgctcacccgcgccgaacgcccgcccgccgaccgctcgaactacgcgcaacgcgcgaactaaaccgacataaaaaaaaccgacgaaaacgaaaacgacgacgacgacgaaaaaaaaaaaaatcgcgactacaaacgccgctaaaactaccgccgaaactactacgacgaacgccgctaaaaaaaccgaaacccgaaccgaaatccgaacaaaaatcgaaaccgcaaccgaaacgcgaacgaaaaccgaaaccgcccgcgacgccgccgctatcccgacgaaaaccctcgccgaactcgaaaatacgaaaaacgcgataaaccgaacaaaacgctaaacgaaactaccgccgacgatcaaaacgcgcgaatatcgaaaaaccaaatccaaaaccgaacgcaaccaaccattcaaaaaaacaacgctaaaaaacgaaaaacaaccgacgaaaaaaatcacacactttactctttttattataccgataacgccgaac

SEQ ID NO: 31155 - DNA, 574 bp, Artificial Sequence
  chemically treated genomic DNA (Homo sapiens) CpG-island No: 31155
gtatggtttagggcgcgcgtatattttcgtttttcgtttcgttcgtattttcgcgtatatatatattcgtatatatagtcgtttattcgcgtcgggcgttcgttcgtcggtcgttcgggttacgcgtagcgcgcgggttgagtcgatatagaggaagtcggcgagggcggaggcggcggcggcggcggaggaggaggaggtcgcggttgtaggcgtcgttggagttgtcgtcggagttgttgcggcgagcgtcgttggaggagtcgggattcgggtcggagttcgagtaggagtcggggtcgtagtcggagcgcgagcggaggtcggggtcgttcgcggcgtcgtcgttgtttcggcgggagttttcgtcgggttcgggagtgcggggagcgcggtgagtcgagtagggcgttgggcgaggttgtcgtcggcgattagggcgcgcgggtgtcggggggttaggtttagggtcggacgtagttagttatttaggaaggtagcgttggagagcgggaggtagtcggcgaggaagattatatattttgttttttttgttgtgtcggtggcgtcgggt

SEQ ID NO: 31156 - DNA, 574 bp, Artificial Sequence
  chemically treated genomic DNA (Homo sapiens) CpG-island No: 31156
acccgacgccaccgacacaacaaaaaaaacaaaatatataatcttcctcgccgactacctcccgctctccaacgctaccttcctaaataactaactacgtccgaccctaaacctaaccccccgacacccgcgcgccctaatcgccgacgacaacctcgcccaacgccctactcgactcaccgcgctccccgcactcccgaacccgacgaaaactcccgccgaaacaacgacgacgccgcgaacgaccccgacctccgctcgcgctccgactacgaccccgactcctactcgaactccgacccgaatcccgactcctccaacgacgctcgccgcaacaactccgacgacaactccaacgacgcctacaaccgcgacctcctcctcctccgccgccgccgccgcctccgccctcgccgacttcctctatatcgactcaacccgcgcgctacgcgtaacccgaacgaccgacgaacgaacgcccgacgcgaataaacgactatatatacgaatatatatatacgcgaaaatacgaacgaaacgaaaaacgaaaatatacgcgcgccctaaaccatac

SEQ ID NO: 31157 - DNA, 1223 bp, Artificial Sequence
  chemically treated genomic DNA (Homo sapiens) CpG-island No: 31157
ggcgttttcggtcggcggatttcgtagtaacggcggtaacggcgacggcggcggcggtggcggtggcggtttttcgtcgaaagggttttcgggtttacgcgttttgtgcgttaggtgtagcgttaggggttttacggggatagtcgtttggggtacgttgcgttttagtattagcgtcggcgacggtttttttcgcgttttagcgttagtggcggtcgcggtttttttttttttcgtcgtttttttgtttttatattcgggcgggggcggttgttcggtcggtcggttcgtcgcggttaatagcgatttttttttagtagttatcgcgggcggattttttcgagaatgggcggcgggtatcggggcgcgagtagatatcgtttttttgttttagtcgttttagtcggggtggtttcgaggttagggaattcgattgttcgttttttcgtcgggatatcggtcggttttaattggggatagataattcgagagttcggcggtcgtggtcgtcgttgtcgtcgttcgtcgaggtcgcgtagcgttcggcgtgacgttttttttcgtatcgaacggagcgttaatcgttcgtcggtttcgtttttttcgcgacgtacgtttcgagttcgttattacgcgtcgggagtcgtagtcgggagtcgcgagtttttatttggcgtagggtagtcgcggaggcgtagtacgtcgaggtcgaggagttttattcgagttggggaggcgcgagtagttaaagttggtaattgttcgcggaggcgtggagacggcgaagaggggcggttcgagagtacggggcggggtttttttgaggagcgtgacgtggttatttatcgggtttttttttcgtcgggtttttcgcgggagttgacggattcgttcgttcgggtgtcgttcggttcgagggtttgtttcgttttagttgtttttcgagtgcgagggaggacgaaggggacgattttcggtttattggttgaggtcgtttcgattgtaggtttaggggcggagcgcgtattaggtttttgtggttcgcggttggttcgcggtttgttttcgcggcgacggcggttaagggtttgggcgggtcgcgtatatggcgttgggaggatcgagcgttcgatttgtttttaggttttaaagttgggtcgtagttaggttaagggaggggacgcggtgtcgattttcggtttggggtagtttttaagtgaagt

SEQ ID NO: 31158 - DNA, 1223 bp, Artificial Sequence
  chemically treated genomic DNA (Homo sapiens) CpG-island No: 31158
acttcacttaaaaactaccccaaaccgaaaatcgacaccgcgtcccctcccttaacctaactacgacccaactttaaaacctaaaaacaaatcgaacgctcgatcctcccaacgccatatacgcgacccgcccaaacccttaaccgccgtcgccgcgaaaacaaaccgcgaaccaaccgcgaaccacaaaaacctaatacgcgctccgcccctaaacctacaatcgaaacgacctcaaccaataaaccgaaaatcgtccccttcgtcctccctcgcactcgaaaaacaactaaaacgaaacaaaccctcgaaccgaacgacacccgaacgaacgaatccgtcaactcccgcgaaaaacccgacgaaaaaaaaacccgataaataaccacgtcacgctcctcaaaaaaaccccgccccgtactctcgaaccgcccctcttcgccgtctccacgcctccgcgaacaattaccaactttaactactcgcgcctccccaactcgaataaaactcctcgacctcgacgtactacgcctccgcgactaccctacgccaaataaaaactcgcgactcccgactacgactcccgacgcgtaataacgaactcgaaacgtacgtcgcgaaaaaaacgaaaccgacgaacgattaacgctccgttcgatacgaaaaaaaacgtcacgccgaacgctacgcgacctcgacgaacgacgacaacgacgaccacgaccgccgaactctcgaattatctatccccaattaaaaccgaccgatatcccgacgaaaaaacgaacaatcgaattccctaacctcgaaaccaccccgactaaaacgactaaaacaaaaaaacgatatctactcgcgccccgatacccgccgcccattctcgaaaaaatccgcccgcgataactactaaaaaaaaatcgctattaaccgcgacgaaccgaccgaccgaacaaccgcccccgcccgaatataaaaacaaaaaaacgacgaaaaaaaaaaaaaccgcgaccgccactaacgctaaaacgcgaaaaaaaccgtcgccgacgctaatactaaaacgcaacgtaccccaaacgactatccccgtaaaacccctaacgctacacctaacgcacaaaacgcgtaaacccgaaaaccctttcgacgaaaaaccgccaccgccaccgccgccgccgtcgccgttaccgccgttactacgaaatccgccgaccgaaaacgcc

SEQ ID NO: 31159 - DNA, 1223 bp, Artificial Sequence
  chemically treated genomic DNA (Homo sapiens) CpG-island No: 31159
attttatttgggagttgttttaggtcgggggtcgatatcgcgtttttttttttagtttagttgcgatttagttttagggtttaagggtaaatcgagcgttcggtttttttagcgttatgtgcgcggttcgtttaggtttttggtcgtcgtcgtcgcgggggtaggtcgcgagttagtcgcgagttatagaggtttggtgcgcgtttcgtttttgagtttgtagtcggggcggttttagttagtgagtcgggagtcgtttttttcgttttttttcgtattcggagggtagttggggcggggtagattttcgggtcgggcggtattcgggcgggcgaattcgttagttttcgcgggaggttcggcgagagaaggattcggtgagtagttacgttacgttttttagggaggtttcgtttcgtgttttcgggtcgttttttttcgtcgtttttacgttttcgcgggtagttattagttttggttgttcgcgtttttttaattcgggtaaagtttttcggtttcggcgtgttgcgttttcgcggttgttttgcgttaggtgagggttcgcggttttcggttgcggttttcggcgcgtggtggcgggttcggggcgtgcgtcgcggagaggacggggtcggcgggcggttggcgtttcgttcggtgcggggaggggcgttacgtcgggcgttgcgcggtttcggcgggcggcggtagcggcggttacggtcgtcgggttttcgggttgtttgtttttagttggagtcggtcggtgtttcggcggagagacgggtagtcgggttttttggtttcggggttatttcggttggggcggttggggtagagggacgatgtttattcgcgtttcgatgttcgtcgtttattttcgggaggattcgttcgcggtgattgttgagagggagtcgttgttggtcgcggcgaatcggtcggtcgagtagtcgttttcgttcgaatgtgagggtaaagaggcggcgagggaggagagggtcgcggtcgttattagcgttggggcgcggggagagtcgtcgtcggcgttggtgttgggacgtagcgtgttttaggcggttgttttcgtgaggtttttggcgttgtatttggcgtataaggcgcgtgggttcgggggttttttcggcggggagtcgttatcgttatcgtcgtcgtcgtcgtcgttgtcgtcgttgttgcgggattcgtcggtcgaggacgtt

SEQ ID NO: 31160 - DNA, 1223 bp, Artificial Sequence
  chemically treated genomic DNA (Homo sapiens) CpG-island No: 31160
aacgtcctcgaccgacgaatcccgcaacaacgacgacaacgacgacgacgacgacgataacgataacgactccccgccgaaaaaacccccgaacccacgcgccttatacgccaaatacaacgccaaaaacctcacgaaaacaaccgcctaaaacacgctacgtcccaacaccaacgccgacgacgactctccccgcgccccaacgctaataacgaccgcgaccctctcctccctcgccgcctctttaccctcacattcgaacgaaaacgactactcgaccgaccgattcgccgcgaccaacaacgactccctctcaacaatcaccgcgaacgaatcctcccgaaaataaacgacgaacatcgaaacgcgaataaacatcgtccctctaccccaaccgccccaaccgaaataaccccgaaaccaaaaaacccgactacccgtctctccgccgaaacaccgaccgactccaactaaaaacaaacaacccgaaaacccgacgaccgtaaccgccgctaccgccgcccgccgaaaccgcgcaacgcccgacgtaacgcccctccccgcaccgaacgaaacgccaaccgcccgccgaccccgtcctctccgcgacgcacgccccgaacccgccaccacgcgccgaaaaccgcaaccgaaaaccgcgaaccctcacctaacgcaaaacaaccgcgaaaacgcaacacgccgaaaccgaaaaactttacccgaattaaaaaaacgcgaacaaccaaaactaataactacccgcgaaaacgtaaaaacgacgaaaaaaaacgacccgaaaacacgaaacgaaacctccctaaaaaacgtaacgtaactactcaccgaatccttctctcgccgaacctcccgcgaaaactaacgaattcgcccgcccgaataccgcccgacccgaaaatctaccccgccccaactaccctccgaatacgaaaaaaaacgaaaaaaacgactcccgactcactaactaaaaccgccccgactacaaactcaaaaacgaaacgcgcaccaaacctctataactcgcgactaactcgcgacctacccccgcgacgacgacgaccaaaaacctaaacgaaccgcgcacataacgctaaaaaaaccgaacgctcgatttacccttaaaccctaaaactaaatcgcaactaaactaaaaaaaaaaacgcgatatcgacccccgacctaaaacaactcccaaataaaat

SEQ ID NO: 31161 - DNA, 655 bp, Artificial Sequence
  chemically treated genomic DNA (Homo sapiens) CpG-island No: 31161
gagcgtttttgcgggagatgggtaggttcgagtcggtagtgatagttcggggaggcgggggatagcgttaggggttttttagaagcggtcgggttattttacgttgaggttaggaagcgtttgttttgcgtttcgtattttgagtagagcgtttataggagacgcggaggggtagtggtattggaacgggggggtagtggcgtcggaaggggataagggggggtagtggcgtcggaaggggacgcgggggggtagtggcgttggaacgggggtagtggcgtcggaaggagacgtggaggggtagtggcgttggaaggagacgtgggggggtagtggcgtcggaacggggggtagtggcgttggaaggagacgcggaggggtagtggcgttggaaggagacgcggaggggtagtggcgtcggaaggagatacggaggggtagtggtgttggaatggagggtagtggcgtcggaacggggggtagtggcgttggaaggagacgcggaggggtagtggcgttggaaggagaaacggaggggtagtggcgttggaacgggggtagtggcgtcggaaggggacgcggaggggtagtggcgttggaaggagagattagggtcgcggggttgttttttgtaaagggttaagttgtgaggatt

SEQ ID NO: 31162 - DNA, 655 bp, Artificial Sequence
  chemically treated genomic DNA (Homo sapiens) CpG-island No: 31162
aatcctcacaacttaaccctttacaaaaaacaaccccgcgaccctaatctctccttccaacgccactacccctccgcgtccccttccgacgccactacccccgttccaacgccactacccctccgtttctccttccaacgccactacccctccgcgtctccttccaacgccactaccccccgttccgacgccactaccctccattccaacaccactacccctccgtatctccttccgacgccactacccctccgcgtctccttccaacgccactacccctccgcgtctccttccaacgccactaccccccgttccgacgccactacccccccacgtctccttccaacgccactacccctccacgtctccttccgacgccactacccccgttccaacgccactacccccccgcgtccccttccgacgccactacccccccttatccccttccgacgccactacccccccgttccaataccactacccctccgcgtctcctataaacgctctactcaaaatacgaaacgcaaaacaaacgcttcctaacctcaacgtaaaataacccgaccgcttctaaaaaacccctaacgctatcccccgcctccccgaactatcactaccgactcgaacctacccatctcccgcaaaaacgctc

SEQ ID NO: 31163 - DNA, 655 bp, Artificial Sequence
  chemically treated genomic DNA (Homo sapiens) CpG-island No: 31163
agtttttatagtttggttttttataagaagtagtttcgcggttttggtttttttttttaacgttattgttttttcgcgttttttttcgacgttattgttttcgttttaacgttattgttttttcgtttttttttttaacgttattgttttttcgcgtttttttttaacgttattgtttttcgtttcgacgttattgttttttattttaatattattgttttttcgtgttttttttcgacgttattgttttttcgcgtttttttttaacgttattgttttttcgcgtttttttttaacgttattgtttttcgtttcgacgttattgtttttttacgtttttttttaacgttattgtttttttacgttttttttcgacgttattgttttcgttttaacgttattgttttttcgcgttttttttcgacgttattgtttttttttgttttttttcgacgttattgttttttcgttttaatgttattgttttttcgcgttttttgtagacgttttgtttaggatgcggggcgtaggataggcgttttttggttttagcgtggggtggttcggtcgtttttggaagatttttggcgttgtttttcgttttttcgggttgttattgtcgattcgggtttgtttatttttcgtaggggcgttt

SEQ ID NO: 31164 - DNA, 655 bp, Artificial Sequence
  chemically treated genomic DNA (Homo sapiens) CpG-island No: 31164
aaacgcccctacgaaaaataaacaaacccgaatcgacaataacaacccgaaaaaacgaaaaacaacgccaaaaatcttccaaaaacgaccgaaccaccccacgctaaaaccaaaaaacgcctatcctacgccccgcatcctaaacaaaacgtctacaaaaaacgcgaaaaaacaataacattaaaacgaaaaaacaataacgtcgaaaaaaaacaaaaaaaaacaataacgtcgaaaaaaaacgcgaaaaaacaataacgttaaaacgaaaacaataacgtcgaaaaaaaacgtaaaaaaacaataacgttaaaaaaaaacgtaaaaaaacaataacgtcgaaacgaaaaacaataacgttaaaaaaaaacgcgaaaaaacaataacgttaaaaaaaaacgcgaaaaaacaataacgtcgaaaaaaaacacgaaaaaacaataatattaaaataaaaaacaataacgtcgaaacgaaaaacaataacgttaaaaaaaaacgcgaaaaaacaataacgttaaaaaaaaaaacgaaaaaacaataacgttaaaacgaaaacaataacgtcgaaaaaaaacgcgaaaaaacaataacgttaaaaaaaaaaaccaaaaccgcgaaactacttcttataaaaaaccaaactataaaaact

SEQ ID NO: 31165 - DNA, 1190 bp, Artificial Sequence
  chemically treated genomic DNA (Homo sapiens) CpG-island No: 31165
atttggttcggtatagcgatcgttttaagtttagaatcgttaagttagttcggggcgtttcggttttttcgtttcgcgtttcgttcgtttttagttcgggtttcgtcgttttcgtcgtttttgtcgttcgggtcgttttcgtcggttttggtttcggtttcgtacgtcggtagggggcgttcgagcgtagttaaaaggttcggcgggaggtcggcggttttagtggcggagcgcggttgtcggtgtgcggtcgggagcgatcgtcgcggggtaggggcgcggcgggtatcgcgtagagcgcgtagaatagacggacggcggcggggattcgacggcggcgtttcggtattttttagatttcggttagcgtttttttgttagtcgtaagtatttagtttcggtttatttcgggttttcgatggttttcgaggtcggggcgattttgcgcgcgtcgcgtcggttgttttgggcggcgttgttgtttttggtcgcgttgtttttcgtcgttttttcggcggcggttttaggtacgcgtcgcgttcgggttttcggcgttttttagtttttcgcgtatttttttgcgttcgggtttcgtcgtttcgtttagtgttggttacgggtcgtgttattagtttgtgcgttttcgttattcgcgggtcggggtatttggcgttttgtgtgggtggcgggagcggggacgtttcggtgttcggggatcgtagcgcgttggcgtttaattttgtcgtcgttcgttttggagtcgggaggttttagtcgtttaagtgtttcgggagatttaggtatagcggggaaaaaaggaaaagaaaggcgatttttagcgtgcggattggggtaatgtttttttttgtttagaatttttcgggagcgtaggtggttattttatttttttcgcgtttatttttcgcgaggtaggatgacgggcgtattcgggagatcggagggaggtagagtagggttgttttagaaggtcgtgggggaaaggttgcgagttgtcgtagggcgtcgggtgtttttgcgttttagaggagacgcgttttagtgttagttcggttttaggcggtaggaggttcgcgcgttcggggggaacgtttaagttgggagaaaatgtttgttttgagaggagggagagggaaatgagaaagttgattttagagaaattcgtttttttt

SEQ ID NO: 31166 - DNA, 1190 bp, Artificial Sequence
  chemically treated genomic DNA (Homo sapiens) CpG-island No: 31166
aaaaaaaacgaatttctctaaaatcaactttctcatttccctctccctcctctcaaaacaaacattttctcccaacttaaacgttccccccgaacgcgcgaacctcctaccgcctaaaaccgaactaacactaaaacgcgtctcctctaaaacgcaaaaacacccgacgccctacgacaactcgcaacctttcccccacgaccttctaaaacaaccctactctacctccctccgatctcccgaatacgcccgtcatcctacctcgcgaaaaataaacgcgaaaaaaataaaataaccacctacgctcccgaaaaattctaaacaaaaaaaaacattaccccaatccgcacgctaaaaatcgcctttcttttccttttttccccgctatacctaaatctcccgaaacacttaaacgactaaaacctcccgactccaaaacgaacgacgacaaaattaaacgccaacgcgctacgatccccgaacaccgaaacgtccccgctcccgccacccacacaaaacgccaaataccccgacccgcgaataacgaaaacgcacaaactaataacacgacccgtaaccaacactaaacgaaacgacgaaacccgaacgcaaaaaaatacgcgaaaaactaaaaaacgccgaaaacccgaacgcgacgcgtacctaaaaccgccgccgaaaaaacgacgaaaaacaacgcgaccaaaaacaacaacgccgcccaaaacaaccgacgcgacgcgcgcaaaatcgccccgacctcgaaaaccatcgaaaacccgaaataaaccgaaactaaatacttacgactaacaaaaaaacgctaaccgaaatctaaaaaataccgaaacgccgccgtcgaatccccgccgccgtccgtctattctacgcgctctacgcgatacccgccgcgcccctaccccgcgacgatcgctcccgaccgcacaccgacaaccgcgctccgccactaaaaccgccgacctcccgccgaaccttttaactacgctcgaacgccccctaccgacgtacgaaaccgaaaccaaaaccgacgaaaacgacccgaacgacaaaaacgacgaaaacgacgaaacccgaactaaaaacgaacgaaacgcgaaacgaaaaaaccgaaacgccccgaactaacttaacgattctaaacttaaaacgatcgctataccgaaccaaat

SEQ ID NO: 31167 - DNA, 1190 bp, Artificial Sequence
  chemically treated genomic DNA (Homo sapiens) CpG-island No: 31167
gggaagggcgagtttttttggaattagtttttttatttttttttttttttttttaagataaatatttttttttagtttgaacgtttttttcgggcgcgcgggttttttgtcgtttggagtcgagttggtattggagcgcgttttttttggagcgtagaggtattcgacgttttgcggtagttcgtagttttttttttacgattttttagaatagttttgttttgttttttttcggtttttcgagtgcgttcgttattttgtttcgcgagaggtgaacgcggagaaagtaggatgattatttacgttttcgagaaattttgggtaaagaaaggtattattttagttcgtacgttgaaagtcgtttttttttttttttttttttcgttgtgtttgaatttttcgggatatttagacggttggagtttttcgattttaaggcgggcgacggtaaagttaaacgttagcgcgttgcggttttcgggtatcgaggcgttttcgttttcgttatttatatagggcgttaagtgtttcgattcgcgagtgacgaggacgtataggttagtgatacgattcgtagttagtattgagcgggacgacggggttcgagcgtaggagggtgcgcggggagttgaggagcgtcgggggttcgggcgcggcgcgtatttggggtcgtcgtcgaggaggcgacggggagtagcgcggttaagagtagtagcgtcgtttaggatagtcggcgcggcgcgcgtagggtcgtttcggtttcgggggttatcgagagttcggggtgggtcggggttgggtgtttgcggttggtaggggggcgttggtcggagtttggggagtgtcgaggcgtcgtcgtcgggttttcgtcgtcgttcgtttgttttgcgcgttttgcgcggtgttcgtcgcgtttttgtttcgcggcgatcgttttcggtcgtatatcggtagtcgcgtttcgttattgaggtcgtcgatttttcgtcgagttttttagttgcgttcgggcgttttttgtcggcgtgcggggtcggggttagggtcggcgggggcgattcgggcgataggggcgacgggggcggcggggttcgggttggaggcgggcggggcgcgggacgaaggggtcggagcgtttcggattgatttagcggttttgaatttggggcggtcgttgtgtcgggttaagt

SEQ ID NO: 31168 - DNA, 1190 bp, Artificial Sequence
  chemically treated genomic DNA (Homo sapiens) CpG-island No: 31168
acttaacccgacacaacgaccgccccaaattcaaaaccgctaaatcaatccgaaacgctccgaccccttcgtcccgcgccccgcccgcctccaacccgaaccccgccgcccccgtcgcccctatcgcccgaatcgcccccgccgaccctaaccccgaccccgcacgccgacaaaaaacgcccgaacgcaactaaaaaactcgacgaaaaatcgacgacctcaataacgaaacgcgactaccgatatacgaccgaaaacgatcgccgcgaaacaaaaacgcgacgaacaccgcgcaaaacgcgcaaaacaaacgaacgacgacgaaaacccgacgacgacgcctcgacactccccaaactccgaccaacgcccccctaccaaccgcaaacacccaaccccgacccaccccgaactctcgataacccccgaaaccgaaacgaccctacgcgcgccgcgccgactatcctaaacgacgctactactcttaaccgcgctactccccgtcgcctcctcgacgacgaccccaaatacgcgccgcgcccgaacccccgacgctcctcaactccccgcgcaccctcctacgctcgaaccccgtcgtcccgctcaatactaactacgaatcgtatcactaacctatacgtcctcgtcactcgcgaatcgaaacacttaacgccctatataaataacgaaaacgaaaacgcctcgatacccgaaaaccgcaacgcgctaacgtttaactttaccgtcgcccgccttaaaatcgaaaaactccaaccgtctaaatatcccgaaaaattcaaacacaacgaaaaaaaaaaaaaaaaaaaaacgactttcaacgtacgaactaaaataatacctttctttacccaaaatttctcgaaaacgtaaataatcatcctactttctccgcgttcacctctcgcgaaacaaaataacgaacgcactcgaaaaaccgaaaaaaaacaaaacaaaactattctaaaaaatcgtaaaaaaaaaactacgaactaccgcaaaacgtcgaatacctctacgctccaaaaaaaacgcgctccaataccaactcgactccaaacgacaaaaaacccgcgcgcccgaaaaaaacgttcaaactaaaaaaaaatatttatcttaaaaaaaaaaaaaaaaaaataaaaaaactaattccaaaaaaactcgcccttccc

SEQ ID NO: 31169 - DNA, 1029 bp, Artificial Sequence
  chemically treated genomic DNA (Homo sapiens) CpG-island No: 31169
tgcgtttcgcgaattcggagttgcgaagtttcgtatcgaacggagatcggcggtagtaaaatgtacgtgggtatcgaatattcggggagggcgtttcgtcgtgttcggggtaattatatcgaaggtcgagcggcggttttacggtatcggtcgggtatcgtcggaggggtttaagtcggagttgggagagtcgcggtattttggagttcggcgggcgggagagtttcgttttatcgtttcgggattttttttagagggaagaaagcgttcgagggttacggcggtcggttcgtttagttttagcgtttcggggagtcgggttttggttcggttttcggcgttgggggcgcgcggtcgtttttagggagtcgcggatttaagttcgttttttcgtcggtttgttcgtcggggcgtttggcgcgtagtagcgcgaggggttacggggttcggaattcgaaggaggcggaacgatgggattgggggtcggggtttaggtgggatgggagtagggttgcggggtttttatcgttcggtttcgcgggttattatcgtcgtttcgtgcggttcgggtttttttattattgttttcggtcgtagtagaggcggtcgtcgcgcgtttggtttcgttttttttcgtcggttttatttcgtaaaggttgcggggagggtggcgcggtcgcgggtatatttgcgcgttcgtcgggttgttgtgggttcgttttttcgtttttgtatcgacgtcgtattttcgtttcgagtttttttgtgatttcgtgttttttggtcggagttttttatcgttttttggaacgtagttttttatatattttttttcgaggtgcgtagatagacgaattcgttttatttttttttttagtttagtgtaaattattgtttcggggcgggggtcgtaggcggcgggggtaggaaagtcgcgggtggatggtagaacgggagaggtgcgtgggtggtattttgattttaggagaaagaagtagaatattgttattgaatttatagttaagtgtt

SEQ ID NO: 31170 - DNA, 1029 bp, Artificial Sequence
  chemically treated genomic DNA (Homo sapiens) CpG-island No: 31170
aacacttaactataaattcaataacaatattctacttctttctcctaaaatcaaaataccacccacgcacctctcccgttctaccatccacccgcgactttcctacccccgccgcctacgacccccgccccgaaacaataatttacactaaactaaaaaaaaaaataaaacgaattcgtctatctacgcacctcgaaaaaaaatatataaaaaactacgttccaaaaaacgataaaaaactccgaccaaaaaacacgaaatcacaaaaaaactcgaaacgaaaatacgacgtcgatacaaaaacgaaaaaacgaacccacaacaacccgacgaacgcgcaaatatacccgcgaccgcgccaccctccccgcaacctttacgaaataaaaccgacgaaaaaaaacgaaaccaaacgcgcgacgaccgcctctactacgaccgaaaacaataataaaaaaacccgaaccgcacgaaacgacgataataacccgcgaaaccgaacgataaaaaccccgcaaccctactcccatcccacctaaaccccgacccccaatcccatcgttccgcctccttcgaattccgaaccccgtaacccctcgcgctactacgcgccaaacgccccgacgaacaaaccgacgaaaaaacgaacttaaatccgcgactccctaaaaacgaccgcgcgcccccaacgccgaaaaccgaaccaaaacccgactccccgaaacgctaaaactaaacgaaccgaccgccgtaaccctcgaacgctttcttccctctaaaaaaaatcccgaaacgataaaacgaaactctcccgcccgccgaactccaaaataccgcgactctcccaactccgacttaaacccctccgacgatacccgaccgataccgtaaaaccgccgctcgaccttcgatataattaccccgaacacgacgaaacgccctccccgaatattcgatacccacgtacattttactaccgccgatctccgttcgatacgaaacttcgcaactccgaattcgcgaaacgca

SEQ ID NO: 31171 - DNA, 1029 bp, Artificial Sequence
  chemically treated genomic DNA (Homo sapiens) CpG-island No: 31171
ggtatttaattataagtttagtgatagtattttgttttttttttttgaagttaaagtgttatttacgtatttttttcgttttgttatttattcgcggtttttttattttcgtcgtttgcggttttcgtttcggggtagtagtttgtattaggttgaagggagaggtggaacggattcgtttatttacgtatttcgaggaggggtgtgtgaggagttacgttttagagaacggtaagaaatttcggttaggaaatacgggattataggagaattcgaggcgaaggtgcggcgtcggtgtaggagcggaggggcggatttatagtagttcggcgagcgcgtaggtgtgttcgcggtcgcgttatttttttcgtagtttttacgggatggagtcggcgggagagggcggggttaggcgcgcggcggtcgtttttgttgcggtcggaaataatagtggaggaattcgagtcgtacggaacggcggtggtggttcgcggagtcggacggtaaagatttcgtagttttgtttttattttatttgagtttcgatttttagttttatcgtttcgtttttttcgagtttcgagtttcgtggtttttcgcgttgttgcgcgttaggcgtttcgacggatagatcgacggaaagacggatttgggttcgcgattttttgggggcggtcgcgcgtttttaacgtcgaaggtcgggttaggattcggtttttcgagacgttgaggttgggcggatcggtcgtcgtggttttcggacgtttttttttttttgggaggaatttcggagcgatgggacgaggttttttcgttcgtcgggttttaggatgtcgcggtttttttagtttcggtttgggttttttcggcggtgttcggtcggtatcgtgaagtcgtcgttcggttttcggtgtagttgtttcggatacggcgggacgtttttttcgggtattcggtatttacgtgtattttgttgtcgtcgattttcgttcgatgcgaagtttcgtaatttcgagttcgcgaggcgta

SEQ ID NO: 31172 - DNA, 1029 bp, Artificial Sequence
  chemically treated genomic DNA (Homo sapiens) CpG-island No: 31172
tacgcctcgcgaactcgaaattacgaaacttcgcatcgaacgaaaatcgacgacaacaaaatacacgtaaataccgaatacccgaaaaaaacgtcccgccgtatccgaaacaactacaccgaaaaccgaacgacgacttcacgataccgaccgaacaccgccgaaaaaacccaaaccgaaactaaaaaaaccgcgacatcctaaaacccgacgaacgaaaaaacctcgtcccatcgctccgaaattcctcccaaaaaaaaaaaaacgtccgaaaaccacgacgaccgatccgcccaacctcaacgtctcgaaaaaccgaatcctaacccgaccttcgacgttaaaaacgcgcgaccgcccccaaaaaatcgcgaacccaaatccgtctttccgtcgatctatccgtcgaaacgcctaacgcgcaacaacgcgaaaaaccacgaaactcgaaactcgaaaaaaacgaaacgataaaactaaaaatcgaaactcaaataaaataaaaacaaaactacgaaatctttaccgtccgactccgcgaaccaccaccgccgttccgtacgactcgaattcctccactattatttccgaccgcaacaaaaacgaccgccgcgcgcctaaccccgccctctcccgccgactccatcccgtaaaaactacgaaaaaaataacgcgaccgcgaacacacctacgcgctcgccgaactactataaatccgcccctccgctcctacaccgacgccgcaccttcgcctcgaattctcctataatcccgtatttcctaaccgaaatttcttaccgttctctaaaacgtaactcctcacacacccctcctcgaaatacgtaaataaacgaatccgttccacctctcccttcaacctaatacaaactactaccccgaaacgaaaaccgcaaacgacgaaaataaaaaaaccgcgaataaataacaaaacgaaaaaaatacgtaaataacactttaacttcaaaaaaaaaaaacaaaatactatcactaaacttataattaaatacc

SEQ ID NO: 31173 - DNA, 659 bp, Artificial Sequence
  chemically treated genomic DNA (Homo sapiens) CpG-island No: 31173
cgtaaatttgtcggattggtttcgtgttttttcgggtgtagtagcggttgtgggcgtcggggtaagcggttgcggttttttcgtttttttgcgtttttcggttttttcgttttttttcgtagtttttttttttagcgtttttttcgttttttcgtttttcgttttttttttcgttcgttttttagcgcgttttttagttcgtttttatttttttttttgttgttgttgtcgttgttgcggcgtcgttaggcgttcgtatttcggtcggttgcgttcgttggtcgttttcgtttcgttttttttttagttcggagttttcggttagatttagttttttttgtcgtttttttcgtttttttcggttcggacgtcgggtttcgtcgtagtaggagtaggggttgtcgtcgatttttttttcgtttgttcgtttgtcggagtagtagtcgaacgtcgcgcgtttggcggcggtttcggtcgggcggtcgttagtttatttttgttgcgtttcggatttcgggcggtttcgcggcgcgttgggttcgtagcgttagcgttgttcgtcgcggttcgggttttgggtatcgcgagaatcgtgttttcggtcgtcgattgtttgcgttttcggggtaggtcggtacgtagtcgatttttcgtcgcgg

SEQ ID NO: 31174 - DNA, 659 bp, Artificial Sequence
  chemically treated genomic DNA (Homo sapiens) CpG-island No: 31174
ccgcgacgaaaaatcgactacgtaccgacctaccccgaaaacgcaaacaatcgacgaccgaaaacacgattctcgcgatacccaaaacccgaaccgcgacgaacaacgctaacgctacgaacccaacgcgccgcgaaaccgcccgaaatccgaaacgcaacaaaaataaactaacgaccgcccgaccgaaaccgccgccaaacgcgcgacgttcgactactactccgacaaacgaacaaacgaaaaaaaaatcgacgacaacccctactcctactacgacgaaacccgacgtccgaaccgaaaaaaacgaaaaaaacgacaaaaaaaactaaatctaaccgaaaactccgaactaaaaaaaaaacgaaacgaaaacgaccaacgaacgcaaccgaccgaaatacgaacgcctaacgacgccgcaacaacgacaacaacaacaaaaaaaaaaataaaaacgaactaaaaaacgcgctaaaaaacgaacgaaaaaaaaaacgaaaaacgaaaaaacgaaaaaaacgctaaaaaaaaaaactacgaaaaaaaacgaaaaaaccgaaaaacgcaaaaaaacgaaaaaaccgcaaccgcttaccccgacgcccacaaccgctactacacccgaaaaaacacgaaaccaatccgacaaatttacg

SEQ ID NO: 31175 - DNA, 659 bp, Artificial Sequence
  chemically treated genomic DNA (Homo sapiens) CpG-island No: 31175
tcgcggcgaggggtcggttgcgtgtcggtttgtttcgggggcgtaggtagtcgacggtcggaggtacggttttcgcggtgtttagagttcgggtcgcggcgggtagcgttgacgttgcggatttagcgcgtcgcggagtcgttcggagttcgggacgtagtagggatgagttggcggtcgttcggtcggagtcgtcgttaagcgcgcggcgttcggttgttgtttcggtaagcgagtaagcgagagggagatcggcggtaatttttgtttttgttgcggcggagttcggcgttcgagtcggaaggagcgggagaggcggtaagaggagttgggtttggtcgagagtttcgggttgggaagggagcggagcgggagcgattagcgagcgtagtcggtcgaggtacgggcgtttggcggcgtcgtaatagcggtaatagtagtaggaaaaaaaatgagagcgagttagagagcgcgttggagagcgagcgagagagggagcgagagacgagagagcgaggaaggcgttgagaggggaggttgcgggagagggcgggagagtcgggaagcgtaagggggcgagggggtcgtagtcgtttgtttcggcgtttatagtcgttgttgtattcgaggaggtacgagattaattcggtaagtttgcg

SEQ ID NO: 31176 - DNA, 659 bp, Artificial Sequence
  chemically treated genomic DNA (Homo sapiens) CpG-island No: 31176
cgcaaacttaccgaattaatctcgtacctcctcgaatacaacaacgactataaacgccgaaacaaacgactacgaccccctcgcccccttacgcttcccgactctcccgccctctcccgcaacctcccctctcaacgccttcctcgctctctcgtctctcgctccctctctcgctcgctctccaacgcgctctctaactcgctctcattttttttcctactactattaccgctattacgacgccgccaaacgcccgtacctcgaccgactacgctcgctaatcgctcccgctccgctcccttcccaacccgaaactctcgaccaaacccaactcctcttaccgcctctcccgctccttccgactcgaacgccgaactccgccgcaacaaaaacaaaaattaccgccgatctccctctcgcttactcgcttaccgaaacaacaaccgaacgccgcgcgcttaacgacgactccgaccgaacgaccgccaactcatccctactacgtcccgaactccgaacgactccgcgacgcgctaaatccgcaacgtcaacgctacccgccgcgacccgaactctaaacaccgcgaaaaccgtacctccgaccgtcgactacctacgcccccgaaacaaaccgacacgcaaccgacccctcgccgcga

SEQ ID NO: 31177 - DNA, 913 bp, Artificial Sequence
  chemically treated genomic DNA (Homo sapiens) CpG-island No: 31177
  misc_feature (788)..(788): n is either a, c, g or t
agcgcgggcggggagtttttcgcgttttttacgttttcggcgattagcgtattgtagtagggtttgcgcggtttgtattttttttcggatcgtttgtaggatattaatcgttttaagcgttttttttttttggatattaagtttgtttacgtttttagtatgcggttcgacggtttcgggtttttcgatttcggcgaggtttcgaagttttgtaagttggatagttcgtcgggggtcgcgttgggtttgttttcgtttatttcggatagttcggacgtcgcgtttgatgcgcgtttacggtttcgtcggcggtttcggtttttcgtcggttttttcgcgcgttttttcgcgtatagtttcggtttgaatttcggcgatgcggttcggtagatttcgcggtacggtttttcggttttgtcggcgttcgggttgttcggttttggttagtcggtcggtttcggggtttgggtatcgtcgttcgattttttaggtacgtcgtcgttcgacgggttttggtgttttagtttcgagggcgtatagggggcgggcggggtgttgtttgcgtttttcggtcgggcgggcgtttcgggattaggcggcggtagcgatttgcggcggcgggaggtagcgagggttgagtttcgggacgcgcggatcggttggttcgaggagtcggtttcggagacgtagtttaagcgtcgtagttgttagatggagttcgaggagggtatggtggaggggcgcgcgcgcggcgaggagttggtcgttttgggtaagtaggtattttnttcgggtagcgtgggaggttatcgaggtgttttgattttttcgttgttttcggtttcgtcgttcgtagttaggttcgttataaatgtatattatatataatgtaaagaaaggtaaatggttttat

SEQ ID NO: 31178 - DNA, 913 bp, Artificial Sequence
  chemically treated genomic DNA (Homo sapiens) CpG-island No: 31178
  misc_feature (126)..(126): n is either a, c, g or t
ataaaaccatttacctttctttacattatatataatatacatttataacgaacctaactacgaacgacgaaaccgaaaacaacgaaaaaatcaaaacacctcgataacctcccacgctacccgaanaaaatacctacttacccaaaacgaccaactcctcgccgcgcgcgcgcccctccaccataccctcctcgaactccatctaacaactacgacgcttaaactacgtctccgaaaccgactcctcgaaccaaccgatccgcgcgtcccgaaactcaaccctcgctacctcccgccgccgcaaatcgctaccgccgcctaatcccgaaacgcccgcccgaccgaaaaacgcaaacaacaccccgcccgccccctatacgccctcgaaactaaaacaccaaaacccgtcgaacgacgacgtacctaaaaaatcgaacgacgatacccaaaccccgaaaccgaccgactaaccaaaaccgaacaacccgaacgccgacaaaaccgaaaaaccgtaccgcgaaatctaccgaaccgcatcgccgaaattcaaaccgaaactatacgcgaaaaaacgcgcgaaaaaaccgacgaaaaaccgaaaccgccgacgaaaccgtaaacgcgcatcaaacgcgacgtccgaactatccgaaataaacgaaaacaaacccaacgcgacccccgacgaactatccaacttacaaaacttcgaaacctcgccgaaatcgaaaaacccgaaaccgtcgaaccgcatactaaaaacgtaaacaaacttaatatccaaaaaaaaaaaacgcttaaaacgattaatatcctacaaacgatccgaaaaaaaatacaaaccgcgcaaaccctactacaatacgctaatcgccgaaaacgtaaaaaacgcgaaaaactccccgcccgcgct

SEQ ID NO: 31179 - DNA, 913 bp, Artificial Sequence
  chemically treated genomic DNA (Homo sapiens) CpG-island No: 31179
  misc_feature (126)..(126): n is either a, c, g or t
gtaaaattatttatttttttttgtattatatataatatatatttataacgggtttggttgcgggcggcggggtcgaggatagcggaggggttaggatatttcgatgattttttacgttgttcgagnaaagtgtttgtttgtttagggcggttagtttttcgtcgcgcgcgcgtttttttattatgtttttttcgaattttatttggtagttgcggcgtttgaattgcgttttcggggtcggtttttcgggttagtcggttcgcgcgtttcggggtttagttttcgttgtttttcgtcgtcgtaggtcgttgtcgtcgtttggtttcggggcgttcgttcggtcgaagggcgtaaatagtatttcgttcgttttttgtgcgttttcggggttgaagtattagggttcgtcgggcgacggcgtgtttggggagtcgagcggcggtgtttaggtttcggggtcggtcggttggttagggtcgggtagttcgggcgtcgatagggtcgagaggtcgtgtcgcggagtttgtcgggtcgtatcgtcgaagtttaggtcgaggttgtgcgcgggggagcgcgcgggggagtcggcggggggtcggggtcgtcggcggggtcgtgggcgcgtattaggcgcggcgttcgggttgttcgggatgggcgaggataggtttagcgcggttttcgacgggttgtttagtttgtagagtttcggggtttcgtcggggtcggggggttcggggtcgtcgggtcgtatgttaggggcgtaggtagatttgatgtttagggagaaggagcgtttgaggcggttagtgttttgtaggcggttcgaggagaggtgtaggtcgcgtaggttttgttgtagtgcgttggtcgtcgggggcgtggggggcgcggggggtttttcgttcgcgtt

SEQ ID NO: 31180 - DNA, 913 bp, Artificial Sequence
  chemically treated genomic DNA (Homo sapiens) CpG-island No: 31180
  misc_feature (788)..(788): n is either a, c, g or t
aacgcgaacgaaaaaccccccgcgccccccacgcccccgacgaccaacgcactacaacaaaacctacgcgacctacacctctcctcgaaccgcctacaaaacactaaccgcctcaaacgctccttctccctaaacatcaaatctacctacgcccctaacatacgacccgacgaccccgaaccccccgaccccgacgaaaccccgaaactctacaaactaaacaacccgtcgaaaaccgcgctaaacctatcctcgcccatcccgaacaacccgaacgccgcgcctaatacgcgcccacgaccccgccgacgaccccgaccccccgccgactcccccgcgcgctcccccgcgcacaacctcgacctaaacttcgacgatacgacccgacaaactccgcgacacgacctctcgaccctatcgacgcccgaactacccgaccctaaccaaccgaccgaccccgaaacctaaacaccgccgctcgactccccaaacacgccgtcgcccgacgaaccctaatacttcaaccccgaaaacgcacaaaaaacgaacgaaatactatttacgcccttcgaccgaacgaacgccccgaaaccaaacgacgacaacgacctacgacgacgaaaaacaacgaaaactaaaccccgaaacgcgcgaaccgactaacccgaaaaaccgaccccgaaaacgcaattcaaacgccgcaactaccaaataaaattcgaaaaaaacataataaaaaaacgcgcgcgcgacgaaaaactaaccgccctaaacaaacaaacactttnctcgaacaacgtaaaaaatcatcgaaatatcctaacccctccgctatcctcgaccccgccgcccgcaaccaaacccgttataaatatatattatatataatacaaaaaaaaataaataattttac

SEQ ID NO: 31181 - DNA, 548 bp, Artificial Sequence
  chemically treated genomic DNA (Homo sapiens) CpG-island No: 31181
taattattcgtgcgttttttttgtttcggattcgtcgcgttttcgtcgtacgcgcggaggtgtttttatagcggtcggcggggtgcggttttttaatagttcgtataggggtcgtcggggcggttttttacggaagcgggagggttgggggtcgtggggggtcggcggcgttttggggagttcgttttcggagttcgcggatgtgtgattcgaggtagtcggttcgtttttgagggttttaggttcgttcgagtgtagggggattcggtttcgttttgcgggggtcgcggcggggcgagtatagtcgttgtaggtaaaacgtcgcgtttgggtttggggagggtttttcggcggcggtttagcgttaataaaggttaggagaagggggggagcggcgtcggcgtttgttcgggtcggggggaggatttcgcgttcggagtcgtttagttggatcgttcggggtttgtgcgacgcggtcgggggttcgggtgacggggggtttgggtgacgcggggttcggggtcgggagggttttttggaggcggggt

SEQ ID NO: 31182 - DNA, 548 bp, Artificial Sequence
  chemically treated genomic DNA (Homo sapiens) CpG-island No: 31182
accccgcctccaaaaaaccctcccgaccccgaaccccgcgtcacccaaaccccccgtcacccgaacccccgaccgcgtcgcacaaaccccgaacgatccaactaaacgactccgaacgcgaaatcctccccccgacccgaacaaacgccgacgccgctcccccccttctcctaacctttattaacgctaaaccgccgccgaaaaaccctccccaaacccaaacgcgacgttttacctacaacgactatactcgccccgccgcgacccccgcaaaacgaaaccgaatccccctacactcgaacgaacctaaaaccctcaaaaacgaaccgactacctcgaatcacacatccgcgaactccgaaaacgaactccccaaaacgccgccgaccccccacgacccccaaccctcccgcttccgtaaaaaaccgccccgacgacccctatacgaactattaaaaaaccgcaccccgccgaccgctataaaaacacctccgcgcgtacgacgaaaacgcgacgaatccgaaacaaaaaaaacgcacgaataatta

SEQ ID NO: 31183 - DNA, 548 bp, Artificial Sequence
  chemically treated genomic DNA (Homo sapiens) CpG-island No: 31183
atttcgtttttaggaagttttttcggtttcgggtttcgcgttatttaggtttttcgttattcgggttttcggtcgcgtcgtatagatttcggacggtttagttgagcggtttcgggcgcgaagtttttttttcgattcggataggcgtcggcgtcgttttttttttttttttggtttttgttggcgttgggtcgtcgtcggggagttttttttagatttaggcgcggcgttttatttgtagcggttgtgttcgtttcgtcgcgattttcgtaggacggagtcggatttttttgtattcgggcggatttgggatttttagaggcgagtcggttgtttcgggttatatattcgcgaatttcgggggcgggttttttaggacgtcgtcgattttttacgatttttagttttttcgttttcgtggaaagtcgtttcgacgatttttgtgcgggttgttgaggggtcgtatttcgtcgatcgttgtgggaatattttcgcgcgtgcggcggggacgcggcgagttcggggtaggaagaacgtacgggtaattg

SEQ ID NO: 31184 - DNA, 548 bp, Artificial Sequence
  chemically treated genomic DNA (Homo sapiens) CpG-island No: 31184
caattacccgtacgttcttcctaccccgaactcgccgcgtccccgccgcacgcgcgaaaatattcccacaacgatcgacgaaatacgacccctcaacaacccgcacaaaaatcgtcgaaacgactttccacgaaaacgaaaaaactaaaaatcgtaaaaaatcgacgacgtcctaaaaaacccgcccccgaaattcgcgaatatataacccgaaacaaccgactcgcctctaaaaatcccaaatccgcccgaatacaaaaaaatccgactccgtcctacgaaaatcgcgacgaaacgaacacaaccgctacaaataaaacgccgcgcctaaatctaaaaaaaactccccgacgacgacccaacgccaacaaaaaccaaaaaaaaaaaaaaaacgacgccgacgcctatccgaatcgaaaaaaaaacttcgcgcccgaaaccgctcaactaaaccgtccgaaatctatacgacgcgaccgaaaacccgaataacgaaaaacctaaataacgcgaaacccgaaaccgaaaaaacttcctaaaaacgaaat

SEQ ID NO: 31185 - DNA, 783 bp, Artificial Sequence
  chemically treated genomic DNA (Homo sapiens) CpG-island No: 31185
  misc_feature (751)..(751): n is either a, c, g or t
tcggatcgatttcgggttagggttcgtttgtttcggttttggttttcgcgggggtgacgttcgggacgtcgggggttcgcgtatattcgcgttggattttatgcggttttggtgggttttggatttttgttttttttttattttatatttaaagaaggagttgcggggagaagggcggtaacgcggcgggcgggcgtgggttgggttcgggttcgtcgggcgttgcggggggcggggaaggggtttttttgtttttggcgttttggacggtcgtggtcgtttatttcggggtcgtttttttttttcgggcgtttatcgggtgtcgttgttttagcgttttagacgcggcgtttttcgtttttcggttcgggtcggtgaattttattttcggcgttttcgtttatttcgttcgcgttcgtttcgggggcgtttcggggattcgcgtcgcgtttagggcgttcgttcggtcgcgtcgtttatgggttcggcgggggttcgcgtagtcggggtaggggtcgggggagcgcgcgggtcgcgtcgtcgtcgtcgtcgtcgtcgtcgttaacgtcgcggggagcgttcgttcgggtcggggcgcgcgtattgcgggcgggtacgcgcgttcgcggcgcgtattttagtttcgcggttcggcgggcgcggtcgggaggtttcggcgcggttcgggttcgggttcgggttcgggttcgggcgttcggcgttcggcggggattttgtgagtattggttanagaggataggttattttattggtgtggttaag

SEQ ID NO: 31186 - DNA, 783 bp, Artificial Sequence
  chemically treated genomic DNA (Homo sapiens) CpG-island No: 31186
  misc_feature (33)..(33): n is either a, c, g or t
cttaaccacaccaataaaataacctatcctctntaaccaatactcacaaaatccccgccgaacgccgaacgcccgaacccgaacccgaacccgaacccgaaccgcgccgaaacctcccgaccgcgcccgccgaaccgcgaaactaaaatacgcgccgcgaacgcgcgtacccgcccgcaatacgcgcgccccgacccgaacgaacgctccccgcgacgttaacgacgacgacgacgacgacgacgacgcgacccgcgcgctcccccgacccctaccccgactacgcgaacccccgccgaacccataaacgacgcgaccgaacgaacgccctaaacgcgacgcgaatccccgaaacgcccccgaaacgaacgcgaacgaaataaacgaaaacgccgaaaataaaattcaccgacccgaaccgaaaaacgaaaaacgccgcgtctaaaacgctaaaacaacgacacccgataaacgcccgaaaaaaaaaaacgaccccgaaataaacgaccacgaccgtccaaaacgccaaaaacaaaaaaaccccttccccgccccccgcaacgcccgacgaacccgaacccaacccacgcccgcccgccgcgttaccgcccttctccccgcaactccttctttaaatataaaataaaaaaaaaacaaaaatccaaaacccaccaaaaccgcataaaatccaacgcgaatatacgcgaacccccgacgtcccgaacgtcacccccgcgaaaaccaaaaccgaaacaaacgaaccctaacccgaaatcgatccga

SEQ ID NO: 31187 - DNA, 783 bp, Artificial Sequence
  chemically treated genomic DNA (Homo sapiens) CpG-island No: 31187
  misc_feature (33)..(33): n is either a, c, g or t
tttggttatattagtaaggtagtttgttttttntgattagtgtttataaaattttcgtcggacgtcggacgttcgagttcgagttcgagttcgagttcgagtcgcgtcggaatttttcggtcgcgttcgtcgagtcgcggggttgggatgcgcgtcgcgagcgcgcgtgttcgttcgtagtgcgcgcgtttcggttcgagcgagcgtttttcgcggcgttggcggcggcgacggcggcgacggcgacgcggttcgcgcgttttttcggtttttgtttcggttgcgcgggttttcgtcgggtttatggacggcgcggtcgagcgggcgttttgagcgcggcgcgggttttcggagcgttttcgaggcgagcgcgagcgaggtgagcgggggcgtcggggatggggtttatcggttcgggtcggggggcggagggcgtcgcgtttggggcgttggggtagcggtattcggtgggcgttcgggaggaggaggcggtttcggaatgagcggttacggtcgtttaggacgttagggatagggaggtttttttttcgtttttcgtaacgttcggcggattcgggtttagtttacgttcgttcgtcgcgttgtcgttttttttttcgtagttttttttttgggtgtggaatgggggggggataaaaatttaggatttattagggtcgtatgagatttagcgcggatatgcgcgagttttcgacgtttcgaacgttattttcgcgggggttagaatcggagtaggcggattttggttcggagtcggttcgg

SEQ ID NO: 31188 - DNA, 783 bp, Artificial Sequence
  chemically treated genomic DNA (Homo sapiens) CpG-island No: 31188
  misc_feature (751)..(751): n is either a, c, g or t
ccgaaccgactccgaaccaaaatccgcctactccgattctaacccccgcgaaaataacgttcgaaacgtcgaaaactcgcgcatatccgcgctaaatctcatacgaccctaataaatcctaaatttttatcccccccccattccacacccaaaaaaaaaactacgaaaaaaaaaacgacaacgcgacgaacgaacgtaaactaaacccgaatccgccgaacgttacgaaaaacgaaaaaaaaacctccctatccctaacgtcctaaacgaccgtaaccgctcattccgaaaccgcctcctcctcccgaacgcccaccgaataccgctaccccaacgccccaaacgcgacgccctccgccccccgacccgaaccgataaaccccatccccgacgcccccgctcacctcgctcgcgctcgcctcgaaaacgctccgaaaacccgcgccgcgctcaaaacgcccgctcgaccgcgccgtccataaacccgacgaaaacccgcgcaaccgaaacaaaaaccgaaaaaacgcgcgaaccgcgtcgccgtcgccgccgtcgccgccgccaacgccgcgaaaaacgctcgctcgaaccgaaacgcgcgcactacgaacgaacacgcgcgctcgcgacgcgcatcccaaccccgcgactcgacgaacgcgaccgaaaaattccgacgcgactcgaactcgaactcgaactcgaactcgaacgtccgacgtccgacgaaaattttataaacactaatcanaaaaaacaaactaccttactaatataaccaaa

SEQ ID NO: 31189 - DNA, 519 bp, Artificial Sequence
  chemically treated genomic DNA (Homo sapiens) CpG-island No: 31189
tttagtcggggtagtagtcgagttttgggtcgtagtagggtcgcgggaggggcgcggggggtcgttgttttcgttatttttagttatggcggtcgcggtgacgtaggcgggtagggaaggcgcgggcgggcgaaagagagagcgcgagggaaggaggaaggaaggaggtatcgtcgtagcgggttgggtcgggttaggcggggagcgcggagtacggtatttttgtgatgaagattgcggttttttggtttttcggtggagaaaggtttgggcgtaggtcgttggttgaggttttcgcgtttcggtttttgggtttttttcgtcgtcgttttgtgattcgatcgcgcgtatttttagtaattttggtagtcgtttcgtttgttgattttcgttttttttttttttttagtttcgcgttcgttttttcgttttttttgttgacgcggcgttaggtttagattgatagatttggttcggttaaaattaaaaatttttgtattgaaaagaaaaaagggagag

SEQ ID NO: 31190 - DNA, 519 bp, Artificial Sequence
  chemically treated genomic DNA (Homo sapiens) CpG-island No: 31190
ctctcccttttttcttttcaatacaaaaatttttaattttaaccgaaccaaatctatcaatctaaacctaacgccgcgtcaacaaaaaaaacgaaaaaacgaacgcgaaactaaaaaaaaaaaaaaaacgaaaatcaacaaacgaaacgactaccaaaattactaaaaatacgcgcgatcgaatcacaaaacgacgacgaaaaaaacccaaaaaccgaaacgcgaaaacctcaaccaacgacctacgcccaaacctttctccaccgaaaaaccaaaaaaccgcaatcttcatcacaaaaataccgtactccgcgctccccgcctaacccgacccaacccgctacgacgatacctccttccttcctccttccctcgcgctctctctttcgcccgcccgcgccttccctacccgcctacgtcaccgcgaccgccataactaaaaataacgaaaacaacgaccccccgcgcccctcccgcgaccctactacgacccaaaactcgactactaccccgactaaa

SEQ ID NO: 31191 - DNA, 519 bp, Artificial Sequence
  chemically treated genomic DNA (Homo sapiens) CpG-island No: 31191
tttttttttttttttttttagtgtagaagtttttaattttgatcgagttaaatttattaatttaggtttggcgtcgcgttagtagagggggcggggaggcgagcgcggaattgggggaggggaaggggcggggattagtaggcggagcggttgttagagttgttgggagtgcgcgcggtcggattataaggcggcggcggaggaggtttagagatcggagcgcggagattttagttagcggtttacgtttaggtttttttttatcggaggattagggaatcgtagtttttattatagaggtatcgtgtttcgcgtttttcgtttgattcggtttagttcgttgcggcggtgttttttttttttttttttttttcgcgttttttttttcgttcgttcgcgttttttttgttcgtttgcgttatcgcggtcgttatggttgagaatggcgagagtagcggtttttcgcgtttttttcgcggttttgttgcggtttaaggttcggttgttgtttcggttgag

SEQ ID NO: 31192 - DNA, 519 bp, Artificial Sequence
  chemically treated genomic DNA (Homo sapiens) CpG-island No: 31192
ctcaaccgaaacaacaaccgaaccttaaaccgcaacaaaaccgcgaaaaaaacgcgaaaaaccgctactctcgccattctcaaccataacgaccgcgataacgcaaacgaacaaaaaaaacgcgaacgaacgaaaaaaaaaacgcgaaaaaaaaaaaaaaaaaaaaaacaccgccgcaacgaactaaaccgaatcaaacgaaaaacgcgaaacacgatacctctataataaaaactacgattccctaatcctccgataaaaaaaaacctaaacgtaaaccgctaactaaaatctccgcgctccgatctctaaacctcctccgccgccgccttataatccgaccgcgcgcactcccaacaactctaacaaccgctccgcctactaatccccgccccttcccctcccccaattccgcgctcgcctccccgccccctctactaacgcgacgccaaacctaaattaataaatttaactcgatcaaaattaaaaacttctacactaaaaaaaaaaaaaaaaaaa

SEQ ID NO: 31193 - DNA, 689 bp, Artificial Sequence
  chemically treated genomic DNA (Homo sapiens) CpG-island No: 31193
gatatcgtaaatttttagtcgttggtcgtttgggatttttttatcggaagtgaaatcgaagaaaacgttacgtcgaaggcgtgggttgtcgtaagtgcgtcgtcgttacgcgtttagttttcggcgatgggtggttttgggattcggaggggaggcggggtggaggcggggtttggggttgtggagaggttgtggtaggtaggtgggtatagatcgaggggattacgggtcggcgttgggtttagtgggttcgaaataaagggttgttcggtggggattcgtcgcggcgttttttgagtggtcgggtcgaggtttttcggtttagtagtgttttcgttgcgcgattttaggcgggtttttttcggtttcgcgtagttcgcgtcgcggtgggggattcggcgtagcggtatttgttgtagagggatttcgcggttcgtttcggtgttcgtgatggggttgattttcgttaaattgtggagttttttttgtaattaaggtgagaagaatggagttgcgcggcggttcgaattcgaggtagagggtttcgtcgtcgatggggatatcggagataggggatagagcgttcggagacgcggaggaggaagggatttaggttagggggcgggtagaaatttagtgttttagatttggaggacgtataggagagatttgacgtgtgggagaaatag

SEQ ID NO: 31194 - DNA, 689 bp, Artificial Sequence
  chemically treated genomic DNA (Homo sapiens) CpG-island No: 31194
ctatttctcccacacgtcaaatctctcctatacgtcctccaaatctaaaacactaaatttctacccgccccctaacctaaatcccttcctcctccgcgtctccgaacgctctatcccctatctccgatatccccatcgacgacgaaaccctctacctcgaattcgaaccgccgcgcaactccattcttctcaccttaattacaaaaaaaactccacaatttaacgaaaatcaaccccatcacgaacaccgaaacgaaccgcgaaatccctctacaacaaataccgctacgccgaatcccccaccgcgacgcgaactacgcgaaaccgaaaaaaacccgcctaaaatcgcgcaacgaaaacactactaaaccgaaaaacctcgacccgaccactcaaaaaacgccgcgacgaatccccaccgaacaaccctttatttcgaacccactaaacccaacgccgacccgtaatcccctcgatctatacccacctacctaccacaacctctccacaaccccaaaccccgcctccaccccgcctcccctccgaatcccaaaaccacccatcgccgaaaactaaacgcgtaacgacgacgcacttacgacaacccacgccttcgacgtaacgttttcttcgatttcacttccgataaaaaaatcccaaacgaccaacgactaaaaatttacgatatc

SEQ ID NO: 31195 - DNA, 689 bp, Artificial Sequence
  chemically treated genomic DNA (Homo sapiens) CpG-island No: 31195
ttattttttttatacgttaggttttttttgtacgttttttaggtttaaaatattgagtttttgttcgttttttggtttaagtttttttttttttcgcgttttcgaacgttttgttttttgttttcggtgtttttatcggcggcgggattttttgtttcggattcgagtcgtcgcgtagttttattttttttattttggttatagaagaggttttatagtttggcgaagattagttttattacgagtatcggggcgggtcgcggggtttttttgtagtaggtgtcgttgcgtcgggttttttatcgcggcgcgggttgcgcggagtcgaggagaattcgtttgagatcgcgtagcgagggtattgttaggtcgagaagtttcgattcgattatttagaaggcgtcgcgacgaatttttatcggatagttttttgtttcgagtttattgagtttaacgtcgattcgtagttttttcggtttgtatttatttatttattatagtttttttatagttttaagtttcgtttttatttcgtttttttttcggattttaggattatttatcgtcggaagttaggcgcgtgacgacggcgtatttacggtaatttacgttttcgacgtggcgtttttttcggttttattttcggtaggagagttttaaacggttagcggttgggaatttgcggtatt

SEQ ID NO: 31196 - DNA, 689 bp, Artificial Sequence
  chemically treated genomic DNA (Homo sapiens) CpG-island No: 31196
aataccgcaaattcccaaccgctaaccgtttaaaactctcctaccgaaaataaaaccgaaaaaaacgccacgtcgaaaacgtaaattaccgtaaatacgccgtcgtcacgcgcctaacttccgacgataaataatcctaaaatccgaaaaaaaaacgaaataaaaacgaaacttaaaactataaaaaaactataataaataaataaatacaaaccgaaaaaactacgaatcgacgttaaactcaataaactcgaaacaaaaaactatccgataaaaattcgtcgcgacgccttctaaataatcgaatcgaaacttctcgacctaacaataccctcgctacgcgatctcaaacgaattctcctcgactccgcgcaacccgcgccgcgataaaaaacccgacgcaacgacacctactacaaaaaaaccccgcgacccgccccgatactcgtaataaaactaatcttcgccaaactataaaacctcttctataaccaaaataaaaaaaataaaactacgcgacgactcgaatccgaaacaaaaaatcccgccgccgataaaaacaccgaaaacaaaaaacaaaacgttcgaaaacgcgaaaaaaaaaaaaacttaaaccaaaaaacgaacaaaaactcaatattttaaacctaaaaaacgtacaaaaaaaacctaacgtataaaaaaaataa

SEQ ID NO: 31197 - DNA, 660 bp, Artificial Sequence
  chemically treated genomic DNA (Homo sapiens) CpG-island No: 31197
  misc_feature (261)..(261): n is either a, c, g or t
  misc_feature (309)..(309): n is either a, c, g or t
tcgacgcggtcgcggttgggataattttaggtcgggcgtagttgatcgtcgcgttttgcgcgcgagcgagtagtcgttttaatttgtcgcggtcgtcgatttcgtttttcgggagcgcgggttaggttaatgggttgggttttaaggggcggggtaggcggtcggcgtagtcgtggcggtagttgtaaaggcggcggtcgttgtggtggtggtggtggtggtgtttgtggttgcggttgttattggtcgggtgtttgcggntcgtgggggatgggggcggcgagttttagttttcggcggtggcggcgnttgtaggtgtggggcggtcgttcgcgttcgggacgcgggatggagcgtcgtggtgagtgtgaggaggtggcgttcgtttcggtcgcggcggtggtggtttcgggttggggtcgttcgcgcgggcgtcggttagttgtcgtttagggttcggtaggggttaggggcgcgttcggcgaggtaggcgcggacgagcgagaggacgcgggcgggcgttgtcggtacgtcgcggatttcgggtgcgcgttttgagttgtgtgacgtcggcgggtagtaggggagaagttggtcgggtggatttttttttttttataggatttttcgagcgtgttttagtttcgttttttttgttag

SEQ ID NO: 31198 - DNA, 660 bp, Artificial Sequence
  chemically treated genomic DNA (Homo sapiens) CpG-island No: 31198
  misc_feature (352)..(352): n is either a, c, g or t
  misc_feature (400)..(400): n is either a, c, g or t
ctaacaaaaaaaacgaaactaaaacacgctcgaaaaatcctataaaaaaaaaaaaatccacccgaccaacttctcccctactacccgccgacgtcacacaactcaaaacgcgcacccgaaatccgcgacgtaccgacaacgcccgcccgcgtcctctcgctcgtccgcgcctacctcgccgaacgcgcccctaacccctaccgaaccctaaacgacaactaaccgacgcccgcgcgaacgaccccaacccgaaaccaccaccgccgcgaccgaaacgaacgccacctcctcacactcaccacgacgctccatcccgcgtcccgaacgcgaacgaccgccccacacctacaancgccgccaccgccgaaaactaaaactcgccgcccccatcccccacganccgcaaacacccgaccaataacaaccgcaaccacaaacaccaccaccaccaccaccacaacgaccgccgcctttacaactaccgccacgactacgccgaccgcctaccccgccccttaaaacccaacccattaacctaacccgcgctcccgaaaaacgaaatcgacgaccgcgacaaattaaaacgactactcgctcgcgcgcaaaacgcgacgatcaactacgcccgacctaaaattatcccaaccgcgaccgcgtcga

SEQ ID NO: 31199 - DNA, 660 bp, Artificial Sequence
  chemically treated genomic DNA (Homo sapiens) CpG-island No: 31199
  misc_feature (352)..(352): n is either a, c, g or t
  misc_feature (400)..(400): n is either a, c, g or t
ttagtaaagggagcggggttgagatacgttcggggagttttgtaaggggaggaaagtttattcggttagttttttttttgttgttcgtcggcgttatataatttagagcgcgtattcggggttcgcggcgtatcggtagcgttcgttcgcgttttttcgttcgttcgcgtttgtttcgtcgggcgcgtttttagtttttgtcggattttggacggtaattagtcggcgttcgcgcgggcgattttagttcggagttattatcgtcgcggtcgaagcgagcgttatttttttatatttattacggcgttttatttcgcgtttcggacgcggacggtcgttttatatttatagncgtcgttatcgtcgagggttggagttcgtcgtttttattttttacggntcgtagatattcggttagtggtagtcgtagttatagatattattattattattattatagcggtcgtcgtttttgtagttatcgttacggttgcgtcggtcgtttgtttcgttttttggagtttagtttattggtttggttcgcgttttcggggggcggggtcggcgatcgcggtaggttggggcggttgttcgttcgcgcgtagaacgcggcggttagttgcgttcggtttgaagttgttttaatcgcggtcgcgtcgg

SEQ ID NO: 31200 - DNA, 660 bp, Artificial Sequence
  chemically treated genomic DNA (Homo sapiens) CpG-island No: 31200
  misc_feature (261)..(261): n is either a, c, g or t
  misc_feature (309)..(309): n is either a, c, g or t
ccgacgcgaccgcgattaaaacaacttcaaaccgaacgcaactaaccgccgcgttctacgcgcgaacgaacaaccgccccaacctaccgcgatcgccgaccccgccccccgaaaacgcgaaccaaaccaataaactaaactccaaaaaacgaaacaaacgaccgacgcaaccgtaacgataactacaaaaacgacgaccgctataataataataataataatatctataactacgactaccactaaccgaatatctacganccgtaaaaaataaaaacgacgaactccaaccctcgacgataacgacgnctataaatataaaacgaccgtccgcgtccgaaacgcgaaataaaacgccgtaataaatataaaaaaataacgctcgcttcgaccgcgacgataataactccgaactaaaatcgcccgcgcgaacgccgactaattaccgtccaaaatccgacaaaaactaaaaacgcgcccgacgaaacaaacgcgaacgaacgaaaaaacgcgaacgaacgctaccgatacgccgcgaaccccgaatacgcgctctaaattatataacgccgacgaacaacaaaaaaaaaactaaccgaataaactttcctccccttacaaaactccccgaacgtatctcaaccccgctccctttactaa

SEQ ID NO: 31201 - DNA, 548 bp, Artificial Sequence
  chemically treated genomic DNA (Homo sapiens) CpG-island No: 31201
ggtttcgtattcggtttttttacggtagtcgtcgcgttgtttttaggcgatttatagattttgtttttttttttttttgtcgcggtttcgcgtttttaacgtcgtcgtcgtcgtcgtcgtcgtcgttatcgtcgtcgttatttttaaattatcgagcgttgggaaagcgtgggatagagcgtttttcgtttttcgtttttcgtttttcgttcggtagttattttcgtcgcggggaaggagggtttttcggttgtcgtttcgttttgtcgcgtcgcgtttttcgttttcgttttcgttttttcgtagggtgggttttttagtgtttattttatttgtcggttatcgttgtttgaggtttttcgtttttcgcgttttgtcgtcgtatttcggcgtttttttttttaattcgtttcggtcgattttttttcgcgttcggttttatacgttatcgtttttggggttggtcggttttcggttttttttattttatttttatttgttaaatgagtgagtcgagggtttagtgttatcgcgtgcgtagtttaggt

SEQ ID NO: 31202 - DNA, 548 bp, Artificial Sequence
  chemically treated genomic DNA (Homo sapiens) CpG-island No: 31202
acctaaactacgcacgcgataacactaaaccctcgactcactcatttaacaaataaaaataaaataaaaaaaaccgaaaaccgaccaaccccaaaaacgataacgtataaaaccgaacgcgaaaaaaaatcgaccgaaacgaattaaaaaaaaaaacgccgaaatacgacgacaaaacgcgaaaaacgaaaaacctcaaacaacgataaccgacaaataaaataaacactaaaaaacccaccctacgaaaaaacgaaaacgaaaacgaaaaacgcgacgcgacaaaacgaaacgacaaccgaaaaaccctccttccccgcgacgaaaataactaccgaacgaaaaacgaaaaacgaaaaacgaaaaacgctctatcccacgctttcccaacgctcgataatttaaaaataacgacgacgataacgacgacgacgacgacgacgacgacgttaaaaacgcgaaaccgcgacaaaaaaaaaaaaaaacaaaatctataaatcgcctaaaaacaacgcgacgactaccgtaaaaaaaccgaatacgaaacc

SEQ ID NO: 31203 - DNA, 548 bp, Artificial Sequence
  chemically treated genomic DNA (Homo sapiens) CpG-island No: 31203
atttgagttgcgtacgcggtggtattgagttttcgatttatttatttgataggtggaggtgggatggggaaggtcggagatcgattaattttaaaggcggtagcgtgtggagtcgaacgcgggagggggtcggtcgaggcggattgaggggggggacgtcgaggtgcggcgataggacgcggaggacgaaagattttaagtagcggtggtcggtaaatgaggtgggtattgggggatttattttgcgaggaggcgggggcggggacggggggcgcggcgcggtagggcggggcggtagtcgggaagtttttttttttcgcggcggaggtgattgtcgggcggggggcggggggcggggggcgggagacgttttgttttacgtttttttagcgttcggtggtttaaagatggcggcggcggtggcggcggcggcggcggcggcggcggcgttgggggcgcggagtcgcgataggaggagggaaaagtagaatttgtgagtcgtttggaggtagcgcggcggttgtcgtgaggaggtcgggtgcggagtt

SEQ ID NO: 31204 - DNA, 548 bp, Artificial Sequence
  chemically treated genomic DNA (Homo sapiens) CpG-island No: 31204
aactccgcacccgacctcctcacgacaaccgccgcgctacctccaaacgactcacaaattctacttttccctcctcctatcgcgactccgcgcccccaacgccgccgccgccgccgccgccgccgccaccgccgccgccatctttaaaccaccgaacgctaaaaaaacgtaaaacaaaacgtctcccgccccccgccccccgccccccgcccgacaatcacctccgccgcgaaaaaaaaaaacttcccgactaccgccccgccctaccgcgccgcgccccccgtccccgcccccgcctcctcgcaaaataaatcccccaatacccacctcatttaccgaccaccgctacttaaaatctttcgtcctccgcgtcctatcgccgcacctcgacgtcccccccctcaatccgcctcgaccgaccccctcccgcgttcgactccacacgctaccgcctttaaaattaatcgatctccgaccttccccatcccacctccacctatcaaataaataaatcgaaaactcaataccaccgcgtacgcaactcaaat

SEQ ID NO: 31205 - DNA, 527 bp, Artificial Sequence
  chemically treated genomic DNA (Homo sapiens) CpG-island No: 31205
gtagcgcgggatacggaaggtggaagcggggcggtatttttcggagaaagttggcgattatttgttcgaaggggtatttgtatatttggtgtatatttatcgagatttttattttcgcgcgtcgcgggtttcgcgtatcggttacgttttcgcgagtttagagttgtttagggtttcgtagaggttcggaggcgtttatattcggatagttatatgggcgtggtttttttttttcgttttttaaattttcgaaattttattggttattcggagaaacgcgtagtcggttacgtttacgtttttattgttagagttcggggtttggggttatagagcgcgggaggcgttggagcgtttttagagtattcggggtttcgcggtttttacgttggcggcgttagagcggttttggtgttttttcgcggtcgcgtttgtcgagaaaagtttttttgtttgggagttattacgtttcgttttaggaaatttggattttgggtttatgcgtttatggtattatcgtttggagt

SEQ ID NO: 31206 - DNA, 527 bp, Artificial Sequence
  chemically treated genomic DNA (Homo sapiens) CpG-island No: 31206
actccaaacgataataccataaacgcataaacccaaaatccaaatttcctaaaacgaaacgtaataactcccaaacaaaaaaacttttctcgacaaacgcgaccgcgaaaaaacaccaaaaccgctctaacgccgccaacgtaaaaaccgcgaaaccccgaatactctaaaaacgctccaacgcctcccgcgctctataaccccaaaccccgaactctaacaataaaaacgtaaacgtaaccgactacgcgtttctccgaataaccaataaaatttcgaaaatttaaaaaacgaaaaaaaaaaaccacgcccatataactatccgaatataaacgcctccgaacctctacgaaaccctaaacaactctaaactcgcgaaaacgtaaccgatacgcgaaacccgcgacgcgcgaaaataaaaatctcgataaatatacaccaaatatacaaataccccttcgaacaaataatcgccaactttctccgaaaaataccgccccgcttccaccttccgtatcccgcgctac

SEQ ID NO: 31207 - DNA, 527 bp, Artificial Sequence
  chemically treated genomic DNA (Homo sapiens) CpG-island No: 31207
attttaggcggtgatattataaacgtataagtttaaggtttaggttttttggggcggggcgtgatggtttttaggtagagaagtttttttcggtaggcgcggtcgcgggagggtattagggtcgttttggcgtcgttagcgtggagatcgcggggtttcgggtgttttgggagcgttttagcgtttttcgcgttttgtaattttaggtttcggattttggtagtaggggcgtgggcgtggtcgattgcgcgttttttcgagtggttaataaagtttcgaaagtttgaaaagcggaggaaaaaggttacgtttatgtggttgttcgagtgtgggcgttttcgggtttttgcggagttttgggtagttttgagttcgcggaggcgtggtcggtgcgcggggttcgcggcgcgcggggatgggggtttcggtggatgtgtattaggtgtataagtattttttcgagtaggtggtcgttagtttttttcgaaaggtatcgtttcgtttttatttttcgtatttcgcgttgt

SEQ ID NO: 31208 - DNA, 527 bp, Artificial Sequence
  chemically treated genomic DNA (Homo sapiens) CpG-island No: 31208
acaacgcgaaatacgaaaaataaaaacgaaacgatacctttcgaaaaaaactaacgaccacctactcgaaaaaatacttatacacctaatacacatccaccgaaacccccatccccgcgcgccgcgaaccccgcgcaccgaccacgcctccgcgaactcaaaactacccaaaactccgcaaaaacccgaaaacgcccacactcgaacaaccacataaacgtaacctttttcctccgcttttcaaactttcgaaactttattaaccactcgaaaaaacgcgcaatcgaccacgcccacgcccctactaccaaaatccgaaacctaaaattacaaaacgcgaaaaacgctaaaacgctcccaaaacacccgaaaccccgcgatctccacgctaacgacgccaaaacgaccctaataccctcccgcgaccgcgcctaccgaaaaaaacttctctacctaaaaaccatcacgccccgccccaaaaaacctaaaccttaaacttatacgtttataatatcaccgcctaaaat

SEQ ID NO: 31209 - DNA, 1478 bp, Artificial Sequence
  chemically treated genomic DNA (Homo sapiens) CpG-island No: 31209
tgatttttcgttcggttagggttcggtatcgttcgcggatgcgcgttttttttttgtagttagtttatttcgagggttttcgcgcgggcggtcgtatttatttatgttgacgaagtttatgattaggtcggcgcggtttaggcgttgtttcgcgggcgcgtcgttttcgtcgtcgtcgttagttatggcgtggtataggtttagtatgaagagcggcgcggacgcgggtagtcgggaggcggcgggtggcgcgcggggtcggggtcgttcgggtagttcgagtatcgttaggatttcgcgttgtacgtttcggcgttcgcgcgcgtttagacgtcgttggggatagtcgggcgggggtcgtaggtcggggtcgttttcgtttagcgcgtataacgttaggtttagaagttagagcggttcggggcgcgcggttatggcgggtcgggggcgtttagcgggcgtatattagtttcgtcgtcgtttttgggttcggggacgtttcgacggcgaacggggagttgagttcggcgagtagggggcggggttcggcgggcggcgtttgcggttttagcgcggtttttggagcgtttttcgcgcgtatttgtttcggtttcgggataagcggacgttgacgcggacgtagacgttaacgtttcgaggtcggggttgttttgagggttgggattgttagttaattcgtttgtcgtcgtcgtttttattagttcggttgtggttgcggttcgcgtagcgtaggggcgatcggcgagtttcggtagcgattcgggcggcgcgattttcgcgagtttttgtttcggtttagtcgtttgtgtcgttcgtttattttcgggattgattaatgggggcgcgggggcggggtttgggcgcggaggtcgcgttcgttaggagtttcgggcggcggtaggtgttgcgggtggggcgatttcgaggtgcgatttcggcgtggttggcggttggttcgggcgaggagttcgtagtttgggcgttagcgtggttagggtcgtcgtggttttcgtcgcgggtttcggcgtagagattttaaggtcgcggcgtcgtttcggtttcgttagtggtgttattcggttgtttcgtcgtggtgtgtcgtggtcgttatcgggttcgatacgcggtcgtagtttcgtttggagagtcgggcggtgttagttaagtttcgcgggtggggtttgtttttttgttcgtagtagtcggttcgggtttcggttatcgcggttttttatcgttttttggcgtttttttcgtggtttttgtatgcgtttttgcgggcgtttttttttcggtatttgttcggttgtttttttttgcgttttttatttggttttcgcgtgagtttaggtagcgttttagtcgggtcgttttcgttagttttagttgtgcgttttgcgttttcggtattgatttagttttgcggaggaggtttcgttttttgtttttagttgggt

SEQ ID NO: 31210 - DNA, 1478 bp, Artificial Sequence
  chemically treated genomic DNA (Homo sapiens) CpG-island No: 31210
acccaactaaaaacaaaaaacgaaacctcctccgcaaaactaaatcaataccgaaaacgcaaaacgcacaactaaaactaacgaaaacgacccgactaaaacgctacctaaactcacgcgaaaaccaaataaaaaacgcaaaaaaaaacaaccgaacaaataccgaaaaaaaaacgcccgcaaaaacgcatacaaaaaccacgaaaaaaacgccaaaaaacgataaaaaaccgcgataaccgaaacccgaaccgactactacgaacaaaaaaacaaaccccacccgcgaaacttaactaacaccgcccgactctccaaacgaaactacgaccgcgtatcgaacccgataacgaccacgacacaccacgacgaaacaaccgaataacaccactaacgaaaccgaaacgacgccgcgaccttaaaatctctacgccgaaacccgcgacgaaaaccacgacgaccctaaccacgctaacgcccaaactacgaactcctcgcccgaaccaaccgccaaccacgccgaaatcgcacctcgaaatcgccccacccgcaacacctaccgccgcccgaaactcctaacgaacgcgacctccgcgcccaaaccccgcccccgcgcccccattaatcaatcccgaaaataaacgaacgacacaaacgactaaaccgaaacaaaaactcgcgaaaatcgcgccgcccgaatcgctaccgaaactcgccgatcgcccctacgctacgcgaaccgcaaccacaaccgaactaataaaaacgacgacgacaaacgaattaactaacaatcccaaccctcaaaacaaccccgacctcgaaacgttaacgtctacgtccgcgtcaacgtccgcttatcccgaaaccgaaacaaatacgcgcgaaaaacgctccaaaaaccgcgctaaaaccgcaaacgccgcccgccgaaccccgccccctactcgccgaactcaactccccgttcgccgtcgaaacgtccccgaacccaaaaacgacgacgaaactaatatacgcccgctaaacgcccccgacccgccataaccgcgcgccccgaaccgctctaacttctaaacctaacgttatacgcgctaaacgaaaacgaccccgacctacgacccccgcccgactatccccaacgacgtctaaacgcgcgcgaacgccgaaacgtacaacgcgaaatcctaacgatactcgaactacccgaacgaccccgaccccgcgcgccacccgccgcctcccgactacccgcgtccgcgccgctcttcatactaaacctataccacgccataactaacgacgacgacgaaaacgacgcgcccgcgaaacaacgcctaaaccgcgccgacctaatcataaacttcgtcaacataaataaatacgaccgcccgcgcgaaaaccctcgaaataaactaactacaaaaaaaaaacgcgcatccgcgaacgataccgaaccctaaccgaacgaaaaatca

SEQ ID NO: 31211 - DNA, 1478 bp, Artificial Sequence
  chemically treated genomic DNA (Homo sapiens) CpG-island No: 31211
gtttagttggaggtaggaggcggagtttttttcgtaaagttggattagtatcggggacgtagggcgtatagttagggttggcgggggcggttcgattggggcgttgtttgggtttacgcgggagttaggtgggggacgtagggagaagtagtcgagtaggtgtcgagaaggaggcgttcgtagaagcgtatgtaggggttacggggaaggcgttaggaggcggtgaggggtcgcggtggtcggaattcgggtcggttgttgcgggtagaggaataggttttattcgcggggtttggttggtatcgttcggttttttagacggggttacggtcgcgtgtcgggttcggtggcgattacggtatattacggcgaggtagtcgggtggtattattggcgggatcgggacggcgtcgcggttttaggatttttgcgtcgaggttcgcggcgggagttacgacggttttgattacgttgacgtttaggttgcgggtttttcgttcggattaatcgttagttacgtcgaggtcgtatttcggggtcgttttattcgtaatatttgtcgtcgttcggggtttttagcgggcgcggttttcgcgtttaggtttcgttttcgcgtttttattggttagtttcgggggtgggcgggcggtatagacggttgagtcggggtaaggattcgcgggaatcgcgtcgttcgggtcgttgtcggagttcgtcggtcgtttttgcgttgcgcggatcgtagttatagtcggattggtgggaacggcggcgatagacggattggttgatagttttagtttttagaatagtttcggtttcgaagcgttggcgtttgcgttcgcgttagcgttcgtttgtttcggagtcggggtaggtgcgcgcggggggcgttttagggatcgcgttgaggtcgtagacgtcgttcgtcgagtttcgttttttgttcgtcgaatttagtttttcgttcgtcgtcggggcgttttcgggtttaggggcggcggcggagttgatgtgcgttcgttgagcgttttcggttcgttatggtcgcgcgtttcggatcgttttggtttttgggtttgacgttgtgcgcgttgggcgggggcggtttcggtttgcgattttcgttcggttgtttttagcgacgtttgggcgcgcgcgagcgtcgggacgtgtagcgcgagattttggcggtgttcgggttattcgggcggtttcggtttcgcgcgttattcgtcgtttttcggttgttcgcgttcgcgtcgttttttatgttggatttgtattacgttatggttggcgacgacgacgaggacggcgcgttcgcggagtagcgtttgggtcgcgtcgatttggttatgagtttcgttaatatgggtgagtgcggtcgttcgcgcggggattttcggagtaagttggttgtaggggaggggcgcgtattcgcgggcggtgtcgggttttggtcgaacggggaatta

SEQ ID NO: 31212 - DNA, 1478 bp, Artificial Sequence
  chemically treated genomic DNA (Homo sapiens) CpG-island No: 31212
taattccccgttcgaccaaaacccgacaccgcccgcgaatacgcgcccctcccctacaaccaacttactccgaaaatccccgcgcgaacgaccgcactcacccatattaacgaaactcataaccaaatcgacgcgacccaaacgctactccgcgaacgcgccgtcctcgtcgtcgtcgccaaccataacgtaatacaaatccaacataaaaaacgacgcgaacgcgaacaaccgaaaaacgacgaataacgcgcgaaaccgaaaccgcccgaataacccgaacaccgccaaaatctcgcgctacacgtcccgacgctcgcgcgcgcccaaacgtcgctaaaaacaaccgaacgaaaatcgcaaaccgaaaccgcccccgcccaacgcgcacaacgtcaaacccaaaaaccaaaacgatccgaaacgcgcgaccataacgaaccgaaaacgctcaacgaacgcacatcaactccgccgccgcccctaaacccgaaaacgccccgacgacgaacgaaaaactaaattcgacgaacaaaaaacgaaactcgacgaacgacgtctacgacctcaacgcgatccctaaaacgccccccgcgcgcacctaccccgactccgaaacaaacgaacgctaacgcgaacgcaaacgccaacgcttcgaaaccgaaactattctaaaaactaaaactatcaaccaatccgtctatcgccgccgttcccaccaatccgactataactacgatccgcgcaacgcaaaaacgaccgacgaactccgacaacgacccgaacgacgcgattcccgcgaatccttaccccgactcaaccgtctataccgcccgcccacccccgaaactaaccaataaaaacgcgaaaacgaaacctaaacgcgaaaaccgcgcccgctaaaaaccccgaacgacgacaaatattacgaataaaacgaccccgaaatacgacctcgacgtaactaacgattaatccgaacgaaaaacccgcaacctaaacgtcaacgtaatcaaaaccgtcgtaactcccgccgcgaacctcgacgcaaaaatcctaaaaccgcgacgccgtcccgatcccgccaataataccacccgactacctcgccgtaatataccgtaatcgccaccgaacccgacacgcgaccgtaaccccgtctaaaaaaccgaacgataccaaccaaaccccgcgaataaaacctattcctctacccgcaacaaccgacccgaattccgaccaccgcgacccctcaccgcctcctaacgccttccccgtaacccctacatacgcttctacgaacgcctccttctcgacacctactcgactacttctccctacgtcccccacctaactcccgcgtaaacccaaacaacgccccaatcgaaccgcccccgccaaccctaactatacgccctacgtccccgatactaatccaactttacgaaaaaaactccgcctcctacctccaactaaac

SEQ ID NO: 31213 - DNA, 515 bp, Artificial Sequence
  chemically treated genomic DNA (Homo sapiens) CpG-island No: 31213
gggcgcgggcgttcgttttgttttgtgacgcgcggttcgaggcgttcgtagggtttatattatttgttttggttttcgattcgggtcgattatggcggcgttgcggtttttggcgttagtgttcgggcgcggggttttcgtcggcggtttagggttcgcgttgttttagggttgcgttcgttgttttgttattagttttcggtttcgtgttaagttttacgcggattcggtggagatggtgaaggatatttttgacggggcgatcgttatgatcgggggtttcgggttttgcgggattttcgagaatttgatcgtcgcgttgtttaggattcgcgtgaaagatttgtaggtggttagtagtaacgtgggcgtggaggatttcggtttgggttttttgttggtcgttaggtaggttcgtcgtatcgtttgtttttacgtgggcgagaatattttgtgcgagagttagtatttggtaggagagttggagttggagtttacgttttagggtattttgg

SEQ ID NO: 31214 - DNA, 515 bp, Artificial Sequence
  chemically treated genomic DNA (Homo sapiens) CpG-island No: 31214
ccaaaataccctaaaacgtaaactccaactccaactctcctaccaaatactaactctcgcacaaaatattctcgcccacgtaaaaacaaacgatacgacgaacctacctaacgaccaacaaaaaacccaaaccgaaatcctccacgcccacgttactactaaccacctacaaatctttcacgcgaatcctaaacaacgcgacgatcaaattctcgaaaatcccgcaaaacccgaaacccccgatcataacgatcgccccgtcaaaaatatccttcaccatctccaccgaatccgcgtaaaacttaacacgaaaccgaaaactaataacaaaacaacgaacgcaaccctaaaacaacgcgaaccctaaaccgccgacgaaaaccccgcgcccgaacactaacgccaaaaaccgcaacgccgccataatcgacccgaatcgaaaaccaaaacaaataatataaaccctacgaacgcctcgaaccgcgcgtcacaaaacaaaacgaacgcccgcgccc

SEQ ID NO: 31215 - DNA, 515 bp, Artificial Sequence
  chemically treated genomic DNA (Homo sapiens) CpG-island No: 31215
ttagggtgttttggggcgtgagttttagttttagtttttttgttaggtattggttttcgtatagggtgttttcgtttacgtaggaatagacgatgcgacggatttgtttggcggttagtaggaggtttaggtcgaagttttttacgtttacgttgttgttgattatttgtaggttttttacgcgggttttgagtagcgcggcgattaggttttcggggatttcgtagagttcgaagttttcgattatgacggtcgtttcgttagagatgttttttattatttttatcgggttcgcgtagaatttggtacggggtcggggattggtggtaaagtagcgggcgtagttttgggatagcgcgagttttgagtcgtcggcggggatttcgcgttcgagtattgacgttaggagtcgtagcgtcgttatagtcggttcgggtcggaggttaggataggtggtgtgagttttgcgagcgtttcgggtcgcgcgttatagagtagggcgggcgttcgcgttt

SEQ ID NO: 31216 - DNA, 515 bp, Artificial Sequence
  chemically treated genomic DNA (Homo sapiens) CpG-island No: 31216
aaacgcgaacgcccgccctactctataacgcgcgacccgaaacgctcgcaaaactcacaccacctatcctaacctccgacccgaaccgactataacgacgctacgactcctaacgtcaatactcgaacgcgaaatccccgccgacgactcaaaactcgcgctatcccaaaactacgcccgctactttaccaccaatccccgaccccgtaccaaattctacgcgaacccgataaaaataataaaaaacatctctaacgaaacgaccgtcataatcgaaaacttcgaactctacgaaatccccgaaaacctaatcgccgcgctactcaaaacccgcgtaaaaaacctacaaataatcaacaacaacgtaaacgtaaaaaacttcgacctaaacctcctactaaccgccaaacaaatccgtcgcatcgtctattcctacgtaaacgaaaacaccctatacgaaaaccaatacctaacaaaaaaactaaaactaaaactcacgccccaaaacaccctaa

SEQ ID NO: 31217 - DNA, 726 bp, Artificial Sequence
  chemically treated genomic DNA (Homo sapiens) CpG-island No: 31217
tgcgcggcgtttattcgaggttggtttttggagatggggaagaagcggcgatcgaagttatcggttattagaattgtttgtaggggcggcggcggtttttttttcgtttttttggttttttcgttatcgttgtttttcggtttcgcgtcgttgcgtttgttagttcgattaattattatattaggcggcgttattataggggtcgttattttttttttttacggttattattttcgtaaggaagttgttatcgtacgtagtaggggataaaaaggatttagtatttgaaatgcgatggattaattaacgaagggaaggagacgaggagggagtagtgcgtatgcgtttttttcgggagtttataggggtttgaggttgatttcggaggcgcgaggagtcggtacgggttacggttgtttcggtttttgaggcgtagggtaggagtggggttttatagatgttagattcggtttgtaagtatcgtcggtttttatttgtaggtgaataagtcgagatttttgtggcgtgataggatttgtggtcgttacgaaggggttagttttatcgggaatttgtaatcgtttagtagttttttcgtttcgcgtatgtgaaatatgtagtttttcgtatttattttagaaatttttgggaatttagcgttttggggagatagaatcgagttagatgttttttcgttgcgaggaatttagaatttgtataaataga

SEQ ID NO: 31218 - DNA, 726 bp, Artificial Sequence
  chemically treated genomic DNA (Homo sapiens) CpG-island No: 31218
tctatttatacaaattctaaattcctcgcaacgaaaaaacatctaactcgattctatctccccaaaacgctaaattcccaaaaatttctaaaataaatacgaaaaactacatatttcacatacgcgaaacgaaaaaactactaaacgattacaaattcccgataaaactaaccccttcgtaacgaccacaaatcctatcacgccacaaaaatctcgacttattcacctacaaataaaaaccgacgatacttacaaaccgaatctaacatctataaaaccccactcctaccctacgcctcaaaaaccgaaacaaccgtaacccgtaccgactcctcgcgcctccgaaatcaacctcaaacccctataaactcccgaaaaaaacgcatacgcactactccctcctcgtctccttcccttcgttaattaatccatcgcatttcaaatactaaatcctttttatcccctactacgtacgataacaacttccttacgaaaataataaccgtaaaaaaaaaaaataacgacccctataataacgccgcctaatataataattaatcgaactaacaaacgcaacgacgcgaaaccgaaaaacaacgataacgaaaaaaccaaaaaaacgaaaaaaaaaccgccgccgcccctacaaacaattctaataaccgataacttcgatcgccgcttcttccccatctccaaaaaccaacctcgaataaacgccgcgca

SEQ ID NO: 31219 - DNA, 726 bp, Artificial Sequence
  chemically treated genomic DNA (Homo sapiens) CpG-island No: 31219
tttatttatgtaggttttgagtttttcgtagcgggggaatatttggttcggttttatttttttaaggcgttgggtttttagaagtttttagaatgaatacggagggttatatattttatatgcgcggggcggggaaattgttgggcgattatagattttcgatggagttggttttttcgtggcgattataagttttattacgttataagaatttcggtttgtttatttataaatgaaggtcgacgatatttgtagatcgagtttgatatttatgggattttatttttattttgcgttttaggggtcgggataatcgtgattcgtatcgatttttcgcgttttcgggattaattttagatttttgtgggttttcggggaagacgtatgcgtattgtttttttttcgttttttttttttcgttaattagtttatcgtattttaagtgttggattttttttgttttttattgcgtgcggtggtagtttttttgcggaagtggtgatcgtgagagaagaagatggcggtttttgtagtggcgtcgtttggtgtggtggttagtcgggttaataagcgtagcggcgcggggtcgggaggtagcggtggcgggggagttagaggggcggaggaggaatcgtcgtcgtttttataagtagttttggtggtcgatagtttcgatcgtcgttttttttttatttttaaggattagtttcgggtgagcgtcgcgta

SEQ ID NO: 31220 - DNA, 726 bp, Artificial Sequence
  chemically treated genomic DNA (Homo sapiens) CpG-island No: 31220
tacgcgacgctcacccgaaactaatccttaaaaataaaaaaaaaacgacgatcgaaactatcgaccaccaaaactacttataaaaacgacgacgattcctcctccgcccctctaactcccccgccaccgctacctcccgaccccgcgccgctacgcttattaacccgactaaccaccacaccaaacgacgccactacaaaaaccgccatcttcttctctcacgatcaccacttccgcaaaaaaactaccaccgcacgcaataaaaaacaaaaaaaatccaacacttaaaatacgataaactaattaacgaaaaaaaaaaaacgaaaaaaaaacaatacgcatacgtcttccccgaaaacccacaaaaatctaaaattaatcccgaaaacgcgaaaaatcgatacgaatcacgattatcccgacccctaaaacgcaaaataaaaataaaatcccataaatatcaaactcgatctacaaatatcgtcgaccttcatttataaataaacaaaccgaaattcttataacgtaataaaacttataatcgccacgaaaaaaccaactccatcgaaaatctataatcgcccaacaatttccccgccccgcgcatataaaatatataaccctccgtattcattctaaaaacttctaaaaacccaacgccttaaaaaaataaaaccgaaccaaatattcccccgctacgaaaaactcaaaacctacataaataaa

SEQ ID NO: 31221 - DNA, 786 bp, Artificial Sequence
  chemically treated genomic DNA (Homo sapiens) CpG-island No: 31221
tgtagcgaggtaagtcgaaacggatcgcgttattttttagaagttagagcggtcggggttttcggaggcggggcgggggttatttttattcgaaatcgtcgtttatagatttgaagaagaatttatagttgggtcgttgtaaaacgtttttaaagttcgttaaggtgacgcgttcggcgggtaggggtagttttataaggtacggcgttttttgtttatttaagtggtagatgattttggtttcgtttatggttttggtttcgggttcggcggttcgcgcgcggtttgttcgggcggtcgggtcgagtttttagacggcggcggcgcgcggcgcggtttagcggtttaatttagttcggggggtgttggcggcgttagtttttttgtttttcggtcgttatcgggttttagcgtcgttcgtcgtcgtcgcggtcgtcgttttcgttttttattttttcgattggattggcgatcgcgattttttcggtggtcgcggttttttcggtttagggtttcgttcgggttcgtttttttttttcggttcggcgcggtttcgtttcggcgcgtttcgttttcggtcgtcgcggagaggcgtcggcgtcgcggtagatggtagggtttttcgtttattggtcgggtcgcggcgtttcggtttcgggtttttagaaacggaaggggagatttatcgggatggcggcgttttcggatttttgaaggttttgatttcggatttaagtgggatcggcgatttttttgtagtttaggaagagtggaatgtagggattg

SEQ ID NO: 31222 - DNA, 786 bp, Artificial Sequence
  chemically treated genomic DNA (Homo sapiens) CpG-island No: 31222
caatccctacattccactcttcctaaactacaaaaaaatcgccgatcccacttaaatccgaaatcaaaaccttcaaaaatccgaaaacgccgccatcccgataaatctccccttccgtttctaaaaacccgaaaccgaaacgccgcgacccgaccaataaacgaaaaaccctaccatctaccgcgacgccgacgcctctccgcgacgaccgaaaacgaaacgcgccgaaacgaaaccgcgccgaaccgaaaaaaaaaaacgaacccgaacgaaaccctaaaccgaaaaaaccgcgaccaccgaaaaaatcgcgatcgccaatccaatcgaaaaaataaaaaacgaaaacgacgaccgcgacgacgacgaacgacgctaaaacccgataacgaccgaaaaacaaaaaaactaacgccgccaacaccccccgaactaaattaaaccgctaaaccgcgccgcgcgccgccgccgtctaaaaactcgacccgaccgcccgaacaaaccgcgcgcgaaccgccgaacccgaaaccaaaaccataaacgaaaccaaaatcatctaccacttaaataaacaaaaaacgccgtaccttataaaactacccctacccgccgaacgcgtcaccttaacgaactttaaaaacgttttacaacgacccaactataaattcttcttcaaatctataaacgacgatttcgaataaaaataacccccgccccgcctccgaaaaccccgaccgctctaacttctaaaaaataacgcgatccgtttcgacttacctcgctaca

SEQ ID NO: 31223 - DNA, 786 bp, Artificial Sequence
  chemically treated genomic DNA (Homo sapiens) CpG-island No: 31223
taatttttgtattttattttttttggattgtagaggagtcgtcgattttatttgggttcggagttagggtttttaggggttcgggaacgtcgttatttcggtgaattttttttttcgtttttagggattcgggatcggagcgtcgcggttcggttagtgggcgggaaattttgttatttgtcgcgacgtcggcgttttttcgcggcggtcgggggcggggcgcgtcggggcggggtcgcgtcgggtcggaggaggggagcgggttcggacgaagttttgggtcgggagggtcgcggttatcggaagagtcgcggtcgttagtttagtcgggagagtggggagcggaagcggcggtcgcggcggcggcgggcggcgttgggattcggtagcggtcggagaataagggagttggcgtcgttagtatttttcgagttgggttgagtcgttgggtcgcgtcgcgcgtcgtcgtcgtttggaggttcggttcggtcgttcgagtaggtcgcgcgcgggtcgtcgggttcgaggttagagttatgggcgagattaagattatttattatttggatgggtaggagacgtcgtattttgtgaagttgtttttgttcgtcgagcgcgttattttggcggattttaagggcgttttgtagcgatttagttataagtttttttttaagtttatggacgacgatttcgggtgaggatggttttcgtttcgttttcgggagtttcggtcgttttggtttttaagggatgacgcggttcgtttcgatttgtttcgttata

SEQ ID NO: 31224 - DNA, 786 bp, Artificial Sequence
  chemically treated genomic DNA (Homo sapiens) CpG-island No: 31224
tataacgaaacaaatcgaaacgaaccgcgtcatcccttaaaaaccaaaacgaccgaaactcccgaaaacgaaacgaaaaccatcctcacccgaaatcgtcgtccataaacttaaaaaaaaacttataactaaatcgctacaaaacgcccttaaaatccgccaaaataacgcgctcgacgaacaaaaacaacttcacaaaatacgacgtctcctacccatccaaataataaataatcttaatctcgcccataactctaacctcgaacccgacgacccgcgcgcgacctactcgaacgaccgaaccgaacctccaaacgacgacgacgcgcgacgcgacccaacgactcaacccaactcgaaaaatactaacgacgccaactcccttattctccgaccgctaccgaatcccaacgccgcccgccgccgccgcgaccgccgcttccgctccccactctcccgactaaactaacgaccgcgactcttccgataaccgcgaccctcccgacccaaaacttcgtccgaacccgctcccctcctccgacccgacgcgaccccgccccgacgcgccccgcccccgaccgccgcgaaaaaacgccgacgtcgcgacaaataacaaaatttcccgcccactaaccgaaccgcgacgctccgatcccgaatccctaaaaacgaaaaaaaaaattcaccgaaataacgacgttcccgaacccctaaaaaccctaactccgaacccaaataaaatcgacgactcctctacaatccaaaaaaaataaaatacaaaaatta

SEQ ID NO: 31225 - DNA, 527 bp, Artificial Sequence
  chemically treated genomic DNA (Homo sapiens) CpG-island No: 31225
ggtagtgtcggtggtatttgtaggacgtttgatttttgaagaatggaaagggtggggtttttgaggtttcggttttgtagtgacggggattcgtgcggcggcggggacgcggtttttgtattgcggtgtttagtttggttcgggttgtcgcggttggcgcggaggcggtatcgcgttcgaaggaggggggagcgttagtttcgtcgtagtagtagtaggcgtggttagggtaggttggaggggcggtttttcggaacgggggcgggattatcgtcggtagggttcgcgtttttgtcgggatttagagtcgttgtagttatagtcgcgaattggcggtcggtaggtgtcgggatcgagggttattcggagcgtagaggcggtattatttatacggatttcgtgggtatttagaatttcgcggagggcgcgacggtgaggttgagattgttatagggagcggggcgatttttagagttagttcgcggtattttttgcgcgggtcgcggttattgtaggtgttttttttt

SEQ ID NO: 31226 - DNA, 527 bp, Artificial Sequence
  chemically treated genomic DNA (Homo sapiens) CpG-island No: 31226
aaaaaaaaacacctacaataaccgcgacccgcgcaaaaaataccgcgaactaactctaaaaatcgccccgctccctataacaatctcaacctcaccgtcgcgccctccgcgaaattctaaatacccacgaaatccgtataaataataccgcctctacgctccgaataaccctcgatcccgacacctaccgaccgccaattcgcgactataactacaacgactctaaatcccgacaaaaacgcgaaccctaccgacgataatcccgcccccgttccgaaaaaccgcccctccaacctaccctaaccacgcctactactactacgacgaaactaacgctcccccctccttcgaacgcgataccgcctccgcgccaaccgcgacaacccgaaccaaactaaacaccgcaatacaaaaaccgcgtccccgccgccgcacgaatccccgtcactacaaaaccgaaacctcaaaaaccccaccctttccattcttcaaaaatcaaacgtcctacaaataccaccgacactacc

SEQ ID NO: 31227 - DNA, 527 bp, Artificial Sequence
  chemically treated genomic DNA (Homo sapiens) CpG-island No: 31227
aggagggggtatttgtagtggtcgcggttcgcgtaggggatgtcgcgggttggttttggggatcgtttcgttttttgtggtagttttagttttatcgtcgcgtttttcgcggagttttaggtgtttacgggattcgtgtgggtggtgtcgtttttgcgtttcgggtggttttcggtttcggtatttgtcggtcgttagttcgcgattgtggttgtagcggttttgagtttcggtaggggcgcgggttttgtcggcggtggtttcgttttcgtttcgagaggtcgtttttttagtttgttttggttacgtttgttgttgttgcggcggggttggcgtttttttttttttcgggcgcggtatcgttttcgcgttagtcgcggtagttcgagttagattgggtatcgtagtgtagggatcgcgttttcgtcgtcgtacggattttcgttattgtaggatcgaggttttagagattttattttttttattttttaggaattaggcgttttgtaagtgttatcgatattgtt

SEQ ID NO: 31228 - DNA, 527 bp, Artificial Sequence
  chemically treated genomic DNA (Homo sapiens) CpG-island No: 31228
aacaatatcgataacacttacaaaacgcctaattcctaaaaaataaaaaaaataaaatctctaaaacctcgatcctacaataacgaaaatccgtacgacgacgaaaacgcgatccctacactacgatacccaatctaactcgaactaccgcgactaacgcgaaaacgataccgcgcccgaaaaaaaaaaaaacgccaaccccgccgcaacaacaacaaacgtaaccaaaacaaactaaaaaaacgacctctcgaaacgaaaacgaaaccaccgccgacaaaacccgcgcccctaccgaaactcaaaaccgctacaaccacaatcgcgaactaacgaccgacaaataccgaaaccgaaaaccacccgaaacgcaaaaacgacaccacccacacgaatcccgtaaacacctaaaactccgcgaaaaacgcgacgataaaactaaaactaccacaaaaaacgaaacgatccccaaaaccaacccgcgacatcccctacgcgaaccgcgaccactacaaataccccctcct

SEQ ID NO: 31229 - DNA, 507 bp, Artificial Sequence
  chemically treated genomic DNA (Homo sapiens) CpG-island No: 31229
tattgtcgtcgtatgtgagatatttttttttttttaaggttagtgattgcgttagagtttttgcgcgttggtaagtaggtgacgtcgcgggtgacggttagttagggcgggggttgtgggggcgggaggtaaggggagaagagggtatgttttcgtcggtgaggcgagaatttattcgtggtttaaagtaacgagggcggggggtattttttatttttatcgtattttttcggggtatatattggcgcgtttcgcgtttttaggtgtttcgagttttttcgcgttattcgtagtttagggcgtttttcgcgacgtcgttatttattttttttatattgcgagcgtattattttagagtcgcggggggttatagttatcggattagggttgggggtgtttgttttggtgcgcgcgcgtcggtttagtttttatagattttttttaggagagattgaaatatttagatttaggagacggagatattgtggtatagagatataggagtta

SEQ ID NO: 31230 - DNA, 507 bp, Artificial Sequence
  chemically treated genomic DNA (Homo sapiens) CpG-island No: 31230
taactcctatatctctataccacaatatctccgtctcctaaatctaaatatttcaatctctcctaaaaaaaatctataaaaactaaaccgacgcgcgcgcaccaaaacaaacacccccaaccctaatccgataactataaccccccgcgactctaaaataatacgctcgcaatataaaaaaaataaataacgacgtcgcgaaaaacgccctaaactacgaataacgcgaaaaaactcgaaacacctaaaaacgcgaaacgcgccaatatataccccgaaaaaatacgataaaaataaaaaataccccccgccctcgttactttaaaccacgaataaattctcgcctcaccgacgaaaacataccctcttctccccttacctcccgcccccacaacccccgccctaactaaccgtcacccgcgacgtcacctacttaccaacgcgcaaaaactctaacgcaatcactaaccttaaaaaaaaaaaaatatctcacatacgacgacaata

SEQ ID NO: 31231 - DNA, 507 bp, Artificial Sequence
  chemically treated genomic DNA (Homo sapiens) CpG-island No: 31231
tgatttttgtatttttgtgttatagtgttttcgttttttgaatttgggtattttagttttttttaggaggggtttatagaaattgggtcgacgcgcgcgtattagggtagatatttttagttttagttcggtggttgtagtttttcgcggttttggagtggtgcgttcgtagtgtaggaggaatgaatggcggcgtcgcggggggcgttttgggttgcgggtgacgcggggaagttcggagtatttgaggacgcggagcgcgttagtgtgtgtttcgagggagtgcggtagagatggagggtgtttttcgttttcgttgttttggattacgggtgagttttcgttttatcgacgggaatatgtttttttttttttttgtttttcgtttttataattttcgttttggttggtcgttattcgcggcgttatttgtttgttagcgcgtaggagttttggcgtaattattggttttggggaggagggggtgttttatatgcggcgatagtg

SEQ ID NO: 31232 - DNA, 507 bp, Artificial Sequence
  chemically treated genomic DNA (Homo sapiens) CpG-island No: 31232
cactatcgccgcatataaaacaccccctcctccccaaaaccaataattacgccaaaactcctacgcgctaacaaacaaataacgccgcgaataacgaccaaccaaaacgaaaattataaaaacgaaaaacaaaaaaaaaaaaaaacatattcccgtcgataaaacgaaaactcacccgtaatccaaaacaacgaaaacgaaaaacaccctccatctctaccgcactccctcgaaacacacactaacgcgctccgcgtcctcaaatactccgaacttccccgcgtcacccgcaacccaaaacgccccccgcgacgccgccattcattcctcctacactacgaacgcaccactccaaaaccgcgaaaaactacaaccaccgaactaaaactaaaaatatctaccctaatacgcgcgcgtcgacccaatttctataaacccctcctaaaaaaaactaaaatacccaaattcaaaaaacgaaaacactataacacaaaaatacaaaaatca

SEQ ID NO: 31233 - DNA, 743 bp, Artificial Sequence
  chemically treated genomic DNA (Homo sapiens) CpG-island No: 31233
tgtcgtttttttatttttttcgttatttgtcgtttttaggagttttcgttcggtttcgcgtttcgataggtttcgttcgggtgttggagtgagattttcgcgttggtttttggagcgcggggtgggcgtttcgttattttgcgtttagttttttcggttcgtttttagtagggtcggtttttcggcgttatgttcggtttgtattgtttttttagttggacgtcgttgtcgtttacggatttttgggttcgggtttgcgttaacggtttttgttttagcgtgcgggttcggtttatttatcgtaattcgtagtcgtagtcggtggacggtgaggttcgggtggggcgcgggcgcggcggggggtgcgtcgggtagggttcgacgtcgtttttcgtcgttttttttaggcgtgttcgtgtattcgttggtcgaggtcgaggtggtgttcggtttcgaggtcgaggtcgtcggacggcgcgtttttttttagttgtagagtcggcgtcgttcgtaggtcgtttgttgtcgcgttttgagttcggggttggggatttcgacgtttcgtcgttgcgcgtagggtgagtttcgcgcgttcgtattcgcgtttttgaaagtcgggcgtagtttaggttttcgtattcgttcgggtttcgttcgtttttcgttttttttcgggtattgttttgtgtatttattggtttattttggtatttagtagtcgtgggttgggtatttgatttgcg

SEQ ID NO: 31234 - DNA, 743 bp, Artificial Sequence
  chemically treated genomic DNA (Homo sapiens) CpG-island No: 31234
cgcaaatcaaatacccaacccacgactactaaataccaaaataaaccaataaatacacaaaacaatacccgaaaaaaaacgaaaaacgaacgaaacccgaacgaatacgaaaacctaaactacgcccgactttcaaaaacgcgaatacgaacgcgcgaaactcaccctacgcgcaacgacgaaacgtcgaaatccccaaccccgaactcaaaacgcgacaacaaacgacctacgaacgacgccgactctacaactaaaaaaaaacgcgccgtccgacgacctcgacctcgaaaccgaacaccacctcgacctcgaccaacgaatacacgaacacgcctaaaaaaaacgacgaaaaacgacgtcgaaccctacccgacgcaccccccgccgcgcccgcgccccacccgaacctcaccgtccaccgactacgactacgaattacgataaataaaccgaacccgcacgctaaaacaaaaaccgttaacgcaaacccgaacccaaaaatccgtaaacgacaacgacgtccaactaaaaaaacaatacaaaccgaacataacgccgaaaaaccgaccctactaaaaacgaaccgaaaaaactaaacgcaaaataacgaaacgcccaccccgcgctccaaaaaccaacgcgaaaatctcactccaacacccgaacgaaacctatcgaaacgcgaaaccgaacgaaaactcctaaaaacgacaaataacgaaaaaaataaaaaaacgaca

SEQ ID NO: 31235 - DNA, 743 bp, Artificial Sequence
  chemically treated genomic DNA (Homo sapiens) CpG-island No: 31235
cgtaggttaggtgtttagtttacgattgttaaatattaggatgagttaatgaatgtataaggtagtgttcggaggaaggcgggggacgggcggagttcgagcgggtgcgggagtttgagttgcgttcggtttttaggagcgcgggtgcgggcgcgcggaatttattttgcgcgtagcggcggggcgtcggggtttttagtttcgggtttagagcgcggtagtaggcggtttgcgagcggcgtcggttttgtagttggaaggagacgcgtcgttcggcggtttcggtttcgaagtcggatattatttcggtttcggttagcgggtatacgaatacgtttggggagggcggcgggaggcggcgtcggattttgttcggcgtatttttcgtcgcgttcgcgttttattcgggttttatcgtttatcggttgcggttgcgggttgcggtaggtgagtcgggttcgtacgttgaggtaggggtcgttggcgtaggttcggatttaggagttcgtgagcggtagcggcgtttagttggaggggtagtataggtcgggtatggcgtcgggaggtcggttttgttgggaacgggtcggggaagttgggcgtagggtgacgggacgtttatttcgcgttttagaggttagcgcgagagttttattttagtattcggacggggtttgtcggggcgcgaggtcgagcgggagtttttgagggcgataggtggcgggggagataagggggcggta

SEQ ID NO: 31236 - DNA, 743 bp, Artificial Sequence
  chemically treated genomic DNA (Homo sapiens) CpG-island No: 31236
taccgcccccttatctcccccgccacctatcgccctcaaaaactcccgctcgacctcgcgccccgacaaaccccgtccgaatactaaaataaaactctcgcgctaacctctaaaacgcgaaataaacgtcccgtcaccctacgcccaacttccccgacccgttcccaacaaaaccgacctcccgacgccatacccgacctatactacccctccaactaaacgccgctaccgctcacgaactcctaaatccgaacctacgccaacgacccctacctcaacgtacgaacccgactcacctaccgcaacccgcaaccgcaaccgataaacgataaaacccgaataaaacgcgaacgcgacgaaaaatacgccgaacaaaatccgacgccgcctcccgccgccctccccaaacgtattcgtatacccgctaaccgaaaccgaaataatatccgacttcgaaaccgaaaccgccgaacgacgcgtctccttccaactacaaaaccgacgccgctcgcaaaccgcctactaccgcgctctaaacccgaaactaaaaaccccgacgccccgccgctacgcgcaaaataaattccgcgcgcccgcacccgcgctcctaaaaaccgaacgcaactcaaactcccgcacccgctcgaactccgcccgtcccccgccttcctccgaacactaccttatacattcattaactcatcctaatatttaacaatcgtaaactaaacacctaacctacg

SEQ ID NO: 31237 - DNA, 662 bp, Artificial Sequence
  chemically treated genomic DNA (Homo sapiens) CpG-island No: 31237
ggaggcgcgcgaagggcgggagttttcgggttttcgttttcggggaggttttgggcgcggggcgggatttcgggacgttgggcgggcgtgttagggtttcgtcgttttggttcggttttgttttgcgttgcgcgtttattatggtgggtttcgcgtcgcggcggcggttgcggtcgttggtagcgttggttttggttttggcgttggtttcggggttgtttatagttcgggtcgggtagatatcgcgttttgtcgagcgggggtttttagtgcggttttttatcgaggaggagttggttcgttatggcggggaggaggtaggcgggggtgtcgcgggtcgagggattcggggtggcgttcgatttgcggcgagtcgagcggggatttaggaggcgtcggcggtttaggaagttttgggggacgcgcggttcgcggcgggcgttatgggtcggcggggggttttttttttataggtttcgaaggatggtcgaggggtgaggacgagtttttaatagtcggagcgtttcgttttgttcgtatattttattttgaatttttttttcggttttcgggagattttttttttagtcgttttttcgttgatgatttgcgtatagattttagaattttttggtttttatgttagtattagtcgaggcgtt

SEQ ID NO: 31238 - DNA, 662 bp, Artificial Sequence
  chemically treated genomic DNA (Homo sapiens) CpG-island No: 31238
aacgcctcgactaatactaacataaaaaccaaaaaattctaaaatctatacgcaaatcatcaacgaaaaaacgactaaaaaaaaaatctcccgaaaaccgaaaaaaaaattcaaaataaaatatacgaacaaaacgaaacgctccgactattaaaaactcgtcctcacccctcgaccatccttcgaaacctataaaaaaaaaaccccccgccgacccataacgcccgccgcgaaccgcgcgtcccccaaaacttcctaaaccgccgacgcctcctaaatccccgctcgactcgccgcaaatcgaacgccaccccgaatccctcgacccgcgacacccccgcctacctcctccccgccataacgaaccaactcctcctcgataaaaaaccgcactaaaaacccccgctcgacaaaacgcgatatctacccgacccgaactataaacaaccccgaaaccaacgccaaaaccaaaaccaacgctaccaacgaccgcaaccgccgccgcgacgcgaaacccaccataataaacgcgcaacgcaaaacaaaaccgaaccaaaacgacgaaaccctaacacgcccgcccaacgtcccgaaatcccgccccgcgcccaaaacctccccgaaaacgaaaacccgaaaactcccgcccttcgcgcgcctcc

SEQ ID NO: 31239 - DNA, 662 bp, Artificial Sequence
  chemically treated genomic DNA (Homo sapiens) CpG-island No: 31239
aacgtttcggttgatgttaatatgaaaattaaaaagttttgaggtttgtacgtagattattaacgaaaaggcggttagaggggaaatttttcggggatcgagggagaagtttagggtggggtgtgcgggtaaagcggagcgtttcgattgttgaggattcgtttttatttttcggttatttttcggggtttatagagaggaggtttttcgtcggtttatggcgttcgtcgcgggtcgcgcgttttttagagttttttgggtcgtcggcgttttttgggttttcgttcggttcgtcgtagatcggacgttatttcgggtttttcggttcgcgatattttcgtttatttttttttcgttatagcgggttagttttttttcggtgaaaagtcgtattgggggttttcgttcggtagggcgcggtgtttgttcggttcgggttgtgggtagtttcggggttagcgttaggattagggttagcgttgttagcggtcgtagtcgtcgtcgcggcgcggggtttattatggtgagcgcgtagcgtaaggtaaggtcgggttagggcggcggggttttagtacgttcgtttagcgtttcggagtttcgtttcgcgtttagagttttttcgagggcggggattcgagaattttcgtttttcgcgcgttttt

SEQ ID NO: 31240 - DNA, 662 bp, Artificial Sequence
  chemically treated genomic DNA (Homo sapiens) CpG-island No: 31240
aaaaacgcgcgaaaaacgaaaattctcgaatccccgccctcgaaaaaactctaaacgcgaaacgaaactccgaaacgctaaacgaacgtactaaaaccccgccgccctaacccgaccttaccttacgctacgcgctcaccataataaaccccgcgccgcgacgacgactacgaccgctaacaacgctaaccctaatcctaacgctaaccccgaaactacccacaacccgaaccgaacaaacaccgcgccctaccgaacgaaaacccccaatacgacttttcaccgaaaaaaaactaacccgctataacgaaaaaaaaataaacgaaaatatcgcgaaccgaaaaacccgaaataacgtccgatctacgacgaaccgaacgaaaacccaaaaaacgccgacgacccaaaaaactctaaaaaacgcgcgacccgcgacgaacgccataaaccgacgaaaaacctcctctctataaaccccgaaaaataaccgaaaaataaaaacgaatcctcaacaatcgaaacgctccgctttacccgcacaccccaccctaaacttctccctcgatccccgaaaaatttcccctctaaccgccttttcgttaataatctacgtacaaacctcaaaactttttaattttcatattaacatcaaccgaaacgtt

SEQ ID NO: 31241 - DNA, 818 bp, Artificial Sequence
  chemically treated genomic DNA (Homo sapiens) CpG-island No: 31241
gaaggtttttcgagtggttttttcggatgttgaggttttgttaacgtttttttgttttttcgtgcggcgtcgagcgtagtgtaggatatataggaagtgtttcgaaatagggttagggtgggggcggtaatcgtgttcggagggggcgtttagagcgtagggattcggtcgggtcgagtgatgttttttttaaaaaataagagttatcgggatgagggttagggatttcgaatttagcgtcgggtagttttcggagtcggagttaggttggtcgggttcggtttaggtatttttttttttcggagtttttcgacgcgcgttcggttatttattttagcgtttttattttgtaaattttgtcgaaggcgtcgtcgtttagttcgtttacgattttttatatttcgttggggtttaggtcgcggcggacgtgtttatattcgcgggatttttttttttcgaaggtagataggcgtaggatgcggcggaaattggtaaaagttatggtcgggggcgcggtggcgtcggttcgggttcgggttcgggttcgggttgtggtttcggcggtcgcgaggagaaggaggaggagttggaggacgtcgcgtttttcggggttttttttagattcgttttttttcgtagttcgatttcggttaagtgtgttttgggtagcgtcgcgtcgggagtattcggaatcgcgtaggcggcggcgtgttcgttttcgttttcgttttgttaggtttttagggtcgttttttttgtgtcggtttcgtagtttttgttcggtttagttttgtttgcgagagtttcggattcgtttt

SEQ ID NO: 31242 - DNA, 818 bp, Artificial Sequence
  chemically treated genomic DNA (Homo sapiens) CpG-island No: 31242
aaaacgaatccgaaactctcgcaaacaaaactaaaccgaacaaaaactacgaaaccgacacaaaaaaaacgaccctaaaaacctaacaaaacgaaaacgaaaacgaacacgccgccgcctacgcgattccgaatactcccgacgcgacgctacccaaaacacacttaaccgaaatcgaactacgaaaaaaaacgaatctaaaaaaaaccccgaaaaacgcgacgtcctccaactcctcctccttctcctcgcgaccgccgaaaccacaacccgaacccgaacccgaacccgaaccgacgccaccgcgcccccgaccataacttttaccaatttccgccgcatcctacgcctatctaccttcgaaaaaaaaaaatcccgcgaatataaacacgtccgccgcgacctaaaccccaacgaaatataaaaaatcgtaaacgaactaaacgacgacgccttcgacaaaatttacaaaataaaaacgctaaaataaataaccgaacgcgcgtcgaaaaactccgaaaaaaaaaaatacctaaaccgaacccgaccaacctaactccgactccgaaaactacccgacgctaaattcgaaatccctaaccctcatcccgataactcttattttttaaaaaaaacatcactcgacccgaccgaatccctacgctctaaacgccccctccgaacacgattaccgcccccaccctaaccctatttcgaaacacttcctatatatcctacactacgctcgacgccgcacgaaaaaacaaaaaaacgttaacaaaacctcaacatccgaaaaaaccactcgaaaaaccttc

SEQ ID NO: 31243 - DNA, 818 bp, Artificial Sequence
  chemically treated genomic DNA (Homo sapiens) CpG-island No: 31243
ggaacgggttcgaggttttcgtaggtagggttgggtcgggtaggagttgcgaggtcggtataagggaggcggttttggggatttgatagggcgggggcgggggcgggtacgtcgtcgtttgcgcggtttcgggtgttttcggcgcggcgttgtttagggtatatttgatcgaggtcgggttgcggggaaaggcgggtttggggagaatttcgagagacgcggcgttttttaatttttttttttttttttcgcggtcgtcgaagttatagttcgagttcgagttcgagttcgagtcggcgttatcgcgttttcggttatggtttttgttaattttcgtcgtattttgcgtttgtttattttcgagaagagaaagtttcgcgaatatgagtacgttcgtcgcgatttggattttaacgaggtgtgggagatcgtgggcgagttgggcgacggcgttttcggtaaggtttataaggtgagggcgttgaggtgggtggtcggacgcgcgtcgaggggtttcggaaggaagggatgtttgagtcggattcggttagtttggtttcggtttcgagggttgttcggcgttgaattcggggtttttggtttttatttcgatgatttttgttttttggggggaatattattcggttcggtcgagtttttgcgttttgggcgtttttttcgggtacggttgtcgtttttattttagttttgtttcggagtattttttgtgtgttttgtattgcgttcggcgtcgtacggggagataaaggggcgttgataggattttagtattcgagagggttattcgagggattttt

SEQ ID NO: 31244 - DNA, 818 bp, Artificial Sequence
  chemically treated genomic DNA (Homo sapiens) CpG-island No: 31244
aaaaatccctcgaataaccctctcgaatactaaaatcctatcaacgcccctttatctccccgtacgacgccgaacgcaatacaaaacacacaaaaaatactccgaaacaaaactaaaataaaaacgacaaccgtacccgaaaaaaacgcccaaaacgcaaaaactcgaccgaaccgaataatattccccccaaaaaacaaaaatcatcgaaataaaaaccaaaaaccccgaattcaacgccgaacaaccctcgaaaccgaaaccaaactaaccgaatccgactcaaacatcccttccttccgaaacccctcgacgcgcgtccgaccacccacctcaacgccctcaccttataaaccttaccgaaaacgccgtcgcccaactcgcccacgatctcccacacctcgttaaaatccaaatcgcgacgaacgtactcatattcgcgaaactttctcttctcgaaaataaacaaacgcaaaatacgacgaaaattaacaaaaaccataaccgaaaacgcgataacgccgactcgaactcgaactcgaactcgaactataacttcgacgaccgcgaaaaaaaaaaaaaaaaattaaaaaacgccgcgtctctcgaaattctccccaaacccgcctttccccgcaacccgacctcgatcaaatataccctaaacaacgccgcgccgaaaacacccgaaaccgcgcaaacgacgacgtacccgcccccgcccccgccctatcaaatccccaaaaccgcctcccttataccgacctcgcaactcctacccgacccaaccctacctacgaaaacctcgaacccgttcc

SEQ ID NO: 31245 - DNA, 604 bp, Artificial Sequence
  chemically treated genomic DNA (Homo sapiens) CpG-island No: 31245
cgttttcgcgttcgtttatcggttcggttttattcgtcgtttttcggtagagtttcgggattttttaattggttgcgggcgtttttcggtttcgttcgtcgtcgtagggtattttggaaattgtagtttttttatattacgtttcgcgagtcgcgggttgggttttggggaagtttcggggatcgttcggtgggatcgtttatggatttaggagttcgttcgtcgcgtcgcgtggtttttaaaatttttatgggagtaagcgggacggcgatttggtatttcgcgagagtttacggatcgttgttagcgtttagaaggtgaatttgtattcgtttatttaattttttcgtagttatttcgttaggttgttttcgtttttattttttcgatggggacgtcggtaggcgagggtattcgttttaggtatatacgttggttgttcgtttgttgcgggtttttcggcgcggtgttgttttttagtgtgcgacgggtaacgtcggtgtagtcgcggttagtttttgtagggttcggtttttcggcgcggttttttttaggggtttttcgtttacgatttataaatttgttaggattagagggttgggag

SEQ ID NO: 31246 - DNA, 604 bp, Artificial Sequence
  chemically treated genomic DNA (Homo sapiens) CpG-island No: 31246
ctcccaaccctctaatcctaacaaatttataaatcgtaaacgaaaaacccctaaaaaaaaccgcgccgaaaaaccgaaccctacaaaaactaaccgcgactacaccgacgttacccgtcgcacactaaaaaacaacaccgcgccgaaaaacccgcaacaaacgaacaaccaacgtatatacctaaaacgaataccctcgcctaccgacgtccccatcgaaaaaataaaaacgaaaacaacctaacgaaataactacgaaaaaattaaataaacgaatacaaattcaccttctaaacgctaacaacgatccgtaaactctcgcgaaataccaaatcgccgtcccgcttactcccataaaaattttaaaaaccacgcgacgcgacgaacgaactcctaaatccataaacgatcccaccgaacgatccccgaaacttccccaaaacccaacccgcgactcgcgaaacgtaatataaaaaaactacaatttccaaaataccctacgacgacgaacgaaaccgaaaaacgcccgcaaccaattaaaaaatcccgaaactctaccgaaaaacgacgaataaaaccgaaccgataaacgaacgcgaaaacg

SEQ ID NO: 31247 - DNA, 604 bp, Artificial Sequence
  chemically treated genomic DNA (Homo sapiens) CpG-island No: 31247
tttttagttttttaattttggtaggtttgtggatcgtggacggggagtttttggaaaggatcgcgtcgggaagtcgggttttgtagggattggtcgcggttgtatcggcgttgttcgtcgtatattaggaggtagtatcgcgtcgaggaattcgtagtagacgggtagttagcgtgtgtgtttggggcgagtgttttcgtttgtcggcgtttttatcggaaaagtgggggcgagggtagtttagcggaatagttgcgggaggattaaatgaacgagtgtaggtttattttttgggcgttgataacgattcgtgggttttcgcgaaatgttaagtcgtcgtttcgtttgtttttataaaagttttgggagttacgcggcgcggcgggcgggtttttgagtttatgagcggttttatcgagcggttttcgaagtttttttaaagtttagttcgcggttcgcggagcgtggtgtggggggattatagtttttagagtgttttgcggcgacgggcggagtcggggagcgttcgtagttaattagggggtttcggggttttgtcggggagcggcgggtggagtcgggtcggtgggcgggcgcggggacg

SEQ ID NO: 31248 - DNA, 604 bp, Artificial Sequence
  chemically treated genomic DNA (Homo sapiens) CpG-island No: 31248
cgtccccgcgcccgcccaccgacccgactccacccgccgctccccgacaaaaccccgaaaccccctaattaactacgaacgctccccgactccgcccgtcgccgcaaaacactctaaaaactataatccccccacaccacgctccgcgaaccgcgaactaaactttaaaaaaacttcgaaaaccgctcgataaaaccgctcataaactcaaaaacccgcccgccgcgccgcgtaactcccaaaacttttataaaaacaaacgaaacgacgacttaacatttcgcgaaaacccacgaatcgttatcaacgcccaaaaaataaacctacactcgttcatttaatcctcccgcaactattccgctaaactaccctcgcccccacttttccgataaaaacgccgacaaacgaaaacactcgccccaaacacacacgctaactacccgtctactacgaattcctcgacgcgatactacctcctaatatacgacgaacaacgccgatacaaccgcgaccaatccctacaaaacccgacttcccgacgcgatcctttccaaaaactccccgtccacgatccacaaacctaccaaaattaaaaaactaaaaa

SEQ ID NO: 31249 - DNA, 637 bp, Artificial Sequence
  chemically treated genomic DNA (Homo sapiens) CpG-island No: 31249
acgcgtcggattaggtatggcgcgaatcggcgattcgttttgtgttcgaatttatgggcgaagtgaatcgtttgtagggaattattcgcggcgggtagttttatgttggcgcgtatcgttggtcgttgggttatatatttgcgtattaggggtcgggggatttttttttgcgtttttgggaagtggatattagtcgtcgtattagtttttattcgtcgttgtcggtataggtattggaagggttatcgtttaacggataaaaggtatttcggggataataggttgatatcgtttaagagtttatatcgacggcggtgtttggtatttcgatgtcggtttattatattttggggttgaagtaggttttaagggtatggttgttcgttatttaaagtggtacgcgagttgggtttagaacgtcgtgagatagttcggtttttatttgtcgtgggcgttggagaattgaggggggttgtttttagtacgagaggatcggagtggacgtattattggtgttcgggttgttatgttaatggtattgttcggtagttaaatgcggaagagataagtgttgaaagtatttaagtacgaaatttgtttcgagatgagttttttttgattttttaagggttttgaa

SEQ ID NO: 31250 - DNA, 637 bp, Artificial Sequence
  chemically treated genomic DNA (Homo sapiens) CpG-island No: 31250
ttcaaaacccttaaaaaatcaaaaaaaactcatctcgaaacaaatttcgtacttaaatactttcaacacttatctcttccgcatttaactaccgaacaataccattaacataacaacccgaacaccaataatacgtccactccgatcctctcgtactaaaaacaacccccctcaattctccaacgcccacgacaaataaaaaccgaactatctcacgacgttctaaacccaactcgcgtaccactttaaataacgaacaaccatacccttaaaacctacttcaaccccaaaatataataaaccgacatcgaaataccaaacaccgccgtcgatataaactcttaaacgatatcaacctattatccccgaaataccttttatccgttaaacgataacccttccaatacctataccgacaacgacgaataaaaactaatacgacgactaatatccacttcccaaaaacgcaaaaaaaaatcccccgacccctaatacgcaaatatataacccaacgaccaacgatacgcgccaacataaaactacccgccgcgaataattccctacaaacgattcacttcgcccataaattcgaacacaaaacgaatcgccgattcgcgccatacctaatccgacgcgt

SEQ ID NO: 31251 - DNA, 637 bp, Artificial Sequence
  chemically treated genomic DNA (Homo sapiens) CpG-island No: 31251
tttaggatttttaaagggttagggagaatttatttcggggtaagtttcgtgtttagatgtttttagtatttatttttttcgtatttagttatcgggtagtgttattggtatgataattcgaatattagtgatgcgtttatttcggttttttcgtattaggagtagttttttttagttttttagcgtttacggtagatagggatcgaattgttttacgacgttttaaatttagttcgcgtattattttaaatggcgaatagttatatttttgggatttattttagttttaggatgtgatgagtcgatatcgaggtgttaaatatcgtcgtcgatatgaatttttgggcggtattagtttgttattttcggagtattttttattcgttgagcgatggtttttttagtatttgtatcggtagcggcgaatagaggttggtacggcggttgatatttattttttaagggcgtaggaagagatttttcggtttttgatacgtaggtgtgtagtttagcggttagcgatgcgcgttaatatggaattgttcgtcgcgaatggttttttgtaggcggtttatttcgtttataaattcgagtataaaacgggtcgtcggttcgcgttatatttgattcggcgcgt

SEQ ID NO: 31252 - DNA, 637 bp, Artificial Sequence
  chemically treated genomic DNA (Homo sapiens) CpG-island No: 31252
acgcgccgaatcaaatataacgcgaaccgacgacccgttttatactcgaatttataaacgaaataaaccgcctacaaaaaaccattcgcgacgaacaattccatattaacgcgcatcgctaaccgctaaactacacacctacgtatcaaaaaccgaaaaatctcttcctacgcccttaaaaaataaatatcaaccgccgtaccaacctctattcgccgctaccgatacaaatactaaaaaaaccatcgctcaacgaataaaaaatactccgaaaataacaaactaataccgcccaaaaattcatatcgacgacgatatttaacacctcgatatcgactcatcacatcctaaaactaaaataaatcccaaaaatataactattcgccatttaaaataatacgcgaactaaatttaaaacgtcgtaaaacaattcgatccctatctaccgtaaacgctaaaaaactaaaaaaaactactcctaatacgaaaaaaccgaaataaacgcatcactaatattcgaattatcataccaataacactacccgataactaaatacgaaaaaaataaatactaaaaacatctaaacacgaaacttaccccgaaataaattctccctaaccctttaaaaatcctaaa

SEQ ID NO: 31253 - DNA, 508 bp, Artificial Sequence
  chemically treated genomic DNA (Homo sapiens) CpG-island No: 31253
ttggcgggatcgtttcgcgtcgcgcgttaggtgggcggtgtgttaaagcgtttttttgaaggtagtattttattttggtatcgggtggttaatcgttacggtataatttcgttaatcggatcggatttatagcgttagcgataggtattattggtagaaggtgtgatggtatcgggaagcgggtaaatcgatttgtagcgttatcgttggaattattaatttttttcgggcggagagggttaacgtcgtttaatattgcgtaggagttggaattgtcgaagacggatttatttgagttggtgaagtcgaaggtacggtagtcgttgcgttatcgttggtttgaatcggtacggcggtttgttgtatcggtattaatgttaggtcggttttagtttcgttttggttgattatcggttgaacggtatcggtgataaatattagtttgttatttacggtaatcgtcgtatttaatagaatacgcgcgttcggttgaatatttgtcgggtta

SEQ ID NO: 31254 - DNA, 508 bp, Artificial Sequence
  chemically treated genomic DNA (Homo sapiens) CpG-island No: 31254
taacccgacaaatattcaaccgaacgcgcgtattctattaaatacgacgattaccgtaaataacaaactaatatttatcaccgataccgttcaaccgataatcaaccaaaacgaaactaaaaccgacctaacattaataccgatacaacaaaccgccgtaccgattcaaaccaacgataacgcaacgactaccgtaccttcgacttcaccaactcaaataaatccgtcttcgacaattccaactcctacgcaatattaaacgacgttaaccctctccgcccgaaaaaaattaataattccaacgataacgctacaaatcgatttacccgcttcccgataccatcacaccttctaccaataatacctatcgctaacgctataaatccgatccgattaacgaaattataccgtaacgattaaccacccgataccaaaataaaatactaccttcaaaaaaacgctttaacacaccgcccacctaacgcgcgacgcgaaacgatcccgccaa

SEQ ID NO: 31255 - DNA, 508 bp, Artificial Sequence
  chemically treated genomic DNA (Homo sapiens) CpG-island No: 31255
taattcggtagatgtttagtcgaacgcgcgtattttgttgagtgcggcgattatcgtgaatgataaattggtatttattatcgatatcgtttagtcggtgattaattagggcggaattaaagtcgatttgatattggtgtcggtatagtaaatcgtcgtgtcggtttaggttagcggtggcgtaacgattatcgtattttcgattttattaatttaggtgaattcgttttcggtagttttagtttttacgtaatattaagcgacgttaatttttttcgttcggagagggttagtagttttagcgataacgttgtaagtcgatttgttcgtttttcgatattattatattttttgttagtaatgtttgtcgttgacgttgtaaattcggttcggttagcgaaattgtgtcgtggcgattaattattcggtgttagggtaaggtgttgtttttagggagacgttttaatatatcgtttatttggcgcgcggcgcggggcgatttcgttag

SEQ ID NO: 31256 - DNA, 508 bp, Artificial Sequence
  chemically treated genomic DNA (Homo sapiens) CpG-island No: 31256
ctaacgaaatcgccccgcgccgcgcgccaaataaacgatatattaaaacgtctccctaaaaacaacaccttaccctaacaccgaataattaatcgccacgacacaatttcgctaaccgaaccgaatttacaacgtcaacgacaaacattactaacaaaaaatataataatatcgaaaaacgaacaaatcgacttacaacgttatcgctaaaactactaaccctctccgaacgaaaaaaattaacgtcgcttaatattacgtaaaaactaaaactaccgaaaacgaattcacctaaattaataaaatcgaaaatacgataatcgttacgccaccgctaacctaaaccgacacgacgatttactataccgacaccaatatcaaatcgactttaattccgccctaattaatcaccgactaaacgatatcgataataaataccaatttatcattcacgataatcgccgcactcaacaaaatacgcgcgttcgactaaacatctaccgaatta

SEQ ID NO: 31257 - DNA, 509 bp, Artificial Sequence
  chemically treated genomic DNA (Homo sapiens) CpG-island No: 31257
aagcggtagaagcgttgcgtgtttagggttttcgttagttgtcggtagtgattgttggcgattttagttggtttggttttcgttcggatatgattaatcgtttgtatttagcgttatacgcggttagtgtatgagttagttcgtttatttttttagtagtttcgaaaatacgtagcgttttatcgaacgtttaggtttgttcgcggtgcgtatttcgtttaatgagcgggaacggatttaggtagacgagttttatattttgatcgtgtttttttacggcggcggcggtacggttggcgcggtgttacgataggtaattcgttttttaaacgacgagtataatcgggcgttgtttcgcggcgttattgtttttggtaatcgtaattttggtgaggcgtatggtcgcgtcggagatgtgattgttcggaaatgcggcgtgtcgtggttgtatcgttttgaatttatgggtacgtaaagcgatatcgaaaacgttcgtaaaggagtaatcg

SEQ ID NO: 31258 - DNA, 509 bp, Artificial Sequence
  chemically treated genomic DNA (Homo sapiens) CpG-island No: 31258
cgattactcctttacgaacgttttcgatatcgctttacgtacccataaattcaaaacgatacaaccacgacacgccgcatttccgaacaatcacatctccgacgcgaccatacgcctcaccaaaattacgattaccaaaaacaataacgccgcgaaacaacgcccgattatactcgtcgtttaaaaaacgaattacctatcgtaacaccgcgccaaccgtaccgccgccgccgtaaaaaaacacgatcaaaatataaaactcgtctacctaaatccgttcccgctcattaaacgaaatacgcaccgcgaacaaacctaaacgttcgataaaacgctacgtattttcgaaactactaaaaaaataaacgaactaactcatacactaaccgcgtataacgctaaatacaaacgattaatcatatccgaacgaaaaccaaaccaactaaaatcgccaacaatcactaccgacaactaacgaaaaccctaaacacgcaacgcttctaccgctt

SEQ ID NO: 31259 - DNA, 509 bp, Artificial Sequence
  chemically treated genomic DNA (Homo sapiens) CpG-island No: 31259
cggttatttttttacgaacgttttcgatatcgttttgcgtatttatgagtttaaaacggtatagttacggtacgtcgtattttcgggtaattatattttcggcgcggttatacgttttattaaagttgcgattattagaagtaataacgtcgcgaagtaacgttcggttgtgttcgtcgtttaaaaagcgaattatttgtcgtggtatcgcgttagtcgtatcgtcgtcgtcgtaagagggtacgattaggatgtaaggttcgtttatttgaattcgttttcgtttattgagcgggatgcgtatcgcgggtagatttaaacgttcgataaaacgttgcgtgttttcggagttgttggagaagtagacgagttggtttatgtattggtcgcgtgtggcgttggatgtagacggttaattatgttcggacggaaattagattagttaagatcgttagtaattattatcggtaattgacgaaagttttgagtacgtaacgtttttgtcgttt

SEQ ID NO: 31260 - DNA, 509 bp, Artificial Sequence
  chemically treated genomic DNA (Homo sapiens) CpG-island No: 31260
aaacgacaaaaacgttacgtactcaaaactttcgtcaattaccgataataattactaacgatcttaactaatctaatttccgtccgaacataattaaccgtctacatccaacgccacacgcgaccaatacataaaccaactcgtctacttctccaacaactccgaaaacacgcaacgttttatcgaacgtttaaatctacccgcgatacgcatcccgctcaataaacgaaaacgaattcaaataaacgaaccttacatcctaatcgtaccctcttacgacgacgacgatacgactaacgcgataccacgacaaataattcgctttttaaacgacgaacacaaccgaacgttacttcgcgacgttattacttctaataatcgcaactttaataaaacgtataaccgcgccgaaaatataattacccgaaaatacgacgtaccgtaactataccgttttaaactcataaatacgcaaaacgatatcgaaaacgttcgtaaaaaaataaccg

SEQ ID NO: 31261 - DNA, 903 bp, Artificial Sequence
  chemically treated genomic DNA (Homo sapiens) CpG-island No: 31261
  misc_feature (838)..(838): n is either a, c, g or t
tgtttcgtaggtgtcggtgaattttttgaaagtttggcgcgacggggacgtggcgaaagcggtcgggtattattagattttgttgtaaatttcgtagatgtattagttggatacgtcgtttgtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtaggacgacgcgttttatgcggtgattatttacgcggcggggtcgtagggcgttttgtcgttgatttcgtagatgttgatggaattttttagcggtaatttgttcggtatgacgtagaacgtcgggatgggttgggacgttaataagtttatcggtaaagaggtgttgattatcggtatttagggcggtattcgcgtcggagacggacgtttaatcgcgttgggttattatatcgggtattgggagatcggtatgtagatgtaggcggcggcgaaggagattattcgtaatggcgggatttcgttcgcggttttcgttagcgattcgtgcgacgggcgttcgtagggtacgtacggtatgttcgattttttgtcgtatcgtaacgacgcggcgatcgtgtttcgtcgtttgattcgttttttgtcgacgcggcgggcggtgatcggcgtacgatttgcgataaagggttgttcgttattatgattgcgttggtcgcgatgtacgatttgtcgattattttggtgtcggcggggcgacgttngcgtcggacgtcgggaagacgcgggtagtgtaaatttcggcgcgcgtttgtaatacgaatttttt

SEQ ID NO: 31262 - DNA, 903 bp, Artificial Sequence
  chemically treated genomic DNA (Homo sapiens) CpG-island No: 31262
  misc_feature (66)..(66): n is either a, c, g or t
aaaaaattcgtattacaaacgcgcgccgaaatttacactacccgcgtcttcccgacgtccgacgcnaacgtcgccccgccgacaccaaaataatcgacaaatcgtacatcgcgaccaacgcaatcataataacgaacaaccctttatcgcaaatcgtacgccgatcaccgcccgccgcgtcgacaaaaaacgaatcaaacgacgaaacacgatcgccgcgtcgttacgatacgacaaaaaatcgaacataccgtacgtaccctacgaacgcccgtcgcacgaatcgctaacgaaaaccgcgaacgaaatcccgccattacgaataatctccttcgccgccgcctacatctacataccgatctcccaatacccgatataataacccaacgcgattaaacgtccgtctccgacgcgaataccgccctaaataccgataatcaacacctctttaccgataaacttattaacgtcccaacccatcccgacgttctacgtcataccgaacaaattaccgctaaaaaattccatcaacatctacgaaatcaacgacaaaacgccctacgaccccgccgcgtaaataatcaccgcataaaacgcgtcgtcctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcacaaacgacgtatccaactaatacatctacgaaatttacaacaaaatctaataatacccgaccgctttcgccacgtccccgtcgcgccaaactttcaaaaaattcaccgacacctacgaaaca

SEQ ID NO: 31263 - DNA, 903 bp, Artificial Sequence
  chemically treated genomic DNA (Homo sapiens) CpG-island No: 31263
  misc_feature (66)..(66): n is either a, c, g or t
aggagattcgtgttgtaaacgcgcgtcgaggtttgtattgttcgcgttttttcgacgttcggcgtnagcgtcgtttcgtcggtattagaatagtcggtaggtcgtgtatcgcggttagcgtaattatggtggcgggtagttttttatcgtaggtcgtacgtcgattatcgttcgtcgcgtcggtagggagcggattaggcggcgaaatacgatcgtcgcgtcgttgcggtacggtagggaatcgaatatatcgtgcgtgttttgcgagcgttcgtcgtacggatcgttgacgaaggtcgcgaacgggatttcgttattgcgggtgatttttttcgtcgtcgtttgtatttgtatgtcgattttttaatgttcggtgtggtagtttagcgcgattgggcgttcgttttcggcgcggatgtcgttttgagtgtcgataattagtatttttttgtcggtgagtttgttggcgttttagtttatttcggcgttttgcgttatgtcgaataggttgtcgttgggagattttattagtatttgcggggttagcggtagagcgttttgcggtttcgtcgcgtgggtgattatcgtataaaacgcgtcgttttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttataaacggcgtatttagttgatatatttgcggaatttgtagtaaggtttgatgatattcggtcgttttcgttacgttttcgtcgcgttaggtttttagaagatttatcgatatttgcggggta

SEQ ID NO: 31264 - DNA, 903 bp, Artificial Sequence
  chemically treated genomic DNA (Homo sapiens) CpG-island No: 31264
  misc_feature (838)..(838): n is either a, c, g or t
taccccgcaaatatcgataaatcttctaaaaacctaacgcgacgaaaacgtaacgaaaacgaccgaatatcatcaaaccttactacaaattccgcaaatatatcaactaaatacgccgtttataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaaacgacgcgttttatacgataatcacccacgcgacgaaaccgcaaaacgctctaccgctaaccccgcaaatactaataaaatctcccaacgacaacctattcgacataacgcaaaacgccgaaataaactaaaacgccaacaaactcaccgacaaaaaaatactaattatcgacactcaaaacgacatccgcgccgaaaacgaacgcccaatcgcgctaaactaccacaccgaacattaaaaaatcgacatacaaatacaaacgacgacgaaaaaaatcacccgcaataacgaaatcccgttcgcgaccttcgtcaacgatccgtacgacgaacgctcgcaaaacacgcacgatatattcgattccctaccgtaccgcaacgacgcgacgatcgtatttcgccgcctaatccgctccctaccgacgcgacgaacgataatcgacgtacgacctacgataaaaaactacccgccaccataattacgctaaccgcgatacacgacctaccgactattctaataccgacgaaacgacgctnacgccgaacgtcgaaaaaacgcgaacaatacaaacctcgacgcgcgtttacaacacgaatctcct

SEQ ID NO: 31265 - DNA, 769 bp, Artificial Sequence
  chemically treated genomic DNA (Homo sapiens) CpG-island No: 31265
gtaatatggttggcgaggttagaggcgaggaataaaatcgtgttggcgattttttgtggacgggcgattttttttagcggaatgtcgagtttaaattgttcgttaaagtcgcgaatacgttgtttttcggcgttatcgtttatttatagcgtgcgttgtatatcggtgtcggtggagttaggcgaaattatattatagcgtacgtcgttattcgttagttttagttcgacgtttaacgttaggttttttagcgtcgttttcgatgcgttataagtatttatgttaatacgcggcgtgtgcgcggcgtcggacgttatagtgataatcgtttcgtttcgttgacggcgaaattggtttatggtttgttggaataggttaaacgtatcgtcgacgtttatcgtaaaagtttgttgttagttttttttattgagttgatcggtcgcgtttatgcgtaaaattttcgtcgtattgattagcgcgtttagtcgtttcgttttagttaatagtcgttgatatatttgcgcgatttgcgtagcgtcggtaatatttattatttcggtcgtaaagggatattgtttttgagtgaacgtttgattaaaatttgtaattttcgttttcgttttaataaacgttagcgtcgtggcgtagtcgatattttatttgcgtcggttatttagatatttttatcgttgaaatttattattttatttcgcgggagagtagtttttattaggcgtcgatggtcgggtttttcgttagtatgataaag

SEQ ID NO: 31266 - DNA, 769 bp, Artificial Sequence
  chemically treated genomic DNA (Homo sapiens) CpG-island No: 31266
ctttatcatactaacgaaaaacccgaccatcgacgcctaataaaaactactctcccgcgaaataaaataataaatttcaacgataaaaatatctaaataaccgacgcaaataaaatatcgactacgccacgacgctaacgtttattaaaacgaaaacgaaaattacaaattttaatcaaacgttcactcaaaaacaatatccctttacgaccgaaataataaatattaccgacgctacgcaaatcgcgcaaatatatcaacgactattaactaaaacgaaacgactaaacgcgctaatcaatacgacgaaaattttacgcataaacgcgaccgatcaactcaataaaaaaaactaacaacaaacttttacgataaacgtcgacgatacgtttaacctattccaacaaaccataaaccaatttcgccgtcaacgaaacgaaacgattatcactataacgtccgacgccgcgcacacgccgcgtattaacataaatacttataacgcatcgaaaacgacgctaaaaaacctaacgttaaacgtcgaactaaaactaacgaataacgacgtacgctataatataatttcgcctaactccaccgacaccgatatacaacgcacgctataaataaacgataacgccgaaaaacaacgtattcgcgactttaacgaacaatttaaactcgacattccgctaaaaaaaatcgcccgtccacaaaaaatcgccaacacgattttattcctcgcctctaacctcgccaaccatattac

SEQ ID NO: 31267 - DNA, 769 bp, Artificial Sequence
  chemically treated genomic DNA (Homo sapiens) CpG-island No: 31267
ttttgttatgttggcgaaaaattcgattatcgacgtttggtggaagttattttttcgcgaggtgaaataatggattttagcggtaaaaatgtttgggtaatcggcgtaggtaaggtatcggttacgttacggcgttggcgtttgttgaggcgggagcgaaagttataggttttgattaagcgtttatttaggagtaatatttttttgcgatcgaagtgatggatgttgtcgacgttgcgtaggtcgcgtaagtgtgttagcgattgttagttgaaacggagcgattggacgcgttggttaatgcggcgggaattttacgtatgggcgcgatcgattagtttagtaaagaggattggtagtagatttttgcggtaaacgtcggcggtgcgtttaatttgttttagtaaattatgaattagtttcgtcgttagcggggcggggcgattgttattgtggcgttcgacgtcgcgtatacgtcgcgtattggtatgagtgtttatggcgtatcgaaagcggcgttgaaaagtttggcgttgagcgtcgggttggaattggcgggtagcggcgtgcgttgtaatgtggtttcgtttggttttatcgatatcgatatgtaacgtacgttgtgggtgagcgatgacgtcgaagaatagcgtattcgcggttttggcgagtagtttaaattcggtatttcgttggggaaaatcgttcgtttataagagatcgttaatacgattttgtttttcgtttttgatttcgttagttatattat

SEQ ID NO: 31268 - DNA, 769 bp, Artificial Sequence
  chemically treated genomic DNA (Homo sapiens) CpG-island No: 31268
ataatataactaacgaaatcaaaaacgaaaaacaaaatcgtattaacgatctcttataaacgaacgattttccccaacgaaataccgaatttaaactactcgccaaaaccgcgaatacgctattcttcgacgtcatcgctcacccacaacgtacgttacatatcgatatcgataaaaccaaacgaaaccacattacaacgcacgccgctacccgccaattccaacccgacgctcaacgccaaacttttcaacgccgctttcgatacgccataaacactcataccaatacgcgacgtatacgcgacgtcgaacgccacaataacaatcgccccgccccgctaacgacgaaactaattcataatttactaaaacaaattaaacgcaccgccgacgtttaccgcaaaaatctactaccaatcctctttactaaactaatcgatcgcgcccatacgtaaaattcccgccgcattaaccaacgcgtccaatcgctccgtttcaactaacaatcgctaacacacttacgcgacctacgcaacgtcgacaacatccatcacttcgatcgcaaaaaaatattactcctaaataaacgcttaatcaaaacctataactttcgctcccgcctcaacaaacgccaacgccgtaacgtaaccgataccttacctacgccgattacccaaacatttttaccgctaaaatccattatttcacctcgcgaaaaaataacttccaccaaacgtcgataatcgaatttttcgccaacataacaaaa

SEQ ID NO: 31269 - DNA, 506 bp, Artificial Sequence
  chemically treated genomic DNA (Homo sapiens) CpG-island No: 31269
cgttaattttcgtcgttttcgttattttatttattagcgtggtgatcgtgtttttgtcgttagaatcggtaatcgttataatcggtgtttgtgtttcgcgatagaatagttcgatatcgttaacgatttcgatttcggtattagcggtagcgtttaaggatggatgcgttagtgtaattatcgggattggcgataattagatttgtcgttattagttatttattatttagattgttcgtgtggcgtttacggtttcgggtaattatttaggttaggcggtgttatacgcgtatttataacgcgcggcgttatatcgcgagcgaggaaaaagtttacgtaggaaagttcggtgaggtttaggtcgataatgacgcgtttcgttagtgatgatgtagaaacgggttattttagaggtcgtattcgtcgtggtattgatggcgattatcggtagttgcggttttgtagagcggttaacgttttcgtaatcgcgaatatcgtcgttattg

SEQ ID NO: 31270 - DNA, 506 bp, Artificial Sequence
  chemically treated genomic DNA (Homo sapiens) CpG-island No: 31270
caataacgacgatattcgcgattacgaaaacgttaaccgctctacaaaaccgcaactaccgataatcgccatcaataccacgacgaatacgacctctaaaataacccgtttctacatcatcactaacgaaacgcgtcattatcgacctaaacctcaccgaactttcctacgtaaactttttcctcgctcgcgatataacgccgcgcgttataaatacgcgtataacaccgcctaacctaaataattacccgaaaccgtaaacgccacacgaacaatctaaataataaataactaataacgacaaatctaattatcgccaatcccgataattacactaacgcatccatccttaaacgctaccgctaataccgaaatcgaaatcgttaacgatatcgaactattctatcgcgaaacacaaacaccgattataacgattaccgattctaacgacaaaaacacgatcaccacgctaataaataaaataacgaaaacgacgaaaattaacg

SEQ ID NO: 31271 - DNA, 506 bp, Artificial Sequence
  chemically treated genomic DNA (Homo sapiens) CpG-island No: 31271
taatggcggcgatattcgcgattacgaaggcgttgatcgttttgtaaaatcgtagttgtcgatgatcgttattaatattacggcgggtacggtttttgaaatgattcgtttttgtattattattgacgaagcgcgttattatcggtttgggttttatcgggtttttttgcgtggatttttttttcgttcgcggtgtgacgtcgcgcgttatggatacgcgtatgatatcgtttggtttggataattattcgaagtcgtaaacgttatacgggtagtttgaatgatgaatggttgatggcggtagatttgattgtcgttagtttcggtaattgtattggcgtatttatttttaagcgttgtcgttgatgtcggaatcgaaatcgttggcgatatcgagttgttttgtcgcgaagtataagtatcgattgtggcgattatcggttttaacggtaaaagtacggttattacgttagtgggtgaaatggcgaaagcggcgggggttaacg

SEQ ID NO: 31272 - DNA, 506 bp, Artificial Sequence
  chemically treated genomic DNA (Homo sapiens) CpG-island No: 31272
cgttaacccccgccgctttcgccatttcacccactaacgtaataaccgtacttttaccgttaaaaccgataatcgccacaatcgatacttatacttcgcgacaaaacaactcgatatcgccaacgatttcgattccgacatcaacgacaacgcttaaaaataaatacgccaatacaattaccgaaactaacgacaatcaaatctaccgccatcaaccattcatcattcaaactacccgtataacgtttacgacttcgaataattatccaaaccaaacgatatcatacgcgtatccataacgcgcgacgtcacaccgcgaacgaaaaaaaaatccacgcaaaaaaacccgataaaacccaaaccgataataacgcgcttcgtcaataataatacaaaaacgaatcatttcaaaaaccgtacccgccgtaatattaataacgatcatcgacaactacgattttacaaaacgatcaacgccttcgtaatcgcgaatatcgccgccatta

SEQ ID NO: 31273 - DNA, 590 bp, Artificial Sequence
  chemically treated genomic DNA (Homo sapiens) CpG-island No: 31273
agggtcgcgtttcgagcggttagagcggttagagggcgagttgcgcggcgtagcgcggcggggaggtaagatggcgtcgtgtttggcgtttttttttggtcgttgttagtttcgttgtttttttttttcgttaggttagcgcggtatttcgttttttgcggcgttcggggttatttttgatggtttagtttggggaattgggtttttcggcggtcgggagtcgtaggataagatggcgttcgtagtacgtttaggttttgcgggtcggggtcgggagtttcgaggcggtcgggataaaggcggtagcgtgcgggcgcgtgggggcggggcggggcggggcggggcggggcgtcgcgcgtcgttcgttgtaggggtttcgcgagagattggcgtcgcgttttcggtttgttgttttggggattcgattaacgtggtgggggttagagcggcgagcggttttggagaaggggaggttgggcgggttagttatcggtcgtttcgcggaagaacgtagataaggattttgggtaaggttaaagtttttttggttttttgtgtgatatgttttttttttttatttttcgtttttt

SEQ ID NO: 31274 - DNA, 590 bp, Artificial Sequence
  chemically treated genomic DNA (Homo sapiens) CpG-island No: 31274
aaaaaacgaaaaataaaaaaaaaaaacatatcacacaaaaaaccaaaaaaactttaaccttacccaaaatccttatctacgttcttccgcgaaacgaccgataactaacccgcccaacctccccttctccaaaaccgctcgccgctctaacccccaccacgttaatcgaatccccaaaacaacaaaccgaaaacgcgacgccaatctctcgcgaaacccctacaacgaacgacgcgcgacgccccgccccgccccgccccgccccgcccccacgcgcccgcacgctaccgcctttatcccgaccgcctcgaaactcccgaccccgacccgcaaaacctaaacgtactacgaacgccatcttatcctacgactcccgaccgccgaaaaacccaattccccaaactaaaccatcaaaaataaccccgaacgccgcaaaaaacgaaataccgcgctaacctaacgaaaaaaaaaaacaacgaaactaacaacgaccaaaaaaaaacgccaaacacgacgccatcttacctccccgccgcgctacgccgcgcaactcgccctctaaccgctctaaccgctcgaaacgcgaccct

SEQ ID NO: 31275 - DNA, 590 bp, Artificial Sequence
  chemically treated genomic DNA (Homo sapiens) CpG-island No: 31275
agagggcgagaggtgaagggggaaggtatgttatataaaagattaaaagggttttaattttgtttaaagtttttgtttgcgttttttcgcggggcgatcggtggttaattcgtttagtttttttttttttagaatcgttcgtcgttttggtttttattacgttggtcgaatttttagagtagtagatcggaagcgcggcgttagtttttcgcgggatttttgtaacgaacggcgcgcggcgtttcgtttcgtttcgtttcgtttcgtttttacgcgttcgtacgttgtcgtttttgtttcggtcgtttcggagttttcggtttcggttcgtaaagtttaggcgtgttgcgagcgttattttgttttacggttttcggtcgtcggagaatttagttttttaagttgagttattaagagtgatttcggacgtcgtaggagacgaagtgtcgcgttgatttgacggaaagggggagtagcgaagttaatagcggttaaggggaagcgttaggtacggcgttattttattttttcgtcgcgttgcgtcgcgtagttcgttttttggtcgttttggtcgttcggagcgcggtttt

SEQ ID NO: 31276 - DNA, 590 bp, Artificial Sequence
  chemically treated genomic DNA (Homo sapiens) CpG-island No: 31276
aaaaccgcgctccgaacgaccaaaacgaccaaaaaacgaactacgcgacgcaacgcgacgaaaaaataaaataacgccgtacctaacgcttccccttaaccgctattaacttcgctactccccctttccgtcaaatcaacgcgacacttcgtctcctacgacgtccgaaatcactcttaataactcaacttaaaaaactaaattctccgacgaccgaaaaccgtaaaacaaaataacgctcgcaacacgcctaaactttacgaaccgaaaccgaaaactccgaaacgaccgaaacaaaaacgacaacgtacgaacgcgtaaaaacgaaacgaaacgaaacgaaacgaaacgccgcgcgccgttcgttacaaaaatcccgcgaaaaactaacgccgcgcttccgatctactactctaaaaattcgaccaacgtaataaaaaccaaaacgacgaacgattctaaaaaaaaaaaaactaaacgaattaaccaccgatcgccccgcgaaaaaacgcaaacaaaaactttaaacaaaattaaaacccttttaatcttttatataacataccttcccccttcacctctcgccctct

SEQ ID NO: 31277 - DNA, 685 bp, Artificial Sequence
  chemically treated genomic DNA (Homo sapiens) CpG-island No: 31277
agtgagttgtggtagtatttgtcgaatgttgtcggcggtggagataatgttagtatcgggttggcgttgaatatttattataatggtttgttttttgttcgtttacgcgtcgagttagttgttttttgtattttgttttatagttgcgatatcgtttagacgaattggcgcgtcgttttggtaggcgatgattagttggcgatatttttcgtcggattgtatttggtcgttcgcggaaagtcgtgatcgtacgggaagggtcgtcgaggttattttttgtcgagttaacgttagcgtcggtaatggtcggtgcgtacggtttcgttggttaggtcgaggtcggtaatcgtttgagcgttaagtttgacgcgaatagtcggacgttgatcgtcggaaagcgttattaggtcgacgtcggaaatattgcgagatttttttgcgcgatagcgggtttttattatattttttatttgcgttatcggtatggcggttgaggtgacggcgagtcgttatgatcggcggatttgatcgggtttattgtgttgtaaatcggcgggttacggtagatcgttcggttaatatagttggtcgtagcgttaatcgcggtttgtattttttgttcggtagatatcgagcggtaatgttagttggaattgtaaagtgataattgacgtatcgttaggaa

SEQ ID NO: 31278 - DNA, 685 bp, Artificial Sequence
  chemically treated genomic DNA (Homo sapiens) CpG-island No: 31278
ttcctaacgatacgtcaattatcactttacaattccaactaacattaccgctcgatatctaccgaacaaaaaatacaaaccgcgattaacgctacgaccaactatattaaccgaacgatctaccgtaacccgccgatttacaacacaataaacccgatcaaatccgccgatcataacgactcgccgtcacctcaaccgccataccgataacgcaaataaaaaatataataaaaacccgctatcgcgcaaaaaaatctcgcaatatttccgacgtcgacctaataacgctttccgacgatcaacgtccgactattcgcgtcaaacttaacgctcaaacgattaccgacctcgacctaaccaacgaaaccgtacgcaccgaccattaccgacgctaacgttaactcgacaaaaaataacctcgacgacccttcccgtacgatcacgactttccgcgaacgaccaaatacaatccgacgaaaaatatcgccaactaatcatcgcctaccaaaacgacgcgccaattcgtctaaacgatatcgcaactataaaacaaaatacaaaaaacaactaactcgacgcgtaaacgaacaaaaaacaaaccattataataaatattcaacgccaacccgatactaacattatctccaccgccgacaacattcgacaaatactaccacaactcact

SEQ ID NO: 31279 - DNA, 685 bp, Artificial Sequence
  chemically treated genomic DNA (Homo sapiens) CpG-island No: 31279
tttttggcggtgcgttagttattattttgtagttttagttaatattatcgttcgatgtttgtcgagtaggaagtgtaggtcgcgattaacgttgcgattaattatgttgatcgagcgatttgtcgtaattcgtcggtttatagtatagtgaattcggttagattcgtcgattatgacgattcgtcgttattttaatcgttatgtcgatgacgtaagtggaagatatggtggaaattcgttgtcgcgtagaagaatttcgtagtattttcggcgtcggtttggtgacgtttttcggcggttagcgttcggttgttcgcgttaaatttaacgtttaggcgattgtcgatttcggtttgattagcgaaatcgtgcgtatcgattattatcggcgttaacgttaattcggtaaaaggtagtttcgacggtttttttcgtgcggttacgatttttcgcgaacgattagatgtaattcgacgaagagtatcgttagttaattatcgtttattagaacggcgcgttaattcgtttgggcgatgtcgtaattgtagagtaaggtgtagaaaatagttggttcggcgcgtgggcgaataaagaataggttattgtgatgaatgtttagcgttagttcggtgttaatattatttttatcgtcgatagtattcggtagatgttgttatagtttatt

SEQ ID NO: 31280 - DNA, 685 bp, Artificial Sequence
  chemically treated genomic DNA (Homo sapiens) CpG-island No: 31280
aataaactataacaacatctaccgaatactatcgacgataaaaataatattaacaccgaactaacgctaaacattcatcacaataacctattctttattcgcccacgcgccgaaccaactattttctacaccttactctacaattacgacatcgcccaaacgaattaacgcgccgttctaataaacgataattaactaacgatactcttcgtcgaattacatctaatcgttcgcgaaaaatcgtaaccgcacgaaaaaaaccgtcgaaactaccttttaccgaattaacgttaacgccgataataatcgatacgcacgatttcgctaatcaaaccgaaatcgacaatcgcctaaacgttaaatttaacgcgaacaaccgaacgctaaccgccgaaaaacgtcaccaaaccgacgccgaaaatactacgaaattcttctacgcgacaacgaatttccaccatatcttccacttacgtcatcgacataacgattaaaataacgacgaatcgtcataatcgacgaatctaaccgaattcactatactataaaccgacgaattacgacaaatcgctcgatcaacataattaatcgcaacgttaatcgcgacctacacttcctactcgacaaacatcgaacgataatattaactaaaactacaaaataataactaacgcaccgccaaaaa

SEQ ID NO: 31281 - DNA, 622 bp, Artificial Sequence
  chemically treated genomic DNA (Homo sapiens) CpG-island No: 31281
atgcgtagtgattgttgaattatcgtagtttttgttagtaaagaatttaatttgtttttttttttagatagtatttagcgtttgcggcgtattatcgcgcgtttcgtcggtaatttttttcgttattttgtcgttgtcgatagcggtattcgttagttttagtagtagattaaatagtacggtataacggtttttacgttgttgtagacgcgcgtttagtaatgttagaatcggtagcgatattttttaaattttttacggtttcgttatgcggtagttgcgttaggtattttagatatagcggtagatggttcggtaattcgcggttgtttaattgtaagtcgtgttgttttgtattgcgttagtaggtttattatcgtttggtcgcggtcgcgggattcgtcgtgtatatgtttaaatagtaatagtgacgtggcgcggttacggtcgaatagttcgttgtatatgcgtttgggtatcgagcggatttatcgtcgttaaatcgcgtaggaaaatgtttagcgtatgggtattttttttttggtagatttttcgacgcggtaatcgttttaaatattttttgttgatgttgttataaggtagtattcgatatttaaggaga

SEQ ID NO: 31282 - DNA, 622 bp, Artificial Sequence
  chemically treated genomic DNA (Homo sapiens) CpG-island No: 31282
tctccttaaatatcgaatactaccttataacaacatcaacaaaaaatatttaaaacgattaccgcgtcgaaaaatctaccaaaaaaaaaatacccatacgctaaacattttcctacgcgatttaacgacgataaatccgctcgatacccaaacgcatatacaacgaactattcgaccgtaaccgcgccacgtcactattactatttaaacatatacacgacgaatcccgcgaccgcgaccaaacgataataaacctactaacgcaatacaaaacaacacgacttacaattaaacaaccgcgaattaccgaaccatctaccgctatatctaaaatacctaacgcaactaccgcataacgaaaccgtaaaaaatttaaaaaatatcgctaccgattctaacattactaaacgcgcgtctacaacaacgtaaaaaccgttataccgtactatttaatctactactaaaactaacgaataccgctatcgacaacgacaaaataacgaaaaaaattaccgacgaaacgcgcgataatacgccgcaaacgctaaatactatctaaaaaaaaaaacaaattaaattctttactaacaaaaactacgataattcaacaatcactacgcat

SEQ ID NO: 31283 - DNA, 622 bp, Artificial Sequence
  chemically treated genomic DNA (Homo sapiens) CpG-island No: 31283
tttttttgaatatcggatgttgttttatggtagtattaataagagatgtttgaggcgattgtcgcgtcgaaaaatttgttaagaagaggatgtttatgcgttgggtatttttttgcgcgatttaacgacgatggattcgttcgatgtttaggcgtatgtatagcgaattgttcgatcgtggtcgcgttacgttattgttgttgtttgaatatgtgtacggcgaatttcgcgatcgcggttaggcgatggtggatttgttggcgtagtatagagtagtacggtttgtagttaaatagtcgcgaattgtcggattatttgtcgttgtatttggagtatttggcgtagttgtcgtatagcgaagtcgtggaaggtttgaaagatatcgttgtcgattttggtattgttgagcgcgcgtttgtaatagcgtgaaagtcgttatgtcgtgttgtttgatttgttgttgaaattggcgaatatcgttatcgatagcgataaagtggcggaaaaaattgtcgacgaagcgcgcgatgatacgtcgtaggcgttggatgttgtttgggaagaagagtaggttaaattttttgttgataaaggttgcggtgatttagtaattattgcgtat

SEQ ID NO: 31284 - DNA, 622 bp, Artificial Sequence
  chemically treated genomic DNA (Homo sapiens) CpG-island No: 31284
atacgcaataattactaaatcaccgcaacctttatcaacaaaaaatttaacctactcttcttcccaaacaacatccaacgcctacgacgtatcatcgcgcgcttcgtcgacaattttttccgccactttatcgctatcgataacgatattcgccaatttcaacaacaaatcaaacaacacgacataacgactttcacgctattacaaacgcgcgctcaacaataccaaaatcgacaacgatatctttcaaaccttccacgacttcgctatacgacaactacgccaaatactccaaatacaacgacaaataatccgacaattcgcgactatttaactacaaaccgtactactctatactacgccaacaaatccaccatcgcctaaccgcgatcgcgaaattcgccgtacacatattcaaacaacaacaataacgtaacgcgaccacgatcgaacaattcgctatacatacgcctaaacatcgaacgaatccatcgtcgttaaatcgcgcaaaaaaatacccaacgcataaacatcctcttcttaacaaatttttcgacgcgacaatcgcctcaaacatctcttattaatactaccataaaacaacatccgatattcaaaaaaa

SEQ ID NO: 31285 - DNA, 516 bp, Artificial Sequence
  chemically treated genomic DNA (Homo sapiens) CpG-island No: 31285
ttaggcgattaaggcgattaacgggaagagattgtgtagggcgatattatgtggtgatcggcggcggtcgttcggtatcggtatggaagagatttattagttattttcgcgttaaagtatatttcgtggggtaagacggtgtcgtttattatcgatgcgcgtttttcgggcgtgtcgacgggcgtttgtttcggttacgtgtcgtcggaggcgttggcgggcgggtcgattggtaagttgcgcgataacgatattatcgagattgtcgtggatcgtttgacgttaattggtagcgtgaattttatcggtatcgcggataattcgttgacgtcggaagagggcgcgcgcgagttggcgcggcggtagacgtattcggatttgtacgtttacgattttttgtcggacgatattcggttgtgggcggtattgtagtcggtgagcggcggtatttggaaaggttgtatttatgatatcgataaaattatcgaggtaattaacgtcggtaaaaaagcgttt

SEQ ID NO: 31286 - DNA, 516 bp, Artificial Sequence
  chemically treated genomic DNA (Homo sapiens) CpG-island No: 31286
aaacgcttttttaccgacgttaattacctcgataattttatcgatatcataaatacaacctttccaaataccgccgctcaccgactacaataccgcccacaaccgaatatcgtccgacaaaaaatcgtaaacgtacaaatccgaatacgtctaccgccgcgccaactcgcgcgcgccctcttccgacgtcaacgaattatccgcgataccgataaaattcacgctaccaattaacgtcaaacgatccacgacaatctcgataatatcgttatcgcgcaacttaccaatcgacccgcccgccaacgcctccgacgacacgtaaccgaaacaaacgcccgtcgacacgcccgaaaaacgcgcatcgataataaacgacaccgtcttaccccacgaaatatactttaacgcgaaaataactaataaatctcttccataccgataccgaacgaccgccgccgatcaccacataatatcgccctacacaatctcttcccgttaatcgccttaatcgcctaa

SEQ ID NO: 31287 - DNA, 516 bp, Artificial Sequence
  chemically treated genomic DNA (Homo sapiens) CpG-island No: 31287
gagcgtttttttatcggcgttaattatttcgataattttatcggtgttataaatatagtttttttaggtgtcgtcgtttatcgattgtagtgtcgtttatagtcgggtgtcgttcggtaaaaagtcgtgggcgtgtaggttcgggtgcgtttgtcgtcgcgttagttcgcgcgcgttttttttcggcgttagcgggttgttcgcggtgtcgatgaagtttacgttgttagttaacgttagacgatttacggtaatttcgatgatgtcgttatcgcgtagtttgttaatcggttcgttcgttagcgttttcggcgatacgtggtcgaagtaggcgttcgtcgatacgttcgagaagcgcgtatcggtgatgagcgatatcgttttgttttacgagatatgttttagcgcggaggtagttggtaggttttttttatgtcggtgtcggacggtcgtcgtcgattattatatgatatcgttttgtataattttttttcgttgatcgttttgatcgtttgg

SEQ ID NO: 31288 - DNA, 516 bp, Artificial Sequence
  chemically treated genomic DNA (Homo sapiens) CpG-island No: 31288
ccaaacgatcaaaacgatcaacgaaaaaaaattatacaaaacgatatcatataataatcgacgacgaccgtccgacaccgacataaaaaaaacctaccaactacctccgcgctaaaacatatctcgtaaaacaaaacgatatcgctcatcaccgatacgcgcttctcgaacgtatcgacgaacgcctacttcgaccacgtatcgccgaaaacgctaacgaacgaaccgattaacaaactacgcgataacgacatcatcgaaattaccgtaaatcgtctaacgttaactaacaacgtaaacttcatcgacaccgcgaacaacccgctaacgccgaaaaaaaacgcgcgcgaactaacgcgacgacaaacgcacccgaacctacacgcccacgactttttaccgaacgacacccgactataaacgacactacaatcgataaacgacgacacctaaaaaaactatatttataacaccgataaaattatcgaaataattaacgccgataaaaaaacgctc

SEQ ID NO: 31289 - DNA, 800 bp, Artificial Sequence
  chemically treated genomic DNA (Homo sapiens) CpG-island No: 31289
gacgtttcgtttcgtttcgttttttttttttttttcgcgtcgggcgggttgttgtatcgtcgttattcgggcgcgcgcggggtcgcgcggacgcggttcgggtcgcgggtgtcgagaggtcgtcgggttattcgtattttcgtttttcgtttgacgtacggaggggtcgggacgcgatttgtcgcgagtgattggagtcgtagtcgtcgtcgttgttgtcgtcgtcgttcgggttcgtttcgtttttagttcgtttttttttcgtcgcgtttttcgttttcgttcgtatttcgatagcgtttttttgttttttttaacgtttcggagtcgtcggtcgttagcgttagcgttagttaggtgagtgtggtcgtcgttcggttcgggcgggagaagcgcgtaggtttcgcggtcgggtggtcggtttgggtcggtgtagtcggcggcggcggcggtagcgggttcggttttttttttttgcgcgggtcgcggggcggaggggttacgtagtgaaggaggggcgttttcgtttcgttatcgtttttgtttttaacgtttcgatcgtttttatcgttttgtcgttatagataaagcgtcggaggtgggagttttgcgggtcgtttttgttttcgcgtcgtttgtcgggtgcggtcgcggttcgtagagatcgggtcgcgcgttttttcgtttttgagcgtttttgtttatttttgggtgaaagggattcgaattgtgtaataggtttgggcgttagtttttattttttagcgggttttttttgttagcgtgtaggaattagatgt

SEQ ID NO: 31290 - DNA, 800 bp, Artificial Sequence
  chemically treated genomic DNA (Homo sapiens) CpG-island No: 31290
acatctaattcctacacgctaacaaaaaaaacccgctaaaaaataaaaactaacgcccaaacctattacacaattcgaatccctttcacccaaaaataaacaaaaacgctcaaaaacgaaaaaacgcgcgacccgatctctacgaaccgcgaccgcacccgacaaacgacgcgaaaacaaaaacgacccgcaaaactcccacctccgacgctttatctataacgacaaaacgataaaaacgatcgaaacgttaaaaacaaaaacgataacgaaacgaaaacgcccctccttcactacgtaacccctccgccccgcgacccgcgcaaaaaaaaaaaaccgaacccgctaccgccgccgccgccgactacaccgacccaaaccgaccacccgaccgcgaaacctacgcgcttctcccgcccgaaccgaacgacgaccacactcacctaactaacgctaacgctaacgaccgacgactccgaaacgttaaaaaaaacaaaaaaacgctatcgaaatacgaacgaaaacgaaaaacgcgacgaaaaaaaaacgaactaaaaacgaaacgaacccgaacgacgacgacaacaacgacgacgactacgactccaatcactcgcgacaaatcgcgtcccgacccctccgtacgtcaaacgaaaaacgaaaatacgaataacccgacgacctctcgacacccgcgacccgaaccgcgtccgcgcgaccccgcgcgcgcccgaataacgacgatacaacaacccgcccgacgcgaaaaaaaaaaaaaaaacgaaacgaaacgaaacgtc

SEQ ID NO: 31291 - DNA, 800 bp, Artificial Sequence
  chemically treated genomic DNA (Homo sapiens) CpG-island No: 31291
atatttggtttttgtacgttggtaaaagagattcgttggaaaataaggattaacgtttaaatttgttgtataattcgggttttttttatttagaaatgaataagggcgtttaggaacggaaaagcgcgcggttcggtttttgcgggtcgcggtcgtattcggtagacggcgcggaggtaaaggcggttcgtagggtttttattttcggcgttttgtttgtggcggtaaggcggtgggggcggtcggggcgttgggagtagaggcggtggcggggcgggggcgttttttttttattgcgtagttttttcgtttcgcggttcgcgtaggggaagaaagtcgggttcgttatcgtcgtcgtcgtcgattgtatcggtttaagtcggttattcggtcgcggggtttgcgcgtttttttcgttcgggtcgagcggcggttatatttatttggttggcgttgacgttagcggtcggcggtttcggggcgttggggaagataggggaacgttatcgaggtgcgggcggaggcggagggcgcggcgggaggaaggcgggttgggggcggagcgggttcgggcggcggcggtagtagcggcgacggttgcggttttagttattcgcggtaaatcgcgtttcggttttttcgtgcgttaggcggggagcgggggtgcgggtggttcggcgatttttcggtattcgcggttcgagtcgcgttcgcgcgatttcgcgcgcgttcgggtgacggcggtatagtaattcgttcggcgcgggaaggaggaaggaggcggggcggggcggggcgtt

SEQ ID NO: 31292 - DNA, 800 bp, Artificial Sequence
  chemically treated genomic DNA (Homo sapiens) CpG-island No: 31292
aacgccccgccccgccccgcctccttcctccttcccgcgccgaacgaattactataccgccgtcacccgaacgcgcgcgaaatcgcgcgaacgcgactcgaaccgcgaataccgaaaaatcgccgaaccacccgcacccccgctccccgcctaacgcacgaaaaaaccgaaacgcgatttaccgcgaataactaaaaccgcaaccgtcgccgctactaccgccgccgcccgaacccgctccgcccccaacccgccttcctcccgccgcgccctccgcctccgcccgcacctcgataacgttcccctatcttccccaacgccccgaaaccgccgaccgctaacgtcaacgccaaccaaataaatataaccgccgctcgacccgaacgaaaaaaacgcgcaaaccccgcgaccgaataaccgacttaaaccgatacaatcgacgacgacgacgataacgaacccgactttcttcccctacgcgaaccgcgaaacgaaaaaactacgcaataaaaaaaaaacgcccccgccccgccaccgcctctactcccaacgccccgaccgcccccaccgccttaccgccacaaacaaaacgccgaaaataaaaaccctacgaaccgcctttacctccgcgccgtctaccgaatacgaccgcgacccgcaaaaaccgaaccgcgcgcttttccgttcctaaacgcccttattcatttctaaataaaaaaaacccgaattatacaacaaatttaaacgttaatccttattttccaacgaatctcttttaccaacgtacaaaaaccaaatat

SEQ ID NO: 31293 - DNA, 569 bp, Artificial Sequence
  chemically treated genomic DNA (Homo sapiens) CpG-island No: 31293
ttcgtcgttttagggtataaagaaagagcgcgtttatagggtgttttttgatttcggcgattcggggttagggaggttcggcgcgttttagcggtcgttttttttttttcgaattcgttcggtttattcgtttttgtatcgcggtcgtttcggttcggttttttttttgtagtgagttgagtgcgtttagtcgaggaggggtcgcgtcgcgtcgcgtcggtcgcggggtttagtttttttcgtcgcgttcggggtcgtttttttcgttggagtcggttgatcgatggttttggtagttcgcgtttttcgtttcggttcgttcgcgagttcggttgtgtgttttggaagtagcgtagcgggtcgtagtcgtgtgacgttcggagcgggtagcgtcgttttttttttttttcgggttcgggacggaggtttatattttttatattttaaagatgaagtttatgggatagtacgacgttttatgagtcggcgtcggttttgggtattttttacgtggttttttttggatttgcgttatttaaaatatgcgattttattatttgaggttatcg

SEQ ID NO: 31294 - DNA, 569 bp, Artificial Sequence
  chemically treated genomic DNA (Homo sapiens) CpG-island No: 31294
cgataacctcaaataataaaatcgcatattttaaataacgcaaatccaaaaaaaaccacgtaaaaaatacccaaaaccgacgccgactcataaaacgtcgtactatcccataaacttcatctttaaaatataaaaaatataaacctccgtcccgaacccgaaaaaaaaaaaaaacgacgctacccgctccgaacgtcacacgactacgacccgctacgctacttccaaaacacacaaccgaactcgcgaacgaaccgaaacgaaaaacgcgaactaccaaaaccatcgatcaaccgactccaacgaaaaaaacgaccccgaacgcgacgaaaaaaactaaaccccgcgaccgacgcgacgcgacgcgacccctcctcgactaaacgcactcaactcactacaaaaaaaaaaccgaaccgaaacgaccgcgatacaaaaacgaataaaccgaacgaattcgaaaaaaaaaaaacgaccgctaaaacgcgccgaacctccctaaccccgaatcgccgaaatcaaaaaacaccctataaacgcgctctttctttataccctaaaacgacgaa

SEQ ID NO: 31295 - DNA, 569 bp, Artificial Sequence
  chemically treated genomic DNA (Homo sapiens) CpG-island No: 31295
cggtaattttaagtagtgaaatcgtatattttaaataacgtaagtttaggaaaggttacgtggaggatatttagaatcgacgtcggtttatgggacgtcgtgttgttttataagttttatttttaaaatgtaaagggtgtgagttttcgtttcgagttcgggggaaagaaagggcggcgttgttcgtttcgggcgttatacggttgcggttcgttgcgttgtttttaaaatatatagtcgggttcgcgggcgagtcgaggcggggggcgcgggttgttagggttatcgattagtcggttttagcgggaagggcggtttcgggcgcggcgggaagggttgggtttcgcggtcggcgcggcgcggcgcggttttttttcggttgagcgtatttagtttattgtaagagaaaagtcgagtcgaggcggtcgcggtgtaggagcgagtgggtcgggcgggttcgggaggggaagagcggtcgttggggcgcgtcgagtttttttggtttcgagtcgtcggggttaggggatattttgtaggcgcgttttttttttgtgttttggggcgacggg

SEQ ID NO: 31296 - DNA, 569 bp, Artificial Sequence
  chemically treated genomic DNA (Homo sapiens) CpG-island No: 31296
cccgtcgccccaaaacacaaaaaaaaaacgcgcctacaaaatatcccctaaccccgacgactcgaaaccaaaaaaactcgacgcgccccaacgaccgctcttcccctcccgaacccgcccgacccactcgctcctacaccgcgaccgcctcgactcgacttttctcttacaataaactaaatacgctcaaccgaaaaaaaaccgcgccgcgccgcgccgaccgcgaaacccaacccttcccgccgcgcccgaaaccgcccttcccgctaaaaccgactaatcgataaccctaacaacccgcgccccccgcctcgactcgcccgcgaacccgactatatattttaaaaacaacgcaacgaaccgcaaccgtataacgcccgaaacgaacaacgccgccctttctttcccccgaactcgaaacgaaaactcacaccctttacattttaaaaataaaacttataaaacaacacgacgtcccataaaccgacgtcgattctaaatatcctccacgtaacctttcctaaacttacgttatttaaaatatacgatttcactacttaaaattaccg

SEQ ID NO: 31297 - DNA, 583 bp, Artificial Sequence
  chemically treated genomic DNA (Homo sapiens) CpG-island No: 31297
gtgaaaagcgaggaggttgaggttgtatcgtcgtggagattagggatcgattgtcgttttgggaacgaggttttaggaatgcgtatgcgtaaaagttacgcgggcgaatacggtttcgtttcgttaagtatgcgcgtcgtttttttcgtttatcgtttttagaagaatggtgttttttcgtagcgttttttttaggagcgatcgggaattggcgtatgcgtattacggtggtggtggcgacgaaggcgggggttgtacgttgtttgtttcgagttttaggtggcgttatttttcgggttgagtcgaagtacgtacgcgcggaggttcgtacgcggagaagggcgggtgcgcgtcgcggtatgcgcggtgcggggcgagacggcggttcgacggggttattcgggcgtaggcgtagtgcggtgtttgtttgtcggattgacgggcggtcgggcggtgcgcggcggcggtggcggcggggaagatggcggcgttttttttggaatagaagttgtttcgtttggaagtaaagttgaagtaggagaatcgggaggttcggcggaggatcgattttaatttggatatt

SEQ ID NO: 31298 - DNA, 583 bp, Artificial Sequence
  chemically treated genomic DNA (Homo sapiens) CpG-island No: 31298
aatatccaaattaaaatcgatcctccgccgaacctcccgattctcctacttcaactttacttccaaacgaaacaacttctattccaaaaaaaacgccgccatcttccccgccgccaccgccgccgcgcaccgcccgaccgcccgtcaatccgacaaacaaacaccgcactacgcctacgcccgaataaccccgtcgaaccgccgtctcgccccgcaccgcgcataccgcgacgcgcacccgcccttctccgcgtacgaacctccgcgcgtacgtacttcgactcaacccgaaaaataacgccacctaaaactcgaaacaaacaacgtacaacccccgccttcgtcgccaccaccaccgtaatacgcatacgccaattcccgatcgctcctaaaaaaaacgctacgaaaaaacaccattcttctaaaaacgataaacgaaaaaaacgacgcgcatacttaacgaaacgaaaccgtattcgcccgcgtaacttttacgcatacgcattcctaaaacctcgttcccaaaacgacaatcgatccctaatctccacgacgatacaacctcaacctcctcgcttttcac

SEQ ID NO: 31299 - DNA, 583 bp, Artificial Sequence
  chemically treated genomic DNA (Homo sapiens) CpG-island No: 31299
gatatttaggttgaggtcgatttttcgtcgggtttttcggtttttttgttttagttttgtttttaggcgggatagtttttgttttagggaggacgtcgttatttttttcgtcgttatcgtcgtcgcgtatcgttcggtcgttcgttagttcggtagataaatatcgtattgcgtttgcgttcggatgatttcgtcgagtcgtcgtttcgtttcgtatcgcgtatgtcgcggcgcgtattcgttttttttcgcgtgcgaattttcgcgcgtgcgtgtttcggtttagttcgaaggatgacgttatttagagttcgaggtaggtaacgtgtaattttcgttttcgtcgttattattatcgtagtgcgtatgcgttaattttcgatcgtttttgagagaggcgttgcgaggaaatattatttttttgaggacggtgggcggggaaaacggcgcgtatgtttagcgaggcgaagtcgtgttcgttcgcgtggtttttgcgtatgcgtatttttggaatttcgtttttaaagcggtagtcgatttttggtttttacggcggtgtagttttagttttttcgttttttat

SEQ ID NO: 31300 - DNA, 583 bp, Artificial Sequence
  chemically treated genomic DNA (Homo sapiens) CpG-island No: 31300
ataaaaaacgaaaaaactaaaactacaccgccgtaaaaaccaaaaatcgactaccgctttaaaaacgaaattccaaaaatacgcatacgcaaaaaccacgcgaacgaacacgacttcgcctcgctaaacatacgcgccgttttccccgcccaccgtcctcaaaaaaataatatttcctcgcaacgcctctctcaaaaacgatcgaaaattaacgcatacgcactacgataataataacgacgaaaacgaaaattacacgttacctacctcgaactctaaataacgtcatccttcgaactaaaccgaaacacgcacgcgcgaaaattcgcacgcgaaaaaaaacgaatacgcgccgcgacatacgcgatacgaaacgaaacgacgactcgacgaaatcatccgaacgcaaacgcaatacgatatttatctaccgaactaacgaacgaccgaacgatacgcgacgacgataacgacgaaaaaaataacgacgtcctccctaaaacaaaaactatcccgcctaaaaacaaaactaaaacaaaaaaaccgaaaaacccgacgaaaaatcgacctcaacctaaatatc

SEQ ID NO: 31301 - DNA, 508 bp, Artificial Sequence
  chemically treated genomic DNA (Homo sapiens) CpG-island No: 31301
attcggagcgtacgtcggttttttcgttagtttttatcggttttttttggttttttcgagggatgtttgtatttgtcgggacgaagcggtttcgttgttcgcgaacgcgttcgggagataaagagtcgcgtttcgggttcgattttttttttagtcgggtttggttcgttttagtttttttatttgttcgcgtcggtttattttcgttttcgttttcggtttttttatagagtcgtttggggtggggttcgggtcggagcgacgcgttggcgttagtcgagagaggcgaggggagggggttgcgggttgcggcgtcgggggagtcgagtcggtttcgtttttcggtcgcgggcgggagagtcgggggcgcgcgttcgattcggattcgggagcgcggtcggcggaagcgcgtcgagggggatgggggagaagcgcgttttggagagaagggtggtttttttgcggttcgggggaagtttgtttttttagttgcgtttgaggaatttag

SEQ ID NO: 31302 - DNA, 508 bp, Artificial Sequence
  chemically treated genomic DNA (Homo sapiens) CpG-island No: 31302
ctaaattcctcaaacgcaactaaaaaaacaaacttcccccgaaccgcaaaaaaaccacccttctctccaaaacgcgcttctcccccatccccctcgacgcgcttccgccgaccgcgctcccgaatccgaatcgaacgcgcgcccccgactctcccgcccgcgaccgaaaaacgaaaccgactcgactcccccgacgccgcaacccgcaaccccctcccctcgcctctctcgactaacgccaacgcgtcgctccgacccgaaccccaccccaaacgactctataaaaaaaccgaaaacgaaaacgaaaataaaccgacgcgaacaaataaaaaaactaaaacgaaccaaacccgactaaaaaaaaaatcgaacccgaaacgcgactctttatctcccgaacgcgttcgcgaacaacgaaaccgcttcgtcccgacaaatacaaacatccctcgaaaaaaccaaaaaaaaccgataaaaactaacgaaaaaaccgacgtacgctccgaat

SEQ ID NO: 31303 - DNA, 508 bp, Artificial Sequence
  chemically treated genomic DNA (Homo sapiens) CpG-island No: 31303
ttgggttttttaggcgtagttggggaaataggtttttttcggatcgtagagaagttatttttttttttaaagcgcgttttttttttatttttttcggcgcgttttcgtcggtcgcgttttcgggttcggatcgagcgcgcgttttcggttttttcgttcgcggtcgaggggcgggatcggttcggttttttcggcgtcgtagttcgtagtttttttttttcgtttttttcggttggcgttaacgcgtcgtttcggttcgggttttattttaggcgattttgtgaggaggtcggaggcggaggcggaggtgagtcgacgcgagtaggtggagaggttgggacgggttaggttcggttgggggaggggtcgggttcgggacgcggttttttgtttttcggacgcgttcgcgggtagcggggtcgtttcgtttcggtaggtgtaggtatttttcggggaggttaggggaggtcgatgggggttggcggggagatcggcgtgcgtttcgggt

SEQ ID NO: 31304 - DNA, 508 bp, Artificial Sequence
  chemically treated genomic DNA (Homo sapiens) CpG-island No: 31304
acccgaaacgcacgccgatctccccgccaacccccatcgacctcccctaacctccccgaaaaatacctacacctaccgaaacgaaacgaccccgctacccgcgaacgcgtccgaaaaacaaaaaaccgcgtcccgaacccgacccctcccccaaccgaacctaacccgtcccaacctctccacctactcgcgtcgactcacctccgcctccgcctccgacctcctcacaaaatcgcctaaaataaaacccgaaccgaaacgacgcgttaacgccaaccgaaaaaaacgaaaaaaaaaaactacgaactacgacgccgaaaaaaccgaaccgatcccgcccctcgaccgcgaacgaaaaaaccgaaaacgcgcgctcgatccgaacccgaaaacgcgaccgacgaaaacgcgccgaaaaaaataaaaaaaaaacgcgctttaaaaaaaaaaataacttctctacgatccgaaaaaaacctatttccccaactacgcctaaaaaacccaa

SEQ ID NO: 31305 - DNA, 508 bp, Artificial Sequence
  chemically treated genomic DNA (Homo sapiens) CpG-island No: 31305
gtgatcgaggtgatgttggtacgggattcgtttaggggagatagtagttcggtttagcggtcgagttcggcgtcgttgagtgtagttcggcgttttttgtgacgttattatttttcgtattttttgggttttcgtcgttgtagttcgcggtattttcggtagtcgttagtagtagcgttcggtttagtaggtgttgtacgacgttcgtttgtagcgtttttagtggtagttcgtttaggcgcgtttgtttcgggtttcgcgaggacgtttcggtttcggttttagtcgtcgtttttttatcgttcgtgtcgggattgggtttcggatttagtgcgttaggggcgggggtcgtcgattcgggttttttagtttcgtagatggtgtatagatcgttagtagagttcggttcggtagcgggaggttacggtaggggcgtatttgcggggagagacgttaggtgggtcgtgggggtgataagttcgtttttgttttaaggtttcgttttttt

SEQ ID NO: 31306 - DNA, 508 bp, Artificial Sequence
  chemically treated genomic DNA (Homo sapiens) CpG-island No: 31306
aaaaaaacgaaaccttaaaacaaaaacgaacttatcacccccacgacccacctaacgtctctccccgcaaatacgcccctaccgtaacctcccgctaccgaaccgaactctactaacgatctatacaccatctacgaaactaaaaaacccgaatcgacgacccccgcccctaacgcactaaatccgaaacccaatcccgacacgaacgataaaaaaacgacgactaaaaccgaaaccgaaacgtcctcgcgaaacccgaaacaaacgcgcctaaacgaactaccactaaaaacgctacaaacgaacgtcgtacaacacctactaaaccgaacgctactactaacgactaccgaaaataccgcgaactacaacgacgaaaacccaaaaaatacgaaaaataataacgtcacaaaaaacgccgaactacactcaacgacgccgaactcgaccgctaaaccgaactactatctcccctaaacgaatcccgtaccaacatcacctcgatcac

SEQ ID NO: 31307 - DNA, 508 bp, Artificial Sequence
  chemically treated genomic DNA (Homo sapiens) CpG-island No: 31307
aaggaggcgggattttgaggtaggggcgggtttattatttttacggtttatttggcgttttttttcgtaggtgcgtttttgtcgtggtttttcgttatcggatcgggttttgttgacggtttgtgtattatttacgagattgaagggttcgagtcggcgattttcgtttttggcgtattggattcggggtttagtttcggtacgagcggtgggaaggcggcggttggggtcggggtcggggcgttttcgcggagttcgaagtaggcgcgtttgggcgagttgttattgggggcgttgtaggcgagcgtcgtgtagtatttgttgagtcggacgttgttgttggcggttgtcgagggtgtcgcgggttgtagcggcgggggtttaggaggtgcggagggtggtggcgttatagggggcgtcgggttgtatttagcgacgtcgaattcggtcgttgggtcgaattattgttttttttggacgagtttcgtgttagtattatttcggttat

SEQ ID NO: 31308 - DNA, 508 bp, Artificial Sequence
  chemically treated genomic DNA (Homo sapiens) CpG-island No: 31308
ataaccgaaataatactaacacgaaactcgtccaaaaaaaacaataattcgacccaacgaccgaattcgacgtcgctaaatacaacccgacgccccctataacgccaccaccctccgcacctcctaaacccccgccgctacaacccgcgacaccctcgacaaccgccaacaacaacgtccgactcaacaaatactacacgacgctcgcctacaacgcccccaataacaactcgcccaaacgcgcctacttcgaactccgcgaaaacgccccgaccccgaccccaaccgccgccttcccaccgctcgtaccgaaactaaaccccgaatccaatacgccaaaaacgaaaatcgccgactcgaacccttcaatctcgtaaataatacacaaaccgtcaacaaaacccgatccgataacgaaaaaccacgacaaaaacgcacctacgaaaaaaaacgccaaataaaccgtaaaaataataaacccgcccctacctcaaaatcccgcctcctt

SEQ ID NO: 31309 - DNA, 650 bp, Artificial Sequence
  chemically treated genomic DNA (Homo sapiens) CpG-island No: 31309
  misc_feature (504)..(504): n is either a, c, g or t
  misc_feature (548)..(548): n is either a, c, g or t
ttatttttattggggcggtttttcgggtttttaaacgcgaagttacgtttttatcgcgcgttcgttttcgcgcggttttttttgatttcggcggttttcgtagtttcgtttatcggagaagcgattttatagcgtttgtttttttttgagcggtatgaagttattttttaggcggcgagcggtttcggcgcgttatttgggcgaggtgatcggtttcgcgatttggagcgttcgcgagaagcggtagttagtgcgatttttgtaggcgcggtagggttagtcggagtcggacgttatcgagttggttcgggagttgcggggtcggagcgaggttgaggtgagatgcggttttcgggatcggagttaggttggaggcggggttggggtggggcggagagtgggcggggttgcggtaggagttagcggggcggggttaggaatgtaagcgagcgggggcgtggcgtggggttgagtggcggggcgttagtgggtgagtttgggcgnggtgaggggcggggcgtggacgggaagagaagatttaggggcgnggcgagtttgggagttagacgtacgcggggtataagtgaagcggaggggtcgggcgatgtcggggtagggtttttttttttattgtacgttttggagaattg

SEQ ID NO: 31310 - DNA, 650 bp, Artificial Sequence
  chemically treated genomic DNA (Homo sapiens) CpG-island No: 31310
  misc_feature (103)..(103): n is either a, c, g or t
  misc_feature (147)..(147): n is either a, c, g or t
caattctccaaaacgtacaataaaaaaaaaaaccctaccccgacatcgcccgacccctccgcttcacttataccccgcgtacgtctaactcccaaactcgccncgcccctaaatcttctcttcccgtccacgccccgcccctcaccncgcccaaactcacccactaacgccccgccactcaaccccacgccacgcccccgctcgcttacattcctaaccccgccccgctaactcctaccgcaaccccgcccactctccgccccaccccaaccccgcctccaacctaactccgatcccgaaaaccgcatctcacctcaacctcgctccgaccccgcaactcccgaaccaactcgataacgtccgactccgactaaccctaccgcgcctacaaaaatcgcactaactaccgcttctcgcgaacgctccaaatcgcgaaaccgatcacctcgcccaaataacgcgccgaaaccgctcgccgcctaaaaaataacttcataccgctcaaaaaaaaacaaacgctataaaatcgcttctccgataaacgaaactacgaaaaccgccgaaatcaaaaaaaaccgcgcgaaaacgaacgcgcgataaaaacgtaacttcgcgtttaaaaacccgaaaaaccgccccaataaaaataa

SEQ ID NO: 31311 - DNA, 650 bp, Artificial Sequence
  chemically treated genomic DNA (Homo sapiens) CpG-island No: 31311
  misc_feature (103)..(103): n is either a, c, g or t
  misc_feature (147)..(147): n is either a, c, g or t
taattttttaaaacgtgtagtggaagggaggattttgtttcggtatcgttcggttttttcgttttatttatgtttcgcgtacgtttagtttttaagttcgttncgtttttaggtttttttttttcgtttacgtttcgttttttattncgtttaggtttatttattaacgtttcgttatttagttttacgttacgttttcgttcgtttatatttttggtttcgtttcgttggtttttgtcgtagtttcgtttatttttcgttttattttagtttcgtttttagtttggtttcggtttcgagaatcgtattttattttagtttcgtttcggtttcgtagttttcgggttagttcggtggcgttcggtttcggttggttttgtcgcgtttgtaggagtcgtattagttgtcgtttttcgcgagcgttttaggtcgcgggatcggttatttcgtttagatagcgcgtcggggtcgttcgtcgtttgggaggtggttttatgtcgtttagaaagaggtaggcgttgtaaggtcgttttttcgatgggcggagttacgggggtcgtcgaggttagaaagaatcgcgcggaggcggacgcgcgatgggggcgtggtttcgcgtttggaggttcggggaatcgttttaatggaagtga

SEQ ID NO: 31312 - DNA, 650 bp, Artificial Sequence
  chemically treated genomic DNA (Homo sapiens) CpG-island No: 31312
  misc_feature (504)..(504): n is either a, c, g or t
  misc_feature (548)..(548): n is either a, c, g or t
tcacttccattaaaacgattccccgaacctccaaacgcgaaaccacgcccccatcgcgcgtccgcctccgcgcgattctttctaacctcgacgacccccgtaactccgcccatcgaaaaaacgaccttacaacgcctacctctttctaaacgacataaaaccacctcccaaacgacgaacgaccccgacgcgctatctaaacgaaataaccgatcccgcgacctaaaacgctcgcgaaaaacgacaactaatacgactcctacaaacgcgacaaaaccaaccgaaaccgaacgccaccgaactaacccgaaaactacgaaaccgaaacgaaactaaaataaaatacgattctcgaaaccgaaaccaaactaaaaacgaaactaaaataaaacgaaaaataaacgaaactacgacaaaaaccaacgaaacgaaaccaaaaatataaacgaacgaaaacgtaacgtaaaactaaataacgaaacgttaataaataaacctaaacgnaataaaaaacgaaacgtaaacgaaaaaaaaaaacctaaaaacgnaacgaacttaaaaactaaacgtacgcgaaacataaataaaacgaaaaaaccgaacgataccgaaacaaaatcctcccttccactacacgttttaaaaaatta

SEQ ID NO: 31313 - DNA, 615 bp, Artificial Sequence
  chemically treated genomic DNA (Homo sapiens) CpG-island No: 31313
  misc_feature (36)..(37): n is either a, c, g or t
gagggtggtgaggattgaggtcggaggaggaggagnnaggcgtagagagagttttagttggagcgggacgtagggaatattcgcggtggtagtagcggttcgcgcgttttcgcgtcgattcgggttcgtttcggttttttcggcggttacgcgggggcggcgtttttgcggggaggagcgcggcgcggcggcggcggttcgtgcgttgtggttcgcgtcgaggtagggcggtggggggtagtcgtagcgggcgcgtgtcgagggcggcggcggcggcgaggtttggcgcgcggggggcgtgtgtcgcgggtaggtgcggtttttggtgcggttcgagttgggtggcggattggtaaggaggagtcgggtcggttgaggcggggtttcggttttgagatttttttcgttttcgtgggcgggatttttttttttttattttttttggaagagcgttaatcgtgtgaggattggagtttttcgggtcgcgtcggttttttttcggttcggcgggtttcggtaatacgtttcgggtttgttacgacgtttgaggaaaatttttcgtgataggaatggggaggttggtgatattggggagggttttttggttatcgtttt

SEQ ID NO: 31314 - DNA, 615 bp, Artificial Sequence
  chemically treated genomic DNA (Homo sapiens) CpG-island No: 31314
  misc_feature (579)..(580): n is either a, c, g or t
aaaacgataaccaaaaaaccctccccaatatcaccaacctccccattcctatcacgaaaaattttcctcaaacgtcgtaacaaacccgaaacgtattaccgaaacccgccgaaccgaaaaaaaaccgacgcgacccgaaaaactccaatcctcacacgattaacgctcttccaaaaaaaataaaaaaaaaaaaatcccgcccacgaaaacgaaaaaaatctcaaaaccgaaaccccgcctcaaccgacccgactcctccttaccaatccgccacccaactcgaaccgcaccaaaaaccgcacctacccgcgacacacgccccccgcgcgccaaacctcgccgccgccgccgccctcgacacgcgcccgctacgactaccccccaccgccctacctcgacgcgaaccacaacgcacgaaccgccgccgccgcgccgcgctcctccccgcaaaaacgccgcccccgcgtaaccgccgaaaaaaccgaaacgaacccgaatcgacgcgaaaacgcgcgaaccgctactaccaccgcgaatattccctacgtcccgctccaactaaaactctctctacgcctnnctcctcctcctccgacctcaatcctcaccaccctc

SEQ ID NO: 31315 - DNA, 615 bp, Artificial Sequence
  chemically treated genomic DNA (Homo sapiens) CpG-island No: 31315
  misc_feature (579)..(580): n is either a, c, g or t
gaagcggtggttaaagggttttttttagtgttattagtttttttatttttgttacggaggattttttttaggcgtcgtgatagattcgaggcgtgttgtcggggttcgtcgggtcgaggaggagtcgacgcggttcggggaattttagtttttatacggttaacgtttttttaaggagagtggaggagggagggtttcgtttacgagaacgaagagaattttagggtcgaagtttcgttttagtcggttcggtttttttttgttagttcgttatttaattcgggtcgtattaggggtcgtatttgttcgcggtatacgtttttcgcgcgttaggtttcgtcgtcgtcgtcgttttcggtacgcgttcgttgcggttgttttttatcgttttgtttcggcgcgggttatagcgtacgagtcgtcgtcgtcgcgtcgcgttttttttcgtagggacgtcgttttcgcgtaatcgtcgaggaagtcgaggcgagttcgggtcggcgcgagggcgcgcgggtcgttgttgttatcgcgggtgttttttgcgtttcgttttagttaggattttttttgcgtttnnttttttttttttcgattttagtttttattattttt

SEQ ID NO: 31316 - DNA, 615 bp, Artificial Sequence
  chemically treated genomic DNA (Homo sapiens) CpG-island No: 31316
  misc_feature (36)..(37): n is either a, c, g or t
aaaaataataaaaactaaaatcgaaaaaaaaaaaannaaacgcaaaaaaaatcctaactaaaacgaaacgcaaaaaacacccgcgataacaacaacgacccgcgcgccctcgcgccgacccgaactcgcctcgacttcctcgacgattacgcgaaaacgacgtccctacgaaaaaaaacgcgacgcgacgacgacgactcgtacgctataacccgcgccgaaacaaaacgataaaaaacaaccgcaacgaacgcgtaccgaaaacgacgacgacgacgaaacctaacgcgcgaaaaacgtataccgcgaacaaatacgacccctaatacgacccgaattaaataacgaactaacaaaaaaaaaccgaaccgactaaaacgaaacttcgaccctaaaattctcttcgttctcgtaaacgaaaccctccctcctccactctccttaaaaaaacgttaaccgtataaaaactaaaattccccgaaccgcgtcgactcctcctcgacccgacgaaccccgacaacacgcctcgaatctatcacgacgcctaaaaaaaatcctccgtaacaaaaataaaaaaactaataacactaaaaaaaaccctttaaccaccgcttc

SEQ ID NO: 31317 - DNA, 617 bp, Artificial Sequence
  chemically treated genomic DNA (Homo sapiens) CpG-island No: 31317
ttcgcgacgggatggaaagtgtagtcgtgttaggggttagggagttagaaaatgttttcgttgttatcgattcgtattagtattcggttggtagtattcgaggggacgggacgcgacgcgacgggacgggcgggacgagggggcggggcggtaggtatagcgcgcgaagacggggtgcggattttcgtattttaggtagttcgcgacggatcggatttagttgttatttagtcgcgagggagggtagcggggtcgaagggagatttgaggtgagaagcggacgtatacgtatttttcgttttttgcgagttgtttgttttcgttttgttttattcgcgtttttttcggtttttttttttttttatttttttgtcgtagttgcgtcgttatcggggttttacgtgatattagattttttcggtacgtgacgtgagaaaggggtcgggttggggcgggataagtcgtttttttttttttttcggaagcgtaatattgaacgtgtttgcgtaatgggtgtcgggttcgtttttttttaattcggacgtaatcgtggtttttgttttgtaataggcggtttagagggaggggttttttcgtttatatttattgtagttttt

SEQ ID NO: 31318 - DNA, 617 bp, Artificial Sequence
  chemically treated genomic DNA (Homo sapiens) CpG-island No: 31318
aaaaactacaataaatataaacgaaaaaacccctccctctaaaccgcctattacaaaacaaaaaccacgattacgtccgaattaaaaaaaaacgaacccgacacccattacgcaaacacgttcaatattacgcttccgaaaaaaaaaaaaaaacgacttatcccgccccaacccgacccctttctcacgtcacgtaccgaaaaaatctaatatcacgtaaaaccccgataacgacgcaactacgacaaaaaaataaaaaaaaaaaaaaaccgaaaaaaacgcgaataaaacaaaacgaaaacaaacaactcgcaaaaaacgaaaaatacgtatacgtccgcttctcacctcaaatctcccttcgaccccgctaccctccctcgcgactaaataacaactaaatccgatccgtcgcgaactacctaaaatacgaaaatccgcaccccgtcttcgcgcgctatacctaccgccccgccccctcgtcccgcccgtcccgtcgcgtcgcgtcccgtcccctcgaatactaccaaccgaatactaatacgaatcgataacaacgaaaacattttctaactccctaacccctaacacgactacactttccatcccgtcgcgaa

SEQ ID NO: 31319 - DNA, 617 bp, Artificial Sequence
  chemically treated genomic DNA (Homo sapiens) CpG-island No: 31319
agaagttatagtaggtataggcgaaaaagtttttttttttaagtcgtttattgtagaataaaaattacgattacgttcggattgggaaaaagcggattcgatatttattgcgtaggtacgtttagtgttacgttttcggaaggaggggagaagcggtttatttcgttttagttcggttttttttttacgttacgtgtcgggagagtttagtgttacgtgaggtttcggtggcggcgtagttacggtaagagagtgagaaggaagggaagtcggaaggggcgcgagtgaagtaaagcgagggtagatagttcgtagagggcgaggggtgcgtgtgcgttcgttttttattttaggttttttttcggtttcgttgttttttttcgcggttgggtgatagttgggttcggttcgtcgcgggttgtttggggtgcgaggattcgtatttcgttttcgcgcgttgtgtttgtcgtttcgttttttcgtttcgttcgtttcgtcgcgtcgcgtttcgttttttcgggtgttgttagtcgggtgttgatgcgagtcggtggtagcgaggatattttttgattttttggtttttgatacggttgtattttttatttcgtcgcggg

SEQ ID NO: 31320 - DNA, 617 bp, Artificial Sequence
  chemically treated genomic DNA (Homo sapiens) CpG-island No: 31320
cccgcgacgaaataaaaaatacaaccgtatcaaaaaccaaaaaatcaaaaaatatcctcgctaccaccgactcgcatcaacacccgactaacaacacccgaaaaaacgaaacgcgacgcgacgaaacgaacgaaacgaaaaaacgaaacgacaaacacaacgcgcgaaaacgaaatacgaatcctcgcaccccaaacaacccgcgacgaaccgaacccaactatcacccaaccgcgaaaaaaaacaacgaaaccgaaaaaaaacctaaaataaaaaacgaacgcacacgcacccctcgccctctacgaactatctaccctcgctttacttcactcgcgccccttccgacttcccttccttctcactctcttaccgtaactacgccgccaccgaaacctcacgtaacactaaactctcccgacacgtaacgtaaaaaaaaaaccgaactaaaacgaaataaaccgcttctcccctccttccgaaaacgtaacactaaacgtacctacgcaataaatatcgaatccgctttttcccaatccgaacgtaatcgtaatttttattctacaataaacgacttaaaaaaaaaaactttttcgcctatacctactataacttct

SEQ ID NO: 31321 - DNA, 717 bp, Artificial Sequence
  chemically treated genomic DNA (Homo sapiens) CpG-island No: 31321
  misc_feature (246)..(246): n is either a, c, g or t
tggtttaagttattttttacgttcgttttattttgatcgttagtttttttttttgtaaaatttattaaggcggttttcggtaagttatcgcggcgggaattagattcgaaagagtgtttatataaattcgtttggttattttgtgtttcgggttagcgcgaggtgggggtgcgggtagggttttcgggtttgcggttgttacgttttttttagttcgtcgcgttatatttacggtttacgggtatntattgcgagtttttagggggcgaattcgatcgttttttttgttcgcgtagtttcggtcgtttagtttgtgattttattagcgttttcgggttagcgggaatattcgagagttcggggcgtcgttcgtttttttagtcggtaggtgtcgggagttagtttcgtttagtcgcgtgggtatcgtaggttcgaaggtataaggtcgcggattcgggcgttcgttcggatttcgggagtagcggtgttcggcggtcggcgatcgagcgggaggttcggggtacggtcgttggcgggattgcgtttttttttttttttttttacgtttttttttttgtagcgagttcgcggattttttttttcgtttcgttttatagatcgggttttttttttttttattttattttttgtttcgtttttttgcggcgaaggaggtttatttattataaatgtatattcggggttgatattagcgat

SEQ ID NO: 31322 - DNA, 717 bp, Artificial Sequence
  chemically treated genomic DNA (Homo sapiens) CpG-island No: 31322
  misc_feature (472)..(472): n is either a, c, g or t
atcgctaatatcaaccccgaatatacatttataataaataaacctccttcgccgcaaaaaaacgaaacaaaaaataaaataaaaaaaaaaaaaacccgatctataaaacgaaacgaaaaaaaaaatccgcgaactcgctacaaaaaaaaaaacgtaaaaaaaaaaaaaaaaaaacgcaatcccgccaacgaccgtaccccgaacctcccgctcgatcgccgaccgccgaacaccgctactcccgaaatccgaacgaacgcccgaatccgcgaccttataccttcgaacctacgatacccacgcgactaaacgaaactaactcccgacacctaccgactaaaaaaacgaacgacgccccgaactctcgaatattcccgctaacccgaaaacgctaataaaatcacaaactaaacgaccgaaactacgcgaacaaaaaaaacgatcgaattcgccccctaaaaactcgcaatanatacccgtaaaccgtaaatataacgcgacgaactaaaaaaaacgtaacaaccgcaaacccgaaaaccctacccgcacccccacctcgcgctaacccgaaacacaaaataaccaaacgaatttatataaacactctttcgaatctaattcccgccgcgataacttaccgaaaaccgccttaataaattttacaaaaaaaaaaactaacgatcaaaataaaacgaacgtaaaaaataacttaaacca

SEQ ID NO: 31323 - DNA, 717 bp, Artificial Sequence
  chemically treated genomic DNA (Homo sapiens) CpG-island No: 31323
  misc_feature (472)..(472): n is either a, c, g or t
gtcgttgatgttagtttcgaatgtgtatttataatagatgagtttttttcgtcgtaggaaggcgaggtagaagatgaggtagagagggagagggttcggtttgtggggcggggcgaggaagagggttcgcgaattcgttataaaggaggaggcgtagggaggaggaggaggaagcgtagtttcgttagcggtcgtgtttcgagtttttcgttcgatcgtcggtcgtcgggtatcgttgttttcggagttcggacgggcgttcgggttcgcggttttatattttcgggtttgcggtatttacgcggttgggcgaggttggttttcggtatttgtcggttgggagaacgggcggcgtttcgggttttcgggtgttttcgttggttcggggacgttggtgaagttataggttggacggtcgaggttgcgcgggtaaagaaggcggtcgggttcgttttttggaggttcgtaatangtgttcgtgggtcgtgagtgtggcgcggcgggttgggaggggcgtggtagtcgtaagttcgggagttttgttcgtatttttatttcgcgttggttcggggtatagggtggttagacggatttgtgtaagtattttttcgaatttaattttcgtcgcgatgatttgtcgaaggtcgttttagtgagttttgtagaggaggaaattgacgattagagtgggacggacgtgggaagtgatttagatta

SEQ ID NO: 31324 - DNA, 717 bp, Artificial Sequence
  chemically treated genomic DNA (Homo sapiens) CpG-island No: 31324
  misc_feature (246)..(246): n is either a, c, g or t
taatctaaatcacttcccacgtccgtcccactctaatcgtcaatttcctcctctacaaaactcactaaaacgaccttcgacaaatcatcgcgacgaaaattaaattcgaaaaaatacttacacaaatccgtctaaccaccctataccccgaaccaacgcgaaataaaaatacgaacaaaactcccgaacttacgactaccacgcccctcccaacccgccgcgccacactcacgacccacgaacacntattacgaacctccaaaaaacgaacccgaccgccttctttacccgcgcaacctcgaccgtccaacctataacttcaccaacgtccccgaaccaacgaaaacacccgaaaacccgaaacgccgcccgttctcccaaccgacaaataccgaaaaccaacctcgcccaaccgcgtaaataccgcaaacccgaaaatataaaaccgcgaacccgaacgcccgtccgaactccgaaaacaacgatacccgacgaccgacgatcgaacgaaaaactcgaaacacgaccgctaacgaaactacgcttcctcctcctcctccctacgcctcctcctttataacgaattcgcgaaccctcttcctcgccccgccccacaaaccgaaccctctccctctctacctcatcttctacctcgccttcctacgacgaaaaaaactcatctattataaatacacattcgaaactaacatcaacgac

SEQ ID NO: 31325 - DNA, 671 bp, Artificial Sequence
  chemically treated genomic DNA (Homo sapiens) CpG-island No: 31325
  misc_feature (142)..(142): n is either a, c, g or t
  misc_feature (195)..(195): n is either a, c, g or t
ttcgcgtcggggtcgcgtttgtttcgtcgtagttgtttttcgatttcggcgttgattcgtttggatttttttattttatcgtttaggtaatacgttattatggattttagagttatcgtttcggtttcggttttgcgttttntgtttcgtcgtcgtttttcggttttcgtcgtgttttcggttcggttttcgttntatgtttgtttcgtttttcgatggcgtttttttattttttttttgtcgtatttcgatttgtttgtcggttttattttagttcgcgtcgttgtcgtatttatcgttaattttattcgttttaagcgttcgatatatttattaatttagtattttgttattttatttttatggtagtatatttttggttaatgcgacgcgcgtttagattttcgtttattattgacggtatataatggtcgtttttcgtttttcgttttcgtttggtttttttcgcgtttgttttattgtcggtattttttttatcgcgttaggttttttatttttcgtgttttttaggttttttcgatgttttttgttatttcgttcgttacgcgttttgtttcgttatttaggtttttttttttattttttttcgtgtgtttcgtttttggttgcggttgtgttttatatttttttttttttgtatttttttgttt

SEQ ID NO: 31326 - DNA, 671 bp, Artificial Sequence
  chemically treated genomic DNA (Homo sapiens) CpG-island No: 31326
  misc_feature (477)..(477): n is either a, c, g or t
  misc_feature (530)..(530): n is either a, c, g or t
aaacaaaaaaatacaaaaaaaaaaaaatataaaacacaaccgcaaccaaaaacgaaacacacgaaaaaaaataaaaaaaaaaacctaaataacgaaacaaaacgcgtaacgaacgaaataacaaaaaacatcgaaaaaacctaaaaaacacgaaaaataaaaaacctaacgcgataaaaaaaataccgacaataaaacaaacgcgaaaaaaaccaaacgaaaacgaaaaacgaaaaacgaccattatataccgtcaataataaacgaaaatctaaacgcgcgtcgcattaaccaaaaatatactaccataaaaataaaataacaaaatactaaattaataaatatatcgaacgcttaaaacgaataaaattaacgataaatacgacaacgacgcgaactaaaataaaaccgacaaacaaatcgaaatacgacaaaaaaaaaataaaaaaacgccatcgaaaaacgaaacaaacatanaacgaaaaccgaaccgaaaacacgacgaaaaccgaaaaacgacgacgaaacanaaaacgcaaaaccgaaaccgaaacgataactctaaaatccataataacgtattacctaaacgataaaataaaaaaatccaaacgaatcaacgccgaaatcgaaaaacaactacgacgaaacaaacgcgaccccgacgcgaa

SEQ ID NO: 31327 - DNA, 671 bp, Artificial Sequence
  chemically treated genomic DNA (Homo sapiens) CpG-island No: 31327
  misc_feature (477)..(477): n is either a, c, g or t
  misc_feature (530)..(530): n is either a, c, g or t
gggtagagaaatataagagaggaggaatgtgaggtatagtcgtaattaaaggcgaaatatacgggagaggataaaagaggggatttgagtggcggagtaaaacgcgtgacgaacgaaatggtagaaagtatcgagggggtttagggagtacggaggatgaggaatttaacgcggtaagaagagtgtcgatagtgagataagcgcgaaggggattagacgagagcggaaaacgggaagcggttattatatgtcgttaatggtagacgaggatttgggcgcgcgtcgtattagttaaaagtatattgttataaaggtggagtagtagggtgttgggttaatgggtgtgtcgagcgtttgaggcgggtgagattggcggtgggtgcggtagcggcgcgggttgaggtgaggtcgataggtagatcggagtgcgatagggggagaatagagaaacgttatcgggggacgaagtagatatgnaacgagagtcgggtcgagggtacggcgggggtcggggggcggcggcgggatangagacgtagagtcggggtcgggacgatgattttggagtttatgatggcgtgttgtttgagcgatgaggtgaaggagtttaagcggattaacgtcgagatcgagaagtagttgcggcgggataagcgcgatttcggcgcgag

SEQ ID NO: 31328 - DNA, 671 bp, Artificial Sequence
  chemically treated genomic DNA (Homo sapiens) CpG-island No: 31328
  misc_feature (142)..(142): n is either a, c, g or t
  misc_feature (195)..(195): n is either a, c, g or t
ctcgcgccgaaatcgcgcttatcccgccgcaactacttctcgatctcgacgttaatccgcttaaactccttcacctcatcgctcaaacaacacgccatcataaactccaaaatcatcgtcccgaccccgactctacgtctcntatcccgccgccgccccccgacccccgccgtaccctcgacccgactctcgttncatatctacttcgtcccccgataacgtttctctattctccccctatcgcactccgatctacctatcgacctcacctcaacccgcgccgctaccgcacccaccgccaatctcacccgcctcaaacgctcgacacacccattaacccaacaccctactactccacctttataacaatatacttttaactaatacgacgcgcgcccaaatcctcgtctaccattaacgacatataataaccgcttcccgttttccgctctcgtctaatccccttcgcgcttatctcactatcgacactcttcttaccgcgttaaattcctcatcctccgtactccctaaaccccctcgatactttctaccatttcgttcgtcacgcgttttactccgccactcaaatcccctcttttatcctctcccgtatatttcgcctttaattacgactatacctcacattcctcctctcttatatttctctaccc

SEQ ID NO: 31329 - DNA, 560 bp, Artificial Sequence
  chemically treated genomic DNA (Homo sapiens) CpG-island No: 31329
tgttttttagagggttatcgttttcgacggggaggtggcgttttttttcgggtttcgggtttcgatcgttcgtgttgttttttttcgggttttttttcgcgatgacggcgtcgttagtaggttaggcggattgggcggggtttcgagcggggattgggatttagatcgattaggggattgggagcgggcggcgcggttatggcgggttgttgcgtcgcgttggcggtttttttgttcgagtacgatacgtcgcgtatcgtgtttattcgtagtcgtaaagtggggtttatgatcggcgtcgtgtaattgtttattttggtttacgttatcgggtgagcgtggggtcgcgcggggggcgcggcgggtgttgttttcgcgttcgcgtcgtgcggcggtttattttggtttcggttatttgggcgagttcgggagcggcgagtcgaggcggtgatattttttttgggttttagtcgtcgcgtcggggtttcgggggcgggaggttgtttgttgttgttttaaagttatagtttgggttaggcgcggtggcgtaagtttgtaat

SEQ ID NO: 31330 - DNA, 560 bp, Artificial Sequence
  chemically treated genomic DNA (Homo sapiens) CpG-island No: 31330
attacaaacttacgccaccgcgcctaacccaaactataactttaaaacaacaacaaacaacctcccgcccccgaaaccccgacgcgacgactaaaacccaaaaaaaatatcaccgcctcgactcgccgctcccgaactcgcccaaataaccgaaaccaaaataaaccgccgcacgacgcgaacgcgaaaacaacacccgccgcgccccccgcgcgaccccacgctcacccgataacgtaaaccaaaataaacaattacacgacgccgatcataaaccccactttacgactacgaataaacacgatacgcgacgtatcgtactcgaacaaaaaaaccgccaacgcgacgcaacaacccgccataaccgcgccgcccgctcccaatcccctaatcgatctaaatcccaatccccgctcgaaaccccgcccaatccgcctaacctactaacgacgccgtcatcgcgaaaaaaaacccgaaaaaaaacaacacgaacgatcgaaacccgaaacccgaaaaaaaacgccacctccccgtcgaaaacgataaccctctaaaaaaca

SEQ ID NO: 31331 - DNA, 560 bp, Artificial Sequence
  chemically treated genomic DNA (Homo sapiens) CpG-island No: 31331
attataggtttgcgttatcgcgtttggtttaggttgtggttttaaaatagtagtaagtagtttttcgttttcggggtttcggcgcggcggttggggtttagggaaggtgttatcgtttcggttcgtcgttttcggattcgtttaggtgatcgaggttaggatgagtcgtcgtacggcgcggacgcgagggtagtattcgtcgcgtttttcgcgcggttttacgtttattcgatgacgtaggttaggatgagtagttgtacggcgtcggttatgagttttattttgcggttgcggatgagtacgatgcgcggcgtgtcgtattcgaataggaaggtcgttagcgcggcgtagtagttcgttatggtcgcgtcgttcgtttttagttttttagtcggtttgggttttagttttcgttcggagtttcgtttagttcgtttggtttgttggcggcgtcgttatcgcggaggagggttcggaaggaggtagtacgggcggtcggggttcggggttcgggggagggcgttattttttcgtcgggaacgatgattttttagggggta

SEQ ID NO: 31332 - DNA, 560 bp, Artificial Sequence
  chemically treated genomic DNA (Homo sapiens) CpG-island No: 31332
taccccctaaaaaatcatcgttcccgacgaaaaaataacgccctcccccgaaccccgaaccccgaccgcccgtactacctccttccgaaccctcctccgcgataacgacgccgccaacaaaccaaacgaactaaacgaaactccgaacgaaaactaaaacccaaaccgactaaaaaactaaaaacgaacgacgcgaccataacgaactactacgccgcgctaacgaccttcctattcgaatacgacacgccgcgcatcgtactcatccgcaaccgcaaaataaaactcataaccgacgccgtacaactactcatcctaacctacgtcatcgaataaacgtaaaaccgcgcgaaaaacgcgacgaatactaccctcgcgtccgcgccgtacgacgactcatcctaacctcgatcacctaaacgaatccgaaaacgacgaaccgaaacgataacaccttccctaaaccccaaccgccgcgccgaaaccccgaaaacgaaaaactacttactactattttaaaaccacaacctaaaccaaacgcgataacgcaaacctataat

SEQ ID NO: 31333 - DNA, 677 bp, Artificial Sequence
  chemically treated genomic DNA (Homo sapiens) CpG-island No: 31333
tacggtcgcgggggttcgttcggggttatttgtttggaatttagcgcgaggtttagagtttttttcggttgcgtagcggcgtacgtgtttcgtggaaggggcggttttcgtattttagaaggagggggcgttcggtcgcgcggatttttttttttgtttattttttagtttcgggtaggtcggttcggaggtagcgagaaagcgtagttaggcggttgttcggcgtttttttaggtgattgttcggagtttttttaggtacgtcgtgcgttttttattcgtgtggtttttttgtatttttttttggggtcgggtcgggtaggggcggaggggagtcgtagttcggttacgggttttggggaattcgggttttcgttcggttgtatttgggtttttagtttttgttcgggcggggatagcgggaagcgtattaggttttcgggacgtcggtgtttttttgtacggtttagcgcgggaatgtggatattagcgaagtcggtttaggtcggttttcgggagaagtaggggttatacggaaagggagttcgagggttttgtagagttcgaggtcgggatttcgcgcgtgtagtgttaatgggttgcggttgggttgagcgtttttttaattttgtaggtttcgggggggttgtcgcggagagttttcgttggggtttcggg

SEQ ID NO: 31334 - DNA, 677 bp, Artificial Sequence
  chemically treated genomic DNA (Homo sapiens) CpG-island No: 31334
cccgaaaccccaacgaaaactctccgcgacaacccccccgaaacctacaaaattaaaaaaacgctcaacccaaccgcaacccattaacactacacgcgcgaaatcccgacctcgaactctacaaaaccctcgaactccctttccgtataacccctacttctcccgaaaaccgacctaaaccgacttcgctaatatccacattcccgcgctaaaccgtacaaaaaaacaccgacgtcccgaaaacctaatacgcttcccgctatccccgcccgaacaaaaactaaaaacccaaatacaaccgaacgaaaacccgaattccccaaaacccgtaaccgaactacgactcccctccgcccctacccgacccgaccccaaaaaaaaatacaaaaaaaccacacgaataaaaaacgcacgacgtacctaaaaaaactccgaacaatcacctaaaaaaacgccgaacaaccgcctaactacgctttctcgctacctccgaaccgacctacccgaaactaaaaaataaacaaaaaaaaaaatccgcgcgaccgaacgccccctccttctaaaatacgaaaaccgccccttccacgaaacacgtacgccgctacgcaaccgaaaaaaactctaaacctcgcgctaaattccaaacaaataaccccgaacgaacccccgcgaccgta

SEQ ID NO: 31335 - DNA, 677 bp, Artificial Sequence
  chemically treated genomic DNA (Homo sapiens) CpG-island No: 31335
ttcggagttttagcggaagtttttcgcggtaattttttcggggtttgtaaggttggaagggcgtttagtttagtcgtagtttattggtattgtacgcgcggggtttcgatttcgggttttgtaggattttcgggtttttttttcgtgtagtttttgtttttttcgagggtcgatttgagtcggtttcgttggtgtttatattttcgcgttgggtcgtgtaaagaagtatcggcgtttcgggggtttggtgcgtttttcgttattttcgttcggataggagttaggggtttaggtgtagtcgaacgggagttcgggttttttagagttcgtgatcgggttgcggttttttttcgtttttgttcgattcgattttaggaaggggtgtagagagattatacgagtggggagcgtacgacgtatttgggagaatttcgagtagttatttgagagaacgtcgagtagtcgtttggttgcgttttttcgttgttttcgagtcggtttgttcgggattaggaagtaagtaaaagggaaagttcgcgcggtcgggcgttttttttttttggggtgcgggaatcgttttttttacggggtacgtgcgtcgttgcgtagtcggagggaattttggatttcgcgttgagttttaggtaggtggtttcgagcgagttttcgcggtcgtg

SEQ ID NO: 31336 - DNA, 677 bp, Artificial Sequence
  chemically treated genomic DNA (Homo sapiens) CpG-island No: 31336
cacgaccgcgaaaactcgctcgaaaccacctacctaaaactcaacgcgaaatccaaaattccctccgactacgcaacgacgcacgtaccccgtaaaaaaaacgattcccgcaccccaaaaaaaaaaaacgcccgaccgcgcgaactttcccttttacttacttcctaatcccgaacaaaccgactcgaaaacaacgaaaaaacgcaaccaaacgactactcgacgttctctcaaataactactcgaaattctcccaaatacgtcgtacgctccccactcgtataatctctctacaccccttcctaaaatcgaatcgaacaaaaacgaaaaaaaaccgcaacccgatcacgaactctaaaaaacccgaactcccgttcgactacacctaaacccctaactcctatccgaacgaaaataacgaaaaacgcaccaaacccccgaaacgccgatacttctttacacgacccaacgcgaaaatataaacaccaacgaaaccgactcaaatcgaccctcgaaaaaaacaaaaactacacgaaaaaaaaacccgaaaatcctacaaaacccgaaatcgaaaccccgcgcgtacaataccaataaactacgactaaactaaacgcccttccaaccttacaaaccccgaaaaaattaccgcgaaaaacttccgctaaaactccgaa

SEQ ID NO: 31337 - DNA, 841 bp, Artificial Sequence
  chemically treated genomic DNA (Homo sapiens) CpG-island No: 31337
cggcgtttttacgcgggttagatttcgtttttgtagttttttttcggttcgcgtttatttttcgtttttaggagtcgggttcggacgttttcgggaagtagtcgtcgttttcggggttcgggcgtggtcgggtttttttcgtcgggttttcgttcgtcgtcgttttagtttttagtcgcgttagggcggggggttaggcgagtttagcgttagtaacggcgggggaggagggttcgggagttttttcgggttgcgcggcgtcggtcggcggtgtagtcgcgcgttcgtcgttagcgaagttattggttcggcgtagttattttacgcggggttgtcgcggcggttttcgcggattggcgcgtaggcgggtagggatcggggcgcgcgtaggcgagtgcgtgcggtttcgaagtttcgtcgtttcggggtttcgttttttttttcggtcgcgacgattatttttttattgttttcgcgtggtttaggtcgcgtttggggtcgtcgttaaattcggtttttatcgtttcggttcgaagaaagcgcgcgaaaggcgcgtttttagcgcgggcgttcgcgtcgtttgttgttttcggtcgtttattgtcgtatttcgcgttttcgcgtcgcgtttcgttttatcggtttaaatttgtatattttaggatcgcggttaatcgttgttcgtttttttcgaagcggatggtttttgtttgagaggaaagggagtggttggcggcgtatgcgttacggtggtcgatttgaatcgaggtttttattgttgtagtttatttttattttttttttttttgtttttttttttttttttttttttttttttttt

SEQ ID NO: 31338 - DNA, 841 bp, Artificial Sequence
  chemically treated genomic DNA (Homo sapiens) CpG-island No: 31338
aaaaaaaaaaaaaaaaaaaaaaaaaaaaaaaacaaaaaaaaaaaaaataaaaataaactacaacaataaaaacctcgattcaaatcgaccaccgtaacgcatacgccgccaaccactccctttcctctcaaacaaaaaccatccgcttcgaaaaaaacgaacaacgattaaccgcgatcctaaaatatacaaatttaaaccgataaaacgaaacgcgacgcgaaaacgcgaaatacgacaataaacgaccgaaaacaacaaacgacgcgaacgcccgcgctaaaaacgcgcctttcgcgcgctttcttcgaaccgaaacgataaaaaccgaatttaacgacgaccccaaacgcgacctaaaccacgcgaaaacaataaaaaaataatcgtcgcgaccgaaaaaaaaaacgaaaccccgaaacgacgaaacttcgaaaccgcacgcactcgcctacgcgcgccccgatccctacccgcctacgcgccaatccgcgaaaaccgccgcgacaaccccgcgtaaaataactacgccgaaccaataacttcgctaacgacgaacgcgcgactacaccgccgaccgacgccgcgcaacccgaaaaaactcccgaaccctcctcccccgccgttactaacgctaaactcgcctaaccccccgccctaacgcgactaaaaactaaaacgacgacgaacgaaaacccgacgaaaaaaacccgaccacgcccgaaccccgaaaacgacgactacttcccgaaaacgtccgaacccgactcctaaaaacgaaaaataaacgcgaaccgaaaaaaaactacaaaaacgaaatctaacccgcgtaaaaacgccg

SEQ ID NO: 31339 - DNA, 841 bp, Artificial Sequence
  chemically treated genomic DNA (Homo sapiens) CpG-island No: 31339
gagagagagagagagagaaggagagagagaaataggagggaagggggtggaaataaattatagtaataaaagtttcggtttaagtcggttatcgtggcgtatgcgtcgttagttattttttttttttttaggtaaaagttattcgtttcgagagagacgagtagcgattggtcgcgattttgggatatgtaaatttaggtcggtggggcggggcgcggcgcgagagcgcgaaatgcggtagtgaacggtcgggggtagtaggcggcgcgagcgttcgcgttgggagcgcgtttttcgcgcgtttttttcgggtcggggcggtggggatcgggtttggcggcggttttaggcgcggtttgggttacgcggggataatggaggggtggtcgtcgcggtcggggggaagggcgggatttcgagacggcggggtttcggggtcgtacgtattcgtttgcgcgcgtttcggtttttgttcgtttgcgcgttaattcgcggaggtcgtcgcggtagtttcgcgtggggtgattgcgtcgagttaatggtttcgttggcggcgagcgcgcgattgtatcgtcggtcggcgtcgcgtagttcgggagggttttcgggtttttttttttcgtcgttgttggcgttgaattcgtttggtttttcgttttggcgcggttgaggattggaacggcggcgggcgggaattcggcggggagggttcggttacgttcgggtttcggagacggcggttgtttttcgggagcgttcgggttcggtttttgggggcggggaatgggcgcgggtcggggggaggttgtagagacgggatttggttcgcgtggaggcgtcg

SEQ ID NO: 31340 - DNA, 841 bp, Artificial Sequence
  chemically treated genomic DNA (Homo sapiens) CpG-island No: 31340
cgacgcctccacgcgaaccaaatcccgtctctacaacctccccccgacccgcgcccattccccgcccccaaaaaccgaacccgaacgctcccgaaaaacaaccgccgtctccgaaacccgaacgtaaccgaaccctccccgccgaattcccgcccgccgccgttccaatcctcaaccgcgccaaaacgaaaaaccaaacgaattcaacgccaacaacgacgaaaaaaaaaaacccgaaaaccctcccgaactacgcgacgccgaccgacgatacaatcgcgcgctcgccgccaacgaaaccattaactcgacgcaatcaccccacgcgaaactaccgcgacgacctccgcgaattaacgcgcaaacgaacaaaaaccgaaacgcgcgcaaacgaatacgtacgaccccgaaaccccgccgtctcgaaatcccgcccttccccccgaccgcgacgaccacccctccattatccccgcgtaacccaaaccgcgcctaaaaccgccgccaaacccgatccccaccgccccgacccgaaaaaaacgcgcgaaaaacgcgctcccaacgcgaacgctcgcgccgcctactacccccgaccgttcactaccgcatttcgcgctctcgcgccgcgccccgccccaccgacctaaatttacatatcccaaaatcgcgaccaatcgctactcgtctctctcgaaacgaataacttttacctaaaaaaaaaaaaaataactaacgacgcatacgccacgataaccgacttaaaccgaaacttttattactataatttatttccacccccttccctcctatttctctctctccttctctctctctctctctc

SEQ ID NO: 31341 - DNA, 810 bp, Artificial Sequence
  chemically treated genomic DNA (Homo sapiens) CpG-island No: 31341
ggcgcgcggtggttgacgcggggtaggggttttggcgagcgcgggaggggcggttagtagtcgttcgcggggttggattgggagtttcgtgcgatttcgggtttggcgtttgggtcgggggtggttttcgggtttttttcgggggtcgtcgaggttcggtttcgatagttttgcggttgttgcgagcgtttttcgagttttcgtttcgcggtgttcgttttaggagcgggcgcggcgttgtgtttttttatttgcgcgtagagggtcgttcggtgaagttatggcggcgggttaggggtaaacgagcgttcgagcggggttggtaggttttcggggcgcgggaggatcgtgggattacggggatgaaaagttttgcggtttcgacgcgtttggagtaaatcgtggttttgcgcgtttttgttttttttcgtttttttttttttttttttttttttttttcgttttttttacgagtttattttttgttttggtaattagtaaagttttttcgttgcgcgtttttcggtatttttttttagaggcgcggggcgggagtcggggtgtcgcgattcggggttgggacgtaaggcggggtttcgagtgtttcgggcgtttttagcgtttagagcgcgcgttttgttcggtatttacgtttttttgggcgggttttagcggggggttgatacgattgtcgttcgggatagattgcgagcgaaggattggttttaagaaacggttgtagtcgcgggtcgtttttttggttttttatttacgtttttagttgagatattagaattttttttatatagg

SEQ ID NO: 31342 - DNA, 810 bp, Artificial Sequence
  chemically treated genomic DNA (Homo sapiens) CpG-island No: 31342
cctatataaaaaaaattctaatatctcaactaaaaacgtaaataaaaaaccaaaaaaacgacccgcgactacaaccgtttcttaaaaccaatccttcgctcgcaatctatcccgaacgacaatcgtatcaaccccccgctaaaacccgcccaaaaaaacgtaaataccgaacaaaacgcgcgctctaaacgctaaaaacgcccgaaacactcgaaaccccgccttacgtcccaaccccgaatcgcgacaccccgactcccgccccgcgcctctaaaaaaaaataccgaaaaacgcgcaacgaaaaaactttactaattaccaaaacaaaaaataaactcgtaaaaaaaacgaaaaaaaaaaaaaaaaaaaaaaaaaaaaacgaaaaaaaacaaaaacgcgcaaaaccacgatttactccaaacgcgtcgaaaccgcaaaacttttcatccccgtaatcccacgatcctcccgcgccccgaaaacctaccaaccccgctcgaacgctcgtttacccctaacccgccgccataacttcaccgaacgaccctctacgcgcaaataaaaaaacacaacgccgcgcccgctcctaaaacgaacaccgcgaaacgaaaactcgaaaaacgctcgcaacaaccgcaaaactatcgaaaccgaacctcgacgacccccgaaaaaaacccgaaaaccacccccgacccaaacgccaaacccgaaatcgcacgaaactcccaatccaaccccgcgaacgactactaaccgcccctcccgcgctcgccaaaacccctaccccgcgtcaaccaccgcgcgcc

SEQ ID NO: 31343 - DNA, 810 bp, Artificial Sequence
  chemically treated genomic DNA (Homo sapiens) CpG-island No: 31343
tttgtgtaaggggagttttggtgttttagttgagggcgtgagtagggagttaggaaagcgattcgcgattgtagtcgttttttaaggttagtttttcgttcgtagtttgtttcgggcggtagtcgtgttagtttttcgttaggattcgtttagggggacgtgggtatcgggtaggacgcgcgttttgggcgttggggacgttcgggatattcggggtttcgttttgcgttttagtttcgggtcgcggtatttcggttttcgtttcgcgtttttggagggaggtatcgagggacgcgtagcgaaggggttttgttaattgttaaagtaggaagtgagttcgtggaagaagcgaaggaggagaagaagaagggaggggaaggcggaggagggtaggggcgcgtagagttacggtttgttttaggcgcgtcggaatcgtaggattttttattttcgtggttttacggttttttcgcgtttcggaggtttgttagtttcgttcggacgttcgtttgtttttaattcgtcgttatggttttatcggacgattttttgcgcgtaggtaaagggatatagcgtcgcgttcgtttttggagcgagtatcgcggggcgggagttcgggaggcgttcgtagtagtcgtagggttatcgaggtcgggtttcggcgattttcgagggaggttcgggaattattttcgatttaggcgttagattcggagtcgtacggggtttttagtttagtttcgcgagcggttgttgatcgtttttttcgcgttcgttagggtttttgtttcgcgttagttatcgcgcgtt

SEQ ID NO: 31344 - DNA, 810 bp, Artificial Sequence
  chemically treated genomic DNA (Homo sapiens) CpG-island No: 31344
aacgcgcgataactaacgcgaaacaaaaaccctaacgaacgcgaaaaaaacgatcaacaaccgctcgcgaaactaaactaaaaaccccgtacgactccgaatctaacgcctaaatcgaaaataattcccgaacctccctcgaaaatcgccgaaacccgacctcgataaccctacgactactacgaacgcctcccgaactcccgccccgcgatactcgctccaaaaacgaacgcgacgctatatccctttacctacgcgcaaaaaatcgtccgataaaaccataacgacgaattaaaaacaaacgaacgtccgaacgaaactaacaaacctccgaaacgcgaaaaaaccgtaaaaccacgaaaataaaaaatcctacgattccgacgcgcctaaaacaaaccgtaactctacgcgcccctaccctcctccgccttcccctcccttcttcttctcctccttcgcttcttccacgaactcacttcctactttaacaattaacaaaaccccttcgctacgcgtccctcgatacctccctccaaaaacgcgaaacgaaaaccgaaataccgcgacccgaaactaaaacgcaaaacgaaaccccgaatatcccgaacgtccccaacgcccaaaacgcgcgtcctacccgatacccacgtccccctaaacgaatcctaacgaaaaactaacacgactaccgcccgaaacaaactacgaacgaaaaactaaccttaaaaaacgactacaatcgcgaatcgctttcctaactccctactcacgccctcaactaaaacaccaaaactccccttacacaaa

SEQ ID NO: 31345 - DNA, 547 bp, Artificial Sequence
  chemically treated genomic DNA (Homo sapiens) CpG-island No: 31345
ggtttcgttattagtttcgtttaattaacgaggttaattagcggttcgtaacgggggagggatacgtagtcgttagtcgaataattcgatgacgaggtttaggaagtacgttgaaattttgggcggcggtaagttgtgcgattttttttgcggtcggtttgggtaggtgtttttttcgagaggtaggtaggggatttcggacgtgagttcgtgtagttgggtgtgttgtgcggcgggtggggcgggttattcgtcgttacgttttggcgggtttagcggattcgcggcgtagacgttggggaggtcgtaggcgcgattcggggcggggatcgtgttagttgcgtgcgttcgttgcggtttgtgggtgtttcgggtttttattttagttttcgcgtcggcggttgtttgttcgtcgcggttgcgcgcgtttcggggaggtgtttggtttagagagcggtttacggagaaggtatagcgagggtaaagcgagatttgggcgtacgttgaattttgttggttttggttatttttgaaaattttaagtata

SEQ ID NO: 31346 - DNA, 547 bp, Artificial Sequence
  chemically treated genomic DNA (Homo sapiens) CpG-island No: 31346
tatacttaaaattttcaaaaataaccaaaaccaacaaaattcaacgtacgcccaaatctcgctttaccctcgctataccttctccgtaaaccgctctctaaaccaaacacctccccgaaacgcgcgcaaccgcgacgaacaaacaaccgccgacgcgaaaactaaaataaaaacccgaaacacccacaaaccgcaacgaacgcacgcaactaacacgatccccgccccgaatcgcgcctacgacctccccaacgtctacgccgcgaatccgctaaacccgccaaaacgtaacgacgaataacccgccccacccgccgcacaacacacccaactacacgaactcacgtccgaaatcccctacctacctctcgaaaaaaacacctacccaaaccgaccgcaaaaaaaatcgcacaacttaccgccgcccaaaatttcaacgtacttcctaaacctcgtcatcgaattattcgactaacgactacgtatccctcccccgttacgaaccgctaattaacctcgttaattaaacgaaactaataacgaaacc

SEQ ID NO: 31347 - DNA, 547 bp, Artificial Sequence
  chemically treated genomic DNA (Homo sapiens) CpG-island No: 31347
tatgtttaaagtttttagagataattaaagttaatagaatttaacgtgcgtttaggtttcgttttgttttcgttgtgtttttttcgtaggtcgttttttgggttaagtattttttcggaacgcgcgtaatcgcggcggataggtagtcgtcggcgcgggagttgaggtaggagttcggggtatttataggtcgtagcggacgtacgtagttagtacggttttcgtttcgggtcgcgtttgcggtttttttagcgtttgcgtcgcgagttcgttggattcgttagggcgtaacggcgggtaattcgttttattcgtcgtataatatatttaattgtacggatttacgttcgggattttttgtttgtttttcgaggaagatatttgtttaggtcggtcgtagaagaggtcgtatagtttgtcgtcgtttagggttttagcgtgttttttgggtttcgttatcgaattgttcggttgacggttgcgtgtttttttttcgttgcgggtcgttgattggtttcgttgattgggcggggttagtagcgggatt

SEQ ID NO: 31348 - DNA, 547 bp, Artificial Sequence
  chemically treated genomic DNA (Homo sapiens) CpG-island No: 31348
aatcccgctactaaccccgcccaatcaacgaaaccaatcaacgacccgcaacgaaaaaaaaacacgcaaccgtcaaccgaacaattcgataacgaaacccaaaaaacacgctaaaaccctaaacgacgacaaactatacgacctcttctacgaccgacctaaacaaatatcttcctcgaaaaacaaacaaaaaatcccgaacgtaaatccgtacaattaaatatattatacgacgaataaaacgaattacccgccgttacgccctaacgaatccaacgaactcgcgacgcaaacgctaaaaaaaccgcaaacgcgacccgaaacgaaaaccgtactaactacgtacgtccgctacgacctataaataccccgaactcctacctcaactcccgcgccgacgactacctatccgccgcgattacgcgcgttccgaaaaaatacttaacccaaaaaacgacctacgaaaaaaacacaacgaaaacaaaacgaaacctaaacgcacgttaaattctattaactttaattatctctaaaaactttaaacata

SEQ ID NO: 31349 - DNA, 848 bp, Artificial Sequence
  chemically treated genomic DNA (Homo sapiens) CpG-island No: 31349
ttacgtagacgttgataggagttttagttacggcgtttagggttatcggagtgttttttattcgtatcggtagcgtttcggtcggggttatggttacggttttcgaggcgtttatagtagtcgggggagcggcgtcggcgggttcggtgaggtcggcgggtattttttaggggtttagcggtagttttggcgttgcggtttcgggagtagaggtgaggggaggtttggcgcgcggtagtcgatttcggtgcggttcgggttttatagtatcgttggggagaggcgcgggggtcgtagtagcgaagttagtgacgggcgttcgttgtacggtaggatacgcgcgtttcggatttttttttcgttcgcgcgagtttgggttgttttcggagcgatattcgttcgatttttcgtagtttttttagcggcgtttatacgtgcgttgttttagttttgcgttttaggttcgggtttcgttgcgggggagtttggatttgcggttttcggaaggtcgtcgtttatatttcgagtttaattgcgtagttgttttttcgttagaaattttaaaattacgaatttcgagtgtttatagttttttacgcgcgattggtacggtttcgtcgcgcggttacgttagttatgtttatatagttacgcggagatttcgcgtacgcgtttaggtcgtcgttatcgtttcgggttttttcgggattcggtcgcgtgattggttaaggagcggagtcgcgttcgtgacgttattggggacggttttagggagcgttaaaattttttttagaatcgttagtaaggaggggcgatgttagaaatttattacgtgggaggggtaagtt

SEQ ID NO: 31350 - DNA, 848 bp, Artificial Sequence
  chemically treated genomic DNA (Homo sapiens) CpG-island No: 31350
aacttacccctcccacgtaataaatttctaacatcgcccctccttactaacgattctaaaaaaaattttaacgctccctaaaaccgtccccaataacgtcacgaacgcgactccgctccttaaccaatcacgcgaccgaatcccgaaaaaacccgaaacgataacgacgacctaaacgcgtacgcgaaatctccgcgtaactatataaacataactaacgtaaccgcgcgacgaaaccgtaccaatcgcgcgtaaaaaactataaacactcgaaattcgtaattttaaaatttctaacgaaaaaacaactacgcaattaaactcgaaatataaacgacgaccttccgaaaaccgcaaatccaaactcccccgcaacgaaacccgaacctaaaacgcaaaactaaaacaacgcacgtataaacgccgctaaaaaaactacgaaaaatcgaacgaatatcgctccgaaaacaacccaaactcgcgcgaacgaaaaaaaaatccgaaacgcgcgtatcctaccgtacaacgaacgcccgtcactaacttcgctactacgacccccgcgcctctccccaacgatactataaaacccgaaccgcaccgaaatcgactaccgcgcgccaaacctcccctcacctctactcccgaaaccgcaacgccaaaactaccgctaaacccctaaaaaatacccgccgacctcaccgaacccgccgacgccgctcccccgactactataaacgcctcgaaaaccgtaaccataaccccgaccgaaacgctaccgatacgaataaaaaacactccgataaccctaaacgccgtaactaaaactcctatcaacgtctacgtaa

SEQ ID NO: 31351 - DNA, 848 bp, Artificial Sequence
  chemically treated genomic DNA (Homo sapiens) CpG-island No: 31351
agtttgttttttttacgtgataggtttttggtatcgtttttttttgttggcgattttggggaagattttaacgttttttggagtcgtttttagtgacgttacgggcgcggtttcgttttttggttaattacgcggtcggatttcggggaaattcggggcggtggcggcggtttgggcgcgtgcgcgaggttttcgcgtggttatataaatatggttggcgtggtcgcgcggcggggtcgtgttaatcgcgcgtagggggttgtgggtattcggggttcgtagttttgaaatttttggcgggggagtagttgcgtagttaggttcgaggtgtgagcgacgatttttcgggagtcgtaagtttaggttttttcgtagcgggattcgagtttgaggcgtagggttgaggtagcgtacgtgtgagcgtcgttgaggaagttgcgagaggtcgggcgggtgtcgtttcgggggtagtttaggttcgcgcggacgagaggaaggttcgggacgcgcgtgttttgtcgtgtagcgggcgttcgttattgatttcgttgttgcggttttcgcgtttttttttagcgatgttgtggaattcgaatcgtatcggagtcggttgtcgcgcgttaagtttttttttatttttgttttcggaatcgtagcgttaaagttgtcgttgagtttttgggggatgttcgtcggttttatcgaattcgtcggcgtcgttttttcggttgttgtgagcgtttcggggatcgtgattatggtttcggtcggggcgttgtcggtgcgggtggagagtatttcggtggttttgggcgtcgtgattaaggtttttgttagcgtttgcgtgg

SEQ ID NO: 31352 - DNA, 848 bp, Artificial Sequence
  chemically treated genomic DNA (Homo sapiens) CpG-island No: 31352
ccacgcaaacgctaacaaaaaccttaatcacgacgcccaaaaccaccgaaatactctccacccgcaccgacaacgccccgaccgaaaccataatcacgatccccgaaacgctcacaacaaccgaaaaaacgacgccgacgaattcgataaaaccgacgaacatcccccaaaaactcaacgacaactttaacgctacgattccgaaaacaaaaataaaaaaaaacttaacgcgcgacaaccgactccgatacgattcgaattccacaacatcgctaaaaaaaaacgcgaaaaccgcaacaacgaaatcaataacgaacgcccgctacacgacaaaacacgcgcgtcccgaaccttcctctcgtccgcgcgaacctaaactacccccgaaacgacacccgcccgacctctcgcaacttcctcaacgacgctcacacgtacgctacctcaaccctacgcctcaaactcgaatcccgctacgaaaaaacctaaacttacgactcccgaaaaatcgtcgctcacacctcgaacctaactacgcaactactcccccgccaaaaatttcaaaactacgaaccccgaatacccacaaccccctacgcgcgattaacacgaccccgccgcgcgaccacgccaaccatatttatataaccacgcgaaaacctcgcgcacgcgcccaaaccgccgccaccgccccgaatttccccgaaatccgaccgcgtaattaaccaaaaaacgaaaccgcgcccgtaacgtcactaaaaacgactccaaaaaacgttaaaatcttccccaaaatcgccaacaaaaaaaaacgataccaaaaacctatcacgtaaaaaaaacaaact

SEQ ID NO: 31353 - DNA, 684 bp, Artificial Sequence
  chemically treated genomic DNA (Homo sapiens) CpG-island No: 31353
gcgtgaatttagattcgatagttagtatcgtaattggagattatgcgggtatcggtgtgaatttagattttacggttagtatcgtaattggagattatgcgggtatcggtgtgaatttagattcgacggttagtatcgtaattggagattacgcgggtatcggtgtgaatttagattttacggttagtatcgtaattggagattacgcgggtatcggtgtgaatttagattttacggttagtatcgtaattggagattacgcgggtatcggtgtgaatttagattcgacggttagtatcgtaattggagattacgcgggtatcggtgtgaatttagattttacggttagtatcgtaattggagattacgcgggtatcggtgtgaatttagattttacggttagtatcgtaattggagattacgcgggtatcggtgtgaatttagattcgacggttagtatcgtaattggagattacgcgggtatcggtgtgaatttagattttacggttagtatcgtaattggagattacgcgggtatcggtgtgaatttagattttacggttagtatcgtaattggagattatgcgggtatcggtgtgaatttagattttacggttagtatcgtaattggagattatataggtatcggtgtgaatttagacgtaacggtatttttttgggttg

SEQ ID NO: 31354 - DNA, 684 bp, Artificial Sequence
  chemically treated genomic DNA (Homo sapiens) CpG-island No: 31354
caacccaaaaaaataccgttacgtctaaattcacaccgatacctatataatctccaattacgatactaaccgtaaaatctaaattcacaccgatacccgcataatctccaattacgatactaaccgtaaaatctaaattcacaccgatacccgcgtaatctccaattacgatactaaccgtaaaatctaaattcacaccgatacccgcgtaatctccaattacgatactaaccgtcgaatctaaattcacaccgatacccgcgtaatctccaattacgatactaaccgtaaaatctaaattcacaccgatacccgcgtaatctccaattacgatactaaccgtaaaatctaaattcacaccgatacccgcgtaatctccaattacgatactaaccgtcgaatctaaattcacaccgatacccgcgtaatctccaattacgatactaaccgtaaaatctaaattcacaccgatacccgcgtaatctccaattacgatactaaccgtaaaatctaaattcacaccgatacccgcgtaatctccaattacgatactaaccgtcgaatctaaattcacaccgatacccgcataatctccaattacgatactaaccgtaaaatctaaattcacaccgatacccgcataatctccaattacgatactaactatcgaatctaaattcacgc

SEQ ID NO: 31355 - DNA, 684 bp, Artificial Sequence
  chemically treated genomic DNA (Homo sapiens) CpG-island No: 31355
tagtttaggagggtgtcgttgcgtttgagtttatatcggtgtttgtgtggtttttagttacggtgttggtcgtggagtttgggtttatatcggtgttcgtatggtttttagttacggtgttggtcgtggagtttgggtttatatcggtgttcgcgtggtttttagttacggtgttggtcgtggagtttgggtttatatcggtgttcgcgtggtttttagttacggtgttggtcgtcgggtttgggtttatatcggtgttcgcgtggtttttagttacggtgttggtcgtggagtttgggtttatatcggtgttcgcgtggtttttagttacggtgttggtcgtggagtttgggtttatatcggtgttcgcgtggtttttagttacggtgttggtcgtcgggtttgagtttatatcggtgttcgcgtggtttttagttacggtgttggtcgtggagtttgggtttatatcggtgttcgcgtggtttttagttacggtgttggtcgtggagtttgggtttatatcggtgttcgcgtggtttttagttacggtgttggtcgtcgggtttgagtttatatcggtgttcgtatggtttttagttacggtgttggtcgtggagtttgggtttatatcggtgttcgtatggtttttagttacggtgttggttgtcgggtttgagtttacgt

SEQ ID NO: 31356 - DNA, 684 bp, Artificial Sequence
  chemically treated genomic DNA (Homo sapiens) CpG-island No: 31356
acgtaaactcaaacccgacaaccaacaccgtaactaaaaaccatacgaacaccgatataaacccaaactccacgaccaacaccgtaactaaaaaccatacgaacaccgatataaactcaaacccgacgaccaacaccgtaactaaaaaccacgcgaacaccgatataaacccaaactccacgaccaacaccgtaactaaaaaccacgcgaacaccgatataaacccaaactccacgaccaacaccgtaactaaaaaccacgcgaacaccgatataaactcaaacccgacgaccaacaccgtaactaaaaaccacgcgaacaccgatataaacccaaactccacgaccaacaccgtaactaaaaaccacgcgaacaccgatataaacccaaactccacgaccaacaccgtaactaaaaaccacgcgaacaccgatataaacccaaacccgacgaccaacaccgtaactaaaaaccacgcgaacaccgatataaacccaaactccacgaccaacaccgtaactaaaaaccacgcgaacaccgatataaacccaaactccacgaccaacaccgtaactaaaaaccatacgaacaccgatataaacccaaactccacgaccaacaccgtaactaaaaaccacacaaacaccgatataaactcaaacgcaacgacaccctcctaaacta

SEQ ID NO: 31357 - DNA, 668 bp, Artificial Sequence
  chemically treated genomic DNA (Homo sapiens) CpG-island No: 31357
cggggtttataatttgatttttatttacgcgtattattttttaatttcggggttcgtaatttggtttttatttacgcgtattattttttagataatttcggggttcgcgatttggtttttatttacgggtattatttttttagtttcggggttcgcgatttgatttttatttacgcgtattattttttaatttcggggttcgcgatttgatttttatttacgcgtattattttttaatttcggggttcgtaatttgatttttatttacgcgtattattttttaatttcggggttcgcgatttgatttttatttacgcgtattattttttagataatttcggggtttataatttggtttttatttacgcgtattattttttagataatttcggggttcgcgatttgatttttatttacgcgtattattttttagataatttcggggtttataatttgatttttatttatgcgtattattttttaattttagggttcgcgatttgatttttatttacgcgtattattttttaatttcggggttcgcgatttgatttttatttacgcgtattattttttagataatttcggggttcgtaatttggtttttatttacgtatattattttttaattttagggtttacgatttggtttttatttacgggtatta

SEQ ID NO: 31358 - DNA, 668 bp, Artificial Sequence
  chemically treated genomic DNA (Homo sapiens) CpG-island No: 31358
taatacccgtaaataaaaaccaaatcgtaaaccctaaaattaaaaaataatatacgtaaataaaaaccaaattacgaaccccgaaattatctaaaaaataatacgcgtaaataaaaatcaaatcgcgaaccccgaaattaaaaaataatacgcgtaaataaaaatcaaatcgcgaaccctaaaattaaaaaataatacgcataaataaaaatcaaattataaaccccgaaattatctaaaaaataatacgcgtaaataaaaatcaaatcgcgaaccccgaaattatctaaaaaataatacgcgtaaataaaaaccaaattataaaccccgaaattatctaaaaaataatacgcgtaaataaaaatcaaatcgcgaaccccgaaattaaaaaataatacgcgtaaataaaaatcaaattacgaaccccgaaattaaaaaataatacgcgtaaataaaaatcaaatcgcgaaccccgaaattaaaaaataatacgcgtaaataaaaatcaaatcgcgaaccccgaaactaaaaaaataatacccgtaaataaaaaccaaatcgcgaaccccgaaattatctaaaaaataatacgcgtaaataaaaaccaaattacgaaccccgaaattaaaaaataatacgcgtaaataaaaatcaaattataaaccccg

SEQ ID NO: 31359 - DNA, 668 bp, Artificial Sequence
  chemically treated genomic DNA (Homo sapiens) CpG-island No: 31359
tgatgttcgtgagtgggggttaggtcgtgggttttgagattgagaggtgatgtgcgtgagtgggggttaggttgcgggtttcgagattatttgagaggtgatgcgcgtgagtgggggttaggtcgcgggtttcgagattgagaggtgatgcgcgtgagtgggggttaggtcgcgggttttgagattgagaggtgatgcgtatgagtgggggttaggttgtgggtttcgagattatttgagaggtgatgcgcgtgagtgggggttaggtcgcgggtttcgagattatttgagaggtgatacgcgtgagtgggggttaggttgtgggtttcgagattatttgagaggtgatgcgcgtgagtgggggttaggtcgcgggtttcgagattgagaggtgatgcgcgtgagtgggggttaggttgcgggtttcgagattgagaggtgatgcgcgtgagtgggggttaggtcgcgggtttcgagattgagaggtgatgcgcgtgagtgggggttaggtcgcgggtttcgagattagagaggtggtgttcgtgagtgggggttaggtcgcgggtttcgagattatttgagaggtgatgcgcgtgagtgggggttaggttgcgggtttcgagattgagaggtgatgcgcgtgagtgggggttaggttgtgggtttcg

SEQ ID NO: 31360 - DNA, 668 bp, Artificial Sequence
  chemically treated genomic DNA (Homo sapiens) CpG-island No: 31360
cgaaacccacaacctaacccccactcacgcgcatcacctctcaatctcgaaacccgcaacctaacccccactcacgcgcatcacctctcaaataatctcgaaacccgcgacctaacccccactcacgaacaccacctctctaatctcgaaacccgcgacctaacccccactcacgcgcatcacctctcaatctcgaaacccgcgacctaacccccactcacgcgcatcacctctcaatctcgaaacccgcaacctaacccccactcacgcgcatcacctctcaatctcgaaacccgcgacctaacccccactcacgcgcatcacctctcaaataatctcgaaacccacaacctaacccccactcacgcgtatcacctctcaaataatctcgaaacccgcgacctaacccccactcacgcgcatcacctctcaaataatctcgaaacccacaacctaacccccactcatacgcatcacctctcaatctcaaaacccgcgacctaacccccactcacgcgcatcacctctcaatctcgaaacccgcgacctaacccccactcacgcgcatcacctctcaaataatctcgaaacccgcaacctaacccccactcacgcacatcacctctcaatctcaaaacccacgacctaacccccactcacgaacatca

SEQ ID NO: 31361 - DNA, 736 bp, Artificial Sequence
  chemically treated genomic DNA (Homo sapiens) CpG-island No: 31361
cggggtcgcgcggagttcgcgtggggaaaggtcgggtttgtattcgtttgtcgggttgggcgttttcgtttcgggttcgggatataggggtttttaggtaggcgtcggttttttcgggtgggcggggacgtcggtttacggtttacggttggcggttttcggggtcggggcgcggggtacggggcgtgggcgcgggcgcgggtcgtcgggcgtgtaggttttggcggatagttcgttttcgcggttcgagcggaaggcggcggttacggttattaggtaggcggtgttcggcgttaggttttgtagcgtggtgtagttgcggtcgcgggtatttttattcgtgcgttttttcgtttcgtagcggttcgaattgtacgtggtagtcgagcgtcgcggttgagtttagcgttggggtttaatttacgcggagcgtgcgcggtcgtgcgtgggagatgacgatgcgtttcgttcggttttttttggggcggggagggcggcgagttgcgtggggtcgtttagtttacgatttttggttcgaagttttcgttttgttttatcgggtcgcgtcgtattcgtaggatttggggttttaggaggcgtacgttggatttaggtattagcgttacgtcgtagttcgtgttcgggtcgaggtcggtttagatttagttcgtggcgttttttggtagttgttggcgttttgtagttttcggttgggcgttgggtattagttttagta

SEQ ID NO: 31362 - DNA, 736 bp, Artificial Sequence
  chemically treated genomic DNA (Homo sapiens) CpG-island No: 31362
tactaaaactaatacccaacgcccaaccgaaaactacaaaacgccaacaactaccaaaaaacgccacgaactaaatctaaaccgacctcgacccgaacacgaactacgacgtaacgctaatacctaaatccaacgtacgcctcctaaaaccccaaatcctacgaatacgacgcgacccgataaaacaaaacgaaaacttcgaaccaaaaatcgtaaactaaacgaccccacgcaactcgccgccctccccgccccaaaaaaaaccgaacgaaacgcatcgtcatctcccacgcacgaccgcgcacgctccgcgtaaattaaaccccaacgctaaactcaaccgcgacgctcgactaccacgtacaattcgaaccgctacgaaacgaaaaaacgcacgaataaaaatacccgcgaccgcaactacaccacgctacaaaacctaacgccgaacaccgcctacctaataaccgtaaccgccgccttccgctcgaaccgcgaaaacgaactatccgccaaaacctacacgcccgacgacccgcgcccgcgcccacgccccgtaccccgcgccccgaccccgaaaaccgccaaccgtaaaccgtaaaccgacgtccccgcccacccgaaaaaaccgacgcctacctaaaaacccctatatcccgaacccgaaacgaaaacgcccaacccgacaaacgaatacaaacccgacctttccccacgcgaactccgcgcgaccccg

SEQ ID NO: 31363 - DNA, 736 bp, Artificial Sequence
  chemically treated genomic DNA (Homo sapiens) CpG-island No: 31363
tgttggagttggtgtttagcgtttagtcgggggttgtaagacgttagtagttgttagggaacgttacggattggatttgggtcggtttcgattcggatacggattacgacgtggcgttagtgtttgagtttaacgtgcgttttttgaggttttagattttgcgggtgcgacgcggttcggtgaggtagggcgggggtttcgggttaggagtcgtgggttgggcggttttacgtagttcgtcgtttttttcgttttagaggaggtcgggcggagcgtatcgttattttttacgtacggtcgcgtacgtttcgcgtgagttgggttttagcgttgggtttagtcgcggcgttcggttattacgtgtagttcgggtcgttgcggggcggggaggcgtacgggtggaggtgttcgcggtcgtaattgtattacgttgtagggtttggcgtcgggtatcgtttatttggtgatcgtgatcgtcgtttttcgttcgggtcgcgagagcgagttgttcgttaaggtttgtacgttcgacggttcgcgttcgcgtttacgtttcgtgtttcgcgtttcgatttcggggatcgttagtcgtgagtcgtaagtcggcgttttcgtttattcgagagggtcggcgtttatttgagggtttttgtgtttcgaattcggagcggaggcgtttaattcggtagacgggtgtaggttcggtttttttttacgcggatttcgcgcgatttcg

SEQ ID NO: 31364 - DNA, 736 bp, Artificial Sequence
  chemically treated genomic DNA (Homo sapiens) CpG-island No: 31364
cgaaatcgcgcgaaatccgcgtaaaaaaaaaccgaacctacacccgtctaccgaattaaacgcctccgctccgaattcgaaacacaaaaaccctcaaataaacgccgaccctctcgaataaacgaaaacgccgacttacgactcacgactaacgatccccgaaatcgaaacgcgaaacacgaaacgtaaacgcgaacgcgaaccgtcgaacgtacaaaccttaacgaacaactcgctctcgcgacccgaacgaaaaacgacgatcacgatcaccaaataaacgatacccgacgccaaaccctacaacgtaatacaattacgaccgcgaacacctccacccgtacgcctccccgccccgcaacgacccgaactacacgtaataaccgaacgccgcgactaaacccaacgctaaaacccaactcacgcgaaacgtacgcgaccgtacgtaaaaaataacgatacgctccgcccgacctcctctaaaacgaaaaaaacgacgaactacgtaaaaccgcccaacccacgactcctaacccgaaacccccgccctacctcaccgaaccgcgtcgcacccgcaaaatctaaaacctcaaaaaacgcacgttaaactcaaacactaacgccacgtcgtaatccgtatccgaatcgaaaccgacccaaatccaatccgtaacgttccctaacaactactaacgtcttacaacccccgactaaacgctaaacaccaactccaaca

SEQ ID NO: 31365 - DNA, 943 bp, Artificial Sequence
  chemically treated genomic DNA (Homo sapiens) CpG-island No: 31365
cgatatatttatgattatattacggagttcgttttcgtatttttcgcgatgtcgcggtcgcgtcgtagtcgcgcgttttagattcggtcgtagtttcggaacgcggcgtattcgtcgtttcgttgttttttttcggtattatcgttttcgtttcgacgtttcgagtttttcgcgcgttcgttcgtcggtcgaggtcgcgttcgcgttttcgtttacgcgcgcgtttcgattcgttgtttcgcgttcggtcgtttattcgtttcggttcgggagcggcgcgagggacgtagtacggaggcgcgtttagtttcgtcgttttttcgtcgtcgttttcggtcgcgtcgttaaagggatcgtcggttcggggttttgaggtggtcgcgggggggcgttcgagtcgcggtgttgacgttacgggggcgcgcggcgggggcgggcgtcggttgtagtagcgtaggcgtttttcgttcgtttcgtttcgtttcggtttcgttttcgcgcgcgcgtcgttttatttgtttgtttcggcgtttgcgacgcgcgtcgttggttggtgggttcgtggggttcggggcgtcgtggtcgggcggagggatttcggggacgtcgagtgcgcggcgttgaagtggcgttcggtcgttttggttatcgcgaaggttttcgattcgcgtgttttttgtcgggttttacggggtttaggtagtaggcgagcggatgcgggcgcgcgggggggtttgtgtacggaggcgtcggagcgtcggcgggggagggatttagttttggggtttttcgtaggtaggggagattttcgaggcgttttttgaggtcgcgggggttcgcgtttattgtttcggggttcgcggggttggaggttttttcgattcgattttagtaggaagcgcggaggttattagagggcggtttaggatggggggagtgagga

SEQ ID NO: 31366 - DNA, 943 bp, Artificial Sequence
  chemically treated genomic DNA (Homo sapiens) CpG-island No: 31366
tcctcactccccccatcctaaaccgccctctaataacctccgcgcttcctactaaaatcgaatcgaaaaaacctccaaccccgcgaaccccgaaacaataaacgcgaacccccgcgacctcaaaaaacgcctcgaaaatctcccctacctacgaaaaaccccaaaactaaatccctcccccgccgacgctccgacgcctccgtacacaaacccccccgcgcgcccgcatccgctcgcctactacctaaaccccgtaaaacccgacaaaaaacacgcgaatcgaaaaccttcgcgataaccaaaacgaccgaacgccacttcaacgccgcgcactcgacgtccccgaaatccctccgcccgaccacgacgccccgaaccccacgaacccaccaaccaacgacgcgcgtcgcaaacgccgaaacaaacaaataaaacgacgcgcgcgcgaaaacgaaaccgaaacgaaacgaaacgaacgaaaaacgcctacgctactacaaccgacgcccgcccccgccgcgcgcccccgtaacgtcaacaccgcgactcgaacgcccccccgcgaccacctcaaaaccccgaaccgacgatccctttaacgacgcgaccgaaaacgacgacgaaaaaacgacgaaactaaacgcgcctccgtactacgtccctcgcgccgctcccgaaccgaaacgaataaacgaccgaacgcgaaacaacgaatcgaaacgcgcgcgtaaacgaaaacgcgaacgcgacctcgaccgacgaacgaacgcgcgaaaaactcgaaacgtcgaaacgaaaacgataataccgaaaaaaaacaacgaaacgacgaatacgccgcgttccgaaactacgaccgaatctaaaacgcgcgactacgacgcgaccgcgacatcgcgaaaaatacgaaaacgaactccgtaatataatcataaatatatcg

SEQ ID NO: 31367 - DNA, 943 bp, Artificial Sequence
  chemically treated genomic DNA (Homo sapiens) CpG-island No: 31367
tttttattttttttattttgggtcgttttttagtggttttcgcgttttttgttggggtcgggtcgggaaggtttttagtttcgcgagtttcggaatagtaagcgcggattttcgcggttttaagggacgtttcggaagttttttttgtttgcggagaattttaggattaaatttttttttcgtcggcgtttcgacgttttcgtgtatagattttttcgcgcgttcgtattcgttcgtttgttgtttggatttcgtgggattcggtagagggtacgcgagtcgggagttttcgcggtggttagagcgatcgggcgttattttagcgtcgcgtattcggcgttttcggggttttttcgttcgattacgacgtttcggattttacgggtttattagttagcggcgcgcgtcgtaggcgtcggagtagataggtgaagcggcgcgcgcgcgggggcggggtcggggcggggcggggcgagcgaggagcgtttgcgttgttgtagtcggcgttcgttttcgtcgcgcgttttcgtgacgttaatatcgcggttcgggcgttttttcgcggttattttaggatttcgggtcggcggtttttttaacggcgcggtcgagggcgacggcgggagggcggcggggttgagcgcgttttcgtgttgcgtttttcgcgtcgttttcgggtcggggcggatgggcggtcgggcgcggggtagcgagtcgggacgcgcgcgtgagcgggggcgcgggcgcggtttcggtcggcgggcgagcgcgcggggggttcggagcgtcggggcgagagcggtggtgtcgggggggggtagcggggcggcgggtacgtcgcgtttcgaggttgcggtcgggtttggagcgcgcggttgcggcgcggtcgcggtatcgcgaggggtacgagggcgaatttcgtgatatggttataggtgtgtcg

SEQ ID NO: 31368 - DNA, 943 bp, Artificial Sequence
  chemically treated genomic DNA (Homo sapiens) CpG-island No: 31368
cgacacacctataaccatatcacgaaattcgccctcgtacccctcgcgataccgcgaccgcgccgcaaccgcgcgctccaaacccgaccgcaacctcgaaacgcgacgtacccgccgccccgctacccccccccgacaccaccgctctcgccccgacgctccgaaccccccgcgcgctcgcccgccgaccgaaaccgcgcccgcgcccccgctcacgcgcgcgtcccgactcgctaccccgcgcccgaccgcccatccgccccgacccgaaaacgacgcgaaaaacgcaacacgaaaacgcgctcaaccccgccgccctcccgccgtcgccctcgaccgcgccgttaaaaaaaccgccgacccgaaatcctaaaataaccgcgaaaaaacgcccgaaccgcgatattaacgtcacgaaaacgcgcgacgaaaacgaacgccgactacaacaacgcaaacgctcctcgctcgccccgccccgccccgaccccgcccccgcgcgcgcgccgcttcacctatctactccgacgcctacgacgcgcgccgctaactaataaacccgtaaaatccgaaacgtcgtaatcgaacgaaaaaaccccgaaaacgccgaatacgcgacgctaaaataacgcccgatcgctctaaccaccgcgaaaactcccgactcgcgtaccctctaccgaatcccacgaaatccaaacaacaaacgaacgaatacgaacgcgcgaaaaaatctatacacgaaaacgtcgaaacgccgacgaaaaaaaaatttaatcctaaaattctccgcaaacaaaaaaaacttccgaaacgtcccttaaaaccgcgaaaatccgcgcttactattccgaaactcgcgaaactaaaaaccttcccgacccgaccccaacaaaaaacgcgaaaaccactaaaaaacgacccaaaataaaaaaaataaaaa

SEQ ID NO: 31369 - DNA, 701 bp, Artificial Sequence
  chemically treated genomic DNA (Homo sapiens) CpG-island No: 31369
gaagcggtttcgtgttgtttagcgttggcgtttcggcggcgcggagttcggttaaatgataggatttgagggtaaaggaggataaaagtttttacgaggtgggtattgcgggaaggaggtcgacgatttcgagatttttcggcgatttcggcgggttatttcggggcggtgagggttttcgcggtacgtgtgcggcggcgtcggtcgtttttttcgtcgttcgggaaggttacgtcgttcggacgtcgaggtttttttcgtgtttcgtttttttcgtttcgtatatttttcgtagttggaggcgtcgggtcggtttgcgtttatcgtttcgttagcgtggttacgtttcgtttaggttgcgtcgtttgtttttggtttcgggtagtcggtcggggcggttatttaatatcgacgtcggtcgcggtcggtttttcgcgtaggtagttttagaggcggtttcgcgaagtttaggagcgtttttgcgattcgggggtagattgcgtagtgttacgtttaggtaggtatttggagtcgtcgtagtttatcggttttgtcgttatttttcgtacgggaagcggaagtgggcgcgggatcgcggcgcgtttagttcggttagttttcgcgtttagtttagttcgcgagttggcgtgtcgttgttgtttgttttaggaaagttgtggggtagggtttgcgtttttggg

SEQ ID NO: 31370 - DNA, 701 bp, Artificial Sequence
  chemically treated genomic DNA (Homo sapiens) CpG-island No: 31370
cccaaaaacgcaaaccctaccccacaactttcctaaaacaaacaacaacgacacgccaactcgcgaactaaactaaacgcgaaaactaaccgaactaaacgcgccgcgatcccgcgcccacttccgcttcccgtacgaaaaataacgacaaaaccgataaactacgacgactccaaatacctacctaaacgtaacactacgcaatctacccccgaatcgcaaaaacgctcctaaacttcgcgaaaccgcctctaaaactacctacgcgaaaaaccgaccgcgaccgacgtcgatattaaataaccgccccgaccgactacccgaaaccaaaaacaaacgacgcaacctaaacgaaacgtaaccacgctaacgaaacgataaacgcaaaccgacccgacgcctccaactacgaaaaatatacgaaacgaaaaaaacgaaacacgaaaaaaacctcgacgtccgaacgacgtaaccttcccgaacgacgaaaaaaacgaccgacgccgccgcacacgtaccgcgaaaaccctcaccgccccgaaataacccgccgaaatcgccgaaaaatctcgaaatcgtcgacctccttcccgcaatacccacctcgtaaaaacttttatcctcctttaccctcaaatcctatcatttaaccgaactccgcgccgccgaaacgccaacgctaaacaacacgaaaccgcttc

SEQ ID NO: 31371 - DNA, 701 bp, Artificial Sequence
  chemically treated genomic DNA (Homo sapiens) CpG-island No: 31371
tttagaggcgtaggttttgttttatagtttttttagggtaggtagtagcgatacgttagttcgcgggttaggttgggcgcgggaattggtcgggttgggcgcgtcgcggtttcgcgtttattttcgtttttcgtgcgggggatggcggtagagtcggtgggttgcggcggttttaggtatttgtttgagcgtggtattgcgtagtttgttttcgggtcgtaggggcgtttttgagtttcgcggggtcgtttttagggttgtttgcgcggagagtcgatcgcggtcgacgtcggtgttaagtggtcgtttcggtcggttattcggagttaagagtaggcggcgtagtttgagcgggacgtggttacgttggcgaggcggtaagcgtagatcgattcggcgtttttagttgcggggagtgtgcggggcggagggagcggggtacggggagagtttcggcgttcgggcggcgtgattttttcgggcggcgggggaagcggtcggcgtcgtcgtatacgtgtcgcgggaatttttatcgtttcggggtggttcgtcggggtcgtcggagaatttcggggtcgtcggtttttttttcgtagtgtttatttcgtgggaatttttgtttttttttgtttttaagttttattatttggtcgggtttcgcgtcgtcggggcgttagcgttgggtagtacggagtcgtttt

SEQ ID NO: 31372 - DNA, 701 bp, Artificial Sequence
  chemically treated genomic DNA (Homo sapiens) CpG-island No: 31372
aaaacgactccgtactacccaacgctaacgccccgacgacgcgaaacccgaccaaataataaaacttaaaaacaaaaaaaaacaaaaattcccacgaaataaacactacgaaaaaaaaaccgacgaccccgaaattctccgacgaccccgacgaaccaccccgaaacgataaaaattcccgcgacacgtatacgacgacgccgaccgcttcccccgccgcccgaaaaaatcacgccgcccgaacgccgaaactctccccgtaccccgctccctccgccccgcacactccccgcaactaaaaacgccgaatcgatctacgcttaccgcctcgccaacgtaaccacgtcccgctcaaactacgccgcctactcttaactccgaataaccgaccgaaacgaccacttaacaccgacgtcgaccgcgatcgactctccgcgcaaacaaccctaaaaacgaccccgcgaaactcaaaaacgcccctacgacccgaaaacaaactacgcaataccacgctcaaacaaatacctaaaaccgccgcaacccaccgactctaccgccatcccccgcacgaaaaacgaaaataaacgcgaaaccgcgacgcgcccaacccgaccaattcccgcgcccaacctaacccgcgaactaacgtatcgctactacctaccctaaaaaaactataaaacaaaacctacgcctctaaa

SEQ ID NO: 31373 - DNA, 725 bp, Artificial Sequence
  chemically treated genomic DNA (Homo sapiens) CpG-island No: 31373
cgcgttattcggcggtttcgtcggttttttttttatttttgatttttttcgttatagttatagaacgtttaagcgttttttcgtttagggtgttttttttgtttcgtttatttgcgtttcgcgggtttagcggtgttacgtcgcgttcgttttaatatgattggtttttgtttttgttattttaggatttaagttcgttattggtcggttttcgttacgtcgttgatgtggagtagggtcgagcgcggaacgcgaggggttgttggggtgtttgtcgtagcgggtttttttcggcggtttgcggagttgttaggatggagtaggttgcggagggagtaagggtgatcgtagtttttgtgttagttgtcgatagtattgaggagttggtcgaagtcgaagaaggagttggagtagtgggcgaagataatgacgtagtcgcgagaggagcggaggtttttggcgatagtgaggaggacggagaggatgtgttcgaggtggagaagattttggatatgaagatcgagggggtatgtggaggggtttcggcgcggggttgggcggggagtttcgggtttggcggggaggacgcgagttggaaatagtacgggtagatttaaaataggagcgggggaggaatgtgagagtttaatgtaagtacgcgaaatcgtgggaaaagcgaagtgatatttttaattgtatttttagggttgagtgtgtgagggaag

SEQ ID NO: 31374 - DNA, 725 bp, Artificial Sequence
  chemically treated genomic DNA (Homo sapiens) CpG-island No: 31374
cttccctcacacactcaaccctaaaaatacaattaaaaatatcacttcgcttttcccacgatttcgcgtacttacattaaactctcacattcctcccccgctcctattttaaatctacccgtactatttccaactcgcgtcctccccgccaaacccgaaactccccgcccaaccccgcgccgaaacccctccacataccccctcgatcttcatatccaaaatcttctccacctcgaacacatcctctccgtcctcctcactatcgccaaaaacctccgctcctctcgcgactacgtcattatcttcgcccactactccaactccttcttcgacttcgaccaactcctcaatactatcgacaactaacacaaaaactacgatcacccttactccctccgcaacctactccatcctaacaactccgcaaaccgccgaaaaaaacccgctacgacaaacaccccaacaacccctcgcgttccgcgctcgaccctactccacatcaacgacgtaacgaaaaccgaccaataacgaacttaaatcctaaaataacaaaaacaaaaaccaatcatattaaaacgaacgcgacgtaacaccgctaaacccgcgaaacgcaaataaacgaaacaaaaaaaacaccctaaacgaaaaaacgcttaaacgttctataactataacgaaaaaaatcaaaaataaaaaaaaaaccgacgaaaccgccgaataacgcg

SEQ ID NO: 31375 - DNA, 725 bp, Artificial Sequence
  chemically treated genomic DNA (Homo sapiens) CpG-island No: 31375
ttttttttatatatttagttttaagagtgtagttggaaatgttatttcgttttttttacgatttcgcgtgtttgtattgaatttttatatttttttttcgtttttgttttgggtttgttcgtgttgtttttagttcgcgtttttttcgttaggttcggagtttttcgtttagtttcgcgtcggggtttttttatatattttttcggtttttatgtttaggattttttttatttcgaatatatttttttcgttttttttattgtcgttaaaggttttcgtttttttcgcggttgcgttattattttcgtttattattttaatttttttttcgatttcggttaattttttagtgttgtcggtagttgatatagggattgcggttatttttgtttttttcgtaatttgttttattttagtagtttcgtaaatcgtcgaggaaaattcgttgcgataaatattttagtagtttttcgcgtttcgcgttcggttttattttatattagcggcgtaacggaagtcgattaatggcgggtttggattttagagtgataggaataaaaattaattatattaaggcgggcgcggcgtaatatcgttgagttcgcgggacgtaggtgggcggggtagggagggtattttaggcggaagagcgtttgggcgttttgtagttgtggcggaaaaggttaagggtgggaggggagtcggcgaggtcgtcgagtggcgcg

SEQ ID NO: 31376 - DNA, 725 bp, Artificial Sequence
  chemically treated genomic DNA (Homo sapiens) CpG-island No: 31376
cgcgccactcgacgacctcgccgactcccctcccacccttaaccttttccgccacaactacaaaacgcccaaacgctcttccgcctaaaataccctccctaccccgcccacctacgtcccgcgaactcaacgatattacgccgcgcccgccttaatataattaatttttattcctatcactctaaaatccaaacccgccattaatcgacttccgttacgccgctaatataaaataaaaccgaacgcgaaacgcgaaaaactactaaaatatttatcgcaacgaattttcctcgacgatttacgaaactactaaaataaaacaaattacgaaaaaaacaaaaataaccgcaatccctatatcaactaccgacaacactaaaaaattaaccgaaatcgaaaaaaaaattaaaataataaacgaaaataataacgcaaccgcgaaaaaaacgaaaacctttaacgacaataaaaaaaacgaaaaaaatatattcgaaataaaaaaaatcctaaacataaaaaccgaaaaaatatataaaaaaaccccgacgcgaaactaaacgaaaaactccgaacctaacgaaaaaaacgcgaactaaaaacaacacgaacaaacccaaaacaaaaacgaaaaaaaaatataaaaattcaatacaaacacgcgaaatcgtaaaaaaaacgaaataacatttccaactacactcttaaaactaaatatataaaaaaaa

SEQ ID NO: 31377 - DNA, 977 bp, Artificial Sequence
  chemically treated genomic DNA (Homo sapiens) CpG-island No: 31377
cgacgtcgtcgagtgaattcggtatacgtatggagagtagttattgttttttttcgtcgatttatagtttatacgcgtgtatttcgttaaatatgcggtagatagcgagcgcgtttcgtagttattggcgttttagcgtcgttatttcggttattttagcgaataattgttttgtttttattacgcgtatttgtagcgttattattagtggttttgcgttattggtattttcgagtgtcgttagttggcgtcgtaggtcgtttacgggttcgcgatgtgtttttattttttcggtgagcgcgcggtgttggcgcgttaggcggcggttggaagtttcgtcgtggtcgaagttatcggcggttgttaggcggtaagcgtcgcgaagttagtttagtagttcgtcgaggttagcgtcgaattggtgtagcgttcgcgttttttgtagtcgtcgttttcgtcgcgtcgtcgttttttttagtttttgttagcggcgtcgggcgttcgtcgcgcgtttcgttaggtttattaggtgtacggtgtttgttttcgggtcgacggtatcgtcggtcgtaattagtttttcgttatatcgtagggtttgttgtagtaacgttcgtcgttcgtttagttcgttttgtaggattttgtgttgggttaggaggcgcgttgtgttggataggttatgcgcgtcgttcgttgttttcgttgcgttcgttgcgttcgtcgtatcgtcgtcgttcgtagtttttaggagacgttttttgtcgcgcgtttagttttcggttttttttagtttttgtagtagcgtttataggtttcgcgaagtttttagtttcgcgcgtcgtcgcgttgtttgtttttgtagtttcgttaggtagtcgtgtacgtggtttacgcggttgtagatgatttgcgggtcgtagggttggtagtttgagttaggagaaggggagtatttaggattggttataagttaa

SEQ ID NO: 31378 - DNA, 977 bp, Artificial Sequence
  chemically treated genomic DNA (Homo sapiens) CpG-island No: 31378
ttaacttataaccaatcctaaatactccccttctcctaactcaaactaccaaccctacgacccgcaaatcatctacaaccgcgtaaaccacgtacacgactacctaacgaaactacaaaaacaaacaacgcgacgacgcgcgaaactaaaaacttcgcgaaacctataaacgctactacaaaaactaaaaaaaaccgaaaactaaacgcgcgacaaaaaacgtctcctaaaaactacgaacgacgacgatacgacgaacgcaacgaacgcaacgaaaacaacgaacgacgcgcataacctatccaacacaacgcgcctcctaacccaacacaaaatcctacaaaacgaactaaacgaacgacgaacgttactacaacaaaccctacgatataacgaaaaactaattacgaccgacgataccgtcgacccgaaaacaaacaccgtacacctaataaacctaacgaaacgcgcgacgaacgcccgacgccgctaacaaaaactaaaaaaaacgacgacgcgacgaaaacgacgactacaaaaaacgcgaacgctacaccaattcgacgctaacctcgacgaactactaaactaacttcgcgacgcttaccgcctaacaaccgccgataacttcgaccacgacgaaacttccaaccgccgcctaacgcgccaacaccgcgcgctcaccgaaaaaataaaaacacatcgcgaacccgtaaacgacctacgacgccaactaacgacactcgaaaataccaataacgcaaaaccactaataataacgctacaaatacgcgtaataaaaacaaaacaattattcgctaaaataaccgaaataacgacgctaaaacgccaataactacgaaacgcgctcgctatctaccgcatatttaacgaaatacacgcgtataaactataaatcgacgaaaaaaaacaataactactctccatacgtataccgaattcactcgacgacgtcg

SEQ ID NO: 31379 - DNA, 977 bp, Artificial Sequence
  chemically treated genomic DNA (Homo sapiens) CpG-island No: 31379
ttggtttgtgattaattttggatgtttttttttttttggtttaggttattagttttgcgattcgtaggttatttgtaatcgcgtgaattacgtgtacggttgtttggcggagttgtaggagtaggtagcgcggcgacgcgcggagttggaggtttcgcggagtttgtgggcgttgttgtaggagttggaggaggtcgagagttgggcgcgcgataaggagcgttttttggaggttgcgggcggcggcggtgcggcgggcgtagcgggcgtagcgggaatagcgggcggcgcgtatgatttgtttagtatagcgcgttttttggtttagtataagattttgtagggcgagttgggcgggcggcgggcgttgttgtagtaggttttgcggtgtggcgaggagttggttgcggtcggcggtgtcgtcggttcgggagtagatatcgtgtatttggtaggtttggcggagcgcgcggcgagcgttcggcgtcgttggtagaggttggaagaggcggcggcgcggcgagagcggcggttgtaggaggcgcgggcgttgtattagttcggcgttgatttcgacgggttgttggattggtttcgcgacgtttatcgtttggtagtcgtcggtgatttcggttacgacgaagtttttagtcgtcgtttggcgcgttagtatcgcgcgtttatcggggaggtggaggtatatcgcgggttcgtgagcggtttgcggcgttagttggcgatattcgggggtgttagtggcgtagggttattggtggtggcgttgtaggtgcgcgtggtggaagtagagtagttgttcgttgaggtgatcgaagtggcggcgttgaggcgttagtggttgcgggacgcgttcgttgtttatcgtatgtttggcgaggtgtacgcgtgtgagttgtggatcggcgagaaggagtaatggttgttttttatgcgtgtgtcggatttattcgacgacgtcg

SEQ ID NO: 31380 - DNA, 977 bp, Artificial Sequence
  chemically treated genomic DNA (Homo sapiens) CpG-island No: 31380
cgacgtcgtcgaataaatccgacacacgcataaaaaacaaccattactccttctcgccgatccacaactcacacgcgtacacctcgccaaacatacgataaacaacgaacgcgtcccgcaaccactaacgcctcaacgccgccacttcgatcacctcaacgaacaactactctacttccaccacgcgcacctacaacgccaccaccaataaccctacgccactaacacccccgaatatcgccaactaacgccgcaaaccgctcacgaacccgcgatatacctccacctccccgataaacgcgcgatactaacgcgccaaacgacgactaaaaacttcgtcgtaaccgaaatcaccgacgactaccaaacgataaacgtcgcgaaaccaatccaacaacccgtcgaaatcaacgccgaactaatacaacgcccgcgcctcctacaaccgccgctctcgccgcgccgccgcctcttccaacctctaccaacgacgccgaacgctcgccgcgcgctccgccaaacctaccaaatacacgatatctactcccgaaccgacgacaccgccgaccgcaaccaactcctcgccacaccgcaaaacctactacaacaacgcccgccgcccgcccaactcgccctacaaaatcttatactaaaccaaaaaacgcgctatactaaacaaatcatacgcgccgcccgctattcccgctacgcccgctacgcccgccgcaccgccgccgcccgcaacctccaaaaaacgctccttatcgcgcgcccaactctcgacctcctccaactcctacaacaacgcccacaaactccgcgaaacctccaactccgcgcgtcgccgcgctacctactcctacaactccgccaaacaaccgtacacgtaattcacgcgattacaaataacctacgaatcgcaaaactaataacctaaaccaaaaaaaaaaaaacatccaaaattaatcacaaaccaa

SEQ ID NO: 31381 - DNA, 803 bp, Artificial Sequence
  chemically treated genomic DNA (Homo sapiens) CpG-island No: 31381
cgaaatgtatatttcgagtgggtatttggttacgtagtattacgagcgtttggcgtagatttcgtaggaagagttggtagatgtgcgtttggattagcgtttttttgcgcgttttttataagtcgagtagtttatgttagttaagttcgaggtgtggtagttattcgtttagtgttaggttcgggtttagttttgcgtcgtcggcggttagtagcgtttcgttggtcgttacgatgcgagtatagtttttttcgcgttggtttattttttttttgagcgtagcgtggcgcgttagtagcgcgttcgttttttttaggttgttgggtaggggtttttcgttgtcgttcgtcgttttttgggcgcgtacgagttagtttaggaaagcgtcgaggttatgtaggaagcgttgtaggcgttttgttgtcgttatcgtttcgtcgtaggtttgagtcgcgttagttagcgcgttttattcggcgtttagttttttcgcgttttggtgtagtcgcgtcgtttgcgtcgggaagcgtttagttagtagggttgttttttttagaagggtcgtttggcgcggttttagcgtttgtagagcggtttttaggtcgttaagacgttattgtagggcgtcgtcggttcggggcgcgttttttatagtttttcgttttttacgtatttgggcgcgtatttcggttatttttagtacgtggttttttattagtagtatcgcgtttattttttttttgcgttgttttattagttttacgatgcggttttatttgtttaggggaaagagagtgatttga

SEQ ID NO: 31382 - DNA, 803 bp, Artificial Sequence
  chemically treated genomic DNA (Homo sapiens) CpG-island No: 31382
tcaaatcactctctttcccctaaacaaataaaaccgcatcgtaaaactaataaaacaacgcaaaaaaaaaataaacgcgatactactaataaaaaaccacgtactaaaaataaccgaaatacgcgcccaaatacgtaaaaaacgaaaaactataaaaaacgcgccccgaaccgacgacgccctacaataacgtcttaacgacctaaaaaccgctctacaaacgctaaaaccgcgccaaacgacccttctaaaaaaaacaaccctactaactaaacgcttcccgacgcaaacgacgcgactacaccaaaacgcgaaaaaactaaacgccgaataaaacgcgctaactaacgcgactcaaacctacgacgaaacgataacgacaacaaaacgcctacaacgcttcctacataacctcgacgctttcctaaactaactcgtacgcgcccaaaaaacgacgaacgacaacgaaaaacccctacccaacaacctaaaaaaaacgaacgcgctactaacgcgccacgctacgctcaaaaaaaaaataaaccaacgcgaaaaaaactatactcgcatcgtaacgaccaacgaaacgctactaaccgccgacgacgcaaaactaaacccgaacctaacactaaacgaataactaccacacctcgaacttaactaacataaactactcgacttataaaaaacgcgcaaaaaaacgctaatccaaacgcacatctaccaactcttcctacgaaatctacgccaaacgctcgtaatactacgtaaccaaatacccactcgaaatatacatttcg

SEQ ID NO: 31383 - DNA, 803 bp, Artificial Sequence
  chemically treated genomic DNA (Homo sapiens) CpG-island No: 31383
ttaagttatttttttttttttgggtaggtggaatcgtatcgtggagttagtggaatagcgtaaagaggaaatgagcgcggtgttgttggtggagaattacgtgttggaggtggtcgaggtgcgcgtttaggtgcgtgagaagcggagagttgtggagagcgcgtttcgggtcggcggcgttttgtagtggcgttttagcggtttagaggtcgttttgtaggcgttggagtcgcgttaggcggtttttttggaggaggtagttttgttggttgagcgtttttcggcgtaggcggcgcggttgtattagggcgcggaggagttgggcgtcgagtggggcgcgttagttagcgcggtttaggtttgcggcgaggcggtggcggtagtagggcgtttgtagcgttttttatatgatttcgacgtttttttggattggttcgtgcgcgtttaggaggcggcgggcggtagcgaggggtttttgtttaatagtttagaagaggcggacgcgttgttggcgcgttacgttgcgtttaaggaggaggtggattagcgcgaggaagattatgttcgtatcgtggcggttagcgaggcgttgttggtcgtcgacggcgtagagttgggttcgggtttggtattagacgagtggttgttatatttcgaatttggttggtataaattgttcggtttgtgggaggcgcgtagggaggcgttggtttaggcgtatatttattagttttttttgcgggatttacgttaggcgttcgtggtgttgcgtaattaggtgtttattcggggtgtatatttcg

SEQ ID NO: 31384 - DNA, 803 bp, Artificial Sequence
  chemically treated genomic DNA (Homo sapiens) CpG-island No: 31384
cgaaatatacaccccgaataaacacctaattacgcaacaccacgaacgcctaacgtaaatcccgcaaaaaaaactaataaatatacgcctaaaccaacgcctccctacgcgcctcccacaaaccgaacaatttataccaaccaaattcgaaatataacaaccactcgtctaataccaaacccgaacccaactctacgccgtcgacgaccaacaacgcctcgctaaccgccacgatacgaacataatcttcctcgcgctaatccacctcctccttaaacgcaacgtaacgcgccaacaacgcgtccgcctcttctaaactattaaacaaaaacccctcgctaccgcccgccgcctcctaaacgcgcacgaaccaatccaaaaaaacgtcgaaatcatataaaaaacgctacaaacgccctactaccgccaccgcctcgccgcaaacctaaaccgcgctaactaacgcgccccactcgacgcccaactcctccgcgccctaatacaaccgcgccgcctacgccgaaaaacgctcaaccaacaaaactacctcctccaaaaaaaccgcctaacgcgactccaacgcctacaaaacgacctctaaaccgctaaaacgccactacaaaacgccgccgacccgaaacgcgctctccacaactctccgcttctcacgcacctaaacgcgcacctcgaccacctccaacacgtaattctccaccaacaacaccgcgctcatttcctctttacgctattccactaactccacgatacgattccacctacccaaaaaaaaaaaaataacttaa

SEQ ID NO: 31385 - DNA, 618 bp, Artificial Sequence
  chemically treated genomic DNA (Homo sapiens) CpG-island No: 31385
gcggtcgttagcgtcgttgttttcgttgttcgtcgcgatcgatcgttttttttgtcggcgttcgttgttcggttcggttcggttcggtttagttcggtttagttcggtttcgtcggttcgcggtttagttagattcgtatgcgtcgtcgcgtttttttttttcgcgtcgtcgtcgcgtttagcgcgttttcgggattttttttcgttcgcggttttcgcgtttcgtcgttcgaggtttacgcgtagttatattcggtcgcggcgtggggtgtacggttgtattcgcgagggtacggcggcgttacgcgttgtatatttttacggggttacgttcgttacgttgttatattcgcgggggtttcggcgtataaatttattttcgtatttacgcgtttgcgcgtcgttatttttttttgtggggttttacggggttatatttttacgtcgttatacgcggcgtttatattggaacggtgttatttattattatataaatttaatagggtaattatcgtttacgcggcgttatatataaatgtatttgttatatatagtcgtatatttttcggtagttataaatagtgttataggtttatatattacgtatagttttatagt

SEQ ID NO: 31386 - DNA, 618 bp, Artificial Sequence
  chemically treated genomic DNA (Homo sapiens) CpG-island No: 31386
actataaaactatacgtaatatataaacctataacactatttataactaccgaaaaatatacgactatatataacaaatacatttatatataacgccgcgtaaacgataattaccctattaaatttatataataataaataacaccgttccaatataaacgccgcgtataacgacgtaaaaatataaccccgtaaaaccccacaaaaaaaaataacgacgcgcaaacgcgtaaatacgaaaataaatttatacgccgaaacccccgcgaatataacaacgtaacgaacgtaaccccgtaaaaatatacaacgcgtaacgccgccgtaccctcgcgaatacaaccgtacaccccacgccgcgaccgaatataactacgcgtaaacctcgaacgacgaaacgcgaaaaccgcgaacgaaaaaaaatcccgaaaacgcgctaaacgcgacgacgacgcgaaaaaaaaaaacgcgacgacgcatacgaatctaactaaaccgcgaaccgacgaaaccgaactaaaccgaactaaaccgaaccgaaccgaaccgaacaacgaacgccgacaaaaaaaacgatcgatcgcgacgaacaacgaaaacaacgacgctaacgaccgc

SEQ ID NO: 31387 - DNA, 618 bp, Artificial Sequence
  chemically treated genomic DNA (Homo sapiens) CpG-island No: 31387
gttgtgaagttgtgcgtgatgtgtgggtttatgatattgtttgtgattgtcggggagtgtgcggttgtgtgtgataggtgtatttgtgtgtgacgtcgcgtgggcggtggttattttattggatttgtgtggtggtgggtgatatcgttttagtgtggacgtcgcgtgtgacggcgtgagggtgtgatttcgtgagattttataggagggagtgacggcgcgtaagcgcgtggatgcgggggtgagtttgtgcgtcgaggttttcgcgagtatggtagcgtggcgagcgtgatttcgtgggagtgtgtagcgcgtgacgtcgtcgtgttttcgcgagtgtagtcgtgtattttacgtcgcggtcgggtgtgattgcgcgtgggtttcgggcggcggggcgcggggatcgcgggcgggagggggtttcgggggcgcgttgagcgcggcggcggcgcgagagagggaggcgcggcggcgtatgcggatttggttgagtcgcgggtcggcggggtcgagttgagtcgggttgggtcgggtcgggtcgggtcgggtagcggacgtcgatagggagggcggtcggtcgcggcgagtagcggagatagcgacgttggcggtcgt

SEQ ID NO: 31388 - DNA, 618 bp, Artificial Sequence
  chemically treated genomic DNA (Homo sapiens) CpG-island No: 31388
acgaccgccaacgtcgctatctccgctactcgccgcgaccgaccgccctccctatcgacgtccgctacccgacccgacccgacccgacccaacccgactcaactcgaccccgccgacccgcgactcaaccaaatccgcatacgccgccgcgcctccctctctcgcgccgccgccgcgctcaacgcgcccccgaaaccccctcccgcccgcgatccccgcgccccgccgcccgaaacccacgcgcaatcacacccgaccgcgacgtaaaatacacgactacactcgcgaaaacacgacgacgtcacgcgctacacactcccacgaaatcacgctcgccacgctaccatactcgcgaaaacctcgacgcacaaactcacccccgcatccacgcgcttacgcgccgtcactccctcctataaaatctcacgaaatcacaccctcacgccgtcacacgcgacgtccacactaaaacgatatcacccaccaccacacaaatccaataaaataaccaccgcccacgcgacgtcacacacaaatacacctatcacacacaaccgcacactccccgacaatcacaaacaatatcataaacccacacatcacgcacaacttcacaac

SEQ ID NO: 31389 - DNA, 551 bp, Artificial Sequence
  chemically treated genomic DNA (Homo sapiens) CpG-island No: 31389
ttttttttcgggaggtggagcgcggaggtagggcgttgagtgataagttatttcggtttcgtttattttatttgttgttatgtggaggcgtggttttttgtggtttcgttttttagtttaagtggcgcgtagagagggcggtgttggacggtgagcgaatgtaagttgacgtttgtttcgtttattcgcgttaggtttcgttttttgatttgagtcgcgggcggagagtttgaggcgtggtttttcgagttagtttcgtttcgttgtttttggtttgagtagggtagagagtatcgtttagtagttagtgggttttcgcgcgtgtcgagattttgaggttttgtatttttacgatttcgtacgatggtcgttaagaagatcgcgattttcggcgttattggttagatcgggtttattattttggcgtaggcggtgtaagtaggtatgagtcggggcgggcggggtatgttacgggatagacgggtagaattttaggaaggggtattatggggtcgggtcgaggttgattggggttatgagcgttttagtta

SEQ ID NO: 31390 - DNA, 551 bp, Artificial Sequence
  chemically treated genomic DNA (Homo sapiens) CpG-island No: 31390
taactaaaacgctcataaccccaatcaacctcgacccgaccccataataccccttcctaaaattctacccgtctatcccgtaacataccccgcccgccccgactcatacctacttacaccgcctacgccaaaataataaacccgatctaaccaataacgccgaaaatcgcgatcttcttaacgaccatcgtacgaaatcgtaaaaatacaaaacctcaaaatctcgacacgcgcgaaaacccactaactactaaacgatactctctaccctactcaaaccaaaaacaacgaaacgaaactaactcgaaaaaccacgcctcaaactctccgcccgcgactcaaatcaaaaaacgaaacctaacgcgaataaacgaaacaaacgtcaacttacattcgctcaccgtccaacaccgccctctctacgcgccacttaaactaaaaaacgaaaccacaaaaaaccacgcctccacataacaacaaataaaataaacgaaaccgaaataacttatcactcaacgccctacctccgcgctccacctcccgaaaaaaaa

SEQ ID NO: 31391 - DNA, 551 bp, Artificial Sequence
  chemically treated genomic DNA (Homo sapiens) CpG-island No: 31391
tggttggggcgtttatggttttaattagtttcggttcgattttatggtgtttttttttaaagttttgttcgtttgtttcgtgatatgtttcgttcgtttcggtttatgtttgtttgtatcgtttgcgttagggtggtgagttcggtttggttagtggcgtcgaagatcgcgatttttttgacggttatcgtacgggatcgtgggggtgtaaggttttagagtttcggtacgcgcgggaatttattggttgttgggcggtgttttttgttttatttaagttaggaataacggggcggagttggttcgaagggttacgttttagatttttcgttcgcggtttaggttaaggggcggggtttaacgcggatgggcggggtaggcgttagtttgtattcgtttatcgtttagtatcgttttttttgcgcgttatttagattggaaggcggggttatagaaggttacgtttttatatagtaataaatagagtggacggagtcgagataatttgttatttagcgttttgttttcgcgttttatttttcggagagggg

SEQ ID NO: 31392 - DNA, 551 bp, Artificial Sequence
  chemically treated genomic DNA (Homo sapiens) CpG-island No: 31392
cccctctccgaaaaataaaacgcgaaaacaaaacgctaaataacaaattatctcgactccgtccactctatttattactatataaaaacgtaaccttctataaccccgccttccaatctaaataacgcgcaaaaaaaacgatactaaacgataaacgaatacaaactaacgcctaccccgcccatccgcgttaaaccccgccccttaacctaaaccgcgaacgaaaaatctaaaacgtaacccttcgaaccaactccgccccgttattcctaacttaaataaaacaaaaaacaccgcccaacaaccaataaattcccgcgcgtaccgaaactctaaaaccttacacccccacgatcccgtacgataaccgtcaaaaaaatcgcgatcttcgacgccactaaccaaaccgaactcaccaccctaacgcaaacgatacaaacaaacataaaccgaaacgaacgaaacatatcacgaaacaaacgaacaaaactttaaaaaaaaacaccataaaatcgaaccgaaactaattaaaaccataaacgccccaacca

SEQ ID NO: 31393 - DNA, 584 bp, Artificial Sequence
  chemically treated genomic DNA (Homo sapiens) CpG-island No: 31393
  misc_feature (552)..(553): n is either a, c, g or t
  misc_feature (566)..(567): n is either a, c, g or t
  misc_feature (579)..(579): n is either a, c, g or t
ttgtgtggtgtcgttgtcgacgttgatatgttgtgaattaaaaagttttagtaatagttcggcgatagtgacgtcgatatttatcgataattgtataattatcgatagtaggttgttgtcgttgttcgttagattgttcgggagattttttagcgttagggtgtttatggaggagaaacgcgtcgagttgattattttttgtaaaaataggacgaacggtaaaacgtagtattagtttagtagggcggtagttataaataatagggtgattagcgatagatttagcgtggtcgttattagtattcgacgataattaaagcgatttattatttgtattataattcgttttatttttatgttgttaagtattatcgggatatattagttcggtatgaaacggcgagaaatcgaggttaatttgtaggaaaatcggtgttataaagggtaatatgttattgttaatacgttcggtaaagtttttcgttaggtttagcgaaaaggtacgagtacggaatagttttagattgaatagggtacggttgttatttttgnngcgtgtagtaganntaaagtattagntgtta

SEQ ID NO: 31394 - DNA, 584 bp, Artificial Sequence
  chemically treated genomic DNA (Homo sapiens) CpG-island No: 31394
  misc_feature (6)..(6): n is either a, c, g or t
  misc_feature (18)..(19): n is either a, c, g or t
  misc_feature (32)..(33): n is either a, c, g or t
taacanctaatactttanntctactacacgcnncaaaaataacaaccgtaccctattcaatctaaaactattccgtactcgtaccttttcgctaaacctaacgaaaaactttaccgaacgtattaacaataacatattaccctttataacaccgattttcctacaaattaacctcgatttctcgccgtttcataccgaactaatatatcccgataatacttaacaacataaaaataaaacgaattataatacaaataataaatcgctttaattatcgtcgaatactaataacgaccacgctaaatctatcgctaatcaccctattatttataactaccgccctactaaactaatactacgttttaccgttcgtcctatttttacaaaaaataatcaactcgacgcgtttctcctccataaacaccctaacgctaaaaaatctcccgaacaatctaacgaacaacgacaacaacctactatcgataattatacaattatcgataaatatcgacgtcactatcgccgaactattactaaaactttttaattcacaacatatcaacgtcgacaacgacaccacacaa

SEQ ID NO: 31395 - DNA, 584 bp, Artificial Sequence
  chemically treated genomic DNA (Homo sapiens) CpG-island No: 31395
  misc_feature (6)..(6): n is either a, c, g or t
  misc_feature (18)..(19): n is either a, c, g or t
  misc_feature (32)..(33): n is either a, c, g or t
tggtanttggtgttttanntttgttgtacgtnntagaaataataatcgtgttttgtttagtttgaaattgtttcgtattcgtattttttcgttgggtttggcggggagttttgtcggacgtattggtagtggtatgttgttttttatgatatcggtttttttgtaaattggtttcggtttttcgtcgttttatgtcggattgatatatttcgatggtgtttggtagtatgggaatgaagcgaattgtggtataggtggtgaatcgttttggttatcgtcgggtattggtagcgattacgttgggtttgtcgttggttattttgttgtttatgattatcgttttgttgggttggtattacgttttgtcgttcgttttgtttttataagggatggttaattcgacgcgttttttttttatgaatattttgacgttgaaagatttttcggataatttggcgagtagcggtaatagtttgttgtcgatgattatgtaattgtcgatgagtatcggcgttattatcgtcgggttgttgttgggattttttggtttatagtatgttagcgtcgatagcggtattatataa

SEQ ID NO: 31396 - DNA, 584 bp, Artificial Sequence
  chemically treated genomic DNA (Homo sapiens) CpG-island No: 31396
  misc_feature (552)..(553): n is either a, c, g or t
  misc_feature (566)..(567): n is either a, c, g or t
  misc_feature (579)..(579): n is either a, c, g or t
ttatataataccgctatcgacgctaacatactataaaccaaaaaatcccaacaacaacccgacgataataacgccgatactcatcgacaattacataatcatcgacaacaaactattaccgctactcgccaaattatccgaaaaatctttcaacgtcaaaatattcataaaaaaaaaacgcgtcgaattaaccatcccttataaaaacaaaacgaacgacaaaacgtaataccaacccaacaaaacgataatcataaacaacaaaataaccaacgacaaacccaacgtaatcgctaccaatacccgacgataaccaaaacgattcaccacctataccacaattcgcttcattcccatactaccaaacaccatcgaaatatatcaatccgacataaaacgacgaaaaaccgaaaccaatttacaaaaaaaccgatatcataaaaaacaacataccactaccaatacgtccgacaaaactccccgccaaacccaacgaaaaaatacgaatacgaaacaatttcaaactaaacaaaacacgattattatttctannacgtacaacaaanntaaaacaccaantacca

SEQ ID NO: 31397 - DNA, 523 bp, Artificial Sequence
  chemically treated genomic DNA (Homo sapiens) CpG-island No: 31397
attcgtagtcggtacgtcggataggtcgaggatttttatcggaatggacggattcgtttttagtattttttgatttagttcgttacgtatcgtacgaatacgatcgtattcgaagttatatagaacgatatcgtttttgtgtagagtatttttacgtattagaacggtagtaatcggattacgatttttatcgaggaaggattcgataatcgtatcgttcgttatatttttacgtatcgtttttagttttagaattttcgtttgtagtaggatagcgtttagtagtttatcgatatcggtattcgttttcgtagattcgtgtacgaattggtttttatcgatttattttttcggtaggatgtcgtattgggagagtacgtatttaacgcgattcggattagtttttggtttatcgattttgtttattgaaagtaatatcggtatttgcgtcgtattcgggtgttggattgtttcgatggtttgcggtatatatcggcgataagagtataattagaatacgagt

SEQ ID NO: 31398 - DNA, 523 bp, Artificial Sequence
  chemically treated genomic DNA (Homo sapiens) CpG-island No: 31398
actcgtattctaattatactcttatcgccgatatataccgcaaaccatcgaaacaatccaacacccgaatacgacgcaaataccgatattactttcaataaacaaaatcgataaaccaaaaactaatccgaatcgcgttaaatacgtactctcccaatacgacatcctaccgaaaaaataaatcgataaaaaccaattcgtacacgaatctacgaaaacgaataccgatatcgataaactactaaacgctatcctactacaaacgaaaattctaaaactaaaaacgatacgtaaaaatataacgaacgatacgattatcgaatccttcctcgataaaaatcgtaatccgattactaccgttctaatacgtaaaaatactctacacaaaaacgatatcgttctatataacttcgaatacgatcgtattcgtacgatacgtaacgaactaaatcaaaaaatactaaaaacgaatccgtccattccgataaaaatcctcgacctatccgacgtaccgactacgaat

SEQ ID NO: 31399 - DNA, 523 bp, Artificial Sequence
  chemically treated genomic DNA (Homo sapiens) CpG-island No: 31399
attcgtattttggttgtgtttttgtcgtcggtgtatgtcgtagattatcgaagtaatttagtattcgaatgcggcgtaggtatcggtgttgtttttagtgaataagatcgatagattagaagttgattcggatcgcgttaagtacgtatttttttagtacggtattttgtcggaagagtgggtcggtgaaagttagttcgtatacggatttgcgaaagcgggtatcggtatcgatgaattgttggacgttattttgttgtaggcggaagttttggagttgaaagcggtacgtaaaggtatggcgagcggtgcggttatcgaattttttttcgataaaggtcgtggttcggttgttatcgttttggtacgtgaaggtattttgtataagggcgatatcgttttgtgtggtttcgaatacggtcgtgttcgtgcgatgcgtaacgaattgggttaggaagtgttggaagcgggttcgtttatttcggtggaaattttcggtttgttcggcgtatcggttgcgggt

SEQ ID NO: 31400 - DNA, 523 bp, Artificial Sequence
  chemically treated genomic DNA (Homo sapiens) CpG-island No: 31400
acccgcaaccgatacgccgaacaaaccgaaaatttccaccgaaataaacgaacccgcttccaacacttcctaacccaattcgttacgcatcgcacgaacacgaccgtattcgaaaccacacaaaacgatatcgcccttatacaaaataccttcacgtaccaaaacgataacaaccgaaccacgacctttatcgaaaaaaaattcgataaccgcaccgctcgccatacctttacgtaccgctttcaactccaaaacttccgcctacaacaaaataacgtccaacaattcatcgataccgatacccgctttcgcaaatccgtatacgaactaactttcaccgacccactcttccgacaaaataccgtactaaaaaaatacgtacttaacgcgatccgaatcaacttctaatctatcgatcttattcactaaaaacaacaccgatacctacgccgcattcgaatactaaattacttcgataatctacgacatacaccgacgacaaaaacacaaccaaaatacgaat

SEQ ID NO: 31401 - DNA, 508 bp, Artificial Sequence
  chemically treated genomic DNA (Homo sapiens) CpG-island No: 31401
atttatatcggtagttggatagagtagggtaattagatgttaatcgcgataatttcgattcgttcggtttggggaatacgttgggatgggtttgggcgtggtcgtttaatcgtcgcgtggtgtataatcgtgtttcggcggatattaacggtaaatcgtgggattcgaaacggatgttgatttagtggaacggtagtaagtggacgggtaacgatatttttgatttcggtaatgtcgtatcgggtacgttaatcgggtcgtttattatgtagtcggaagggatgggacgtttgtttgttattaataaaatggcggaaggttcgtgttagacgcgcgtttggttgtttatcgttagtatttcgagggagcgggtaaatttttgggttagtatttcggtttcgttgttggtatcggaggtatatagtatatcggtagaaagttaacggtttatcgttacgttttgttcgttttttttaataaagttagcgttacggttagtttttattag

SEQ ID NO: 31402 - DNA, 508 bp, Artificial Sequence
  chemically treated genomic DNA (Homo sapiens) CpG-island No: 31402
ctaataaaaactaaccgtaacgctaactttattaaaaaaaacgaacaaaacgtaacgataaaccgttaactttctaccgatatactatatacctccgataccaacaacgaaaccgaaatactaacccaaaaatttacccgctccctcgaaatactaacgataaacaaccaaacgcgcgtctaacacgaaccttccgccattttattaataacaaacaaacgtcccatcccttccgactacataataaacgacccgattaacgtacccgatacgacattaccgaaatcaaaaatatcgttacccgtccacttactaccgttccactaaatcaacatccgtttcgaatcccacgatttaccgttaatatccgccgaaacacgattatacaccacgcgacgattaaacgaccacgcccaaacccatcccaacgtattccccaaaccgaacgaatcgaaattatcgcgattaacatctaattaccctactctatccaactaccgatataaat

SEQ ID NO: 31403 - DNA, 508 bp, Artificial Sequence
  chemically treated genomic DNA (Homo sapiens) CpG-island No: 31403
ttgatgaaagttgatcgtgacgttaattttattgaaaagaacgagtagggcgtaacggtaaatcgttggttttttatcggtatgttgtgtgttttcggtgttagtaacgaaatcgggatgttgatttagaaatttgttcgttttttcgggatgttggcggtagataattaggcgcgcgtttgatacggatttttcgttattttgttgatggtaaataggcgttttatttttttcggttgtatgataaacggttcggttggcgtattcggtgcggtattgtcgaagttaggaatatcgttattcgtttatttgttgtcgttttattggattagtattcgtttcggattttacggtttatcgttgatattcgtcgaagtacggttgtatattacgcgacggttgagcggttacgtttaggtttattttagcgtattttttagatcggacgggtcggagttatcgcggttagtatttggttgttttgttttgtttagttatcggtgtagat

SEQ ID NO: 31404 - DNA, 508 bp, Artificial Sequence
  chemically treated genomic DNA (Homo sapiens) CpG-island No: 31404
atctacaccgataactaaacaaaacaaaacaaccaaatactaaccgcgataactccgacccgtccgatctaaaaaatacgctaaaataaacctaaacgtaaccgctcaaccgtcgcgtaatatacaaccgtacttcgacgaatatcaacgataaaccgtaaaatccgaaacgaatactaatccaataaaacgacaacaaataaacgaataacgatattcctaacttcgacaataccgcaccgaatacgccaaccgaaccgtttatcatacaaccgaaaaaaataaaacgcctatttaccatcaacaaaataacgaaaaatccgtatcaaacgcgcgcctaattatctaccgccaacatcccgaaaaaacgaacaaatttctaaatcaacatcccgatttcgttactaacaccgaaaacacacaacataccgataaaaaaccaacgatttaccgttacgccctactcgttcttttcaataaaattaacgtcacgatcaactttcatcaa

SEQ ID NO: 31405 - DNA, 985 bp, Artificial Sequence
  chemically treated genomic DNA (Homo sapiens) CpG-island No: 31405
gcgtcggtatcggtatttgtatttgcgtttgtatttgcgttagcgtcggtatcggtattagtatttgcgtcggtatttgcgtcggtttcggtatttgcgtcggtatcggtatttgtatttgcgtcggtatcggtatttgcgttagcgtcggcgtcggtatcggcgtcggtatcggcgtcggtttcggcgtcggtatcggcgttagcgtttgtatcggcgtcggtatcggtatttgtatcggtatttgcgattagcgtcggcgtttgtatcggcgttagcgttagtatttgtatcggtattagtatttgcgtcggtatttgcgtcggtatcggcgtcggtatcggtattcgcgtttgtatttgcgttagcgtttgtatttgcgtttgtatcggcgtcggtatttgcgttagcgttagcgtcggtatcggcgtcggtatttgcgtcggcgtttgtatttgcgtcggcgtcggcgtttgtatttgcgtttgtattagtattagtatttgtatttgtatttgcgtcggcgtttgtatttgcgtcggtatttgcgtttgtatttgcgtttgtatttgcgtttgtatttgcgttagcgtcggcgtcggcgtcggtatttgcgtcggtatttgcgtcggtatcggtatcggtatcggtatcggcgtttgtatttgcgttagcgtttgtatttgcgtttgtatttgcgtcggtatttgcgttagcgttagcgtcggtatttgcgttagcgtcggtatcggtattagcgtcggtatcggtattagtatttgcgtcggtatttgcgtcggtatttgcgtttgtattagtattagtatttgcgtcggcgtttgtatttgcgtcggcgtcggcgtttgtattagtattagcgtcggcgtttgtattagtatttgtattagcgtcggcgtcggcgtttgtattagcgtcggcgtttgtatttgtattatttttatagaaattattatttaaagttatg

SEQ ID NO: 31406 - DNA, 985 bp, Artificial Sequence
  chemically treated genomic DNA (Homo sapiens) CpG-island No: 31406
cataactttaaataataatttctataaaaataatacaaatacaaacgccgacgctaatacaaacgccgacgccgacgctaatacaaatactaatacaaacgccgacgctaatactaatacaaacgccgacgccgacgcaaatacaaacgccgacgcaaatactaatactaatacaaacgcaaataccgacgcaaataccgacgcaaatactaataccgataccgacgctaataccgataccgacgctaacgcaaataccgacgctaacgctaacgcaaataccgacgcaaatacaaacgcaaatacaaacgctaacgcaaatacaaacgccgataccgataccgataccgataccgacgcaaataccgacgcaaataccgacgccgacgccgacgctaacgcaaatacaaacgcaaatacaaacgcaaatacaaacgcaaataccgacgcaaatacaaacgccgacgcaaatacaaatacaaatactaatactaatacaaacgcaaatacaaacgccgacgccgacgcaaatacaaacgccgacgcaaataccgacgccgataccgacgctaacgctaacgcaaataccgacgccgatacaaacgcaaatacaaacgctaacgcaaatacaaacgcgaataccgataccgacgccgataccgacgcaaataccgacgcaaatactaataccgatacaaatactaacgctaacgccgatacaaacgccgacgctaatcgcaaataccgatacaaataccgataccgacgccgatacaaacgctaacgccgataccgacgccgaaaccgacgccgataccgacgccgataccgacgccgacgctaacgcaaataccgataccgacgcaaatacaaataccgataccgacgcaaataccgaaaccgacgcaaataccgacgcaaatactaataccgataccgacgctaacgcaaatacaaacgcaaatacaaataccgataccgacgc

SEQ ID NO: 31407 - DNA, 985 bp, Artificial Sequence
  chemically treated genomic DNA (Homo sapiens) CpG-island No: 31407
tatgattttagatagtggtttttataaagatgatatagatgtagacgtcgacgttgatgtagacgtcgacgtcgacgttgatgtagatgttgatgtagacgtcgacgttgatgttgatgtagacgtcgacgtcgacgtagatgtagacgtcgacgtagatgttgatgttgatgtagacgtagatgtcgacgtagatgtcgacgtagatgttgatgtcgatgtcgacgttgatgtcgatgtcgacgttgacgtagatgtcgacgttgacgttgacgtagatgtcgacgtagatgtagacgtagatgtagacgttgacgtagatgtagacgtcgatgtcgatgtcgatgtcgatgtcgacgtagatgtcgacgtagatgtcgacgtcgacgtcgacgttgacgtagatgtagacgtagatgtagacgtagatgtagacgtagatgtcgacgtagatgtagacgtcgacgtagatgtagatgtagatgttgatgttgatgtagacgtagatgtagacgtcgacgtcgacgtagatgtagacgtcgacgtagatgtcgacgtcgatgtcgacgttgacgttgacgtagatgtcgacgtcgatgtagacgtagatgtagacgttgacgtagatgtagacgcggatgtcgatgtcgacgtcgatgtcgacgtagatgtcgacgtagatgttgatgtcgatgtagatgttgacgttgacgtcgatgtagacgtcgacgttgatcgtagatgtcgatgtagatgtcgatgtcgacgtcgatgtagacgttgacgtcgatgtcgacgtcgaggtcgacgtcgatgtcgacgtcgatgtcgacgtcgacgttgacgtagatgtcgatgtcgacgtagatgtagatgtcgatgtcgacgtagatgtcgaggtcgacgtagatgtcgacgtagatgttgatgtcgatgtcgacgttgacgtagatgtagacgtagatgtagatgtcgatgtcgacgt

SEQ ID NO: 31408 - DNA, 985 bp, Artificial Sequence
  chemically treated genomic DNA (Homo sapiens) CpG-island No: 31408
acgtcgacatcgacatctacatctacgtctacatctacgtcaacgtcgacatcgacatcaacatctacgtcgacatctacgtcgacctcgacatctacgtcgacatcgacatctacatctacgtcgacatcgacatctacgtcaacgtcgacgtcgacatcgacgtcgacatcgacgtcgacctcgacgtcgacatcgacgtcaacgtctacatcgacgtcgacatcgacatctacatcgacatctacgatcaacgtcgacgtctacatcgacgtcaacgtcaacatctacatcgacatcaacatctacgtcgacatctacgtcgacatcgacgtcgacatcgacatccgcgtctacatctacgtcaacgtctacatctacgtctacatcgacgtcgacatctacgtcaacgtcaacgtcgacatcgacgtcgacatctacgtcgacgtctacatctacgtcgacgtcgacgtctacatctacgtctacatcaacatcaacatctacatctacatctacgtcgacgtctacatctacgtcgacatctacgtctacatctacgtctacatctacgtctacatctacgtcaacgtcgacgtcgacgtcgacatctacgtcgacatctacgtcgacatcgacatcgacatcgacatcgacgtctacatctacgtcaacgtctacatctacgtctacatctacgtcgacatctacgtcaacgtcaacgtcgacatctacgtcaacgtcgacatcgacatcaacgtcgacatcgacatcaacatctacgtcgacatctacgtcgacatctacgtctacatcaacatcaacatctacgtcgacgtctacatctacgtcgacgtcgacgtctacatcaacatcaacgtcgacgtctacatcaacatctacatcaacgtcgacgtcgacgtctacatcaacgtcgacgtctacatctatatcatctttataaaaaccactatctaaaatcata

SEQ ID NO: 31409 - DNA, 515 bp, Artificial Sequence
  chemically treated genomic DNA (Homo sapiens) CpG-island No: 31409
tttcgtggaatttaattttattaggggtgcggcgtattttagattcgatcggagtgggttttgtatatcgtcgttttatttcgcgggggttttgtttgtgttgggggtggtggcgggcgcgggttgcgcgttggtgttttgggtagggcggggaggtcgggcgaggattcgttaggtagcgtcgttttttgttttgggcgcggtgaggaaggacgttttttaacgggttatattttgttgtgtagatttaaaattcgtttttgaggtttcgcgtttaggagcggggttaggtggttttagggcggcggcggtttgtcggagattcgcgagtttcgtattcgacgtttttttttaacgcggttttttgttcgcgtcgcggaattttttcgtcgggtgttttatttatcggaggggtcgtgtcggttgaggttgttatcgggtgcgtggtatagttcgtgatagtttatgggtgaggttttgtgtaaatttggatgtagggaaagttgtttgttaga

SEQ ID NO: 31410 - DNA, 515 bp, Artificial Sequence
  chemically treated genomic DNA (Homo sapiens) CpG-island No: 31410
tctaacaaacaactttccctacatccaaatttacacaaaacctcacccataaactatcacgaactataccacgcacccgataacaacctcaaccgacacgacccctccgataaataaaacacccgacgaaaaaattccgcgacgcgaacaaaaaaccgcgttaaaaaaaaacgtcgaatacgaaactcgcgaatctccgacaaaccgccgccgccctaaaaccacctaaccccgctcctaaacgcgaaacctcaaaaacgaattttaaatctacacaacaaaatataacccgttaaaaaacgtccttcctcaccgcgcccaaaacaaaaaacgacgctacctaacgaatcctcgcccgacctccccgccctacccaaaacaccaacgcgcaacccgcgcccgccaccacccccaacacaaacaaaacccccgcgaaataaaacgacgatatacaaaacccactccgatcgaatctaaaatacgccgcacccctaataaaattaaattccacgaaa

SEQ ID NO: 31411 - DNA, 515 bp, Artificial Sequence
  chemically treated genomic DNA (Homo sapiens) CpG-island No: 31411
tttaataggtaattttttttgtatttaagtttgtataaaattttatttatgagttattacgagttatgttacgtattcggtgataattttaatcggtacgattttttcggtgggtaaaatattcgacgaaggggtttcgcggcgcgagtaggaggtcgcgttgggagagggcgtcgggtgcggagttcgcgagttttcggtaagtcgtcgtcgttttggggttatttgatttcgtttttgaacgcggggttttagaggcgagttttgggtttatatagtaaaatgtggttcgttagaaagcgtttttttttatcgcgtttagaataagaagcggcgttgtttggcgagttttcgttcggttttttcgttttgtttagagtattagcgcgtagttcgcgttcgttattatttttaatatagataaagttttcgcgagatggagcggcggtgtataaaatttatttcgatcggatttgggatgcgtcgtatttttagtagggttaagttttacgaga

SEQ ID NO: 31412 - DNA, 515 bp, Artificial Sequence
  chemically treated genomic DNA (Homo sapiens) CpG-island No: 31412
tctcgtaaaacttaaccctactaaaaatacgacgcatcccaaatccgatcgaaataaattttatacaccgccgctccatctcgcgaaaactttatctatattaaaaataataacgaacgcgaactacgcgctaatactctaaacaaaacgaaaaaaccgaacgaaaactcgccaaacaacgccgcttcttattctaaacgcgataaaaaaaaacgctttctaacgaaccacattttactatataaacccaaaactcgcctctaaaaccccgcgttcaaaaacgaaatcaaataaccccaaaacgacgacgacttaccgaaaactcgcgaactccgcacccgacgccctctcccaacgcgacctcctactcgcgccgcgaaaccccttcgtcgaatattttacccaccgaaaaaatcgtaccgattaaaattatcaccgaatacgtaacataactcgtaataactcataaataaaattttatacaaacttaaatacaaaaaaaattacctattaaa

SEQ ID NO: 31413 - DNA, 689 bp, Artificial Sequence
  chemically treated genomic DNA (Homo sapiens) CpG-island No: 31413
cgaaatggaatatcgggtagagtgaagaagtttggtaaggggcgaaagagttgtggttaatcggtaagagttagtttaacgtttgtgataagttatttagcgtttggcgtgcgttaggtaaataagattcgttggcgtatttagagcgtattcgtttggcgatgaaagcgggtaatataggtttggtaatagtgttggtagggtagatgtttgtcgattattagattatcgtttcggtaattattttattggcgaataattttaatacggtattgattttcgcgcgtataattggcgcgatcgattttattcgttaaatggcggcggtggcgtttgttagtgtggcgcggtaggatgttgagaatgtacggttgatgattttatcgtttgtttaggcgtagtagtttaatgaagattagatttaggagttgcgcgatatcgtcgtttggcgtttgatgggtaacgatgttatcgacgagtaggcgaaatggcgcgatgacgttattatgcgttcgtaatttatttcgtttattgaacgtcgtgtacgaatggcgtttggtatcggcgatcgtcgcggtttgaatatttggttggcgcgtttgtttatggaagcgaaagagaaagatgaatggcgttattggtaggcggatttattgttggaacgcggacgtgaagttgaagtaaaagag

SEQ ID NO: 31414 - DNA, 689 bp, Artificial Sequence
  chemically treated genomic DNA (Homo sapiens) CpG-island No: 31414
ctcttttacttcaacttcacgtccgcgttccaacaataaatccgcctaccaataacgccattcatctttctctttcgcttccataaacaaacgcgccaaccaaatattcaaaccgcgacgatcgccgataccaaacgccattcgtacacgacgttcaataaacgaaataaattacgaacgcataataacgtcatcgcgccatttcgcctactcgtcgataacatcgttacccatcaaacgccaaacgacgatatcgcgcaactcctaaatctaatcttcattaaactactacgcctaaacaaacgataaaatcatcaaccgtacattctcaacatcctaccgcgccacactaacaaacgccaccgccgccatttaacgaataaaatcgatcgcgccaattatacgcgcgaaaatcaataccgtattaaaattattcgccaataaaataattaccgaaacgataatctaataatcgacaaacatctaccctaccaacactattaccaaacctatattacccgctttcatcgccaaacgaatacgctctaaatacgccaacgaatcttatttacctaacgcacgccaaacgctaaataacttatcacaaacgttaaactaactcttaccgattaaccacaactctttcgccccttaccaaacttcttcactctacccgatattccatttcg

SEQ ID NO: 31415 - DNA, 689 bp, Artificial Sequence
  chemically treated genomic DNA (Homo sapiens) CpG-island No: 31415
tttttttgttttagttttacgttcgcgttttagtaataaattcgtttgttagtaacgttatttatttttttttttcgtttttataggtagacgcgttagttaggtatttaggtcgcgacgatcgtcggtgttaagcgttattcgtatacggcgtttaataagcgaagtagattgcgagcgtataatggcgttatcgcgttatttcgtttgttcgtcggtgatatcgttgtttattaaacgttaggcgacgatatcgcgtagtttttgaatttgatttttattaagttgttgcgtttgggtaagcgatgggattattagtcgtgtatttttagtattttgtcgcgttatattggtaaacgttatcgtcgttatttgacgggtaaaatcggtcgcgttagttgtacgcgcgaaggttagtatcgtattagggttgttcgttagtgaaatgattgtcgaggcgatagtttggtaatcggtaggtatttgttttgttagtattgttattaggtttgtgttattcgtttttatcgttagacggatacgttttaaatacgttagcggattttgtttatttgacgtacgttagacgttaaataatttgttataggcgttaggttggtttttgtcggttagttatagttttttcgttttttgttaggtttttttattttgttcggtgttttatttcg

SEQ ID NO: 31416 - DNA, 689 bp, Artificial Sequence
  chemically treated genomic DNA (Homo sapiens) CpG-island No: 31416
cgaaataaaacaccgaacaaaataaaaaaacctaacaaaaaacgaaaaaactataactaaccgacaaaaaccaacctaacgcctataacaaattatttaacgtctaacgtacgtcaaataaacaaaatccgctaacgtatttaaaacgtatccgtctaacgataaaaacgaataacacaaacctaataacaatactaacaaaacaaatacctaccgattaccaaactatcgcctcgacaatcatttcactaacgaacaaccctaatacgatactaaccttcgcgcgtacaactaacgcgaccgattttacccgtcaaataacgacgataacgtttaccaatataacgcgacaaaatactaaaaatacacgactaataatcccatcgcttacccaaacgcaacaacttaataaaaatcaaattcaaaaactacgcgatatcgtcgcctaacgtttaataaacaacgatatcaccgacgaacaaacgaaataacgcgataacgccattatacgctcgcaatctacttcgcttattaaacgccgtatacgaataacgcttaacaccgacgatcgtcgcgacctaaatacctaactaacgcgtctacctataaaaacgaaaaaaaaaaataaataacgttactaacaaacgaatttattactaaaacgcgaacgtaaaactaaaacaaaaaaa

SEQ ID NO: 31417 - DNA, 553 bp, Artificial Sequence
  chemically treated genomic DNA (Homo sapiens) CpG-island No: 31417
cgcgtcgtcgttatatagtaatcgttcgcgaatttgaaaatagcggcgcgtatgggcgtttattcgtagttagtcgttaacgttgattagtatagttatcgacgcgggataatttagcgttagttgtatttttattagcgtatcgagcgtatggtcgattattgcgtaatgtttaatttttgcggttattagcgtttgatgtagtttcgttgttatttgggcgatattgtaattttttgttagcgtgtcgggattattgtcggtgtcgcgttggtcgtaatagattatttgatatttttgttttagtatcgttagttgcggtaattagtaattgtcgttatttttaagattcgaaattaatattattacgggcgtattagtataagggggaggtgagagtgaaagttttatcgcggttttatttggcgatatgcgtaattgtggcgatttttattagcgcgttaggttttattagttcgtattgaatgtagaatcgcgtcggtttattattcggaaaaaattcggcgtagatttcgttaatcgcggcgtaatt

SEQ ID NO: 31418 - DNA, 553 bp, Artificial Sequence
  chemically treated genomic DNA (Homo sapiens) CpG-island No: 31418
aattacgccgcgattaacgaaatctacgccgaattttttccgaataataaaccgacgcgattctacattcaatacgaactaataaaacctaacgcgctaataaaaatcgccacaattacgcatatcgccaaataaaaccgcgataaaactttcactctcacctcccccttatactaatacgcccgtaataatattaatttcgaatcttaaaaataacgacaattactaattaccgcaactaacgatactaaaacaaaaatatcaaataatctattacgaccaacgcgacaccgacaataatcccgacacgctaacaaaaaattacaatatcgcccaaataacaacgaaactacatcaaacgctaataaccgcaaaaattaaacattacgcaataatcgaccatacgctcgatacgctaataaaaatacaactaacgctaaattatcccgcgtcgataactatactaatcaacgttaacgactaactacgaataaacgcccatacgcgccgctattttcaaattcgcgaacgattactatataacgacgacgcg

SEQ ID NO: 31419 - DNA, 553 bp, Artificial Sequence
  chemically treated genomic DNA (Homo sapiens) CpG-island No: 31419
aattacgtcgcgattaacgaaatttacgtcgagtttttttcgggtgataaatcggcgcgattttgtatttagtgcggattggtaaaatttgacgcgttggtggaaatcgttataattgcgtatatcgttaagtgaggtcgcgatgaaatttttatttttattttttttttatgttgatgcgttcgtagtggtgttgatttcgggttttgggggtagcggtagttattggttatcgtaattggcggtgttggagtaggagtattaggtagtttgttacgattagcgcggtatcggtaataatttcgatacgttggtagaagattatagtatcgtttagatggtagcggaattgtattaggcgttggtagtcgtagggattgagtattacgtagtggtcggttatgcgttcggtgcgttggtgggaatgtagttggcgttggattatttcgcgtcggtaattgtgttgattagcgttaacggttggttacgaataaacgtttatacgcgtcgttgtttttaggttcgcgaacgattattgtatagcggcggcgcg

SEQ ID NO: 31420 - DNA, 553 bp, Artificial Sequence
  chemically treated genomic DNA (Homo sapiens) CpG-island No: 31420
cgcgccgccgctatacaataatcgttcgcgaacctaaaaacaacgacgcgtataaacgtttattcgtaaccaaccgttaacgctaatcaacacaattaccgacgcgaaataatccaacgccaactacattcccaccaacgcaccgaacgcataaccgaccactacgtaatactcaatccctacgactaccaacgcctaatacaattccgctaccatctaaacgatactataatcttctaccaacgtatcgaaattattaccgataccgcgctaatcgtaacaaactacctaatactcctactccaacaccgccaattacgataaccaataactaccgctacccccaaaacccgaaatcaacaccactacgaacgcatcaacataaaaaaaaaataaaaataaaaatttcatcgcgacctcacttaacgatatacgcaattataacgatttccaccaacgcgtcaaattttaccaatccgcactaaatacaaaatcgcgccgatttatcacccgaaaaaaactcgacgtaaatttcgttaatcgcgacgtaatt

SEQ ID NO: 31421 - DNA, 783 bp, Artificial Sequence
  chemically treated genomic DNA (Homo sapiens) CpG-island No: 31421
tttcgagaggtttaagggggttgaggattcggttttcgggagatcgtttattaggcggtggatacggggtagtttcgagaggaaggagatagtggattgttggaggaatgttcgcgagaatatcgaggttgatggaaatagaagatatttacgggtataggattaagagttaaagggaagaagagagggacggggtcgagtagtttggggggttcggcgtgggaggtcggagtagaggtcgttaagcgtcgttcgtagttagtcgtttttttcggagacgtattttcggatttcgtatatttagtttttcgtcgtttttgtttcggtaataatcgcgggcgtagttgttttcgtcgggttagggatagcgggggtaaaggtaattttggggttggcgggtagtagattggtagcgttcgtgtgtgtgtgcggggagtcgattttgagatcgttaacgttagattttgtttttttttttttaatttttttttattatttaatttttcggtcggttggtgttcgtttcgatcgacggatatcgtattttttataacgtttttcgtcgttttttatttttttttcgacgttttgagttgagggaaaataggttattcggatcgatttcgaattcgttcgggtgttttcgaatcgcggacgttattttcgttcgaacgttggtattttttcggcggttttttggttcgtttagatgtagtaaattttttttatttgtattgacgttatgatggaattatttttttaagatcggcgaggttagagacg

SEQ ID NO: 31422 - DNA, 783 bp, Artificial Sequence
  chemically treated genomic DNA (Homo sapiens) CpG-island No: 31422
cgtctctaacctcgccgatcttaaaaaaataattccatcataacgtcaatacaaataaaaaaaatttactacatctaaacgaaccaaaaaaccgccgaaaaaataccaacgttcgaacgaaaataacgtccgcgattcgaaaacacccgaacgaattcgaaatcgatccgaataacctattttccctcaactcaaaacgtcgaaaaaaaaataaaaaacgacgaaaaacgttataaaaaatacgatatccgtcgatcgaaacgaacaccaaccgaccgaaaaattaaataataaaaaaaaattaaaaaaaaaaaaacaaaatctaacgttaacgatctcaaaatcgactccccgcacacacacacgaacgctaccaatctactacccgccaaccccaaaattacctttacccccgctatccctaacccgacgaaaacaactacgcccgcgattattaccgaaacaaaaacgacgaaaaactaaatatacgaaatccgaaaatacgtctccgaaaaaaacgactaactacgaacgacgcttaacgacctctactccgacctcccacgccgaaccccccaaactactcgaccccgtccctctcttcttccctttaactcttaatcctatacccgtaaatatcttctatttccatcaacctcgatattctcgcgaacattcctccaacaatccactatctccttcctctcgaaactaccccgtatccaccgcctaataaacgatctcccgaaaaccgaatcctcaacccccttaaacctctcgaaa

SEQ ID NO: 31423 - DNA, 783 bp, Artificial Sequence
  chemically treated genomic DNA (Homo sapiens) CpG-island No: 31423
cgtttttggtttcgtcggttttggggggatggttttattatggcgttaatgtaggtgagaggagtttgttgtatttgggcgggttagggagtcgtcgagagagtgttagcgttcgggcgggggtggcgttcgcgattcggggatattcgggcgggttcgggatcggttcgggtggtttgtttttttttagtttagggcgtcgggggaggggtaagaggcggcgagaggcgttgtggggggtgcggtattcgtcggtcgaagcggatattagtcggtcgggaagttgggtgataaaggagggttggggaagaaagggtaaagtttggcgttggcggttttagaatcggtttttcgtatatatatacgggcgttgttagtttgttgttcgttagttttagggttgtttttattttcgttgtttttggttcgacggaaatagttgcgttcgcggttgttgtcggggtaggggcggcggggggttgagtgtgcgggattcgagaatgcgttttcggagaaggcggttggttgcggacggcgtttagcggtttttgtttcggttttttacgtcgggttttttagattgttcggtttcgtttttttttttttttttttgatttttaattttgtgttcgtgggtattttttatttttattagtttcggtattttcgcggatatttttttagtagtttattgttttttttttttcgaagttgtttcgtgtttatcgtttgatgggcgatttttcgagagtcgagtttttagtttttttaaatttttcggga

SEQ ID NO: 31424 - DNA, 783 bp, Artificial Sequence
  chemically treated genomic DNA (Homo sapiens) CpG-island No: 31424
tcccgaaaaatttaaaaaaactaaaaactcgactctcgaaaaatcgcccatcaaacgataaacacgaaacaacttcgaaaaaaaaaaaacaataaactactaaaaaaatatccgcgaaaataccgaaactaataaaaataaaaaatacccacgaacacaaaattaaaaatcaaaaaaaaaaaaaaaaaaacgaaaccgaacaatctaaaaaacccgacgtaaaaaaccgaaacaaaaaccgctaaacgccgtccgcaaccaaccgccttctccgaaaacgcattctcgaatcccgcacactcaaccccccgccgcccctaccccgacaacaaccgcgaacgcaactatttccgtcgaaccaaaaacaacgaaaataaaaacaaccctaaaactaacgaacaacaaactaacaacgcccgtatatatatacgaaaaaccgattctaaaaccgccaacgccaaactttaccctttcttccccaaccctcctttatcacccaacttcccgaccgactaatatccgcttcgaccgacgaataccgcaccccccacaacgcctctcgccgcctcttacccctcccccgacgccctaaactaaaaaaaaacaaaccacccgaaccgatcccgaacccgcccgaatatccccgaatcgcgaacgccacccccgcccgaacgctaacactctctcgacgactccctaacccgcccaaatacaacaaactcctctcacctacattaacgccataataaaaccatccccccaaaaccgacgaaaccaaaaacg

SEQ ID NO: 31425 - DNA, 646 bp, Artificial Sequence
  chemically treated genomic DNA (Homo sapiens) CpG-island No: 31425
ggagaggtcgcgaagagtcgttggggttttttaggttcgatacgacgttcgtttttttcgttttatttgggatattagatttcggacgttttatttgcgttcgattcggacgtcggagaaggcgcgcggttttcgaaggtttcgtattttagtcggttatcggtttcgaaggttcgttgttggaggacgttcgggagatagaggttcggggatttcggagcgcggcggtcgtatataatgtagtttttttttcgtagagaggtagttcgatcgtttacgggttgtttaacgttagaaatagtattacgcgggtgacgagcggttgcggacgttttagttgtacgagtttacgattgcgagatacggttttttattcgattgtcgtataagtggcgtatgtttagttcgggacgtttgattggtagttgggttgtttgcgcgtgcgtagaatttgtcgttcgtttgtcgttcgtttgtcgttcgtttgtcgttcgtttgtcgttcgtttgtcgttcgtttgtcgttcgtttgtcgttttttcggtcgcgcgcgttattcgttagttgagttgggagttcgtcgttttgtttttggtttagcggttttttttttttagaattttattttttttataatagtgtggagg

SEQ ID NO: 31426 - DNA, 646 bp, Artificial Sequence
  chemically treated genomic DNA (Homo sapiens) CpG-island No: 31426
cctccacactattataaaaaaaataaaattctaaaaaaaaaaaaccgctaaaccaaaaacaaaacgacgaactcccaactcaactaacgaataacgcgcgcgaccgaaaaaacgacaaacgaacgacaaacgaacgacaaacgaacgacaaacgaacgacaaacgaacgacaaacgaacgacaaacgaacgacaaattctacgcacgcgcaaacaacccaactaccaatcaaacgtcccgaactaaacatacgccacttatacgacaatcgaataaaaaaccgtatctcgcaatcgtaaactcgtacaactaaaacgtccgcaaccgctcgtcacccgcgtaatactatttctaacgttaaacaacccgtaaacgatcgaactacctctctacgaaaaaaaaactacattatatacgaccgccgcgctccgaaatccccgaacctctatctcccgaacgtcctccaacaacgaaccttcgaaaccgataaccgactaaaatacgaaaccttcgaaaaccgcgcgccttctccgacgtccgaatcgaacgcaaataaaacgtccgaaatctaatatcccaaataaaacgaaaaaaacgaacgtcgtatcgaacctaaaaaaccccaacgactcttcgcgacctctcc

SEQ ID NO: 31427 - DNA, 646 bp, Artificial Sequence
  chemically treated genomic DNA (Homo sapiens) CpG-island No: 31427
tttttatattgttataaagaaggtaaaattttaggaaggaggagtcgttgagttaaggatagagcggcgggtttttagtttagttggcggataacgcgcgcggtcgggaaggcggtaggcgggcggtaggcgggcggtaggcgggcggtaggcgggcggtaggcgggcggtaggcgggcggtaggcgggcggtagattttgcgtacgcgtaggtagtttagttgttagttaggcgtttcgggttgggtatgcgttatttgtgcggtagtcgggtgggaagtcgtgtttcgtagtcgtggattcgtgtagttggggcgttcgtagtcgttcgttattcgcgtgatgttgtttttggcgttgggtagttcgtgggcggtcgaattgtttttttgcggaaggaggattgtattgtgtgcggtcgtcgcgtttcgaggttttcgggtttttgtttttcgggcgttttttagtagcgggttttcggggtcggtagtcggttggagtacggggttttcgggagtcgcgcgtttttttcggcgttcgggtcgagcgtaggtagggcgttcgaggtttggtgttttaagtgaggcggggagggcgggcgtcgtgtcgggtttggggagttttagcggtttttcgcgattttttt

SEQ ID NO: 31428 - DNA, 646 bp, Artificial Sequence
  chemically treated genomic DNA (Homo sapiens) CpG-island No: 31428
aaaaaaatcgcgaaaaaccgctaaaactccccaaacccgacacgacgcccgccctccccgcctcacttaaaacaccaaacctcgaacgccctacctacgctcgacccgaacgccgaaaaaaacgcgcgactcccgaaaaccccgtactccaaccgactaccgaccccgaaaacccgctactaaaaaacgcccgaaaaacaaaaacccgaaaacctcgaaacgcgacgaccgcacacaatacaatcctccttccgcaaaaaaacaattcgaccgcccacgaactacccaacgccaaaaacaacatcacgcgaataacgaacgactacgaacgccccaactacacgaatccacgactacgaaacacgacttcccacccgactaccgcacaaataacgcatacccaacccgaaacgcctaactaacaactaaactacctacgcgtacgcaaaatctaccgcccgcctaccgcccgcctaccgcccgcctaccgcccgcctaccgcccgcctaccgcccgcctaccgcccgcctaccgccttcccgaccgcgcgcgttatccgccaactaaactaaaaacccgccgctctatccttaactcaacgactcctccttcctaaaattttaccttctttataacaatataaaaa

SEQ ID NO: 31429 - DNA, 937 bp, Artificial Sequence
  chemically treated genomic DNA (Homo sapiens) CpG-island No: 31429
cgcgcgcgcgtttagtttttatttttttttagcgggatttcggggatttttttttttattggtttgaaacgttttttcggcgatttgggatcgtttttttttggtttgcggttgtcggcggatttcgattttcgagggcggcggcgttcggtatttattagtcggcgtgcggttcgtcgattattagtagtattttggtttttttggcggttgcgggcgcgggagcgggcgcgtttattaggttagtcgaggcggtcgtttgttttacggtttgggatagcgagttgaagaagttgttgtttatcgacggcgtcggcgcgggttgcggcgcgggttgcggcgcgggcgtcgaggcgggcggcggttttcgtttcgggttcggcgaggcggtcgggggcgtcgtcgaggtcgaggcggcgttcggatcggggggcggcggcggcggcggttgttggggttcgggtcgttgtaggtcggttatgtagtcgttgggtaggttggcgatgaagttgttgttcgatagtcggcgtcgtaggaagtttattatttggtttaaagggttgggggcgcgcggggttacggggtttggtggcgcggagggagagcgagggcggaaggcgagattgaggcgattgaggcggttgaggcggcggtttagttagtagagatttagatttcggcgttagatttcgtagatagtagcggcggattgggttaggtaagtcgcgcggcgcgaggttcgcggagagggagcgggcggggtaggggcggggttagagatagttttcgtttcgcgtcgtagaggcggtttcgttttcgtttacggagggtatttagtcgcgcgtttggcgattttcggggtttgtaggagggggcgatttaggtttttagtaatttgagcgtgattatgcggggagggcgtgggagttaggttttt

SEQ ID NO: 31430 - DNA, 937 bp, Artificial Sequence
  chemically treated genomic DNA (Homo sapiens) CpG-island No: 31430
aaaaacctaactcccacgccctccccgcataatcacgctcaaattactaaaaacctaaatcgccccctcctacaaaccccgaaaatcgccaaacgcgcgactaaataccctccgtaaacgaaaacgaaaccgcctctacgacgcgaaacgaaaactatctctaaccccgcccctaccccgcccgctccctctccgcgaacctcgcgccgcgcgacttacctaacccaatccgccgctactatctacgaaatctaacgccgaaatctaaatctctactaactaaaccgccgcctcaaccgcctcaatcgcctcaatctcgccttccgccctcgctctccctccgcgccaccaaaccccgtaaccccgcgcgcccccaaccctttaaaccaaataataaacttcctacgacgccgactatcgaacaacaacttcatcgccaacctacccaacgactacataaccgacctacaacgacccgaaccccaacaaccgccgccgccgccgccccccgatccgaacgccgcctcgacctcgacgacgcccccgaccgcctcgccgaacccgaaacgaaaaccgccgcccgcctcgacgcccgcgccgcaacccgcgccgcaacccgcgccgacgccgtcgataaacaacaacttcttcaactcgctatcccaaaccgtaaaacaaacgaccgcctcgactaacctaataaacgcgcccgctcccgcgcccgcaaccgccaaaaaaaccaaaatactactaataatcgacgaaccgcacgccgactaataaataccgaacgccgccgccctcgaaaatcgaaatccgccgacaaccgcaaaccaaaaaaaaacgatcccaaatcgccgaaaaaacgtttcaaaccaataaaaaaaaaaatccccgaaatcccgctaaaaaaaaataaaaactaaacgcgcgcgcg

SEQ ID NO: 31431 - DNA, 937 bp, Artificial Sequence
  chemically treated genomic DNA (Homo sapiens) CpG-island No: 31431
gaaggtttggtttttacgtttttttcgtatagttacgtttaggttgttggaggtttgggtcgtttttttttgtaagtttcgagagtcgttagacgcgcggttaggtgtttttcgtgagcgggggcggggtcgtttttgcggcgcggggcgggggttatttttggtttcgtttttgtttcgttcgtttttttttcgcgagtttcgcgtcgcgcggtttgtttggtttagttcgtcgttgttgtttgcggggtttggcgtcggggtttgagtttttgttggttaagtcgtcgttttagtcgttttagtcgttttaatttcgtttttcgttttcgtttttttttcgcgttattagatttcgtagtttcgcgcgtttttagttttttaagttagatgatgaattttttgcggcgtcggttgtcggatagtagttttatcgttaatttgtttaacggttatatgatcgatttgtagcggttcgagttttagtagtcgtcgtcgtcgtcgtttttcggttcgggcgtcgtttcggtttcggcggcgttttcgatcgtttcgtcgggttcggagcggaggtcgtcgttcgtttcggcgttcgcgtcgtagttcgcgtcgtagttcgcgtcgacgtcgtcggtgggtagtagtttttttagttcgttgttttaagtcgtgaagtagacggtcgtttcggttggtttggtggacgcgttcgttttcgcgttcgtagtcgttaggaaggttaaggtgttgttggtggtcgacgagtcgtacgtcgattggtaggtgtcgggcgtcgtcgttttcgggggtcggggttcgtcggtagtcgtaggttaggagaggacggttttaggtcgtcgaggaaacgttttagattaatgaaaaggagggttttcgaggtttcgttgggaggaggtgggggttgagcgcgcgcgcg

SEQ ID NO: 31432 - DNA, 937 bp, Artificial Sequence
  chemically treated genomic DNA (Homo sapiens) CpG-island No: 31432
cgcgcgcgcgctcaacccccacctcctcccaacgaaacctcgaaaaccctccttttcattaatctaaaacgtttcctcgacgacctaaaaccgtcctctcctaacctacgactaccgacgaaccccgacccccgaaaacgacgacgcccgacacctaccaatcgacgtacgactcgtcgaccaccaacaacaccttaaccttcctaacgactacgaacgcgaaaacgaacgcgtccaccaaaccaaccgaaacgaccgtctacttcacgacttaaaacaacgaactaaaaaaactactacccaccgacgacgtcgacgcgaactacgacgcgaactacgacgcgaacgccgaaacgaacgacgacctccgctccgaacccgacgaaacgatcgaaaacgccgccgaaaccgaaacgacgcccgaaccgaaaaacgacgacgacgacgactactaaaactcgaaccgctacaaatcgatcatataaccgttaaacaaattaacgataaaactactatccgacaaccgacgccgcaaaaaattcatcatctaacttaaaaaactaaaaacgcgcgaaactacgaaatctaataacgcgaaaaaaaaacgaaaacgaaaaacgaaattaaaacgactaaaacgactaaaacgacgacttaaccaacaaaaactcaaaccccgacgccaaaccccgcaaacaacaacgacgaactaaaccaaacaaaccgcgcgacgcgaaactcgcgaaaaaaaaacgaacgaaacaaaaacgaaaccaaaaataacccccgccccgcgccgcaaaaacgaccccgcccccgctcacgaaaaacacctaaccgcgcgtctaacgactctcgaaacttacaaaaaaaaacgacccaaacctccaacaacctaaacgtaactatacgaaaaaaacgtaaaaaccaaaccttc

SEQ ID NO: 31433 - DNA, 513 bp, Artificial Sequence
  chemically treated genomic DNA (Homo sapiens) CpG-island No: 31433
aggcgggtgcggcggggttcgcgttggcgcggggtttttttttttttaggcgcgttgggttcgttttcggtttcgcgacgtttcgggttcgttttttttgtggtttcgcggtttcggtttgttttcggcgtttatttattcgggtttttttttttttcgtttttttttttttattggtatttttacgcgcgttttcgtcgtttttttttattttagattttgcgttcgttagtgatttttggttcgttggttcgttttttttcgtgtcggcgttgttttttttttttaattttggtttttattattttttttttttcgcggtcgttttttttttttattttttgttttcgtttttagttttatatttttttatttttcgggtttcgtttcgtttcgtttcgatatttagtttttttggtttttggttttgaagttggtgtttttatcgttttttattatttcgttttttatttgcgcggttagattttttaatttagatattgcgttgttttt

SEQ ID NO: 31434 - DNA, 513 bp, Artificial Sequence
  chemically treated genomic DNA (Homo sapiens) CpG-island No: 31434
aaaaacaacgcaatatctaaattaaaaaatctaaccgcgcaaataaaaaacgaaataataaaaaacgataaaaacaccaacttcaaaaccaaaaaccaaaaaaactaaatatcgaaacgaaacgaaacgaaacccgaaaaataaaaaaatataaaactaaaaacgaaaacaaaaaataaaaaaaaaaaacgaccgcgaaaaaaaaaaaataataaaaaccaaaattaaaaaaaaaaaacaacgccgacacgaaaaaaaacgaaccaacgaaccaaaaatcactaacgaacgcaaaatctaaaataaaaaaaaacgacgaaaacgcgcgtaaaaataccaataaaaaaaaaaaaacgaaaaaaaaaaaaacccgaataaataaacgccgaaaacaaaccgaaaccgcgaaaccacaaaaaaaacgaacccgaaacgtcgcgaaaccgaaaacgaacccaacgcgcctaaaaaaaaaaaaaccccgcgccaacgcgaaccccgccgcacccgcct

SEQ ID NO: 31435 - DNA, 513 bp, Artificial Sequence
  chemically treated genomic DNA (Homo sapiens) CpG-island No: 31435
aaggataacgtagtatttaagttggaagatttggtcgcgtaggtggaaggcgaagtgatggggagcgataaagatattaattttaaaattagggattaggagggttgggtgtcgaggcgaggcgaggcgaagttcgggggataagggggtgtggagttggggacgggaataggggatgaggagaaaaagcggtcgcgaagaggaaggagtggtgggagttaggattggggaggggggataacgtcgatacgggaagggacgagttaacgagttaggagttattggcgggcgtaggatttggggtgggagggggcggcgagagcgcgcgtggaggtgttaatggaaggaagggggcggaagaaaggaagattcgaatgaatgagcgtcgggggtaggtcggggtcgcggggttatagaggaagcgggttcggggcgtcgcggggtcgggggcgggtttagcgcgtttggaaaggaggaagtttcgcgttagcgcgggtttcgtcgtattcgttt

SEQ ID NO: 31436 - DNA, 513 bp, Artificial Sequence
  chemically treated genomic DNA (Homo sapiens) CpG-island No: 31436
aaacgaatacgacgaaacccgcgctaacgcgaaacttcctcctttccaaacgcgctaaacccgcccccgaccccgcgacgccccgaacccgcttcctctataaccccgcgaccccgacctacccccgacgctcattcattcgaatcttcctttcttccgcccccttccttccattaacacctccacgcgcgctctcgccgccccctcccaccccaaatcctacgcccgccaataactcctaactcgttaactcgtcccttcccgtatcgacgttatcccccctccccaatcctaactcccaccactccttcctcttcgcgaccgctttttctcctcatcccctattcccgtccccaactccacacccccttatcccccgaacttcgcctcgcctcgcctcgacacccaaccctcctaatccctaattttaaaattaatatctttatcgctccccatcacttcgccttccacctacgcgaccaaatcttccaacttaaatactacgttatcctt

SEQ ID NO: 31437 - DNA, 984 bp, Artificial Sequence
  chemically treated genomic DNA (Homo sapiens) CpG-island No: 31437
ttcgcgggtgttgcggatagggttttatattttcggttcgtttttcgagaacgaggaaatttgttaagtcgtcgggatttatatttcgtagttttttcgcgtttttgtttagtttagttttagcgcgttcgatcgttttttatttgttttagtttttgggttgtattcggttattttattttttttcggcgatttcgcggtttcgttatttttttttcgcgatttgggttcgggtcgttttcgggtaggagcgttcgatcgtcgtttttcgtttagtttcgatttagttagttttttcgcggttcggtttttttcgtttttaggttcgagtttttatcgcgcgttttttagttttagtttttgttttcgtttcgtttggtagtttttggtttatatttttacgtcggttatttggagttaagcgtagcggagcgttttatttacggttttaggtcgtagagggttcggtgttcggcgtttcgtttttttttagttttacgtggtaggcgtagatggagagtaggatttcggcggtagcgtatattgcgtattaggttatttttttttatcgcggtatcgatatttagtaggacgtgcgtcgtcgtttgttttttttcgttttcgttttagtcgtcgtcgttgtcgttttattggtttcgtcgtttgtttcgggtttcgtttcgataggcgcgcggttttatcgtttcgataggagtgaggcgggcggggcggggaaggcgcgcgtaggcgtcgaaggagtggatagagagcgtaattattttggaggttcgatcggtcggcggaaattgaggtagcgcgttacggcgttcgcgaggtttggggttcggggagagaggggcggggtcgggagggacggggttaggcgggttagcgcggggagggatttcggggagcggagtaaggatgttattgtgggtgattgggcgaggtttcggtttttttttttggacgtggtattttatt

SEQ ID NO: 31438 - DNA, 984 bp, Artificial Sequence
  chemically treated genomic DNA (Homo sapiens) CpG-island No: 31438
aataaaataccacgtccaaaaaaaaaaaccgaaacctcgcccaatcacccacaataacatccttactccgctccccgaaatccctccccgcgctaacccgcctaaccccgtccctcccgaccccgcccctctctccccgaaccccaaacctcgcgaacgccgtaacgcgctacctcaatttccgccgaccgatcgaacctccaaaataattacgctctctatccactccttcgacgcctacgcgcgccttccccgccccgcccgcctcactcctatcgaaacgataaaaccgcgcgcctatcgaaacgaaacccgaaacaaacgacgaaaccaataaaacgacaacgacgacgactaaaacgaaaacgaaaaaaaacaaacgacgacgcacgtcctactaaatatcgataccgcgataaaaaaaaataacctaatacgcaatatacgctaccgccgaaatcctactctccatctacgcctaccacgtaaaactaaaaaaaaacgaaacgccgaacaccgaaccctctacgacctaaaaccgtaaataaaacgctccgctacgcttaactccaaataaccgacgtaaaaatataaaccaaaaactaccaaacgaaacgaaaacaaaaactaaaactaaaaaacgcgcgataaaaactcgaacctaaaaacgaaaaaaaccgaaccgcgaaaaaactaactaaatcgaaactaaacgaaaaacgacgatcgaacgctcctacccgaaaacgacccgaacccaaatcgcgaaaaaaaaataacgaaaccgcgaaatcgccgaaaaaaaataaaataaccgaatacaacccaaaaactaaaacaaataaaaaacgatcgaacgcgctaaaactaaactaaacaaaaacgcgaaaaaactacgaaatataaatcccgacgacttaacaaatttcctcgttctcgaaaaacgaaccgaaaatataaaaccctatccgcaacacccgcgaa

SEQ ID NO: 31439 - DNA, 984 bp, Artificial Sequence
  chemically treated genomic DNA (Homo sapiens) CpG-island No: 31439
aatagagtgttacgtttagagggaggggtcgaggtttcgtttagttatttatagtggtatttttgtttcgtttttcggagttttttttcgcgttggttcgtttggtttcgtttttttcggtttcgttttttttttttcgggttttaagtttcgcgggcgtcgtggcgcgttgttttagttttcgtcggtcgatcgggtttttagggtagttgcgttttttgtttattttttcggcgtttgcgcgcgtttttttcgtttcgttcgttttatttttgtcggggcggtggggtcgcgcgtttgtcggggcggggttcggagtaggcgacggagttaatggggcggtagcggcggcggttgaggcggaggcggagggaggtagacggcggcgtacgttttgttgagtgtcggtgtcgcggtgggagaaggtgatttgatacgtagtgtgcgttgtcgtcgggattttgttttttatttacgtttattacgtggagttggagaagggcgggacgtcgagtatcgggttttttgcgatttgggatcgtgggtgaagcgtttcgttgcgtttggttttagatagtcggcgtgggggtgtgggttaggagttgttaagcggggcgagggtagaggttggggttggggagcgcgcggtgggagttcgggtttggaggcggaggggatcgggtcgcgggggaattgattgggtcggggttgggcgggaggcggcggtcgggcgtttttgttcgggggcgattcgagtttaggtcgcggggaggaggtggcggggtcgcgaggtcgtcggggaagaatgaggtggtcgagtgtagtttagaggttggggtagatggggagcggtcgggcgcgttggggttgggttgggtaggagcgcgagggggttgcggagtgtgggtttcggcggtttgataggttttttcgttttcgggaggcgggtcgggggtgtgggattttgttcgtagtattcgcgag

SEQ ID NO: 31440 - DNA, 984 bp, Artificial Sequence
  chemically treated genomic DNA (Homo sapiens) CpG-island No: 31440
ctcgcgaatactacgaacaaaatcccacacccccgacccgcctcccgaaaacgaaaaaacctatcaaaccgccgaaacccacactccgcaaccccctcgcgctcctacccaacccaaccccaacgcgcccgaccgctccccatctaccccaacctctaaactacactcgaccacctcattcttccccgacgacctcgcgaccccgccacctcctccccgcgacctaaactcgaatcgcccccgaacaaaaacgcccgaccgccgcctcccgcccaaccccgacccaatcaattcccccgcgacccgatcccctccgcctccaaacccgaactcccaccgcgcgctccccaaccccaacctctaccctcgccccgcttaacaactcctaacccacacccccacgccgactatctaaaaccaaacgcaacgaaacgcttcacccacgatcccaaatcgcaaaaaacccgatactcgacgtcccgcccttctccaactccacgtaataaacgtaaataaaaaacaaaatcccgacgacaacgcacactacgtatcaaatcaccttctcccaccgcgacaccgacactcaacaaaacgtacgccgccgtctacctccctccgcctccgcctcaaccgccgccgctaccgccccattaactccgtcgcctactccgaaccccgccccgacaaacgcgcgaccccaccgccccgacaaaaataaaacgaacgaaacgaaaaaaacgcgcgcaaacgccgaaaaaataaacaaaaaacgcaactaccctaaaaacccgatcgaccgacgaaaactaaaacaacgcgccacgacgcccgcgaaacttaaaacccgaaaaaaaaaaaacgaaaccgaaaaaaacgaaaccaaacgaaccaacgcgaaaaaaaactccgaaaaacgaaacaaaaataccactataaataactaaacgaaacctcgacccctccctctaaacgtaacactctatt

SEQ ID NO: 31441 - DNA, 822 bp, Artificial Sequence
  chemically treated genomic DNA (Homo sapiens) CpG-island No: 31441
gagcgtttttaggtgaaaggtagttggagagcgcgagaagggggtgggtaagaagacgatcgggggcgaagacggtggggagtggaagaggggagaagagggtgcggggagagaaaaacgcggtaggaagtcgttgttgcgagaaggtggggaggggaagaagatggcggagaataagaggttggggaaaaaagacgatgggagggggagagaagaaagtgggaagaagattgcgattgatagacgttgttgcgagacggtgggaggatatgggaagaaaacggtgtgaggggaagaaaacgggggagaaaacggttgtggggaaggcgcggggagaagatagtgaggagaagagggcgtggggagaggacggtggggaagaggaagagaagatggtgaggggagagaaaagcgcggtaggaagacgttgttgcgagaagaaggtggggatatggaggcggtaagaaaatggagaagaggttgggaaagaagacgattgggagaggagaagagggtgggaagaaggcgatggggagaggagaagagggtgggaagaaggcgatggggagaggagaagagggtgggaagaagattaaggtagatatgggaagaaaagggtgcgggatgaggaagaaaacggttggcggtaataggtcgggagaagacggtgaggagggggaggggagaagagggagcggcgggaagacgttgttgggggaataggcgggaaggtggagattggaagttagcgggtggagagaaggagatggaaggaaaagttgtcgttataggaattcgtgttgcgaggaatgggagagattg

SEQ ID NO: 31442 - DNA, 822 bp, Artificial Sequence
  chemically treated genomic DNA (Homo sapiens) CpG-island No: 31442
caatctctcccattcctcgcaacacgaattcctataacgacaacttttccttccatctccttctctccacccgctaacttccaatctccaccttcccgcctattcccccaacaacgtcttcccgccgctccctcttctcccctccccctcctcaccgtcttctcccgacctattaccgccaaccgttttcttcctcatcccgcacccttttcttcccatatctaccttaatcttcttcccaccctcttctcctctccccatcgccttcttcccaccctcttctcctctccccatcgccttcttcccaccctcttctcctctcccaatcgtcttctttcccaacctcttctccattttcttaccgcctccatatccccaccttcttctcgcaacaacgtcttcctaccgcgcttttctctcccctcaccatcttctcttcctcttccccaccgtcctctccccacgccctcttctcctcactatcttctccccgcgccttccccacaaccgttttctcccccgttttcttcccctcacaccgttttcttcccatatcctcccaccgtctcgcaacaacgtctatcaatcgcaatcttcttcccactttcttctctccccctcccatcgtcttttttccccaacctcttattctccgccatcttcttcccctccccaccttctcgcaacaacgacttcctaccgcgtttttctctccccgcaccctcttctcccctcttccactccccaccgtcttcgcccccgatcgtcttcttacccacccccttctcgcgctctccaactacctttcacctaaaaacgctc

SEQ ID NO: 31443 - DNA, 822 bp, Artificial Sequence
  chemically treated genomic DNA (Homo sapiens) CpG-island No: 31443
tagttttttttatttttcgtagtacgggtttttgtggcggtagtttttttttttatttttttttttttattcgttggtttttagtttttattttttcgtttatttttttagtagcgttttttcgtcgttttttttttttttttttttttttttatcgttttttttcggtttattatcgttaatcgtttttttttttatttcgtatttttttttttttatgtttgttttagttttttttttattttttttttttttttttatcgttttttttttattttttttttttttttttatcgttttttttttatttttttttttttttttaatcgtttttttttttagttttttttttatttttttgtcgtttttatatttttatttttttttcgtagtagcgtttttttgtcgcgtttttttttttttttattatttttttttttttttttttatcgttttttttttacgtttttttttttttattgtttttttttcgcgttttttttataatcgttttttttttcgtttttttttttttatatcgttttttttttatgtttttttatcgtttcgtagtagcgtttgttagtcgtaattttttttttattttttttttttttttttttatcgttttttttttttagttttttatttttcgttattttttttttttttttattttttcgtagtagcgattttttgtcgcgttttttttttttcgtatttttttttttttttttttattttttatcgttttcgttttcgatcgtttttttgtttatttttttttcgcgttttttaattgttttttatttagaagcgttt

SEQ ID NO: 31444 - DNA, 822 bp, Artificial Sequence
  chemically treated genomic DNA (Homo sapiens) CpG-island No: 31444
aaacgcttctaaataaaaaacaattaaaaaacgcgaaaaaaaaataaacaaaaaaacgatcgaaaacgaaaacgataaaaaataaaaaaaaaaaaaaaaaaatacgaaaaaaaaaaaacgcgacaaaaaatcgctactacgaaaaaataaaaaaaaaaaaaaaataacgaaaaataaaaaactaaaaaaaaaaaacgataaaaaaaaaaaaaaaaaaaataaaaaaaaaattacgactaacaaacgctactacgaaacgataaaaaaacataaaaaaaaaacgatataaaaaaaaaaaaacgaaaaaaaaaacgattataaaaaaaacgcgaaaaaaaaacaataaaaaaaaaaaaacgtaaaaaaaaaacgataaaaaaaaaaaaaaaaaaataataaaaaaaaaaaaaaacgcgacaaaaaaacgctactacgaaaaaaaaataaaaatataaaaacgacaaaaaaataaaaaaaaaactaaaaaaaaaaacgattaaaaaaaaaaaaaaaaataaaaaaaaaacgataaaaaaaaaaaaaaaaaataaaaaaaaaacgataaaaaaaaaaaaaaaaaataaaaaaaaaactaaaacaaacataaaaaaaaaaaaatacgaaataaaaaaaaaaacgattaacgataataaaccgaaaaaaaacgataaaaaaaaaaaaaaaaaaaaaaaaaacgacgaaaaaacgctactaaaaaaataaacgaaaaaataaaaactaaaaaccaacgaataaaaaaaaaaaaataaaaaaaaaaactaccgccacaaaaacccgtactacgaaaaataaaaaaaacta

SEQ ID NO: 31445 - DNA, 666 bp, Artificial Sequence
  chemically treated genomic DNA (Homo sapiens) CpG-island No: 31445
acgcggagataaagatatttcgatagttacggatatagatagataaagatcgacggacgcgcggacgtacggacggttcggttcggcgaggggaaagcggtttttcgtagttagggtagtagattttttaggggcgaggagattttcggttatcgtattttatttgttttttgcgtttcgggcgtatttgagatttttttttttttttagtgtttttcggtgtgttttcgtttttttttttttagagttgttgagcgggtcgggtcggttttattgcgcgggatgtagttttcggtttttatttattggtcgaggcgggtagagaaattttcggttttttcgttcggtcgttgttaattcgttagttttaggcgcgtcggtttttgcgcgggtttcggagtcggggcggggcggggcggggcggggcggggcggggtcggttcggggcggggttagagtcggcgtcgttgattggtagcgagttgtcggtagtttggtttgtgtcgttcggcggtttttgtttcgggttgatagttggggttgttcgcgatttcgcggttttttcgcgttcgcggtttgcgcggggtttcgggtttcgtttttttgtttttatttttattagttttattgggcgattttgtttttttagttttttttttttgtttg

SEQ ID NO: 31446 - DNA, 666 bp, Artificial Sequence
  chemically treated genomic DNA (Homo sapiens) CpG-island No: 31446
caaacaaaaaaaaaaaactaaaaaaacaaaatcgcccaataaaactaataaaaataaaaacaaaaaaacgaaacccgaaaccccgcgcaaaccgcgaacgcgaaaaaaccgcgaaatcgcgaacaaccccaactatcaacccgaaacaaaaaccgccgaacgacacaaaccaaactaccgacaactcgctaccaatcaacgacgccgactctaaccccgccccgaaccgaccccgccccgccccgccccgccccgccccgccccgactccgaaacccgcgcaaaaaccgacgcgcctaaaactaacgaattaacaacgaccgaacgaaaaaaccgaaaatttctctacccgcctcgaccaataaataaaaaccgaaaactacatcccgcgcaataaaaccgacccgacccgctcaacaactctaaaaaaaaaaaaacgaaaacacaccgaaaaacactaaaaaaaaaaaaaaatctcaaatacgcccgaaacgcaaaaaacaaataaaatacgataaccgaaaatctcctcgcccctaaaaaatctactaccctaactacgaaaaaccgctttcccctcgccgaaccgaaccgtccgtacgtccgcgcgtccgtcgatctttatctatctatatccgtaactatcgaaatatctttatctccgcgt

SEQ ID NO: 31447 - DNA, 666 bp, Artificial Sequence
  chemically treated genomic DNA (Homo sapiens) CpG-island No: 31447
taggtaagaaaggaagattgagggggtagggtcgtttaatggggttgatggaagtgagagtagagagacgggattcgggatttcgcgtaggtcgcgggcgcgaaggagtcgcgaggtcgcgagtagttttagttgttagttcggaataaaggtcgtcgagcggtatagattaggttgtcggtagttcgttgttaattagcggcgtcggttttggtttcgtttcgggtcggtttcgtttcgtttcgtttcgtttcgtttcgtttcggtttcgggattcgcgtagaggtcggcgcgtttggagttggcgggttggtagcggtcgggcggggaggtcgaaagtttttttgttcgtttcggttagtgagtgggagtcgggagttgtatttcgcgtagtgggatcggttcggttcgtttagtagttttggaaaaagagagacgggaatatatcgggaaatattgggaaaaaaaaaaagttttaagtgcgttcgaggcgtagggggtaggtaaggtgcggtggtcggggattttttcgtttttggagggtttgttgttttggttgcgggaaatcgtttttttttcgtcgggtcggatcgttcgtgcgttcgcgcgttcgtcggtttttgtttgtttgtgttcgtggttgtcgaggtgtttttgttttcgcgt

SEQ ID NO: 31448 - DNA, 666 bp, Artificial Sequence
  chemically treated genomic DNA (Homo sapiens) CpG-island No: 31448
acgcgaaaacaaaaacacctcgacaaccacgaacacaaacaaacaaaaaccgacgaacgcgcgaacgcacgaacgatccgacccgacgaaaaaaaaacgatttcccgcaaccaaaacaacaaaccctccaaaaacgaaaaaatccccgaccaccgcaccttacctaccccctacgcctcgaacgcacttaaaactttttttttttcccaatatttcccgatatattcccgtctctctttttccaaaactactaaacgaaccgaaccgatcccactacgcgaaatacaactcccgactcccactcactaaccgaaacgaacaaaaaaactttcgacctccccgcccgaccgctaccaacccgccaactccaaacgcgccgacctctacgcgaatcccgaaaccgaaacgaaacgaaacgaaacgaaacgaaacgaaaccgacccgaaacgaaaccaaaaccgacgccgctaattaacaacgaactaccgacaacctaatctataccgctcgacgacctttattccgaactaacaactaaaactactcgcgacctcgcgactccttcgcgcccgcgacctacgcgaaatcccgaatcccgtctctctactctcacttccatcaaccccattaaacgaccctaccccctcaatcttcctttcttaccta

SEQ ID NO: 31449 - DNA, 749 bp, Artificial Sequence
  chemically treated genomic DNA (Homo sapiens) CpG-island No: 31449
cggcgtagcggttagtagggggtagtgcgttttagcgtaattttcgtcgttcggtttagtttcggttttttatcggttgaggaatgaagttttatcgtgaatcgattttttattaaagaaataaaaattggtggtatcgagacgtacgggaggattttaagtttttcggggatattcgtagtttttggggatgcgttcgagggagtttaggttgtattcgcggggttttattttgttttcgagttaaaaagtcgtcgatttttttttttagggttttgttttttgtaggttcggttttagcgcgtagtagaaacgttaggggcggcgtttttagaagtacgcgggtttttttcggcgatgtgcggggttgggtggcgtcgtcgattttcgtacggagttttttttaggcgttttcggtttcgttttcgtttttttttttgcgtttttgcgttttgtgttttgttttgcgttttgttttcgttttcgtttcggttttttgttttgcgttttgttttcgttttcgttttttttttcgttttcgtttggaggtttcgtttaaggttttttcgggttgcgttacgaatttgtttcgcgttttcggtttcggtttcggtttcggtttcggtttcggtttcgcgcgttttttttcgtttttcgttcgtttttttttacgggtttcggttattgtatttttttgtgtgttgagatttttagaatattttgagggatgggaaacggggagggtagga

SEQ ID NO: 31450 - DNA, 749 bp, Artificial Sequence
  chemically treated genomic DNA (Homo sapiens) CpG-island No: 31450
tcctaccctccccgtttcccatccctcaaaatattctaaaaatctcaacacacaaaaaaatacaataaccgaaacccgtaaaaaaaaacgaacgaaaaacgaaaaaaaacgcgcgaaaccgaaaccgaaaccgaaaccgaaaccgaaaccgaaaacgcgaaacaaattcgtaacgcaacccgaaaaaaccttaaacgaaacctccaaacgaaaacgaaaaaaaaaacgaaaacgaaaacaaaacgcaaaacaaaaaaccgaaacgaaaacgaaaacaaaacgcaaaacaaaacacaaaacgcaaaaacgcaaaaaaaaaaacgaaaacgaaaccgaaaacgcctaaaaaaaactccgtacgaaaatcgacgacgccacccaaccccgcacatcgccgaaaaaaacccgcgtacttctaaaaacgccgcccctaacgtttctactacgcgctaaaaccgaacctacaaaaaacaaaaccctaaaaaaaaaaatcgacgactttttaactcgaaaacaaaataaaaccccgcgaatacaacctaaactccctcgaacgcatccccaaaaactacgaatatccccgaaaaacttaaaatcctcccgtacgtctcgataccaccaatttttatttctttaataaaaaatcgattcacgataaaacttcattcctcaaccgataaaaaaccgaaactaaaccgaacgacgaaaattacgctaaaacgcactaccccctactaaccgctacgccg

SEQ ID NO: 31451 - DNA, 749 bp, Artificial Sequence
  chemically treated genomic DNA (Homo sapiens) CpG-island No: 31451
ttttatttttttcgttttttattttttagaatgttttagaaattttagtatataggaagatgtagtggtcgaggttcgtagaaggaagcgggcgaagggcggaggaggacgcgcggggtcggggtcggggtcggggtcggggtcggggtcggggacgcggggtaggttcgtggcgtagttcggggagattttgggcgaggtttttaggcggggacgggaaagggaacgggaacggggatagggcgtagggtagagggtcgggacggaaacggggatagggcgtagggtagagtatagagcgtaggggcgtagagaaggggacgaagacggggtcggaggcgtttgaggggggtttcgtgcgggaatcggcggcgttatttagtttcgtatatcgtcgagagaggttcgcgtgtttttgagagcgtcgtttttgacgtttttgttgcgcgttgggatcgaatttataggaagtaaaattttagaggaagaagtcggcggttttttggttcggagataaaatggagtttcgcggatgtagtttgggttttttcgggcgtatttttagaagttgcgggtgttttcggaggatttgaagttttttcgtgcgtttcgatgttattagtttttgtttttttggtgaggaatcggtttacggtgaaattttattttttagtcggtggggagtcgaggttgggtcgggcggcgagggttgcgttgggacgtattgttttttattggtcgttgcgtcg

SEQ ID NO: 31452 - DNA, 749 bp, Artificial Sequence
  chemically treated genomic DNA (Homo sapiens) CpG-island No: 31452
cgacgcaacgaccaataaaaaacaatacgtcccaacgcaaccctcgccgcccgacccaacctcgactccccaccgactaaaaaataaaatttcaccgtaaaccgattcctcaccaaaaaaacaaaaactaataacatcgaaacgcacgaaaaaacttcaaatcctccgaaaacacccgcaacttctaaaaatacgcccgaaaaaacccaaactacatccgcgaaactccattttatctccgaaccaaaaaaccgccgacttcttcctctaaaattttacttcctataaattcgatcccaacgcgcaacaaaaacgtcaaaaacgacgctctcaaaaacacgcgaacctctctcgacgatatacgaaactaaataacgccgccgattcccgcacgaaacccccctcaaacgcctccgaccccgtcttcgtccccttctctacgcccctacgctctatactctaccctacgccctatccccgtttccgtcccgaccctctaccctacgccctatccccgttcccgttccctttcccgtccccgcctaaaaacctcgcccaaaatctccccgaactacgccacgaacctaccccgcgtccccgaccccgaccccgaccccgaccccgaccccgaccccgcgcgtcctcctccgcccttcgcccgcttccttctacgaacctcgaccactacatcttcctatatactaaaatttctaaaacattctaaaaaataaaaaacgaaaaaaataaaa

SEQ ID NO: 31453 - DNA, 531 bp, Artificial Sequence
  chemically treated genomic DNA (Homo sapiens) CpG-island No: 31453
tttcgtcgggagatttttaatttattttcgttttcgttattttttgggattagttttcgtattttttatcgttttttttttttttatttttataatttcgttcgagttttattgcgtttgtgcggttaacgaggtcgcgcgtaggcgatcggggtagaagagttttcggtttttgttgttaataagacgtggatttgcgagtcggggtaaaagggttttcggtttgcgggaaattggaggttagcggtgggcgtggatcgtcgaggtgattggcggttgtcggatttgttgttgtttgttgattaggtagtcgtaggtaatgacggatgtttagattttgtgggcggagtaaaggaattatgtattgatatacgtatatttatcgaggggcgcgttcgtttgcgtgttttttatttcgtagtcgaaaggagcgcgtttcggggtaggttttcgggtatttttcgtagaggatcgggttttatattttttgttttttttttttttttagtaagttataatttattttgggag

SEQ ID NO: 31454 - DNA, 531 bp, Artificial Sequence
  chemically treated genomic DNA (Homo sapiens) CpG-island No: 31454
ctcccaaaataaattataacttactaaaaaaaaaaaaaaaacaaaaaatataaaacccgatcctctacgaaaaatacccgaaaacctaccccgaaacgcgctcctttcgactacgaaataaaaaacacgcaaacgaacgcgcccctcgataaatatacgtatatcaatacataattcctttactccgcccacaaaatctaaacatccgtcattacctacgactacctaatcaacaaacaacaacaaatccgacaaccgccaatcacctcgacgatccacgcccaccgctaacctccaatttcccgcaaaccgaaaacccttttaccccgactcgcaaatccacgtcttattaacaacaaaaaccgaaaactcttctaccccgatcgcctacgcgcgacctcgttaaccgcacaaacgcaataaaactcgaacgaaattataaaaataaaaaaaaaaaaaacgataaaaaatacgaaaactaatcccaaaaaataacgaaaacgaaaataaattaaaaatctcccgacgaaa

SEQ ID NO: 31455 - DNA, 531 bp, Artificial Sequence
  chemically treated genomic DNA (Homo sapiens) CpG-island No: 31455
tttttaaaataagttatgatttattaggggaggaaaaggagtaaagagtataaagttcggttttttgcgggaagtattcggaggtttgtttcggaacgcgtttttttcggttacgagatgaggggtacgtagacggacgcgtttttcggtgagtgtgcgtgtattagtgtatgatttttttatttcgtttatagggtttgggtattcgttattatttacggttgtttggttagtaaataatagtagattcgataatcgttagttatttcgacggtttacgtttatcgttagtttttagtttttcgtagatcggaagtttttttgtttcggttcgtaggtttacgttttattgatagtaggaatcggaagtttttttgtttcgatcgtttgcgcgcggtttcgttggtcgtataggcgtagtggagttcgggcggagttgtgggagtggaggagaaagaggcggtagggggtacgggggttggttttagaagatggcggaggcgggggtgagttgggggtttttcggcgaag

SEQ ID NO: 31456 - DNA, 531 bp, Artificial Sequence
  chemically treated genomic DNA (Homo sapiens) CpG-island No: 31456
cttcgccgaaaaacccccaactcacccccgcctccgccatcttctaaaaccaacccccgtaccccctaccgcctctttctcctccactcccacaactccgcccgaactccactacgcctatacgaccaacgaaaccgcgcgcaaacgatcgaaacaaaaaaacttccgattcctactatcaataaaacgtaaacctacgaaccgaaacaaaaaaacttccgatctacgaaaaactaaaaactaacgataaacgtaaaccgtcgaaataactaacgattatcgaatctactattatttactaaccaaacaaccgtaaataataacgaatacccaaaccctataaacgaaataaaaaaatcatacactaatacacgcacactcaccgaaaaacgcgtccgtctacgtacccctcatctcgtaaccgaaaaaaacgcgttccgaaacaaacctccgaatacttcccgcaaaaaaccgaactttatactctttactccttttcctcccctaataaatcataacttattttaaaaa

SEQ ID NO: 31457 - DNA, 739 bp, Artificial Sequence
  chemically treated genomic DNA (Homo sapiens) CpG-island No: 31457
gttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcgagagtggcgttggtacgtttaaatttcggggttttcggttaggttaggggggcgggcgtgcggcggggtcgggtcgggtcgggcgcgtttagcgggtttcgggtatacgttttttatttgggcgaggttcggtgcgtaggcgtttagcgcgggggtagcggtcgggcgtttaagttcggcgcgggtaagagttggatagtttaggggtcgcgtcgggtcgagttgtcgttcgcgttatttttatcgtcgtcgttgttatcgttatcgttatcgtttgggttgtagtagatcgcgggagaacgtttgcgcgaagtttcggtgtagttttggcgggatcgtagtaattatcggagcgtgagtaatagtttttcggttggaggagttattgttttacgcgttcgcggttcgcgcgtcgaggtaagttttgggcgtttagtttagatcggcgttttcggattgggcgttttttgtttgttcggttttcgttttttttcgtagagcgagtttgtatttgggcgcgtcgttcgagggaatggttaggagtttttttttcggtagagtttgtattttgttttaaggttt

SEQ ID NO: 31458 - DNA, 739 bp, Artificial Sequence
  chemically treated genomic DNA (Homo sapiens) CpG-island No: 31458
aaaccttaaaacaaaatacaaactctaccgaaaaaaaaactcctaaccattccctcgaacgacgcgcccaaatacaaactcgctctacgaaaaaaaacgaaaaccgaacaaacaaaaaacgcccaatccgaaaacgccgatctaaactaaacgcccaaaacttacctcgacgcgcgaaccgcgaacgcgtaaaacaataactcctccaaccgaaaaactattactcacgctccgataattactacgatcccgccaaaactacaccgaaacttcgcgcaaacgttctcccgcgatctactacaacccaaacgataacgataacgataacaacgacgacgataaaaataacgcgaacgacaactcgacccgacgcgacccctaaactatccaactcttacccgcgccgaacttaaacgcccgaccgctacccccgcgctaaacgcctacgcaccgaacctcgcccaaataaaaaacgtatacccgaaacccgctaaacgcgcccgacccgacccgaccccgccgcacgcccgcccccctaacctaaccgaaaaccccgaaatttaaacgtaccaacgccactctcgcgcgccgaaactataacgatttactaaacaaaaacttacgaaacacacaaaaaaaaaataaaacgaaaccgttcgaaaactcgttaacactacaaaacctcccgcaacatcgctaccttaaatcccgcctttccaaacgtacgcgcacaacgaac

SEQ ID NO: 31459 - DNA, 739 bp, Artificial Sequence
  chemically treated genomic DNA (Homo sapiens) CpG-island No: 31459
ggattttgagataaagtgtaaattttatcgggaggggggtttttggttattttttcgggcggcgcgtttaggtgtaggttcgttttgcggaggagggcgggggtcgggtaagtagagggcgtttagttcgggggcgtcggtttgggttgggcgtttagagtttatttcggcgcgcgggtcgcgggcgcgtggggtagtggtttttttagtcgggaagttgttgtttacgtttcggtggttgttgcggtttcgttagggttgtatcggggtttcgcgtagacgttttttcgcgatttgttgtagtttaggcggtggcggtggcggtagtagcggcggcggtggaggtggcgcgggcgatagttcggttcggcgcggtttttgaattgtttaatttttgttcgcgtcgggtttaagcgttcggtcgttgttttcgcgttgagcgtttgcgtatcgggtttcgtttaggtgaggggcgtgtgttcggagttcgttgggcgcgttcggttcggttcggtttcgtcgtacgttcgtttttttggtttggtcgaggatttcggggtttggacgtgttaacgttattttcgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagt

SEQ ID NO: 31460 - DNA, 739 bp, Artificial Sequence
  chemically treated genomic DNA (Homo sapiens) CpG-island No: 31460
actcgctatacgcgcacgcctaaaaaaacgaaatttaaaacaacgatactacgaaaaactctacaatatcaacgaacccccgaacgattccgcctcattccctctctatatacctcgcaaatctctacttaataaaccgtcacaacttcgacgcgcgaaaataacgttaacacgtccaaaccccgaaatcctcgaccaaaccaaaaaaacgaacgtacgacgaaaccgaaccgaaccgaacgcgcccaacgaactccgaacacacgcccctcacctaaacgaaacccgatacgcaaacgctcaacgcgaaaacaacgaccgaacgcttaaacccgacgcgaacaaaaattaaacaattcaaaaaccgcgccgaaccgaactatcgcccgcgccacctccaccgccgccgctactaccgccaccgccaccgcctaaactacaacaaatcgcgaaaaaacgtctacgcgaaaccccgatacaaccctaacgaaaccgcaacaaccaccgaaacgtaaacaacaacttcccgactaaaaaaaccactaccccacgcgcccgcgacccgcgcgccgaaataaactctaaacgcccaacccaaaccgacgcccccgaactaaacgccctctacttacccgacccccgccctcctccgcaaaacgaacctacacctaaacgcgccgcccgaaaaaataaccaaaaacccccctcccgataaaatttacactttatctcaaaatcc

SEQ ID NO: 31461 - DNA, 633 bp, Artificial Sequence
  chemically treated genomic DNA (Homo sapiens) CpG-island No: 31461
ttgcgttatggtcgttttttcgcgataattcgtagagtttggattatatttcgatatataatttttattaaattttagacgtcggtattcgttttgtttaggtcgggtttaagtatttgagatcgtcgtcgttgaagttgtcgttatttcgcgtcgtttttgttgcgtcgagtcgttcgcggttattttattttttttttgggttcgttttttttattcgaatttttcggtgtttcgtttttttttttaggttttattaattaagattacgcgtcgtcggaagttgttgcgtgtgggtcgttattatttcgttttttagcgttcgttttcgggtttttaagaaaaggtttttttggttaggacgtatgcgcgcgcgtgggtcgcgtagtcgttgatgtttggaagcgcgttgcgatataaatttttacgtagggatgttggcgacggtggtcgttgggggagttgtttagcgtcgttcggtattgggttttttttttttttattttttgtagttttttgttttcgtgggtggttggcgcgtttgcggagttagggtcgttgtgtggatcgtgggattgtagttttagttaaagggttattacgtttggtcggttttgtagatttgggttttag

SEQ ID NO: 31462 - DNA, 633 bp, Artificial Sequence
  chemically treated genomic DNA (Homo sapiens) CpG-island No: 31462
ctaaaacccaaatctacaaaaccgaccaaacgtaataaccctttaactaaaactacaatcccacgatccacacaacgaccctaactccgcaaacgcgccaaccacccacgaaaacaaaaaactacaaaaaataaaaaaaaaaaaaacccaataccgaacgacgctaaacaactcccccaacgaccaccgtcgccaacatccctacgtaaaaatttatatcgcaacgcgcttccaaacatcaacgactacgcgacccacgcgcgcgcatacgtcctaaccaaaaaaaccttttcttaaaaacccgaaaacgaacgctaaaaaacgaaataataacgacccacacgcaacaacttccgacgacgcgtaatcttaattaataaaacctaaaaaaaaaaacgaaacaccgaaaaattcgaataaaaaaaacgaacccaaaaaaaaaataaaataaccgcgaacgactcgacgcaacaaaaacgacgcgaaataacgacaacttcaacgacgacgatctcaaatacttaaacccgacctaaacaaaacgaataccgacgtctaaaatttaataaaaattatatatcgaaatataatccaaactctacgaattatcgcgaaaaaacgaccataacgcaa

SEQ ID NO: 31463 - DNA, 633 bp, Artificial Sequence
  chemically treated genomic DNA (Homo sapiens) CpG-island No: 31463
ttggggtttagatttatagaatcgattagacgtgatagttttttggttggggttgtagttttacgatttatataacgattttggtttcgtagacgcgttaattatttacggaggtaagaaattgtagaaagtaaagggaaagggagtttagtgtcgggcggcgttgagtagtttttttagcggttatcgtcgttaatatttttgcgtaggggtttgtatcgtagcgcgtttttagatattaacggttgcgcggtttacgcgcgcgtatgcgttttgattaggggaatttttttttggggattcggaggcgagcgttggaaggcgggatagtggcgatttatacgtagtagttttcggcggcgcgtagttttgattggtggaatttgggagagggggcggggtatcggggaattcgaatgggagaggcgggtttaaggagggagtggaatggtcgcgggcggttcgacgtagtagaggcgacgcgagatggcggtagttttagcggcggcgattttaggtatttgagttcggtttgggtaaggcgggtatcgacgtttggagtttagtgggagttatgtgtcggagtgtggtttaggttttgcgggttgtcgcggagaggcggttatggcgtag

SEQ ID NO: 31464 - DNA, 633 bp, Artificial Sequence
  chemically treated genomic DNA (Homo sapiens) CpG-island No: 31464
ctacgccataaccgcctctccgcgacaacccgcaaaacctaaaccacactccgacacataactcccactaaactccaaacgtcgatacccgccttacccaaaccgaactcaaatacctaaaatcgccgccgctaaaactaccgccatctcgcgtcgcctctactacgtcgaaccgcccgcgaccattccactccctccttaaacccgcctctcccattcgaattccccgataccccgccccctctcccaaattccaccaatcaaaactacgcgccgccgaaaactactacgtataaatcgccactatcccgccttccaacgctcgcctccgaatccccaaaaaaaaattcccctaatcaaaacgcatacgcgcgcgtaaaccgcgcaaccgttaatatctaaaaacgcgctacgatacaaacccctacgcaaaaatattaacgacgataaccgctaaaaaaactactcaacgccgcccgacactaaactccctttccctttactttctacaatttcttacctccgtaaataattaacgcgtctacgaaaccaaaatcgttatataaatcgtaaaactacaaccccaaccaaaaaactatcacgtctaatcgattctataaatctaaaccccaa

SEQ ID NO: 31465 - DNA, 503 bp, Artificial Sequence
  chemically treated genomic DNA (Homo sapiens) CpG-island No: 31465
gcggtaggaggtcgtgttcggtttgcgttatcgttttcgtcgtttttcggttcgtttatcgcggtagtgcgtttggaagtcgttaggtcgtagcgcggggaatagggcggttattcggtttagtagtcgttcgtagggtttcgggttcgtcgtagtttcggttttcgttttaggttcggggttgtagtagaagttgaagcggcgaatttcgcgcgtcgcgttttttttgtttagaaggtaggtttttacggtgagcgacgttatagcgagcggcgagttggcggaaaacgggtcgtttcggtcgtagtcgtcgcgcggtttttgtagcgaacgcggaggtttcgtttcgtttcgagaggggcggagtttttcgcgtttttttcgttttcgttatcgtcgtcgcggcgcgagagtcgttttgtagaggtttttttattatttttttttttttcgttatttttcgttttaggtttttcggtttttttattgttgatttttttttt

SEQ ID NO: 31466 - DNA, 503 bp, Artificial Sequence
  chemically treated genomic DNA (Homo sapiens) CpG-island No: 31466
aaaaaaaaaatcaacaataaaaaaaccgaaaaacctaaaacgaaaaataacgaaaaaaaaaaaaataataaaaaaacctctacaaaacgactctcgcgccgcgacgacgataacgaaaacgaaaaaaacgcgaaaaactccgcccctctcgaaacgaaacgaaacctccgcgttcgctacaaaaaccgcgcgacgactacgaccgaaacgacccgttttccgccaactcgccgctcgctataacgtcgctcaccgtaaaaacctaccttctaaacaaaaaaaacgcgacgcgcgaaattcgccgcttcaacttctactacaaccccgaacctaaaacgaaaaccgaaactacgacgaacccgaaaccctacgaacgactactaaaccgaataaccgccctattccccgcgctacgacctaacgacttccaaacgcactaccgcgataaacgaaccgaaaaacgacgaaaacgataacgcaaaccgaacacgacctcctaccgc

SEQ ID NO: 31467 - DNA, 503 bp, Artificial Sequence
  chemically treated genomic DNA (Homo sapiens) CpG-island No: 31467
aagagaggggttagtaatgagggggtcgggagatttggagcgaggggtaacggggaaggggagagtagtgaaggggtttttgtagggcggttttcgcgtcgcgacgacggtggcgggggcggggagggcgcgagagatttcgtttttttcgaggcggggcggggttttcgcgttcgttataaaagtcgcgcggcggttgcgatcgggacggttcgtttttcgttagttcgtcgttcgttatggcgtcgtttatcgtgaaggtttattttttgggtaaggaggacgcggcgcgcgagattcgtcgttttagtttttgttgtagtttcgagtttgaggcggaagtcgaggttgcggcgggttcgggattttgcgagcggttgttgagtcgggtggtcgttttgtttttcgcgttgcggtttggcggtttttaggcgtattatcgcggtgagcgggtcggggagcggcgggggcggtgacgtaggtcggatacggttttttgtcgt

SEQ ID NO: 31468 - DNA, 503 bp, Artificial Sequence
  chemically treated genomic DNA (Homo sapiens) CpG-island No: 31468
acgacaaaaaaccgtatccgacctacgtcaccgcccccgccgctccccgacccgctcaccgcgataatacgcctaaaaaccgccaaaccgcaacgcgaaaaacaaaacgaccacccgactcaacaaccgctcgcaaaatcccgaacccgccgcaacctcgacttccgcctcaaactcgaaactacaacaaaaactaaaacgacgaatctcgcgcgccgcgtcctccttacccaaaaaataaaccttcacgataaacgacgccataacgaacgacgaactaacgaaaaacgaaccgtcccgatcgcaaccgccgcgcgacttttataacgaacgcgaaaaccccgccccgcctcgaaaaaaacgaaatctctcgcgccctccccgcccccgccaccgtcgtcgcgacgcgaaaaccgccctacaaaaaccccttcactactctccccttccccgttacccctcgctccaaatctcccgaccccctcattactaacccctctctt

SEQ ID NO: 31469 - DNA, 852 bp, Artificial Sequence
  chemically treated genomic DNA (Homo sapiens) CpG-island No: 31469
acgtgcgttggcgttatttggtttattagaggtacgtggggaaaatgaggtggaggatgagtatagggcggtttcgttaattttcggcggtgagatttcggaaagttgtacggttttcggggttcgcgggcgtagaattcggatagaattcgtcgtcggtttttatttggtcgttttaagtagatatgaggagagttcgtagagggcgtattcgtttttcgttagtttttcgttttttcgtttcggttttttcgcgttcggttttcgggttttggtttcgcgttttcgtttcgtcgcgcgttggcgtgcgtgttcgtcgcgacgcgtcgaggtcgggtcggaatcggattcgttcgtcgttcgtcgttagtttcgtcgttagtttagtcgcggcgtttataggttcggtcgttcgcgcgttttttattcgtaaggtcgtcgtttttgtcgtggtttcggcgtcgttgtagtacgaagaaggggttggttcgtttcgttatttatagcgtattggttattagtatttttttcgggtttagttatatcgcggagtcgttcgtatcgggtcgaggttcgcgaggcggaagcgttcgtcgtcgtcggcgtttcggagcggagcgtgcggagcggagcgtgcggagcgggtcggggcggggcggggtcgggcgggcggcgttttttggcgggcgtgtggcgttttcgtacgcggttcgagtttcgcgtcgtttttttagtttcggtttcgggcgcgcgttagtttggttttttggagcggtgtagttcgcggttttcggtttgggtttagaacggaacggtttagttcgtagataggggagtcgttgtgtagagtag

SEQ ID NO: 31470 - DNA, 852 bp, Artificial Sequence
  chemically treated genomic DNA (Homo sapiens) CpG-island No: 31470
ctactctacacaacgactcccctatctacgaactaaaccgttccgttctaaacccaaaccgaaaaccgcgaactacaccgctccaaaaaaccaaactaacgcgcgcccgaaaccgaaactaaaaaaacgacgcgaaactcgaaccgcgtacgaaaacgccacacgcccgccaaaaaacgccgcccgcccgaccccgccccgccccgacccgctccgcacgctccgctccgcacgctccgctccgaaacgccgacgacgacgaacgcttccgcctcgcgaacctcgacccgatacgaacgactccgcgatataactaaacccgaaaaaaatactaataaccaatacgctataaataacgaaacgaaccaaccccttcttcgtactacaacgacgccgaaaccacgacaaaaacgacgaccttacgaataaaaaacgcgcgaacgaccgaacctataaacgccgcgactaaactaacgacgaaactaacgacgaacgacgaacgaatccgattccgacccgacctcgacgcgtcgcgacgaacacgcacgccaacgcgcgacgaaacgaaaacgcgaaaccaaaacccgaaaaccgaacgcgaaaaaaccgaaacgaaaaaacgaaaaactaacgaaaaacgaatacgccctctacgaactctcctcatatctacttaaaacgaccaaataaaaaccgacgacgaattctatccgaattctacgcccgcgaaccccgaaaaccgtacaactttccgaaatctcaccgccgaaaattaacgaaaccgccctatactcatcctccacctcattttccccacgtacctctaataaaccaaataacgccaacgcacgt

SEQ ID NO: 31471 - DNA, 852 bp, Artificial Sequence
  chemically treated genomic DNA (Homo sapiens) CpG-island No: 31471
ttgttttgtatagcggtttttttgtttgcggattgggtcgtttcgttttggatttaggtcggaggtcgcgggttgtatcgttttaggaggttaggttggcgcgcgttcgaggtcggggttgagggggcggcgcggaattcgggtcgcgtgcgggagcgttatacgttcgttagggggcgtcgttcgttcggtttcgtttcgtttcggttcgtttcgtacgtttcgtttcgtacgtttcgtttcgggacgtcgacggcggcgggcgttttcgtttcgcgggtttcggttcggtgcgagcggtttcgcgatgtggttgagttcggaggaggtgttggtggttaatgcgttgtgggtgacggagcgggttaatttttttttcgtgttgtagcgacgtcggggttacggtaggggcggcggttttacgggtgagaggcgcgcgggcggtcgggtttgtgggcgtcgcggttgggttggcggcggggttggcggcgggcggcgggcgggttcggtttcggttcggtttcggcgcgtcgcggcggatacgtacgttagcgcgcggcggggcgggggcgcgaggttaggattcgggagtcgggcgcggaggggtcggggcggggaggcgaggggttggcgggaggcgaatgcgttttttgcgggttttttttatgtttgtttggggcggttaagtggagatcggcggcgggttttgttcggattttgcgttcgcgagtttcgggggtcgtgtagtttttcgggattttatcgtcgaaagttggcgagatcgttttgtgtttattttttattttattttttttacgtgtttttaatgggttaggtgacgttagcgtacgt

SEQ ID NO: 31472 - DNA, 852 bp, Artificial Sequence
  chemically treated genomic DNA (Homo sapiens) CpG-island No: 31472
acgtacgctaacgtcacctaacccattaaaaacacgtaaaaaaaataaaataaaaaataaacacaaaacgatctcgccaactttcgacgataaaatcccgaaaaactacacgacccccgaaactcgcgaacgcaaaatccgaacaaaacccgccgccgatctccacttaaccgccccaaacaaacataaaaaaaacccgcaaaaaacgcattcgcctcccgccaacccctcgcctccccgccccgacccctccgcgcccgactcccgaatcctaacctcgcgcccccgccccgccgcgcgctaacgtacgtatccgccgcgacgcgccgaaaccgaaccgaaaccgaacccgcccgccgcccgccgccaaccccgccgccaacccaaccgcgacgcccacaaacccgaccgcccgcgcgcctctcacccgtaaaaccgccgcccctaccgtaaccccgacgtcgctacaacacgaaaaaaaaattaacccgctccgtcacccacaacgcattaaccaccaacacctcctccgaactcaaccacatcgcgaaaccgctcgcaccgaaccgaaacccgcgaaacgaaaacgcccgccgccgtcgacgtcccgaaacgaaacgtacgaaacgaaacgtacgaaacgaaccgaaacgaaacgaaaccgaacgaacgacgccccctaacgaacgtataacgctcccgcacgcgacccgaattccgcgccgccccctcaaccccgacctcgaacgcgcgccaacctaacctcctaaaacgatacaacccgcgacctccgacctaaatccaaaacgaaacgacccaatccgcaaacaaaaaaaccgctatacaaaacaa

SEQ ID NO: 31473 - DNA, 1094 bp, Artificial Sequence
  chemically treated genomic DNA (Homo sapiens) CpG-island No: 31473
tcgcgtgtcgtcgtcgtttattatcggtttattcgagttcgagcgcgtttatcgagtttagtgaggcgcggcgggagggcgcggggcggggagcgagttttaggcgggttcgggtcgtaggattatttcggtcggcgcgtttattttattcgtttatcgtagggtgaattgtagcgagtatttttcgttgtttttcgttacgttttgggtcgtcggtatttttttttatgaaggtcggggtgtggggtaggggcgtacgcgttggattttcgggattcgcgtagggcgtttattaggttcgtgcgtatttttcgtaggggcggcggttttgtgcggtttggtttatttgttcgcgcgttttcgttatttttagggttacgcgcgtttcgcgtagtttaggtgagggtcgggcggggagcggggcggggtcggggaaagatcgcgggcgggcggggtttttggggagcgggatcgaagttgggggcgggcgacgggtcggagtttagcgtttttggggattcggtgggcgagttttggcggcggttagaggaagttttcgtggggttagggttgcggcggggaagaagcgggttttttcgcgttattttttcgttgatcgtcgttcgtaggttggtatcgttgtacgcgagcgcgcgcgttttttggttgttggtggcgttggttgcgttcggtttgttcgtttattttttttcggtcgcgttgcgcgtcgcgtttttcggacggtttcggacgttgttgtcgtgggtttgagattaaggttttcgggtcgacggagtcgggaaagaagagtcggagtttttagttgtttcggggaggggcgttcgttttcgtattttagtttttattattaaagttttagtgatcgagattcgggttgcgttttttgggttcgcgggggtggcgtatcgcgggttacggagtttggaggggtttagttcgagttcgggtagttcggggcgggtttttatagtggcggcgtgagagtgtttgcgaaggaacgagtttttttttggggcgggagtggatcgggtttttattttttattttattttttatttagtttcggggttata

SEQ ID NO: 31474 - DNA, 1094 bp, Artificial Sequence
  chemically treated genomic DNA (Homo sapiens) CpG-island No: 31474
tataaccccgaaactaaataaaaaataaaataaaaaataaaaacccgatccactcccgccccaaaaaaaaactcgttccttcgcaaacactctcacgccgccactataaaaacccgccccgaactacccgaactcgaactaaacccctccaaactccgtaacccgcgatacgccacccccgcgaacccaaaaaacgcaacccgaatctcgatcactaaaactttaataataaaaactaaaatacgaaaacgaacgcccctccccgaaacaactaaaaactccgactcttctttcccgactccgtcgacccgaaaaccttaatctcaaacccacgacaacaacgtccgaaaccgtccgaaaaacgcgacgcgcaacgcgaccgaaaaaaaataaacgaacaaaccgaacgcaaccaacgccaccaacaaccaaaaaacgcgcgcgctcgcgtacaacgataccaacctacgaacgacgatcaacgaaaaaataacgcgaaaaaacccgcttcttccccgccgcaaccctaaccccacgaaaacttcctctaaccgccgccaaaactcgcccaccgaatccccaaaaacgctaaactccgacccgtcgcccgcccccaacttcgatcccgctccccaaaaaccccgcccgcccgcgatctttccccgaccccgccccgctccccgcccgaccctcacctaaactacgcgaaacgcgcgtaaccctaaaaataacgaaaacgcgcgaacaaataaaccaaaccgcacaaaaccgccgcccctacgaaaaatacgcacgaacctaataaacgccctacgcgaatcccgaaaatccaacgcgtacgcccctaccccacaccccgaccttcataaaaaaaaataccgacgacccaaaacgtaacgaaaaacaacgaaaaatactcgctacaattcaccctacgataaacgaataaaataaacgcgccgaccgaaataatcctacgacccgaacccgcctaaaactcgctccccgccccgcgccctcccgccgcgcctcactaaactcgataaacgcgctcgaactcgaataaaccgataataaacgacgacgacacgcga

SEQ ID NO: 31475 - DNA, 1094 bp, Artificial Sequence
  chemically treated genomic DNA (Homo sapiens) CpG-island No: 31475
tgtgatttcgaggttgagtagagagtggggtaggaggtgaaaattcgatttattttcgttttaggggagggttcgttttttcgtagatatttttacgtcgttattatgaaagttcgtttcgggttgttcggattcgggttgggtttttttaggtttcgtagttcgcggtgcgttattttcgcggatttagagaacgtagttcgggtttcggttattagaattttaatgatagagattaggatgcggaagcgagcgttttttttcggggtagttggaggtttcggtttttttttttcggtttcgtcggttcgggggttttggttttaggtttacggtagtagcgttcggagtcgttcgaggagcgcggcgcgtagcgcggtcgggaggaagtgggcgagtaggtcgagcgtagttagcgttattagtagttagagggcgcgcgcgttcgcgtatagcggtgttagtttgcgggcggcggttagcggggaggtggcgcgaggaggttcgtttttttttcgtcgtaattttggttttacggggattttttttggtcgtcgttagggttcgtttatcgaatttttaaaggcgttgggtttcggttcgtcgttcgtttttagtttcggtttcgttttttaggagtttcgttcgttcgcgattttttttcggtttcgtttcgtttttcgttcggtttttatttgagttgcgcggagcgcgcgtagttttggaagtagcggaggcgcgcgaataggtagattaggtcgtatagggtcgtcgtttttgcgagaggtacgtacgggtttggtgagcgttttgcgcgggtttcgggggtttagcgcgtgcgtttttgttttatatttcgatttttatgaaagaagatgtcggcgatttagagcgtggcgaggaatagcgggaagtattcgttgtagtttattttgcggtgggcgggtgggatgagcgcgtcggtcgggatggttttgcgattcggattcgtttggggttcgtttttcgtttcgcgttttttcgtcgcgttttattgggttcggtagacgcgttcgaattcgggtgggtcggtggtgagcggcggcgatacgcgg

SEQ ID NO: 31476 - DNA, 1094 bp, Artificial Sequence
  chemically treated genomic DNA (Homo sapiens) CpG-island No: 31476
ccgcgtatcgccgccgctcaccaccgacccacccgaattcgaacgcgtctaccgaacccaataaaacgcgacgaaaaaacgcgaaacgaaaaacgaaccccaaacgaatccgaatcgcaaaaccatcccgaccgacgcgctcatcccacccgcccaccgcaaaataaactacaacgaatacttcccgctattcctcgccacgctctaaatcgccgacatcttctttcataaaaatcgaaatataaaacaaaaacgcacgcgctaaacccccgaaacccgcgcaaaacgctcaccaaacccgtacgtacctctcgcaaaaacgacgaccctatacgacctaatctacctattcgcgcgcctccgctacttccaaaactacgcgcgctccgcgcaactcaaataaaaaccgaacgaaaaacgaaacgaaaccgaaaaaaaatcgcgaacgaacgaaactcctaaaaaacgaaaccgaaactaaaaacgaacgacgaaccgaaacccaacgcctttaaaaattcgataaacgaaccctaacgacgaccaaaaaaaatccccgtaaaaccaaaattacgacgaaaaaaaaacgaacctcctcgcgccacctccccgctaaccgccgcccgcaaactaacaccgctatacgcgaacgcgcgcgccctctaactactaataacgctaactacgctcgacctactcgcccacttcctcccgaccgcgctacgcgccgcgctcctcgaacgactccgaacgctactaccgtaaacctaaaaccaaaacccccgaaccgacgaaaccgaaaaaaaaaaaccgaaacctccaactaccccgaaaaaaaacgctcgcttccgcatcctaatctctatcattaaaattctaataaccgaaacccgaactacgttctctaaatccgcgaaaataacgcaccgcgaactacgaaacctaaaaaaacccaacccgaatccgaacaacccgaaacgaactttcataataacgacgtaaaaatatctacgaaaaaacgaaccctcccctaaaacgaaaataaatcgaattttcacctcctaccccactctctactcaacctcgaaatcaca

SEQ ID NO: 31477 - DNA, 558 bp, Artificial Sequence
  chemically treated genomic DNA (Homo sapiens) CpG-island No: 31477
acgacgagtcggttattaggaatttcgtatttaggatttttttcgaggtcggaggggcgtagatgattagcgagaggcgcggtaggttagagggattttagtgcgtaggggcggggtcgcggcggtcggagcgaagagtataagcgtatgcgagacggcgtaggggattagagggttcggagcgcgtgcgtggggcggggtcgcggcgggataaatgtagagcgtacgcgtttggttgtttggcgattgtataagtagggatggcgtcgttttagcgttttcgggtgttacgttgttgtagttgtcgttttttttaggcgtattaggtttggcgggtgttagttttttttttttttttcggcgcggggatagcggacggggagtggcggggttgtgggtgttgtttcgaatggtttcgggatgtatcgggttcgaaggagtgtagggatcgttgagggcgggttttattggggtcgttttcgtataacgttttgagttttttgtttggtttttgtataaattagaggtaatggttttgcggaggtggttttttgtgaa

SEQ ID NO: 31478 - DNA, 558 bp, Artificial Sequence
  chemically treated genomic DNA (Homo sapiens) CpG-island No: 31478
ttcacaaaaaaccacctccgcaaaaccattacctctaatttatacaaaaaccaaacaaaaaactcaaaacgttatacgaaaacgaccccaataaaacccgccctcaacgatccctacactccttcgaacccgatacatcccgaaaccattcgaaacaacacccacaaccccgccactccccgtccgctatccccgcgccgaaaaaaaaaaaaaaaactaacacccgccaaacctaatacgcctaaaaaaaacgacaactacaacaacgtaacacccgaaaacgctaaaacgacgccatccctacttatacaatcgccaaacaaccaaacgcgtacgctctacatttatcccgccgcgaccccgccccacgcacgcgctccgaaccctctaatcccctacgccgtctcgcatacgcttatactcttcgctccgaccgccgcgaccccgcccctacgcactaaaatccctctaacctaccgcgcctctcgctaatcatctacgcccctccgacctcgaaaaaaatcctaaatacgaaattcctaataaccgactcgtcgt

SEQ ID NO: 31479 - DNA, 558 bp, Artificial Sequence
  chemically treated genomic DNA (Homo sapiens) CpG-island No: 31479
tttataagaggttattttcgtagaattattatttttggtttgtataagaattaaataaaaagtttagaacgttatgcgggggcgattttaatgagattcgtttttagcggtttttgtattttttcgggttcggtgtatttcggagttattcgagataatatttatagtttcgttatttttcgttcgttgttttcgcgtcggaggaggaggagggggttggtattcgttagatttggtgcgtttggaagaggcggtagttgtagtagcgtagtattcgagaacgttgaagcgacgttatttttgtttgtgtagtcgttaggtagttaagcgcgtgcgttttgtatttgtttcgtcgcggtttcgttttacgtacgcgtttcgaattttttagttttttacgtcgtttcgtatgcgtttatatttttcgtttcggtcgtcgcggtttcgtttttgcgtattgggatttttttagtttgtcgcgtttttcgttggttatttgcgttttttcgatttcggaaagagttttgggtgcgggatttttggtagtcgattcgtcgt

SEQ ID NO: 31480 - DNA, 558 bp, Artificial Sequence
  chemically treated genomic DNA (Homo sapiens) CpG-island No: 31480
acgacgaatcgactaccaaaaatcccgcacccaaaactctttccgaaatcgaaaaaacgcaaataaccaacgaaaaacgcgacaaactaaaaaaatcccaatacgcaaaaacgaaaccgcgacgaccgaaacgaaaaatataaacgcatacgaaacgacgtaaaaaactaaaaaattcgaaacgcgtacgtaaaacgaaaccgcgacgaaacaaatacaaaacgcacgcgcttaactacctaacgactacacaaacaaaaataacgtcgcttcaacgttctcgaatactacgctactacaactaccgcctcttccaaacgcaccaaatctaacgaataccaaccccctcctcctcctccgacgcgaaaacaacgaacgaaaaataacgaaactataaatattatctcgaataactccgaaatacaccgaacccgaaaaaatacaaaaaccgctaaaaacgaatctcattaaaatcgcccccgcataacgttctaaactttttatttaattcttatacaaaccaaaaataataattctacgaaaataacctcttataaa

SEQ ID NO: 31481 - DNA, 937 bp, Artificial Sequence
  chemically treated genomic DNA (Homo sapiens) CpG-island No: 31481
ttcgtcgtcgtcgcggttttttgttttttttcgtcgtcgcggtttattttttttatttcgtttaggttttttgttcgtcgtggttttttcgtttttcgtcgcggttttttgttcgtcgcgtttttttattttcgtcgtcgtggttttttgttttatcgtcgttgcggttttttttcgtcgtggattttttttttttgttttcgcgattttttattcgtcgcggttttttgtttttattttgtttcggttttttgtttttcgtcgttttttgtattttcgtcgtcgcggtttttttttcgtcgtggttttttttttttgttttcgcggttttttattcgttatagttttttgtttttcgtcgtcgcggttttttgtttttatttcgtttcggttttttgtttatcgcggttttttatttcgcgtcgtcgcggttttttgttcgtcgcggatttgtgtttttttcgtcgtcgcggttttttgttcgtcgcggttttttgttatatattcgtcgtcgcggttttttgtttttttgtcgtcgcggttttttgttttatcgtcgatatagttttttgtatattcgtcgttttggttttttgtcgtcgcggttttttgttttttcgttgtcgcggttttttgttttttcgttatcgtcgttgttttttgttttatcgtcgtcgtggttttttgttcgtcgcggttttttgttatcgcggttttttattcgttacggttttttattcgtcgcggttttttgcgtttcgttgttacggttttttgtttttttgtcgtagcgattttttcgtcgtcgcggcgttttgttttcgtcgtcgaggatttttgttttcgtcgttacggttttgagggcgggagcggtagattcggttgttagttttattggcgttttggtaagggtagcgttgaggggtgtttttggttt

SEQ ID NO: 31482 - DNA, 937 bp, Artificial Sequence
  chemically treated genomic DNA (Homo sapiens) CpG-island No: 31482
aaaccaaaaacacccctcaacgctacccttaccaaaacgccaataaaactaacaaccgaatctaccgctcccgccctcaaaaccgtaacgacgaaaacaaaaatcctcgacgacgaaaacaaaacgccgcgacgacgaaaaaatcgctacgacaaaaaaacaaaaaaccgtaacaacgaaacgcaaaaaaccgcgacgaataaaaaaccgtaacgaataaaaaaccgcgataacaaaaaaccgcgacgaacaaaaaaccacgacgacgataaaacaaaaaacaacgacgataacgaaaaaacaaaaaaccgcgacaacgaaaaaacaaaaaaccgcgacgacaaaaaaccaaaacgacgaatatacaaaaaactatatcgacgataaaacaaaaaaccgcgacgacaaaaaaacaaaaaaccgcgacgacgaatatataacaaaaaaccgcgacgaacaaaaaaccgcgacgacgaaaaaaacacaaatccgcgacgaacaaaaaaccgcgacgacgcgaaataaaaaaccgcgataaacaaaaaaccgaaacgaaataaaaacaaaaaaccgcgacgacgaaaaacaaaaaactataacgaataaaaaaccgcgaaaacaaaaaaaaaaaaccacgacgaaaaaaaaaccgcgacgacgaaaatacaaaaaacgacgaaaaacaaaaaaccgaaacaaaataaaaacaaaaaaccgcgacgaataaaaaatcgcgaaaacaaaaaaaaaaaatccacgacgaaaaaaaaccgcaacgacgataaaacaaaaaaccacgacgacgaaaataaaaaaacgcgacgaacaaaaaaccgcgacgaaaaacgaaaaaaccacgacgaacaaaaaacctaaacgaaataaaaaaaataaaccgcgacgacgaaaaaaaacaaaaaaccgcgacgacgacgaa

SEQ ID NO: 31483 - DNA, 937 bp, Artificial Sequence
  chemically treated genomic DNA (Homo sapiens) CpG-island No: 31483
ggattaggagtattttttagcgttgtttttgttaggacgttagtagagttggtagtcgagtttgtcgttttcgtttttagagtcgtggcggcggggataaaaattttcggcggcgggggtaaaacgtcgcggcggcgaaaaagtcgttgcggtagggggataaaaagtcgtgatagcggggcgtaaaaagtcgcggcgggtaaaaggtcgtggcgagtaaaaagtcgcgatggtaaaaagtcgcggcgggtaaaaagttacggcggcggtggggtaaaaagtagcggcggtggcggaggggtaaaaagtcgcggtagcgagggggtagaaagtcgcggcggtaaaaagttaaggcggcgagtgtgtaaaaagttgtgtcggcggtggggtaaaaagtcgcggcggtagaggggtaaaaagtcgcggcggcgggtgtgtggtagaaagtcgcggcgggtaaaaagtcgcggcggcgaggggggtataaattcgcggcgggtaaaaagtcgcggcggcgcggggtaaaaagtcgcggtgggtaagaagtcgaggcggggtgggggtaaaaagtcgcggcggcggggggtaaaaagttgtggcgggtaaaaggtcgcgggggtaggggggaaaagttacggcggggaaaaagtcgcggcggcgggggtgtaaaaagcggcggggggtaaaaagtcgaggtagggtgggggtaaaaagtcgcggcgggtgaaaagtcgcgggggtaggggggaaaaatttacggcgggaaaaagtcgtagcggcgatggggtaaaaagttacggcggcgggggtaaaaaggcgcggcgggtaaaaagtcgcggcggggggcggggaagttacggcgggtaaaaagtttaggcgggatggggggaataagtcgcggcggcgggggggggtaaaaagtcgcggcggcggcgga

SEQ ID NO: 31484 - DNA, 937 bp, Artificial Sequence
  chemically treated genomic DNA (Homo sapiens) CpG-island No: 31484
tccgccgccgccgcgactttttacccccccccgccgccgcgacttattccccccatcccgcctaaactttttacccgccgtaacttccccgccccccgccgcgactttttacccgccgcgcctttttacccccgccgccgtaactttttaccccatcgccgctacgactttttcccgccgtaaatttttcccccctacccccgcgacttttcacccgccgcgactttttacccccaccctacctcgactttttaccccccgccgctttttacacccccgccgccgcgactttttccccgccgtaacttttcccccctacccccgcgaccttttacccgccacaactttttaccccccgccgccgcgactttttacccccaccccgcctcgacttcttacccaccgcgactttttaccccgcgccgccgcgactttttacccgccgcgaatttatacccccctcgccgccgcgactttttacccgccgcgactttctaccacacacccgccgccgcgactttttacccctctaccgccgcgactttttaccccaccgccgacacaactttttacacactcgccgccttaactttttaccgccgcgactttctaccccctcgctaccgcgactttttacccctccgccaccgccgctactttttaccccaccgccgccgtaactttttacccgccgcgactttttaccatcgcgactttttactcgccacgaccttttacccgccgcgactttttacgccccgctatcacgactttttatccccctaccgcaacgactttttcgccgccgcgacgttttacccccgccgccgaaaatttttatccccgccgccacgactctaaaaacgaaaacgacaaactcgactaccaactctactaacgtcctaacaaaaacaacgctaaaaaatactcctaatcc

SEQ ID NO: 31485 - DNA, 901 bp, Artificial Sequence
  chemically treated genomic DNA (Homo sapiens) CpG-island No: 31485
taacgtcgaggttttttttattgtttaagttggtttttcggggtacgtttgcgtagtgggtaagttggaaaagcgtgtgggtgagattttcgtataatttttttttattgtttgtgtgtggcgtttgcgtagtaagggatcgttggaattgggtaggaggggatagggttcggtttttcgttttttttcgaggcgtttgcgtattaggtagtcggtttttgtcgttatcgttatgtgtggggcgtgtgtggaataacgttattgtttagcggagttgagggtttcggagttcgatcgtagcggtagcgacgataatagcggcgacgacgacgacgacgaggtggggggaggacggcgtgcgagagatttacgggacgcgacgcgtttcgtttttttcgttcggtttttttttttacggtaaggggtaagtgatgcgatcggttgttcggtgtaggcgtcgtagtcgtagttatcgtcgcggttgttttttatattttgtttttcgggtttgcggcgaggattcgggcgtcgttcgtcgcggggcggggggtgcggggttggatcgcgaagggggcgtttttcgggtgtttcgcgcggcgtcgttatttttattttttgttcgtttgggattcggggtttgacgggattatttttttttattttttattcgtcgtttttcggagttttagttttgcggtttttcggttttttcgagttttttgttgtcgttttcgtattttttaagtgtattgaattatttttagttttcgattggttttgtgtagttttttttttttcgtcgtagtagtttgcgaggggtgcgggcggagtattggagggaatggttgcgttgtcgttggggaagggattttttttttattggagtagtttttcgggttaa

SEQ ID NO: 31486 - DNA, 901 bp, Artificial Sequence
  chemically treated genomic DNA (Homo sapiens) CpG-island No: 31486
ttaacccgaaaaactactccaataaaaaaaaaatcccttccccaacgacaacgcaaccattccctccaatactccgcccgcacccctcgcaaactactacgacgaaaaaaaaaaaactacacaaaaccaatcgaaaactaaaaataattcaatacacttaaaaaatacgaaaacgacaacaaaaaactcgaaaaaaccgaaaaaccgcaaaactaaaactccgaaaaacgacgaataaaaaataaaaaaaaataatcccgtcaaaccccgaatcccaaacgaacaaaaaataaaaataacgacgccgcgcgaaacacccgaaaaacgcccccttcgcgatccaaccccgcaccccccgccccgcgacgaacgacgcccgaatcctcgccgcaaacccgaaaaacaaaatataaaaaacaaccgcgacgataactacgactacgacgcctacaccgaacaaccgatcgcatcacttaccccttaccgtaaaaaaaaaaaccgaacgaaaaaaacgaaacgcgtcgcgtcccgtaaatctctcgcacgccgtcctccccccacctcgtcgtcgtcgtcgtcgccgctattatcgtcgctaccgctacgatcgaactccgaaaccctcaactccgctaaacaataacgttattccacacacgccccacacataacgataacgacaaaaaccgactacctaatacgcaaacgcctcgaaaaaaaacgaaaaaccgaaccctatcccctcctacccaattccaacgatcccttactacgcaaacgccacacacaaacaataaaaaaaaattatacgaaaatctcacccacacgcttttccaacttacccactacgcaaacgtaccccgaaaaaccaacttaaacaataaaaaaaacctcgacgtta

SEQ ID NO: 31487 - DNA, 901 bp, Artificial Sequence
  chemically treated genomic DNA (Homo sapiens) CpG-island No: 31487
ttggttcggggagttgttttaatgggggaaaaattttttttttagcggtagcgtagttattttttttaatgtttcgttcgtatttttcgtaaattgttacggcggaggggggagggttgtataaagttagtcgaaagttgaaaatgatttaatgtatttaggggatgcggaggcggtagtaaggggttcgggaaagtcggggggtcgtaggattggagtttcggggggcggcgggtgggggatgggaaagggtggtttcgttaagtttcgggttttaggcgggtagagggtgggggtggcggcgtcgcgcggagtattcgggaagcgtttttttcgcggtttagtttcgtatttttcgtttcgcggcgggcggcgttcgagttttcgtcgtaaattcgaggagtaggatgtggaaagtagtcgcggcggtggttgcggttgcggcgtttatatcgagtagtcgatcgtattatttattttttatcgtggagagagggatcggacgggggaggcggggcgcgtcgcgtttcgtgagtttttcgtacgtcgttttttttttatttcgtcgtcgtcgtcgtcgtcgttgttgtcgtcgttgtcgttgcggtcgagtttcggggtttttagtttcgttgggtaataacgttattttatatacgttttatatatagcggtaacggtaaagatcgattgtttagtgcgtaggcgtttcgggaaagggcgaggagtcggattttatttttttttgtttagttttaacgattttttattgcgtaggcgttatatatagataatgaaaaggggttgtgcgagggttttatttatacgtttttttagtttgtttattgcgtaggcgtgtttcgaaagattagtttgaataatgaagaggatttcggcgtta

SEQ ID NO: 31488 - DNA, 901 bp, Artificial Sequence
  chemically treated genomic DNA (Homo sapiens) CpG-island No: 31488
taacgccgaaatcctcttcattattcaaactaatctttcgaaacacgcctacgcaataaacaaactaaaaaaacgtataaataaaaccctcgcacaaccccttttcattatctatatataacgcctacgcaataaaaaatcgttaaaactaaacaaaaaaaaataaaatccgactcctcgccctttcccgaaacgcctacgcactaaacaatcgatctttaccgttaccgctatatataaaacgtatataaaataacgttattacccaacgaaactaaaaaccccgaaactcgaccgcaacgacaacgacgacaacaacgacgacgacgacgacgacgaaataaaaaaaaaacgacgtacgaaaaactcacgaaacgcgacgcgccccgcctcccccgtccgatccctctctccacgataaaaaataaataatacgatcgactactcgatataaacgccgcaaccgcaaccaccgccgcgactactttccacatcctactcctcgaatttacgacgaaaactcgaacgccgcccgccgcgaaacgaaaaatacgaaactaaaccgcgaaaaaaacgcttcccgaatactccgcgcgacgccgccacccccaccctctacccgcctaaaacccgaaacttaacgaaaccaccctttcccatcccccacccgccgccccccgaaactccaatcctacgaccccccgactttcccgaaccccttactaccgcctccgcatcccctaaatacattaaatcattttcaactttcgactaactttatacaaccctcccccctccgccgtaacaatttacgaaaaatacgaacgaaacattaaaaaaaataactacgctaccgctaaaaaaaaaatttttcccccattaaaacaactccccgaaccaa

SEQ ID NO: 31489 - DNA, 1160 bp, Artificial Sequence
  chemically treated genomic DNA (Homo sapiens) CpG-island No: 31489
atcgagacgcgagttacgtagtcgttcgggcgggcgtttttagagatacgggcgatatttttttttgtgagaaagagtacgtgaattgttggtcggttgttatttacgtttagtacggcgatggatatacgtatcgcggtaattttatgttcggcgtttttatcgcgggtttttattattaattggtgttaggtttgtgtttttcggtttataggtgtttatatttttattacgtcgtttatgtttttttatcgcgaagtaggtcgcgtcgtttagtgtttcgtcgtcgttattcgttttaggtatttgtcgggcgcggacgttgtagcgtacgaagttattgggttttacgtcgcgggcggtggcgcgtacgcgatagatttcggcgttcggttgggcgtgttttcgtatcgcggcgcgggattcgttttgtttaaagatcggcgggttgtcgtttttatttagtacgcgtagttttacgtttaggaggtcggtgcgtcggggtcggtcgtcgttttatgtttcgatttgtagtcggtgcgtcgtcgttttttttcggtttaagcgtcgtagtagtattagatttagaggttttaggggtgacgaggagtttggtaaaagcggtgacggtagtggtttcggagttcggtagcgtaattggaagaacgggtttgcggggtttttgggtaggtcggacggttgtattagggtgtagttttgagtgttgaatagttcggcgttcggatcgtgggtaattggtaggcggaaggcggtttttggcgggttgagttcggagacgtcgagttgtagggagtcgaggggaaagcggggcgagtggttatttacgtcgttgacgcgaatttttatttgtattatagcgtttagtagcgtggcggcgacgaagttgtagtggtttcgtcgttcgcggtttaggcgtcgcgtagtgcggatgatgtcggtgttcgggtgtacgtggaagtcgtttagtagcggggagttatcggagtttttcgatagaaagaagtcgttttttttttgttgttgcgcggtcggtagttcggcgcggatgttatttattagcgtgttcgggggaagttttttatttacggaaagggtgaggttgaataattgggtagaggagttcgaggtcgtttatagtt

SEQ ID NO: 31490 - DNA, 1160 bp, Artificial Sequence
  chemically treated genomic DNA (Homo sapiens) CpG-island No: 31490
aactataaacgacctcgaactcctctacccaattattcaacctcaccctttccgtaaataaaaaacttcccccgaacacgctaataaataacatccgcgccgaactaccgaccgcgcaacaacaaaaaaaaaacgacttctttctatcgaaaaactccgataactccccgctactaaacgacttccacgtacacccgaacaccgacatcatccgcactacgcgacgcctaaaccgcgaacgacgaaaccactacaacttcgtcgccgccacgctactaaacgctataatacaaataaaaattcgcgtcaacgacgtaaataaccactcgccccgctttcccctcgactccctacaactcgacgtctccgaactcaacccgccaaaaaccgccttccgcctaccaattacccacgatccgaacgccgaactattcaacactcaaaactacaccctaatacaaccgtccgacctacccaaaaaccccgcaaacccgttcttccaattacgctaccgaactccgaaaccactaccgtcaccgcttttaccaaactcctcgtcacccctaaaacctctaaatctaatactactacgacgcttaaaccgaaaaaaaacgacgacgcaccgactacaaatcgaaacataaaacgacgaccgaccccgacgcaccgacctcctaaacgtaaaactacgcgtactaaataaaaacgacaacccgccgatctttaaacaaaacgaatcccgcgccgcgatacgaaaacacgcccaaccgaacgccgaaatctatcgcgtacgcgccaccgcccgcgacgtaaaacccaataacttcgtacgctacaacgtccgcgcccgacaaatacctaaaacgaataacgacgacgaaacactaaacgacgcgacctacttcgcgataaaaaaacataaacgacgtaataaaaatataaacacctataaaccgaaaaacacaaacctaacaccaattaataataaaaacccgcgataaaaacgccgaacataaaattaccgcgatacgtatatccatcgccgtactaaacgtaaataacaaccgaccaacaattcacgtactctttctcacaaaaaaaaatatcgcccgtatctctaaaaacgcccgcccgaacgactacgtaactcgcgtctcgat

SEQ ID NO: 31491 - DNA, 1160 bp, Artificial Sequence
  chemically treated genomic DNA (Homo sapiens) CpG-island No: 31491
ggttgtgggcggtttcgggtttttttgtttagttgtttaattttatttttttcgtagatgaggggtttttttcggatacgttggtaggtgatattcgcgtcgggttgtcggtcgcgtagtagtaggaggggagcggtttttttttgtcggaggatttcgatgatttttcgttgttggacgatttttacgtgtattcggatatcggtattattcgtattgcgcggcgtttggatcgcgagcggcgggattattatagtttcgtcgtcgttacgttgttgggcgttgtggtgtaggtggagattcgcgttaacgacgtgaatgattattcgtttcgtttttttttcgattttttgtaattcgacgttttcgagtttagttcgttagggatcgtttttcgtttgttagttgtttacgattcggacgtcggattgtttagtatttagggttatattttggtgtaatcgttcgatttgtttaaggatttcgtaggttcgtttttttagttgcgttatcggatttcggggttattatcgttatcgtttttgttaggtttttcgttatttttggagtttttagatttggtgttgttgcggcgtttggatcgagaggaggcggcggcgtatcggttgtagatcgaggtatgggacggcggtcgatttcggcgtatcggttttttgagcgtggagttgcgcgtgttggatgagaacgataattcgtcggtttttgagtaggacgagtttcgcgtcgcggtgcgagagtacgtttagtcgggcgtcgaggtttgtcgcgtgcgcgttatcgttcgcgacgtggggtttaatggtttcgtgcgttatagcgttcgcgttcggtaagtgtttggggcgggtagcggcggcggggtattgggcgacgcggtttatttcgcggtggaggagtatgagcggcgtggtgagagtgtggatatttgtggatcgagaggtataggtttggtattagttggtggtggaggttcgcgatggaggcgtcgagtatgaggttgtcgcggtgcgtgtgtttatcgtcgtgttggacgtgaatgataatcggttagtaatttacgtgtttttttttatagagggaggtgtcgttcgtgtttttgaaggcgttcgttcgggcgattacgtggttcgcgtttcggt

SEQ ID NO: 31492 - DNA, 1160 bp, Artificial Sequence
  chemically treated genomic DNA (Homo sapiens) CpG-island No: 31492
accgaaacgcgaaccacgtaatcgcccgaacgaacgccttcaaaaacacgaacgacacctccctctataaaaaaaaacacgtaaattactaaccgattatcattcacgtccaacacgacgataaacacacgcaccgcgacaacctcatactcgacgcctccatcgcgaacctccaccaccaactaataccaaacctatacctctcgatccacaaatatccacactctcaccacgccgctcatactcctccaccgcgaaataaaccgcgtcgcccaataccccgccgccgctacccgccccaaacacttaccgaacgcgaacgctataacgcacgaaaccattaaaccccacgtcgcgaacgataacgcgcacgcgacaaacctcgacgcccgactaaacgtactctcgcaccgcgacgcgaaactcgtcctactcaaaaaccgacgaattatcgttctcatccaacacgcgcaactccacgctcaaaaaaccgatacgccgaaatcgaccgccgtcccatacctcgatctacaaccgatacgccgccgcctcctctcgatccaaacgccgcaacaacaccaaatctaaaaactccaaaaataacgaaaaacctaacaaaaacgataacgataataaccccgaaatccgataacgcaactaaaaaaacgaacctacgaaatccttaaacaaatcgaacgattacaccaaaatataaccctaaatactaaacaatccgacgtccgaatcgtaaacaactaacaaacgaaaaacgatccctaacgaactaaactcgaaaacgtcgaattacaaaaaatcgaaaaaaaaacgaaacgaataatcattcacgtcgttaacgcgaatctccacctacaccacaacgcccaacaacgtaacgacgacgaaactataataatcccgccgctcgcgatccaaacgccgcgcaatacgaataataccgatatccgaatacacgtaaaaatcgtccaacaacgaaaaatcatcgaaatcctccgacaaaaaaaaaccgctcccctcctactactacgcgaccgacaacccgacgcgaatatcacctaccaacgtatccgaaaaaaacccctcatctacgaaaaaaataaaattaaacaactaaacaaaaaaacccgaaaccgcccacaacc

SEQ ID NO: 31493 - DNA, 784 bp, Artificial Sequence
  chemically treated genomic DNA (Homo sapiens) CpG-island No: 31493
cgcgttagatatcgagacgcgagttacgtagtcgttcggtcgggcgtttttagagatacgggcgacgtttttttttgtgagaaagagtacgtgaattgttggtcggttgttatttacgtttagtacggcgatggatacgcgtatcgtggtaattttaggttcggcgtttttatcgcgggtttttattattaattggtgttaggtttgtgtttcgcggtttagaggtttttatattcgtattacgtcgtttagtttttttatcgcgaagtaggtcgcgtcgtttagtgtttcgtcgtcgttattcgttttaggtatttgtcgggcgcggacgttgtagcgtacgaagttattgggttttaggtcgcggtcggtggcgcgtacgcgatagatttcggcgttcggttgggcgttttcgcgtatcgcggcgcggtattcgttttgtttaaagatcggcgggttgtcgtttttatttagtacgcgtagttttacgtttaggaggtcggtgcgtcggggtcggtcgtcgttttatgtttcgatttgtagtcggtgcgtcgtcgttttttttcggtttaagcgtcgtagtagtattagatttagaggttttaggggtgacgaggagtttggtaaaagcggtgacggtagtggtttcggagttcggtagcgtaattggaagaacgggtttgcggggtttttgggtaggtcggacggttgtattagggtgtagttttgagtgttgaatagttcggcgttcggatcgtgggtaattggtaggcggaaggcggtt

SEQ ID NO: 31494 - DNA, 784 bp, Artificial Sequence
  chemically treated genomic DNA (Homo sapiens) CpG-island No: 31494
aaccgccttccgcctaccaattacccacgatccgaacgccgaactattcaacactcaaaactacaccctaatacaaccgtccgacctacccaaaaaccccgcaaacccgttcttccaattacgctaccgaactccgaaaccactaccgtcaccgcttttaccaaactcctcgtcacccctaaaacctctaaatctaatactactacgacgcttaaaccgaaaaaaaacgacgacgcaccgactacaaatcgaaacataaaacgacgaccgaccccgacgcaccgacctcctaaacgtaaaactacgcgtactaaataaaaacgacaacccgccgatctttaaacaaaacgaataccgcgccgcgatacgcgaaaacgcccaaccgaacgccgaaatctatcgcgtacgcgccaccgaccgcgacctaaaacccaataacttcgtacgctacaacgtccgcgcccgacaaatacctaaaacgaataacgacgacgaaacactaaacgacgcgacctacttcgcgataaaaaaactaaacgacgtaatacgaatataaaaacctctaaaccgcgaaacacaaacctaacaccaattaataataaaaacccgcgataaaaacgccgaacctaaaattaccacgatacgcgtatccatcgccgtactaaacgtaaataacaaccgaccaacaattcacgtactctttctcacaaaaaaaaacgtcgcccgtatctctaaaaacgcccgaccgaacgactacgtaactcgcgtctcgatatctaacgcg

SEQ ID NO: 31495 - DNA, 784 bp, Artificial Sequence
  chemically treated genomic DNA (Homo sapiens) CpG-island No: 31495
gatcgtttttcgtttgttagttgtttacgattcggacgtcggattgtttagtatttagggttatattttggtgtaatcgttcgatttgtttaaggatttcgtaggttcgtttttttagttgcgttatcggatttcggggttattatcgttatcgtttttgttaggtttttcgttatttttggagtttttagatttggtgttgttgcggcgtttggatcgagaggaggcggcggcgtatcggttgtagatcgaggtatgggacggcggtcgatttcggcgtatcggttttttgagcgtggagttgcgcgtgttggatgagaacgataattcgtcggtttttgagtaggacgagtatcgcgtcgcggtgcgcgaggacgtttagtcgggcgtcgaggtttgtcgcgtgcgcgttatcgatcgcgatttggggtttaatggtttcgtgcgttatagcgttcgcgttcggtaagtgtttggggcgggtagcggcggcggggtattgggcgacgcggtttatttcgcggtggaggagttgagcggcgtggtgcgagtgtggagatttttggatcgcgaggtataggtttggtattagttggtggtggaggttcgcgatggaggcgtcgagtttgaggttgttacggtgcgcgtgtttatcgtcgtgttggacgtgaatgataatcggttagtaatttacgtgtttttttttatagagggaggcgtcgttcgtgtttttgaaggcgttcgatcgggcgattacgtggttcgcgtttcggtgtttgacgcg

SEQ ID NO: 31496 - DNA, 784 bp, Artificial Sequence
  chemically treated genomic DNA (Homo sapiens) CpG-island No: 31496
cgcgtcaaacaccgaaacgcgaaccacgtaatcgcccgatcgaacgccttcaaaaacacgaacgacgcctccctctataaaaaaaaacacgtaaattactaaccgattatcattcacgtccaacacgacgataaacacgcgcaccgtaacaacctcaaactcgacgcctccatcgcgaacctccaccaccaactaataccaaacctatacctcgcgatccaaaaatctccacactcgcaccacgccgctcaactcctccaccgcgaaataaaccgcgtcgcccaataccccgccgccgctacccgccccaaacacttaccgaacgcgaacgctataacgcacgaaaccattaaaccccaaatcgcgatcgataacgcgcacgcgacaaacctcgacgcccgactaaacgtcctcgcgcaccgcgacgcgatactcgtcctactcaaaaaccgacgaattatcgttctcatccaacacgcgcaactccacgctcaaaaaaccgatacgccgaaatcgaccgccgtcccatacctcgatctacaaccgatacgccgccgcctcctctcgatccaaacgccgcaacaacaccaaatctaaaaactccaaaaataacgaaaaacctaacaaaaacgataacgataataaccccgaaatccgataacgcaactaaaaaaacgaacctacgaaatccttaaacaaatcgaacgattacaccaaaatataaccctaaatactaaacaatccgacgtccgaatcgtaaacaactaacaaacgaaaaacgatc

SEQ ID NO: 31497 - DNA, 729 bp, Artificial Sequence
  chemically treated genomic DNA (Homo sapiens) CpG-island No: 31497
agattaggcgtttgtttttcgtcggagatttagagcgttattaggtttcgggagtttcgaagttcggggaaagtcggagtagtagcgttatttttgtttcgtagttcgttcgcggggggtcggcggtagttagaagtcgtagtttttcggtttaggcgcggtttttttagttttcgggtcggtcggtaggggcgttttggggtagcgttattcgttttttttttacgcgtcgttcgtaaattcggtttaagttttcgcgttcgtcgagcgggcgagtttttatttgtagagcgttaggattttcgtcgtcgttattttaggcggttttcgcgttcgtattttttagcgttttttaggtcgcgggttttagttcgatcgggttttgcgcgggaagtcgtagtgagtattaagttcggagtaatttttttagttgtcgttcgcgtcgtcgttgggcgtcgtttgcggtttcgggcggggcgggttgggggcggggcgggggcggggcgattcgtagggttggggaagagttcggtttcgtttttgggagtttgcgtttttgtgggtagcgggtgcggagggttcgcgtggggttagttcgttaggagcgggttgcgggcgttgtgtatcgttcgtaatcgttacgttttacgaattagtgttcggcgggttcgttacgcgtttttagtcgtttttttagatcgtttatttattgttatttgttgcgatgtg

SEQ ID NO: 31498 - DNA, 729 bp, Artificial Sequence
  chemically treated genomic DNA (Homo sapiens) CpG-island No: 31498
cacatcgcaacaaataacaataaataaacgatctaaaaaaacgactaaaaacgcgtaacgaacccgccgaacactaattcgtaaaacgtaacgattacgaacgatacacaacgcccgcaacccgctcctaacgaactaaccccacgcgaaccctccgcacccgctacccacaaaaacgcaaactcccaaaaacgaaaccgaactcttccccaaccctacgaatcgccccgcccccgccccgcccccaacccgccccgcccgaaaccgcaaacgacgcccaacgacgacgcgaacgacaactaaaaaaattactccgaacttaatactcactacgacttcccgcgcaaaacccgatcgaactaaaacccgcgacctaaaaaacgctaaaaaatacgaacgcgaaaaccgcctaaaataacgacgacgaaaatcctaacgctctacaaataaaaactcgcccgctcgacgaacgcgaaaacttaaaccgaatttacgaacgacgcgtaaaaaaaaaacgaataacgctaccccaaaacgcccctaccgaccgacccgaaaactaaaaaaaccgcgcctaaaccgaaaaactacgacttctaactaccgccgaccccccgcgaacgaactacgaaacaaaaataacgctactactccgactttccccgaacttcgaaactcccgaaacctaataacgctctaaatctccgacgaaaaacaaacgcctaatct

SEQ ID NO: 31499 - DNA, 729 bp, Artificial Sequence
  chemically treated genomic DNA (Homo sapiens) CpG-island No: 31499
tatatcgtagtaagtggtagtgaatgaacgatttaagggagcgattgagggcgcgtgacgggttcgtcgggtattggttcgtggagcgtggcggttacgggcggtgtatagcgttcgtagttcgtttttagcgagttggttttacgcgggtttttcgtattcgttgtttataggagcgtaggtttttagaggcggggtcgggtttttttttaattttgcgagtcgtttcgttttcgtttcgtttttagttcgtttcgttcgggatcgtagacggcgtttagcggcggcgcgaacggtagttaggagggttgtttcgggtttggtgtttattgcgatttttcgcgtagggttcggtcggattaggattcgcggtttgagagacgttggaggatgcggacgcggaggtcgtttggggtagcggcggcgggagttttggcgttttgtaggtaggagttcgttcgttcggcgggcgcggaaatttgggtcgagtttgcgggcggcgcgtggagaaggggcgggtggcgttgttttagggcgtttttatcggtcggttcggggattgagggagtcgcgtttgggtcgaggggttgcggtttttggttgtcgtcggtttttcgcgaacgggttgcggggtaggggtggcgttgttgtttcgatttttttcggatttcgaggttttcgggatttggtagcgttttgggttttcggcggagaataggcgtttaattt

SEQ ID NO: 31500 - DNA, 729 bp, Artificial Sequence
  chemically treated genomic DNA (Homo sapiens) CpG-island No: 31500
aaattaaacgcctattctccgccgaaaacccaaaacgctaccaaatcccgaaaacctcgaaatccgaaaaaaatcgaaacaacaacgccacccctaccccgcaacccgttcgcgaaaaaccgacgacaaccaaaaaccgcaacccctcgacccaaacgcgactccctcaatccccgaaccgaccgataaaaacgccctaaaacaacgccacccgccccttctccacgcgccgcccgcaaactcgacccaaatttccgcgcccgccgaacgaacgaactcctacctacaaaacgccaaaactcccgccgccgctaccccaaacgacctccgcgtccgcatcctccaacgtctctcaaaccgcgaatcctaatccgaccgaaccctacgcgaaaaatcgcaataaacaccaaacccgaaacaaccctcctaactaccgttcgcgccgccgctaaacgccgtctacgatcccgaacgaaacgaactaaaaacgaaacgaaaacgaaacgactcgcaaaattaaaaaaaaacccgaccccgcctctaaaaacctacgctcctataaacaacgaatacgaaaaacccgcgtaaaaccaactcgctaaaaacgaactacgaacgctatacaccgcccgtaaccgccacgctccacgaaccaatacccgacgaacccgtcacgcgccctcaatcgctcccttaaatcgttcattcactaccacttactacgatata

SEQ ID NO: 31501 - DNA, 560 bp, Artificial Sequence
  chemically treated genomic DNA (Homo sapiens) CpG-island No: 31501
tttgcgtttatcggtcgggggttttcgtaggttgaggcgtacgtttaggtattttattttcgagaagatagttagggtcgcggtgttggtcgaggcgcgggggtaggtgttcgggttttaggcggcggtggcgcgtttttgggtttttaggcgtagcgcgcgtagggttatcggttcggacgtttttagtagtacgtgttcggttattgtttcgtcgttggaatagtagtttttgcgttcgttttcgaatattagatttaggttttttacgcggttttcggtatttacggtcgtcgcgtatttagttttttcgtttatttcgtcgggcgatttttttttgtttttgaggtcggtagaggttcggagtcggggtcgcgagtatagcggcgtcgttgttataggcgttcgcggtagggtaaggtcgtcgcggtagtcgtgcggtattcgatggggtatcggttcgtcgagaggtttgtcgttttaataaatttagttgggtttggaaaagggtcgggatagtttattttcggcgggcggttattggttagttgcgagttttg

SEQ ID NO: 31502 - DNA, 560 bp, Artificial Sequence
  chemically treated genomic DNA (Homo sapiens) CpG-island No: 31502
caaaactcgcaactaaccaataaccgcccgccgaaaataaactatcccgacccttttccaaacccaactaaatttattaaaacgacaaacctctcgacgaaccgataccccatcgaataccgcacgactaccgcgacgaccttaccctaccgcgaacgcctataacaacgacgccgctatactcgcgaccccgactccgaacctctaccgacctcaaaaacaaaaaaaaatcgcccgacgaaataaacgaaaaaactaaatacgcgacgaccgtaaataccgaaaaccgcgtaaaaaacctaaatctaatattcgaaaacgaacgcaaaaactactattccaacgacgaaacaataaccgaacacgtactactaaaaacgtccgaaccgataaccctacgcgcgctacgcctaaaaacccaaaaacgcgccaccgccgcctaaaacccgaacacctacccccgcgcctcgaccaacaccgcgaccctaactatcttctcgaaaataaaatacctaaacgtacgcctcaacctacgaaaacccccgaccgataaacgcaaa

SEQ ID NO: 31503 - DNA, 560 bp, Artificial Sequence
  chemically treated genomic DNA (Homo sapiens) CpG-island No: 31503
tagggttcgtagttgattaatggtcgttcgtcgggggtgggttgtttcggtttttttttaggtttaattgggtttgttaaagcgataggtttttcggcgagtcggtgttttatcgggtatcgtacggttgtcgcggcggttttattttgtcgcgagcgtttgtgatagcggcgtcgttgtgttcgcgatttcggtttcgggtttttgtcgattttaggggtaggaaagagtcgttcggcgggatgggcggggaggttgggtgcgcggcggtcgtgggtgtcgagggtcgcgtgaagagtttgggtttggtgttcgaggacgagcgtaagggttgttattttagcggcgagatagtggtcgggtacgtgttgttggaggcgttcgagtcggtggttttgcgcgcgttgcgtttggaggtttaggggcgcgttatcgtcgtttggggttcgagtatttgttttcgcgtttcggttagtatcgcggttttggttgttttttcggaggtggagtatttgaacgtgcgttttagtttgcgggagttttcggtcggtaagcgtagg

SEQ ID NO: 31504 - DNA, 560 bp, Artificial Sequence
  chemically treated genomic DNA (Homo sapiens) CpG-island No: 31504
cctacgcttaccgaccgaaaactcccgcaaactaaaacgcacgttcaaatactccacctccgaaaaaacaaccaaaaccgcgatactaaccgaaacgcgaaaacaaatactcgaaccccaaacgacgataacgcgcccctaaacctccaaacgcaacgcgcgcaaaaccaccgactcgaacgcctccaacaacacgtacccgaccactatctcgccgctaaaataacaacccttacgctcgtcctcgaacaccaaacccaaactcttcacgcgaccctcgacacccacgaccgccgcgcacccaacctccccgcccatcccgccgaacgactctttcctacccctaaaatcgacaaaaacccgaaaccgaaatcgcgaacacaacgacgccgctatcacaaacgctcgcgacaaaataaaaccgccgcgacaaccgtacgatacccgataaaacaccgactcgccgaaaaacctatcgctttaacaaacccaattaaacctaaaaaaaaaccgaaacaacccacccccgacgaacgaccattaatcaactacgaacccta

SEQ ID NO: 31505 - DNA, 786 bp, Artificial Sequence
  chemically treated genomic DNA (Homo sapiens) CpG-island No: 31505
tcgcgacgaatttcggttgtagaagaggaagagtattatttgtagttcgcggcgtgggaaacgtcgtcggaggggtttcgcgagtcggggaagtgcgcgtagcggggttttaggcggttttaggcgttgagtgcgaggaacgttcgcgttcgtcggcgttcgggagacgtagtcgaaggaggagggcgggcgttttattcgcgttatagttgcggtcggttagagagatcgtagaggtcgggattttcgtagtttttacggtcgttgttgttattgtcggggtggcgcgtttagtcggagaatttcgttcgcgttcggggttgggggcgaggcggggcgttgacgttatttttttttttttatcgtttttaagggggagggagtggggaaagaggtagcgagtcgtcgtagtcgtcggtcgtaattttttaattcggcggttggttgtttgggtacgttttgataaatttggttgttttcgggttttcgtttcggtttcgcgtatttttttttcgtttgcgtttggtgtttaagtttgttttggtcggaagttttcggagatgcggtcgtttgggtttcggcggtacggacgttggtattttggttagggatatgttgaagatttcggggaggtaaagttggtattttaaattcggtttttaatatatatttatatcgcgaggggattacggagttgtcgaggattttagagtttagggtcgaggattcggttagattggtgagttttttgtttaaatcgtgtatgttttttggtatttaagttta

SEQ ID NO: 31506 - DNA, 786 bp, Artificial Sequence
  chemically treated genomic DNA (Homo sapiens) CpG-island No: 31506
taaacttaaataccaaaaaacatacacgatttaaacaaaaaactcaccaatctaaccgaatcctcgaccctaaactctaaaatcctcgacaactccgtaatcccctcgcgatataaatatatattaaaaaccgaatttaaaataccaactttacctccccgaaatcttcaacatatccctaaccaaaataccaacgtccgtaccgccgaaacccaaacgaccgcatctccgaaaacttccgaccaaaacaaacttaaacaccaaacgcaaacgaaaaaaaaatacgcgaaaccgaaacgaaaacccgaaaacaaccaaatttatcaaaacgtacccaaacaaccaaccgccgaattaaaaaattacgaccgacgactacgacgactcgctacctctttccccactccctcccccttaaaaacgataaaaaaaaaaaaataacgtcaacgccccgcctcgcccccaaccccgaacgcgaacgaaattctccgactaaacgcgccaccccgacaataacaacaacgaccgtaaaaactacgaaaatcccgacctctacgatctctctaaccgaccgcaactataacgcgaataaaacgcccgccctcctccttcgactacgtctcccgaacgccgacgaacgcgaacgttcctcgcactcaacgcctaaaaccgcctaaaaccccgctacgcgcacttccccgactcgcgaaacccctccgacgacgtttcccacgccgcgaactacaaataatactcttcctcttctacaaccgaaattcgtcgcga

SEQ ID NO: 31507 - DNA, 786 bp, Artificial Sequence
  chemically treated genomic DNA (Homo sapiens) CpG-island No: 31507
taaatttaaatgttaaaaggtatgtacgatttgaataaagaatttattagtttagtcgagttttcggttttgggttttaaagttttcggtagtttcgtgattttttcgcggtgtagatatgtgttaagagtcgggtttgaagtattaattttgttttttcgggatttttagtatgtttttaattagagtgttaacgttcgtgtcgtcgggatttaggcggtcgtattttcggaggttttcgattagggtaaatttaagtattaaacgtaggcgaaaagagagtgcgcggggtcggaacgagggttcgggagtagttaagtttgttaggacgtgtttaggtagttagtcgtcgagttgaggagttgcggtcggcggttgcggcgattcgttgtttttttttttatttttttttttttggaggcggtgggggaggggaggtgacgttagcgtttcgtttcgtttttagtttcgggcgcggacgggatttttcggttgggcgcgttatttcgatagtggtagtagcggtcgtggaggttgcgggggtttcggtttttgcggtttttttggtcggtcgtagttgtggcgcgggtgaaacgttcgtttttttttttcggttgcgtttttcgggcgtcggcgagcgcgggcgtttttcgtatttagcgtttggagtcgtttggagtttcgttgcgcgtattttttcggttcgcggagttttttcggcggcgttttttacgtcgcggattgtaggtgatgtttttttttttttgtagtcgaaattcgtcgcga

SEQ ID NO: 31508 - DNA, 786 bp, Artificial Sequence
  chemically treated genomic DNA (Homo sapiens) CpG-island No: 31508
tcgcgacgaatttcgactacaaaaaaaaaaaaacatcacctacaatccgcgacgtaaaaaacgccgccgaaaaaactccgcgaaccgaaaaaatacgcgcaacgaaactccaaacgactccaaacgctaaatacgaaaaacgcccgcgctcgccgacgcccgaaaaacgcaaccgaaaaaaaaaaacgaacgtttcacccgcgccacaactacgaccgaccaaaaaaaccgcaaaaaccgaaacccccgcaacctccacgaccgctactaccactatcgaaataacgcgcccaaccgaaaaatcccgtccgcgcccgaaactaaaaacgaaacgaaacgctaacgtcacctcccctcccccaccgcctccaaaaaaaaaaaaataaaaaaaaaaacaacgaatcgccgcaaccgccgaccgcaactcctcaactcgacgactaactacctaaacacgtcctaacaaacttaactactcccgaaccctcgttccgaccccgcgcactctcttttcgcctacgtttaatacttaaatttaccctaatcgaaaacctccgaaaatacgaccgcctaaatcccgacgacacgaacgttaacactctaattaaaaacatactaaaaatcccgaaaaaacaaaattaatacttcaaacccgactcttaacacatatctacaccgcgaaaaaatcacgaaactaccgaaaactttaaaacccaaaaccgaaaactcgactaaactaataaattctttattcaaatcgtacataccttttaacatttaaattta

SEQ ID NO: 31509 - DNA, 1005 bp, Artificial Sequence
  chemically treated genomic DNA (Homo sapiens) CpG-island No: 31509
tataagtttcgttttgtttttcggagtcgcgttagatttcgttgggcgttttttcgttttttagtacggatttggtgttcgtagggattggggttttttgggttcgggcgggattgcgtggtcgaattcgcgggtttagagtcggtagtcggggaaagtgggttcgagttttcgcgttcgagaaacgagcgtcggcgtcggcgggcggggtcggggcggagggattttttgcgttcggggagcgtgaggcgtcggcgtcgagttgggcggtcgggcgcggggagagggcgcggggagagggcgcgggagcggttcgcgcggtaggtattatgcggacgcgcgagttcggcgagggtttcggtaggttcggtttttgttcgggggcgcgttgagacggcgggtgagttttacgagagcgtcgtcgttatttcgggttaattttgcggttagttcgttggggcgcgggtcggcgggcgggggcgagagcgtgtagcgcgttgcggtgcggattttgtgggtgttcgttcggttttcggttcgggtttcggcgttgtcgaaaacggatgagcgcgcgatttttcggagggtggagtgattcggttttttttaattgggaaatttagtattggttaggggggtttcggcggcggagcgggaaaaggaggcgatcgcgcgggatcgattcggggttattgttggggttcgattttttttgatacgtcgtttttttttcgggagttcgtcgggttgcgtcggtttcgcggttttttggggtatttcgtcgtttgcgaaagattcgttcgttgagcggtgtacgcgggaggtttgcgcggggttgtcgggtttttgggtttttgggtgtttgcgttttgtaggagcgttgttcggaggtgtagatgtaatcggtggattgcggagtgaagggttgcgaggttgtatttcggggttgaatatttgtataatgtgcggtttgttagtgttttttgttttttttggaggaggaat

SEQ ID NO: 31510 - DNA, 1005 bp, Artificial Sequence
  chemically treated genomic DNA (Homo sapiens) CpG-island No: 31510
attcctcctccaaaaaaaacaaaaaacactaacaaaccgcacattatacaaatattcaaccccgaaatacaacctcgcaacccttcactccgcaatccaccgattacatctacacctccgaacaacgctcctacaaaacgcaaacacccaaaaacccaaaaacccgacaaccccgcgcaaacctcccgcgtacaccgctcaacgaacgaatctttcgcaaacgacgaaataccccaaaaaaccgcgaaaccgacgcaacccgacgaactcccgaaaaaaaaacgacgtatcaaaaaaaatcgaaccccaacaataaccccgaatcgatcccgcgcgatcgcctccttttcccgctccgccgccgaaacccccctaaccaatactaaatttcccaattaaaaaaaaccgaatcactccaccctccgaaaaatcgcgcgctcatccgttttcgacaacgccgaaacccgaaccgaaaaccgaacgaacacccacaaaatccgcaccgcaacgcgctacacgctctcgcccccgcccgccgacccgcgccccaacgaactaaccgcaaaattaacccgaaataacgacgacgctctcgtaaaactcacccgccgtctcaacgcgcccccgaacaaaaaccgaacctaccgaaaccctcgccgaactcgcgcgtccgcataatacctaccgcgcgaaccgctcccgcgccctctccccgcgccctctccccgcgcccgaccgcccaactcgacgccgacgcctcacgctccccgaacgcaaaaaatccctccgccccgaccccgcccgccgacgccgacgctcgtttctcgaacgcgaaaactcgaacccactttccccgactaccgactctaaacccgcgaattcgaccacgcaatcccgcccgaacccaaaaaaccccaatccctacgaacaccaaatccgtactaaaaaacgaaaaaacgcccaacgaaatctaacgcgactccgaaaaacaaaacgaaacttata

SEQ ID NO: 31511 - DNA, 1005 bp, Artificial Sequence
  chemically treated genomic DNA (Homo sapiens) CpG-island No: 31511
gttttttttttagagaagatagaaaatattgataaatcgtatattgtgtagatgtttagtttcgaaatgtagtttcgtagttttttatttcgtagtttatcggttgtatttgtattttcgggtagcgtttttgtagggcgtaaatatttagagatttagggattcggtagtttcgcgtaggtttttcgcgtgtatcgtttagcgagcgggtttttcgtagacggcgggatgttttaggagatcgcgaggtcggcgtagttcggcgagttttcggagggaaggcggcgtgttagaaaggatcggattttagtaatggtttcggatcggtttcgcgcggtcgtttttttttttcgtttcgtcgtcgggatttttttagttagtgttgaattttttaattgggaaggatcgagttattttatttttcgggaagtcgcgcgtttattcgttttcggtagcgtcggagttcgagtcggggatcgggcggatatttatagagttcgtatcgtagcgcgttgtacgttttcgttttcgttcgtcggttcgcgttttagcgaattaatcgtaaagttggttcgaagtggcgacggcgttttcgtggagtttattcgtcgttttagcgcgttttcgagtagggatcgggtttgtcggggttttcgtcgggttcgcgcgttcgtatggtatttgtcgcgcgagtcgttttcgcgtttttttttcgcgtttttttttcgcgttcggtcgtttagttcggcgtcggcgttttacgtttttcgagcgtaggagattttttcgtttcggtttcgttcgtcggcgtcggcgttcgtttttcgggcgcggaaattcgagtttatttttttcggttgtcggttttgggttcgcgggttcggttacgtagtttcgttcggatttaaagagttttagtttttgcgaatattaggttcgtgttgggagacgagaaggcgtttagcggggtttagcgcggtttcgaggggtagggcgaggtttgtg

SEQ ID NO: 31512 - DNA, 1005 bp, Artificial Sequence
  chemically treated genomic DNA (Homo sapiens) CpG-island No: 31512
cacaaacctcgccctacccctcgaaaccgcgctaaaccccgctaaacgccttctcgtctcccaacacgaacctaatattcgcaaaaactaaaactctttaaatccgaacgaaactacgtaaccgaacccgcgaacccaaaaccgacaaccgaaaaaaataaactcgaatttccgcgcccgaaaaacgaacgccgacgccgacgaacgaaaccgaaacgaaaaaatctcctacgctcgaaaaacgtaaaacgccgacgccgaactaaacgaccgaacgcgaaaaaaaaacgcgaaaaaaaaacgcgaaaacgactcgcgcgacaaataccatacgaacgcgcgaacccgacgaaaaccccgacaaacccgatccctactcgaaaacgcgctaaaacgacgaataaactccacgaaaacgccgtcgccacttcgaaccaactttacgattaattcgctaaaacgcgaaccgacgaacgaaaacgaaaacgtacaacgcgctacgatacgaactctataaatatccgcccgatccccgactcgaactccgacgctaccgaaaacgaataaacgcgcgacttcccgaaaaataaaataactcgatccttcccaattaaaaaattcaacactaactaaaaaaatcccgacgacgaaacgaaaaaaaaaaacgaccgcgcgaaaccgatccgaaaccattactaaaatccgatcctttctaacacgccgccttccctccgaaaactcgccgaactacgccgacctcgcgatctcctaaaacatcccgccgtctacgaaaaacccgctcgctaaacgatacacgcgaaaaacctacgcgaaactaccgaatccctaaatctctaaatatttacgccctacaaaaacgctacccgaaaatacaaatacaaccgataaactacgaaataaaaaactacgaaactacatttcgaaactaaacatctacacaatatacgatttatcaatattttctatcttctctaaaaaaaaaac

SEQ ID NO: 31513 - DNA, 520 bp, Artificial Sequence
  chemically treated genomic DNA (Homo sapiens) CpG-island No: 31513
tgattcggttttatttagagtattcgagcgcgttttattttcgttcggcgtcgtcgacgtttcgtttgattggaaattcgaaattcgcgggtgttaggttcgggttttattattgtttcgtcgtcggtaagttagggttagcgttaaggggattttatttcggtcggggggattttttcgtttaaagaagggaagattttgtcggtattattgagaggcgtgtttttttttggttgtcgttcgagtatcgagagttttagttcgtttattggttgtgagggttgggttaggtttatgtgtcggtagggaaagtttgagcggtttcgcgggaggttatagcgtcggcgagtcgagcgattttttcgttttatattttatttattgggcggggcgtcgcggatttcgggcggcgggagcggatcggagcggataggaggggtaattgtgagtggcggttattttttggatttcgcggggtagagtatttgaggtcgtgtcggagtgggttttagagtcgaag

SEQ ID NO: 31514 - DNA, 520 bp, Artificial Sequence
  chemically treated genomic DNA (Homo sapiens) CpG-island No: 31514
cttcgactctaaaacccactccgacacgacctcaaatactctaccccgcgaaatccaaaaaataaccgccactcacaattacccctcctatccgctccgatccgctcccgccgcccgaaatccgcgacgccccgcccaataaataaaatataaaacgaaaaaatcgctcgactcgccgacgctataacctcccgcgaaaccgctcaaactttccctaccgacacataaacctaacccaaccctcacaaccaataaacgaactaaaactctcgatactcgaacgacaaccaaaaaaaaacacgcctctcaataataccgacaaaatcttcccttctttaaacgaaaaaatccccccgaccgaaataaaatccccttaacgctaaccctaacttaccgacgacgaaacaataataaaacccgaacctaacacccgcgaatttcgaatttccaatcaaacgaaacgtcgacgacgccgaacgaaaataaaacgcgctcgaatactctaaataaaaccgaatca

SEQ ID NO: 31515 - DNA, 520 bp, Artificial Sequence
  chemically treated genomic DNA (Homo sapiens) CpG-island No: 31515
tttcggttttggagtttatttcggtacggttttaggtgttttatttcgcgggatttagggagtggtcgttatttatagttgttttttttgttcgtttcggttcgttttcgtcgttcgaggttcgcgacgtttcgtttagtgggtggagtgtgaggcggggaggtcgttcgattcgtcggcgttgtggtttttcgcggagtcgtttagattttttttgtcggtatatggatttggtttaatttttatagttagtagacgagttggagttttcggtgttcgagcggtagttagaagagaatacgttttttaatggtgtcgataaggtttttttttttttggacgaggaggttttttcggtcgaggtaaggtttttttggcgttggttttaatttgtcggcggcgggatagtagtaggattcgggtttggtattcgcgagtttcgggtttttagttaggcggggcgtcgacggcgtcgagcgagggtggggcgcgttcgagtgttttgaatggagtcgagtta

SEQ ID NO: 31516 - DNA, 520 bp, Artificial Sequence
  chemically treated genomic DNA (Homo sapiens) CpG-island No: 31516
taactcgactccattcaaaacactcgaacgcgccccaccctcgctcgacgccgtcgacgccccgcctaactaaaaacccgaaactcgcgaataccaaacccgaatcctactactatcccgccgccgacaaattaaaaccaacgccaaaaaaaccttacctcgaccgaaaaaacctcctcgtccaaaaaaaaaaaaaccttatcgacaccattaaaaaacgtattctcttctaactaccgctcgaacaccgaaaactccaactcgtctactaactataaaaattaaaccaaatccatataccgacaaaaaaaatctaaacgactccgcgaaaaaccacaacgccgacgaatcgaacgacctccccgcctcacactccacccactaaacgaaacgtcgcgaacctcgaacgacgaaaacgaaccgaaacgaacaaaaaaaacaactataaataacgaccactccctaaatcccgcgaaataaaacacctaaaaccgtaccgaaataaactccaaaaccgaaa

SEQ ID NO: 31517 - DNA, 952 bp, Artificial Sequence
  chemically treated genomic DNA (Homo sapiens) CpG-island No: 31517
gattcggtcgtcgggtttttcgttaaggtgttcgagggcgtggcgggcgcgtttaacgaggtagtattgttggcgttgatggagcgtacgggttatagtatggtgtaagagaacgggtagcgtaagtacggcggtttatcgttcggttgggagggttcgtattcgtagcgtggttgcgaggttttcgtgggtaagatttcgcgcgacgtgtacgaggacgagttggtgttcgtgttcgaggtcgtgggtcgtatttacgagttgcgttttatgatggattttgacggtaagaatcgcggttacgttttcgttatgtattgttataagtacgaggttaagcgcgtagtgcgtgagtttaataattacgagattcgttcgggtcgtttgttcggcgtgtgttgtagcgtggataattgtcgtttttttatcggcgggatttttaagatgaagaagcgcgaggaaattttggaggagattgttaaggttatcgagggcgtgttggacgtgatcgtttacgttagcgcggtcgataagatgaagaatcgcggtttcgttttcgtggagtacgagagttatcgcgcggttgttatggttcgtcgtaagtttatgtttggtcgtatttagttgtggggttattagatcgtcgtggattgggtcgaatttgagatcgacgtggacgaggacgtgatggagatcgtgaagattttttacgtgcgtaattttatgatcgagattatcgaggatattattaagaagagtttcggttagtttaatttcggttgcgtggagcgcgttaagaagattcgcgattacgttttcgtgtattttattagtcgcgaggatgtcgtgtatgttatgaataattttaacggtattgagttggagggttcgtgtttggaggttacgttggttaagttcgtggataaggagtagtattcgcgttattagaagg

SEQ ID NO: 31518 - DNA, 952 bp, Artificial Sequence
  chemically treated genomic DNA (Homo sapiens) CpG-island No: 31518
ccttctaataacgcgaatactactccttatccacgaacttaaccaacgtaacctccaaacacgaaccctccaactcaataccgttaaaattattcataacatacacgacatcctcgcgactaataaaatacacgaaaacgtaatcgcgaatcttcttaacgcgctccacgcaaccgaaattaaactaaccgaaactcttcttaataatatcctcgataatctcgatcataaaattacgcacgtaaaaaatcttcacgatctccatcacgtcctcgtccacgtcgatctcaaattcgacccaatccacgacgatctaataaccccacaactaaatacgaccaaacataaacttacgacgaaccataacaaccgcgcgataactctcgtactccacgaaaacgaaaccgcgattcttcatcttatcgaccgcgctaacgtaaacgatcacgtccaacacgccctcgataaccttaacaatctcctccaaaatttcctcgcgcttcttcatcttaaaaatcccgccgataaaaaaacgacaattatccacgctacaacacacgccgaacaaacgacccgaacgaatctcgtaattattaaactcacgcactacgcgcttaacctcgtacttataacaatacataacgaaaacgtaaccgcgattcttaccgtcaaaatccatcataaaacgcaactcgtaaatacgacccacgacctcgaacacgaacaccaactcgtcctcgtacacgtcgcgcgaaatcttacccacgaaaacctcgcaaccacgctacgaatacgaaccctcccaaccgaacgataaaccgccgtacttacgctacccgttctcttacaccatactataacccgtacgctccatcaacgccaacaatactacctcgttaaacgcgcccgccacgccctcgaacaccttaacgaaaaacccgacgaccgaatc

SEQ ID NO: 31519 - DNA, 952 bp, Artificial Sequence
  chemically treated genomic DNA (Homo sapiens) CpG-island No: 31519
ttttttggtagcgcgagtattgttttttgtttacgggtttggttagcgtgatttttaggtacgagttttttagtttagtgtcgttgaggttgtttatggtatgtacggtattttcgcggttggtgaagtgtacgaaggcgtagtcgcggatttttttgacgcgttttacgtagtcggggttgaattggtcgaagttttttttgatggtgttttcggtggtttcgattatgaggttgcgtacgtagaggatttttacggtttttattacgttttcgtttacgtcgattttaggttcggtttagtttacggcgatttggtggttttatagttggatgcggttaggtatgagtttgcggcgagttatggtagtcgcgcggtggttttcgtattttacgaaggcgaagtcgcggttttttattttgtcggtcgcgttggcgtagacgattacgtttagtacgttttcggtgattttggtaattttttttaggattttttcgcgtttttttattttggggatttcgtcgatgaagaggcggtagttgtttacgttgtagtatacgtcgagtaggcggttcgggcggatttcgtagttgttgagtttacgtattgcgcgtttggtttcgtgtttgtggtagtatatgacgaaggcgtagtcgcggtttttgtcgttaaagtttattatgaggcgtagttcgtagatgcggtttacggtttcgaatacgggtattagttcgttttcgtatacgtcgcgcgggattttgtttacgaagatttcgtagttacgttgcgggtgcgggtttttttagtcgggcggtgggtcgtcgtatttgcgttgttcgtttttttgtattatgttgtagttcgtgcgttttattagcgttagtagtgttgtttcgttgggcgcgttcgttacgttttcgggtattttggcggaggattcggcggtcgagtt

SEQ ID NO: 31520 - DNA, 952 bp, Artificial Sequence
  chemically treated genomic DNA (Homo sapiens) CpG-island No: 31520
aactcgaccgccgaatcctccgccaaaatacccgaaaacgtaacgaacgcgcccaacgaaacaacactactaacgctaataaaacgcacgaactacaacataatacaaaaaaacgaacaacgcaaatacgacgacccaccgcccgactaaaaaaacccgcacccgcaacgtaactacgaaatcttcgtaaacaaaatcccgcgcgacgtatacgaaaacgaactaatacccgtattcgaaaccgtaaaccgcatctacgaactacgcctcataataaactttaacgacaaaaaccgcgactacgccttcgtcatatactaccacaaacacgaaaccaaacgcgcaatacgtaaactcaacaactacgaaatccgcccgaaccgcctactcgacgtatactacaacgtaaacaactaccgcctcttcatcgacgaaatccccaaaataaaaaaacgcgaaaaaatcctaaaaaaaattaccaaaatcaccgaaaacgtactaaacgtaatcgtctacgccaacgcgaccgacaaaataaaaaaccgcgacttcgccttcgtaaaatacgaaaaccaccgcgcgactaccataactcgccgcaaactcatacctaaccgcatccaactataaaaccaccaaatcgccgtaaactaaaccgaacctaaaatcgacgtaaacgaaaacgtaataaaaaccgtaaaaatcctctacgtacgcaacctcataatcgaaaccaccgaaaacaccatcaaaaaaaacttcgaccaattcaaccccgactacgtaaaacgcgtcaaaaaaatccgcgactacgccttcgtacacttcaccaaccgcgaaaataccgtacataccataaacaacctcaacgacactaaactaaaaaactcgtacctaaaaatcacgctaaccaaacccgtaaacaaaaaacaatactcgcgctaccaaaaaa

SEQ ID NO: 31521 - DNA, 682 bp, Artificial Sequence
  chemically treated genomic DNA (Homo sapiens) CpG-island No: 31521
tcggtcgtcgaagttggcgtttgggcgcggggaggggcgggtcggggcgcggtcgagtagtggggtcgagttcgaggaagaggaagtcggagttcgagtttgagttcgagttcgagttcgacggcggttgtagggcgtttcggtagttcgagtcggcgtagcgtagttcgtatttttttcgttcgatttgcgagcgtcgttcgggtatgcgaagtcgttttttttcgggtaagcgtcggtcgggttcggacgttttggggatttttttagggatgggaggggggattcggggattttcggcgggagttttatattcgtaggtggggtcgggcggagcgtggtattcgggtttcgtcggttttttgcgcgttttttcgtagtggggacggagggttttggggggcgtcgagcggtggggatagagggcgtcgggggtatcgcgcggtggggacggagggcgttggggggcgtcgcgtttcgggggtcggagtcgggtcggggatgttgttcgtcgtcgtttcgtttggggtttcgcgtttttaagttttcggtgttttcgtttttcgttttagcggttgtaatattagcgcgtagaggagtttttgcgagtattcgggagttgtagttatcgtttttttattttcgatttagtaggatagttttagaacgggattttatagtt

SEQ ID NO: 31522 - DNA, 682 bp, Artificial Sequence
  chemically treated genomic DNA (Homo sapiens) CpG-island No: 31522
aactataaaatcccgttctaaaactatcctactaaatcgaaaataaaaaaacgataactacaactcccgaatactcgcaaaaactcctctacgcgctaatattacaaccgctaaaacgaaaaacgaaaacaccgaaaacttaaaaacgcgaaaccccaaacgaaacgacgacgaacaacatccccgacccgactccgacccccgaaacgcgacgccccccaacgccctccgtccccaccgcgcgatacccccgacgccctctatccccaccgctcgacgccccccaaaaccctccgtccccactacgaaaaaacgcgcaaaaaaccgacgaaacccgaataccacgctccgcccgaccccacctacgaatataaaactcccgccgaaaatccccgaatcccccctcccatccctaaaaaaatccccaaaacgtccgaacccgaccgacgcttacccgaaaaaaaacgacttcgcatacccgaacgacgctcgcaaatcgaacgaaaaaaatacgaactacgctacgccgactcgaactaccgaaacgccctacaaccgccgtcgaactcgaactcgaactcaaactcgaactccgacttcctcttcctcgaactcgaccccactactcgaccgcgccccgacccgcccctccccgcgcccaaacgccaacttcgacgaccga

SEQ ID NO: 31523 - DNA, 682 bp, Artificial Sequence
  chemically treated genomic DNA (Homo sapiens) CpG-island No: 31523
ggttgtggggtttcgttttggggttgttttgttgagtcgggggtggggaagcggtggttataattttcgggtgttcgtagaaatttttttgcgcgttgatgttgtagtcgttggggcgaggggcgggagtatcgggaatttgggggcgcggaattttaagcggggcggcggcgggtagtattttcgattcgatttcgattttcgagacgcggcgttttttagcgtttttcgtttttatcgcgcggtgttttcggcgttttttgtttttatcgttcggcgttttttaaggtttttcgtttttattgcggaggggcgcgtagggggtcggcggggttcgggtattacgtttcgttcggttttatttgcggatgtggggttttcgtcggaggttttcgggtttttttttttatttttggaaaagtttttagggcgttcgggttcgatcggcgtttattcggggagggacggtttcgtatgttcgggcggcgttcgtaggtcgggcggggagggtgcgggttgcgttgcgtcggttcgggttgtcggagcgttttgtagtcgtcgtcgggttcgggttcgggtttaggttcgggtttcgattttttttttttcgggttcggttttattgttcggtcgcgtttcggttcgttttttttcgcgtttagacgttagtttcggcggtcgg

SEQ ID NO: 31524 - DNA, 682 bp, Artificial Sequence
  chemically treated genomic DNA (Homo sapiens) CpG-island No: 31524
ccgaccgccgaaactaacgtctaaacgcgaaaaaaaacgaaccgaaacgcgaccgaacaataaaaccgaacccgaaaaaaaaaaaatcgaaacccgaacctaaacccgaacccgaacccgacgacgactacaaaacgctccgacaacccgaaccgacgcaacgcaacccgcaccctccccgcccgacctacgaacgccgcccgaacatacgaaaccgtccctccccgaataaacgccgatcgaacccgaacgccctaaaaacttttccaaaaataaaaaaaaaaacccgaaaacctccgacgaaaaccccacatccgcaaataaaaccgaacgaaacgtaatacccgaaccccgccgaccccctacgcgcccctccgcaataaaaacgaaaaaccttaaaaaacgccgaacgataaaaacaaaaaacgccgaaaacaccgcgcgataaaaacgaaaaacgctaaaaaacgccgcgtctcgaaaatcgaaatcgaatcgaaaatactacccgccgccgccccgcttaaaattccgcgcccccaaattcccgatactcccgcccctcgccccaacgactacaacatcaacgcgcaaaaaaatttctacgaacacccgaaaattataaccaccgcttccccacccccgactcaacaaaacaaccccaaaacgaaaccccacaacc

SEQ ID NO: 31525 - DNA, 524 bp, Artificial Sequence
  chemically treated genomic DNA (Homo sapiens) CpG-island No: 31525
cgcgcggtgggggcggcggtcgagttgttgcggcgtttagggtttgggggcgttttcgttttgtagatgcgttttttagggggtggggagttaagagtttgtggttttttcgttacggggtaaacggtaatatttgggcggtcgcgattttgcgagcgttttggtttcggcgggcggcggggaatcgtagtgatgttcgagttcgttttttttgtgttttcgcggtgagtttcgtttcgaagtcggaagtttgggaacgttttaattgggagaacggcgttcggttggttaatttatttcgtttttcggaaataatgagttggatttttgatttgaatgtgttggcggagcggggtttgtaagtcggcgttttatttagttttggtttttaaggcgttttttgtattattcgtaggtggtcgaggttattgtacgtattttcgaaattatcgagtgtgggtgtttggggtaggtattatttcgcgaggattattttagattgagagttggtttaggagttttga

SEQ ID NO: 31526 - DNA, 524 bp, Artificial Sequence
  chemically treated genomic DNA (Homo sapiens) CpG-island No: 31526
tcaaaactcctaaaccaactctcaatctaaaataatcctcgcgaaataatacctaccccaaacacccacactcgataatttcgaaaatacgtacaataacctcgaccacctacgaataatacaaaaaacgccttaaaaaccaaaactaaataaaacgccgacttacaaaccccgctccgccaacacattcaaatcaaaaatccaactcattatttccgaaaaacgaaataaattaaccaaccgaacgccgttctcccaattaaaacgttcccaaacttccgacttcgaaacgaaactcaccgcgaaaacacaaaaaaaacgaactcgaacatcactacgattccccgccgcccgccgaaaccaaaacgctcgcaaaatcgcgaccgcccaaatattaccgtttaccccgtaacgaaaaaaccacaaactcttaactccccaccccctaaaaaacgcatctacaaaacgaaaacgcccccaaaccctaaacgccgcaacaactcgaccgccgcccccaccgcgcg

SEQ ID NO: 31527 - DNA, 524 bp, Artificial Sequence
  chemically treated genomic DNA (Homo sapiens) CpG-island No: 31527
ttaaaatttttaaattaatttttagtttgagatggttttcgcggggtgatatttgttttaaatatttatattcggtgatttcgaaaatacgtgtagtagtttcggttatttgcgggtggtataaagggcgttttgaggattagagttggatgaaacgtcggtttataaatttcgtttcgttagtatatttaagttaaggatttagtttattgttttcgaggagcggaatgaattgattagtcgagcgtcgtttttttagttagagcgtttttaagttttcggtttcggaacggggtttatcgcgaggatataaaaggggcgagttcgggtattattgcggtttttcgtcgttcgtcgaggttagaacgttcgtagagtcgcggtcgtttaggtgttatcgtttatttcgtgacggaagagttataggtttttgattttttattttttgaaaagcgtatttgtagaacgggggcgtttttaagttttgagcgtcgtagtagttcggtcgtcgtttttatcgcgcg

SEQ ID NO: 31528 - DNA, 524 bp, Artificial Sequence
  chemically treated genomic DNA (Homo sapiens) CpG-island No: 31528
cgcgcgataaaaacgacgaccgaactactacgacgctcaaaacttaaaaacgcccccgttctacaaatacgcttttcaaaaaataaaaaatcaaaaacctataactcttccgtcacgaaataaacgataacacctaaacgaccgcgactctacgaacgttctaacctcgacgaacgacgaaaaaccgcaataatacccgaactcgccccttttatatcctcgcgataaaccccgttccgaaaccgaaaacttaaaaacgctctaactaaaaaaacgacgctcgactaatcaattcattccgctcctcgaaaacaataaactaaatccttaacttaaatatactaacgaaacgaaatttataaaccgacgtttcatccaactctaatcctcaaaacgccctttataccacccgcaaataaccgaaactactacacgtattttcgaaatcaccgaatataaatatttaaaacaaatatcaccccgcgaaaaccatctcaaactaaaaattaatttaaaaattttaa

SEQ ID NO: 31529 - DNA, 722 bp, Artificial Sequence
  chemically treated genomic DNA (Homo sapiens) CpG-island No: 31529
ttcgggttcgggatacggggagttttttttttaggggcgtaaacggggtttcggtttttcgggtttttttcgggttaatggcggcgttttgatttcgattcggtattaacgcgaggagttcgcgcggttcggggttgattttatgtcgtttagttgtcgcgcgttggtgggtcgcggtttcgattttcgtcgtttcgtttcggtcgggtttcggttgtagaagcgggcggggagttgggtttaggggtcgcgtcggagatatatgggtttatttgtttcgaaggttcgtaagacggcgacggcggttatagtattcgggatggttagacgtcgtaggatcgcgttgtttggtcggtcgtaggtgttgggcgtttcgagggcgttgttgtgagtagggtcgggacggaattcgacggaattcgacggtggtcgagattcggacggaatcgtttgataggtttaggtttcgcggggacgttttaggttaggtttagttcgtattacgtttcgtttcggtacgtttcgtttcgtttcggtacgttttttttcgtttcggtacgtttcgtttcgtttttacgaggttcgttttcggttcgtcgtttttcgtcgcgtttcgtacggtgaaaggcgcgtattgaaaatttgtaggtcggttttaggggttgtttgataaggtttgtgggaaagtttaagcgaggggaggagtaggatgattttttttt

SEQ ID NO: 31530 - DNA, 722 bp, Artificial Sequence
  chemically treated genomic DNA (Homo sapiens) CpG-island No: 31530
aaaaaaaaatcatcctactcctcccctcgcttaaactttcccacaaaccttatcaaacaacccctaaaaccgacctacaaattttcaatacgcgcctttcaccgtacgaaacgcgacgaaaaacgacgaaccgaaaacgaacctcgtaaaaacgaaacgaaacgtaccgaaacgaaaaaaaacgtaccgaaacgaaacgaaacgtaccgaaacgaaacgtaatacgaactaaacctaacctaaaacgtccccgcgaaacctaaacctatcaaacgattccgtccgaatctcgaccaccgtcgaattccgtcgaattccgtcccgaccctactcacaacaacgccctcgaaacgcccaacacctacgaccgaccaaacaacgcgatcctacgacgtctaaccatcccgaatactataaccgccgtcgccgtcttacgaaccttcgaaacaaataaacccatatatctccgacgcgacccctaaacccaactccccgcccgcttctacaaccgaaacccgaccgaaacgaaacgacgaaaatcgaaaccgcgacccaccaacgcgcgacaactaaacgacataaaatcaaccccgaaccgcgcgaactcctcgcgttaataccgaatcgaaatcaaaacgccgccattaacccgaaaaaaacccgaaaaaccgaaaccccgtttacgcccctaaaaaaaaaactccccgtatcccgaacccgaa

SEQ ID NO: 31531 - DNA, 722 bp, Artificial Sequence
  chemically treated genomic DNA (Homo sapiens) CpG-island No: 31531
aaaaagaaattattttattttttttttcgtttaaatttttttataggttttgttaaataatttttggagtcggtttgtaggtttttaatgcgcgttttttatcgtgcggggcgcggcggggagcggcgagtcgggggcgggtttcgtgggggcggggcggggcgtgtcggggcggggaggggcgtgtcggggcggggcggggcgtgtcggggcggggcgtagtacggattgggtttggtttggggcgttttcgcgaagtttgggtttgttaggcggtttcgttcgggtttcggttatcgtcgagtttcgtcgagtttcgtttcggttttgtttatagtagcgttttcggagcgtttagtatttgcggtcggttaggtagcgcgattttgcggcgtttggttatttcgaatgttatggtcgtcgtcgtcgttttgcgggttttcggggtaagtgggtttatgtgttttcggcgcggtttttgggtttagtttttcgttcgtttttgtagtcgggattcggtcggggcggggcggcgggagtcggagtcgcggtttattagcgcgcggtagttggacggtataaggttagtttcgggtcgcgcgggtttttcgcgttggtgtcgagtcggggttagggcgtcgttattgattcggggaggattcggggaatcggagtttcgtttacgtttttggggagggaatttttcgtgtttcggattcggg

SEQ ID NO: 31532 - DNA, 722 bp, Artificial Sequence
  chemically treated genomic DNA (Homo sapiens) CpG-island No: 31532
cccgaatccgaaacacgaaaaattccctccccaaaaacgtaaacgaaactccgattccccgaatcctccccgaatcaataacgacgccctaaccccgactcgacaccaacgcgaaaaacccgcgcgacccgaaactaaccttataccgtccaactaccgcgcgctaataaaccgcgactccgactcccgccgccccgccccgaccgaatcccgactacaaaaacgaacgaaaaactaaacccaaaaaccgcgccgaaaacacataaacccacttaccccgaaaacccgcaaaacgacgacgacgaccataacattcgaaataaccaaacgccgcaaaatcgcgctacctaaccgaccgcaaatactaaacgctccgaaaacgctactataaacaaaaccgaaacgaaactcgacgaaactcgacgataaccgaaacccgaacgaaaccgcctaacaaacccaaacttcgcgaaaacgccccaaaccaaacccaatccgtactacgccccgccccgacacgccccgccccgccccgacacgcccctccccgccccgacacgccccgccccgcccccacgaaacccgcccccgactcgccgctccccgccgcgccccgcacgataaaaaacgcgcattaaaaacctacaaaccgactccaaaaattatttaacaaaacctataaaaaaatttaaacgaaaaaaaaaataaaataatttcttttt

SEQ ID NO: 31533 - DNA, 1034 bp, Artificial Sequence
  chemically treated genomic DNA (Homo sapiens) CpG-island No: 31533
tcgaagtttcgttttgggttttgggtttttagcgttcgtttttcgtcgaggggtttcgggtatttgtagttttgggcgcgcgttttcgaggcgggcgggagcgcgtacggcgggagtgcgggagcggagcgtacgtgtcgtcgggaaggggtcgcgttaatatggcggcggttgcggtcgttgcggtgacggttggcggcggtcggtgaggcgggcggggtcggaggcgcggaggcggggtttcgggcgagtcgttttgggaggcgggggtcgtttttatagcggcggtaggaggtgtcgcgtcggggaattttttggttttcgggttcggtttcgtcgggatttttttggaagggaaataatggggcggagggtattgcggtagtcgtcgtcgtcgtcgcgtcgcgtcgcgtcggatttgttcggtcgttcgggatcgttagttttgttcgttgtttatagtttagtagtcgggatcgtattgaggtaatttttattttttagttttcgtcgtgaggggtcggcggcggcgggtttcgcgggcgtttttttcgggtcgggattcggagttggtttcggggagtcggacgtcgttattttcggtttttggaggaggggacgcggttgcggttcgcggttcggttttggggggcggttcgggtatagtgcgggggttgtttgtgtgttttcgcgttcggagcgtggggttcgcggggcgatgggcgggttgggggcgtcgcgcggggtgcggggaggttcgggggtggaattcggcgattgttttttcgagtgagtcgcgatttcggttaggcgcgtttttttcgtaagtttcggtcgcgtttttcgagttttagtgggtaggattcgggtaaatttcgtgtttttaaatgattgttttgatgtcgcggaattttgtttggattaggcgaggggaggatggggcgaatgagagatttgtaagttttggaaattcgtgcgtttttgtaaagtttgtaaaatagtttggcgtttataattttaggttggtgcggtat

SEQ ID NO: 31534 - DNA, 1034 bp, Artificial Sequence
  chemically treated genomic DNA (Homo sapiens) CpG-island No: 31534
ataccgcaccaacctaaaattataaacgccaaactattttacaaactttacaaaaacgcacgaatttccaaaacttacaaatctctcattcgccccatcctcccctcgcctaatccaaacaaaattccgcgacatcaaaacaatcatttaaaaacacgaaatttacccgaatcctacccactaaaactcgaaaaacgcgaccgaaacttacgaaaaaaacgcgcctaaccgaaatcgcgactcactcgaaaaaacaatcgccgaattccacccccgaacctccccgcaccccgcgcgacgcccccaacccgcccatcgccccgcgaaccccacgctccgaacgcgaaaacacacaaacaacccccgcactatacccgaaccgccccccaaaaccgaaccgcgaaccgcaaccgcgtcccctcctccaaaaaccgaaaataacgacgtccgactccccgaaaccaactccgaatcccgacccgaaaaaaacgcccgcgaaacccgccgccgccgacccctcacgacgaaaactaaaaaataaaaattacctcaatacgatcccgactactaaactataaacaacgaacaaaactaacgatcccgaacgaccgaacaaatccgacgcgacgcgacgcgacgacgacgacgactaccgcaataccctccgccccattatttcccttccaaaaaaatcccgacgaaaccgaacccgaaaaccaaaaaattccccgacgcgacacctcctaccgccgctataaaaacgacccccgcctcccaaaacgactcgcccgaaaccccgcctccgcgcctccgaccccgcccgcctcaccgaccgccgccaaccgtcaccgcaacgaccgcaaccgccgccatattaacgcgaccccttcccgacgacacgtacgctccgctcccgcactcccgccgtacgcgctcccgcccgcctcgaaaacgcgcgcccaaaactacaaatacccgaaacccctcgacgaaaaacgaacgctaaaaacccaaaacccaaaacgaaacttcga

SEQ ID NO: 31535 - DNA, 1034 bp, Artificial Sequence
  chemically treated genomic DNA (Homo sapiens) CpG-island No: 31535
atgtcgtattagtttagggttgtgagcgttaaattattttgtaaattttgtaaaggcgtacggatttttaagatttgtagattttttattcgttttatttttttttcgtttggtttaaataaagtttcgcggtattaaggtagttatttaaaggtacgaagtttgttcgggttttgtttattggggttcgggagacgcgatcgaaatttgcgagggagacgcgtttggtcgggatcgcggtttattcggggaggtagtcgtcgggttttattttcgggttttttcgtatttcgcgcggcgtttttagttcgtttatcgtttcgcggattttacgtttcgggcgcggggatatataggtagttttcgtattgtgttcgagtcgttttttagggtcgagtcgcgaatcgtagtcgcgtttttttttttaggggtcgggaatggcggcgttcggtttttcggggttaatttcgagtttcggttcggggaggacgttcgcggagttcgtcgtcgtcggttttttacggcgggagttgaggaatggaagttattttagtacggtttcgattgttaggttgtgggtagcggatagagttggcggtttcgggcggtcgagtagattcggcgcggcgcggcgcggcggcggcggcggttatcgtagtgtttttcgttttattgttttttttttaagaggatttcggcgaagtcgagttcgggaattaggaagtttttcggcgcgatattttttgtcgtcgttatggaaacggttttcgttttttagggcggttcgttcgggatttcgttttcgcgttttcggtttcgttcgttttatcggtcgtcgttaatcgttatcgtagcggtcgtagtcgtcgttatattggcgcggttttttttcggcggtacgtgcgtttcgttttcgtattttcgtcgtgcgcgttttcgttcgtttcggggacgcgcgtttagggttgtaggtgttcggagtttttcggcgggaagcgggcgttggaagtttaggatttaaagcggggtttcgg

SEQ ID NO: 31536 - DNA, 1034 bp, Artificial Sequence
  chemically treated genomic DNA (Homo sapiens) CpG-island No: 31536
ccgaaaccccgctttaaatcctaaacttccaacgcccgcttcccgccgaaaaactccgaacacctacaaccctaaacgcgcgtccccgaaacgaacgaaaacgcgcacgacgaaaatacgaaaacgaaacgcacgtaccgccgaaaaaaaaccgcgccaatataacgacgactacgaccgctacgataacgattaacgacgaccgataaaacgaacgaaaccgaaaacgcgaaaacgaaatcccgaacgaaccgccctaaaaaacgaaaaccgtttccataacgacgacaaaaaatatcgcgccgaaaaacttcctaattcccgaactcgacttcgccgaaatcctcttaaaaaaaaaacaataaaacgaaaaacactacgataaccgccgccgccgccgcgccgcgccgcgccgaatctactcgaccgcccgaaaccgccaactctatccgctacccacaacctaacaatcgaaaccgtactaaaataacttccattcctcaactcccgccgtaaaaaaccgacgacgacgaactccgcgaacgtcctccccgaaccgaaactcgaaattaaccccgaaaaaccgaacgccgccattcccgacccctaaaaaaaaaaacgcgactacgattcgcgactcgaccctaaaaaacgactcgaacacaatacgaaaactacctatatatccccgcgcccgaaacgtaaaatccgcgaaacgataaacgaactaaaaacgccgcgcgaaatacgaaaaaacccgaaaataaaacccgacgactacctccccgaataaaccgcgatcccgaccaaacgcgtctccctcgcaaatttcgatcgcgtctcccgaaccccaataaacaaaacccgaacaaacttcgtacctttaaataactaccttaataccgcgaaactttatttaaaccaaacgaaaaaaaaataaaacgaataaaaaatctacaaatcttaaaaatccgtacgcctttacaaaatttacaaaataatttaacgctcacaaccctaaactaatacgacat

SEQ ID NO: 31537 - DNA, 500 bp, Artificial Sequence
  chemically treated genomic DNA (Homo sapiens) CpG-island No: 31537
cgcggggtttggcggcggggtcgggggttgtacgcgattattcggtagggggcggcggcgatagcggcggtcgtaagggacgcgttcggggttcgcgtttagggggagcggtagcggtttggtagttgtttttcgcgttttcgcggtttagttaggggagggggcgtagcgtcggggttatggattcgcgttaggtcgttgtttttcgtcggcgggttcggggcggggcggattcgttttcgttttcgttttcgttttcgttttcgtttttatttttacgttttattttttacgtagttttcgttttttttgttttttttcgcgtcgtttttttttttcgcgtttttcgggagaaatatggtcgggagtagcgaggaggcgttagattacgggcgaggcgtcgtggtaaatgtaaattttttattttggggttcggttcgtttttttttttttttggtattttgtttgtagattaaatgtttgtcgtgcgtcgggggaga

SEQ ID NO: 31538 - DNA, 500 bp, Artificial Sequence
  chemically treated genomic DNA (Homo sapiens) CpG-island No: 31538
tctcccccgacgcacgacaaacatttaatctacaaacaaaataccaaaaaaaaaaaaaaacgaaccgaaccccaaaataaaaaatttacatttaccacgacgcctcgcccgtaatctaacgcctcctcgctactcccgaccatatttctcccgaaaaacgcgaaaaaaaaaaacgacgcgaaaaaaaacaaaaaaaacgaaaactacgtaaaaaataaaacgtaaaaataaaaacgaaaacgaaaacgaaaacgaaaacgaaaacgaatccgccccgccccgaacccgccgacgaaaaacaacgacctaacgcgaatccataaccccgacgctacgccccctcccctaactaaaccgcgaaaacgcgaaaaacaactaccaaaccgctaccgctccccctaaacgcgaaccccgaacgcgtcccttacgaccgccgctatcgccgccgccccctaccgaataatcgcgtacaacccccgaccccgccgccaaaccccgcg

SEQ ID NO: 31539 - DNA, 500 bp, Artificial Sequence
  chemically treated genomic DNA (Homo sapiens) CpG-island No: 31539
tttttttcgacgtacggtaagtatttaatttataagtagggtgttagggagggaggggagcgggtcgagttttaaaatagggagtttgtatttattacgacgtttcgttcgtagtttggcgttttttcgttgttttcggttatgtttttttcggggaacgcgggaagggaagacggcgcgggaaggagtagggagggcgaaggttgcgtgggggatgggacgtggggatggggacggggacggggacggggacggggacggggacgggttcgtttcgtttcgggttcgtcggcgggaagtagcggtttgacgcggatttatggtttcggcgttgcgtttttttttttggttaggtcgcgggggcgcggggagtagttgttaagtcgttatcgttttttttgagcgcgggtttcggacgcgttttttgcggtcgtcgttgtcgtcgtcgttttttgtcggatggtcgcgtgtagttttcggtttcgtcgttaagtttcgcg

SEQ ID NO: 31540 - DNA, 500 bp, Artificial Sequence
  chemically treated genomic DNA (Homo sapiens) CpG-island No: 31540
cgcgaaacttaacgacgaaaccgaaaactacacgcgaccatccgacaaaaaacgacgacgacaacgacgaccgcaaaaaacgcgtccgaaacccgcgctcaaaaaaaacgataacgacttaacaactactccccgcgcccccgcgacctaaccaaaaaaaaaaacgcaacgccgaaaccataaatccgcgtcaaaccgctacttcccgccgacgaacccgaaacgaaacgaacccgtccccgtccccgtccccgtccccgtccccgtccccatccccacgtcccatcccccacgcaaccttcgccctccctactccttcccgcgccgtcttcccttcccgcgttccccgaaaaaaacataaccgaaaacaacgaaaaaacgccaaactacgaacgaaacgtcgtaataaatacaaactccctattttaaaactcgacccgctcccctccctccctaacaccctacttataaattaaatacttaccgtacgtcgaaaaaaa

SEQ ID NO: 31541 - DNA, 570 bp, Artificial Sequence
  chemically treated genomic DNA (Homo sapiens) CpG-island No: 31541
acgcgcgcgtatattcgtacgtttagggttatatttatacgtcgttttttacgattatatagtattagatttcggttttttatgtttttggatggtgacggcggattggtattttggaagcgatgcgagagcgataaggttggcgtcggttcgtaaaagttgtaggagtatcgttaggtgttgtcgttatcgggaagcggggttgtaggtaggtgcgagtcgcgtttcgggtcgtcggttagcgttggggatcggagcggtaattgtaggatcgcggtttcggaagttttcgtgtgtatacgtttttttttttttttttcgggggttcgggattgtagagggatcgttcggggaaggcgagaggtgagggtagatgcgggtttatcggtcggcgtttttttcgcgggcggttagggtaggggcggagtagagggacgtcgagaggggatcggagtatgcgaaatgaggtttcgtgagcggtgttttttttttttgttttattttttttaataatagtaaacgattaggtcgaggattgaagtgggttgtaattcgattttttatttagat

SEQ ID NO: 31542 - DNA, 570 bp, Artificial Sequence
  chemically treated genomic DNA (Homo sapiens) CpG-island No: 31542
atctaaataaaaaatcgaattacaacccacttcaatcctcgacctaatcgtttactattattaaaaaaaataaaacaaaaaaaaaaaacaccgctcacgaaacctcatttcgcatactccgatcccctctcgacgtccctctactccgcccctaccctaaccgcccgcgaaaaaaacgccgaccgataaacccgcatctaccctcacctctcgccttccccgaacgatccctctacaatcccgaacccccgaaaaaaaaaaaaaaaaacgtatacacacgaaaacttccgaaaccgcgatcctacaattaccgctccgatccccaacgctaaccgacgacccgaaacgcgactcgcacctacctacaaccccgcttcccgataacgacaacacctaacgatactcctacaacttttacgaaccgacgccaaccttatcgctctcgcatcgcttccaaaataccaatccgccgtcaccatccaaaaacataaaaaaccgaaatctaatactatataatcgtaaaaaacgacgtataaatataaccctaaacgtacgaatatacgcgcgcgt

SEQ ID NO: 31543 - DNA, 570 bp, Artificial Sequence
  chemically treated genomic DNA (Homo sapiens) CpG-island No: 31543
gtttgggtgaggaatcgaattataatttattttaattttcgatttggtcgtttgttgttattaggagaaatggggtagagagggagggtatcgtttacggagttttatttcgtatgtttcgattttttttcggcgtttttttatttcgtttttattttgatcgttcgcgagggagacgtcggtcgatggattcgtatttgtttttatttttcgtttttttcgggcgatttttttatagtttcggattttcgagaaaggggaagggagacgtgtgtatacgggggttttcgggatcgcggttttgtagttgtcgtttcggtttttagcgttggtcggcgattcgaggcgcggttcgtatttatttgtagtttcgtttttcggtggcggtaatatttagcgatgtttttgtagtttttgcgggtcggcgttagttttatcgttttcgtatcgtttttaagatgttaattcgtcgttattatttaggggtatagggaatcgaagtttggtgttgtgtgatcgtggagggcggcgtgtgagtgtggttttgagcgtgcgagtgtgcgcgcgcgt

SEQ ID NO: 31544 - DNA, 570 bp, Artificial Sequence
  chemically treated genomic DNA (Homo sapiens) CpG-island No: 31544
acgcgcgcgcacactcgcacgctcaaaaccacactcacacgccgccctccacgatcacacaacaccaaacttcgattccctatacccctaaataataacgacgaattaacatcttaaaaacgatacgaaaacgataaaactaacgccgacccgcaaaaactacaaaaacatcgctaaatattaccgccaccgaaaaacgaaactacaaataaatacgaaccgcgcctcgaatcgccgaccaacgctaaaaaccgaaacgacaactacaaaaccgcgatcccgaaaacccccgtatacacacgtctcccttcccctttctcgaaaatccgaaactataaaaaaatcgcccgaaaaaaacgaaaaataaaaacaaatacgaatccatcgaccgacgtctccctcgcgaacgatcaaaataaaaacgaaataaaaaaacgccgaaaaaaaatcgaaacatacgaaataaaactccgtaaacgataccctccctctctaccccatttctcctaataacaacaaacgaccaaatcgaaaattaaaataaattataattcgattcctcacccaaac

SEQ ID NO: 31545 - DNA, 528 bp, Artificial Sequence
  chemically treated genomic DNA (Homo sapiens) CpG-island No: 31545
gaagtcgcgtaggtttttcgagttttattttgcgttaggagagttacggtagtaggaacgggtattgttgttatcgggtcgacgggtgagttattgtttggaaatggagtgggcgggcgagggtgtgagagaatgaatgatgttaagagcgcgttgggcgtagggcgtagggagcgggtcgcgcgcggcgggcggggagagcgggcgcggggtcgcggttaatattgagcgtcgcgtcgtgggtcgagtggggcggggagatttagttttcggcgcgtacggagtttggtcggtgttgtagcgtcgtcgagtgcggtttcgggggcggcggtcgcgggagggattcggagagttgttttttttagttaggtcgcggcgtgggagggcgagatttcgagtaaattttttagcggtttcggttcgagggtggtgacgttcggggttggtcgcggcggttgcggtagcgggttttattttttggtaaatttttttttcgggagtaagtgtttttagttgggagtgtttgga

SEQ ID NO: 31546 - DNA, 528 bp, Artificial Sequence
  chemically treated genomic DNA (Homo sapiens) CpG-island No: 31546
tccaaacactcccaactaaaaacacttactcccgaaaaaaaaatttaccaaaaaataaaacccgctaccgcaaccgccgcgaccaaccccgaacgtcaccaccctcgaaccgaaaccgctaaaaaatttactcgaaatctcgccctcccacgccgcgacctaactaaaaaaaacaactctccgaatccctcccgcgaccgccgcccccgaaaccgcactcgacgacgctacaacaccgaccaaactccgtacgcgccgaaaactaaatctccccgccccactcgacccacgacgcgacgctcaatattaaccgcgaccccgcgcccgctctccccgcccgccgcgcgcgacccgctccctacgccctacgcccaacgcgctcttaacatcattcattctctcacaccctcgcccgcccactccatttccaaacaataactcacccgtcgacccgataacaacaatacccgttcctactaccgtaactctcctaacgcaaaataaaactcgaaaaacctacgcgacttc

SEQ ID NO: 31547 - DNA, 528 bp, Artificial Sequence
  chemically treated genomic DNA (Homo sapiens) CpG-island No: 31547
tttagatatttttagttgaaggtatttgttttcgggaaggggatttgttaggggatggagttcgttgtcgtagtcgtcgcgattagtttcgggcgttattattttcgggtcgaagtcgttagaaagtttgttcggggtttcgtttttttacgtcgcggtttgattaggggaagtagtttttcgggtttttttcgcggtcgtcgttttcgaggtcgtattcggcggcgttgtagtatcggttaggtttcgtgcgcgtcgagggttgggttttttcgttttattcggtttacggcgcggcgtttagtgttgatcgcggtttcgcgttcgtttttttcgttcgtcgcgcgcggttcgttttttgcgttttgcgtttagcgcgtttttgatattatttatttttttatattttcgttcgtttattttatttttaaatagtgatttattcgtcggttcggtggtagtagtgttcgtttttgttgtcgtggtttttttggcgtagagtggagttcgaaaaatttgcgcgatttt

SEQ ID NO: 31548 - DNA, 528 bp, Artificial Sequence
  chemically treated genomic DNA (Homo sapiens) CpG-island No: 31548
aaaatcgcgcaaatttttcgaactccactctacgccaaaaaaaccacgacaacaaaaacgaacactactaccaccgaaccgacgaataaatcactatttaaaaataaaataaacgaacgaaaatataaaaaaataaataatatcaaaaacgcgctaaacgcaaaacgcaaaaaacgaaccgcgcgcgacgaacgaaaaaaacgaacgcgaaaccgcgatcaacactaaacgccgcgccgtaaaccgaataaaacgaaaaaacccaaccctcgacgcgcacgaaacctaaccgatactacaacgccgccgaatacgacctcgaaaacgacgaccgcgaaaaaaacccgaaaaactacttcccctaatcaaaccgcgacgtaaaaaaacgaaaccccgaacaaactttctaacgacttcgacccgaaaataataacgcccgaaactaatcgcgacgactacgacaacgaactccatcccctaacaaatccccttcccgaaaacaaataccttcaactaaaaatatctaaa

SEQ ID NO: 31549 - DNA, 542 bp, Artificial Sequence
  chemically treated genomic DNA (Homo sapiens) CpG-island No: 31549
ggatgtttcgcgttcggcgttttcgtagttagttttagtttagtagcgttacgaggtcgtatagtagtagcgcgttttcgttggggtttagtcgtagtagttttagaggcgtacgtaggaggcgcgcgggttagggcgggttttcggtcggcggttgcgacggtttcggagacgatatggttcgggcgtcggcggtttcgggttttttttgttgtttggaggagacgcgtacgtagttgtttgattcgcggcgttagtgttttgttttgttttggaaggtcgggggcgggtagggggtgtaggaacgttttcggattggttgcgtcgcgcgtatttttttcgtcgtcgttatttagcgacgtttgggcggaatttggaggcgcgtcggttgtttggcggagggggttggcgggttagtaggcgggggatttgaagtttgtttcgaagttcggttacgattttttgtagggtcgggtttggcggtgattgtttttgaaattgggatgttggtaatataattttgcgttttgattggttgttgg

SEQ ID NO: 31550 - DNA, 542 bp, Artificial Sequence
  chemically treated genomic DNA (Homo sapiens) CpG-island No: 31550
ccaacaaccaatcaaaacgcaaaattatattaccaacatcccaatttcaaaaacaatcaccgccaaacccgaccctacaaaaaatcgtaaccgaacttcgaaacaaacttcaaatcccccgcctactaacccgccaaccccctccgccaaacaaccgacgcgcctccaaattccgcccaaacgtcgctaaataacgacgacgaaaaaaatacgcgcgacgcaaccaatccgaaaacgttcctacaccccctacccgcccccgaccttccaaaacaaaacaaaacactaacgccgcgaatcaaacaactacgtacgcgtctcctccaaacaacaaaaaaaacccgaaaccgccgacgcccgaaccatatcgtctccgaaaccgtcgcaaccgccgaccgaaaacccgccctaacccgcgcgcctcctacgtacgcctctaaaactactacgactaaaccccaacgaaaacgcgctactactatacgacctcgtaacgctactaaactaaaactaactacgaaaacgccgaacgcgaaacatcc

SEQ ID NO: 31551 - DNA, 542 bp, Artificial Sequence
  chemically treated genomic DNA (Homo sapiens) CpG-island No: 31551
ttaatagttaattagagcgtaaggttgtgttgttagtattttagttttagggatagttatcgttaagttcgattttgtaaagggtcgtaatcggatttcggggtaaattttaggtttttcgtttgttagttcgttaatttttttcgttaggtagtcggcgcgtttttaggtttcgtttaggcgtcgttgagtggcggcggcggggagaatgcgcgcggcgtagttaattcgggggcgtttttatattttttgttcgttttcgattttttagagtagagtaggatattggcgtcgcgggttaggtagttgcgtgcgcgttttttttaggtagtaaggggaattcgaggtcgtcggcgttcggattatgtcgttttcggggtcgtcgtagtcgtcggtcgaggattcgttttggttcgcgcgttttttgcgtgcgtttttggggttgttgcggttggattttagcgggggcgcgttgttgttatgcggtttcgtagcgttgttgggttggagttggttgcggaggcgtcgggcgcggggtattt

SEQ ID NO: 31552 - DNA, 542 bp, Artificial Sequence
  chemically treated genomic DNA (Homo sapiens) CpG-island No: 31552
aaataccccgcgcccgacgcctccgcaaccaactccaacccaacaacgctacgaaaccgcataacaacaacgcgcccccgctaaaatccaaccgcaacaaccccaaaaacgcacgcaaaaaacgcgcgaaccaaaacgaatcctcgaccgacgactacgacgaccccgaaaacgacataatccgaacgccgacgacctcgaattccccttactacctaaaaaaaacgcgcacgcaactacctaacccgcgacgccaatatcctactctactctaaaaaatcgaaaacgaacaaaaaatataaaaacgcccccgaattaactacgccgcgcgcattctccccgccgccgccactcaacgacgcctaaacgaaacctaaaaacgcgccgactacctaacgaaaaaaattaacgaactaacaaacgaaaaacctaaaatttaccccgaaatccgattacgaccctttacaaaatcgaacttaacgataactatccctaaaactaaaatactaacaacacaaccttacgctctaattaactattaa

SEQ ID NO: 31553 - DNA, 856 bp, Artificial Sequence
  chemically treated genomic DNA (Homo sapiens) CpG-island No: 31553
gtggggaggaggtaggaggcggttgcgcggggttggcgcgggtaggggcggaggacgggcgtacgcgggtcggggttagttgttcgcgttcggttcgggggcggcggcgcgggaggagcgggttgcgttagttagaggggtcgtcgggggagcgttttcgtcgtcgggtttcgcgggtcgagtcggttttgtattcgattgatttcgttttttttggagagagcggtcgggtcgcgttcgggtcgttagtatttgttcgcgtttggcgggtttttttttttttttgcgcgtagttatcgtcgtagtttttatgtttttcgttttcgtcgtttttcggtggttttcgtttttgttgttgttgttgttgttgttgtcgttggttcgcggcgtttcggttcggttcgtagtcggggggtaggtttcggagttggtggtgtttacgcggttgttcggtagcgcgggcgagttcgcgttttatttgttcgttttcggtaagggtttcgtgttgcgtttggcgttcgacgatagttttttagcgttcgagtttaagatcgagcgtttcgggggtttcggtcgggcgatcgggggcgagcgggggttgcgcggttgtttttttttcggtatcgtgaatggggagttcgagtcgttggcggcggttagtttgtgtcgcgggttgagcggtttttttttgttggacggcgaggagtttattatttagtcgtagggcgcggggggttttttggtttagtcgtatcgtttgtagcgttggggtttcgtcggagttcgttttttttcgcgaggattcgagtgggaggtggagacgggagagggttagaggtaggagagaggagattat

SEQ ID NO: 31554 - DNA, 856 bp, Artificial Sequence
  chemically treated genomic DNA (Homo sapiens) CpG-island No: 31554
ataatctcctctctcctacctctaaccctctcccgtctccacctcccactcgaatcctcgcgaaaaaaaacgaactccgacgaaaccccaacgctacaaacgatacgactaaaccaaaaaaccccccgcgccctacgactaaataataaactcctcgccgtccaacaaaaaaaaaccgctcaacccgcgacacaaactaaccgccgccaacgactcgaactccccattcacgataccgaaaaaaaaacaaccgcgcaacccccgctcgcccccgatcgcccgaccgaaacccccgaaacgctcgatcttaaactcgaacgctaaaaaactatcgtcgaacgccaaacgcaacacgaaacccttaccgaaaacgaacaaataaaacgcgaactcgcccgcgctaccgaacaaccgcgtaaacaccaccaactccgaaacctaccccccgactacgaaccgaaccgaaacgccgcgaaccaacgacaacaacaacaacaacaacaacaaaaacgaaaaccaccgaaaaacgacgaaaacgaaaaacataaaaactacgacgataactacgcgcaaaaaaaaaaaaaaacccgccaaacgcgaacaaatactaacgacccgaacgcgacccgaccgctctctccaaaaaaaacgaaatcaatcgaatacaaaaccgactcgacccgcgaaacccgacgacgaaaacgctcccccgacgacccctctaactaacgcaacccgctcctcccgcgccgccgcccccgaaccgaacgcgaacaactaaccccgacccgcgtacgcccgtcctccgcccctacccgcgccaaccccgcgcaaccgcctcctacctcctccccac

SEQ ID NO: 31555 - DNA, 856 bp, Artificial Sequence
  chemically treated genomic DNA (Homo sapiens) CpG-island No: 31555
gtggtttttttttttttgtttttgattttttttcgtttttattttttattcgggttttcgcgggagggggcgggtttcggcgggattttagcgttgtaggcggtgcggttgagttagggagtttttcgcgttttgcggttggatggtgaatttttcgtcgtttagtaggaaggagtcgtttagttcgcggtataggttgatcgtcgttagcgattcgggttttttatttacggtgtcggagaagaagtagtcgcgtagttttcgttcgttttcggtcgttcggtcggagttttcgaggcgttcgattttgaattcgggcgttaggaagttgtcgtcgggcgttaggcgtagtacgaagtttttgtcgaaggcggataggtggagcgcgagttcgttcgcgttgtcgggtaatcgcgtgggtattattagtttcgaggtttgtttttcggttgcgggtcgggtcggggcgtcgcgggttagcggtagtagtagtagtagtagtagtaggagcggaggttatcggggggcggcgggggcggggagtatgggggttgcggcggtggttgcgcgtaggagagggaagaagttcgttaggcgcgggtaggtgttggcggttcgagcgcggttcggtcgttttttttaggaaaagcggaattaatcgggtgtaaggtcgattcggttcgcggggttcggcggcgggagcgttttttcggcggtttttttggttggcgtagttcgtttttttcgcgtcgtcgttttcgagtcgagcgcgagtagttggtttcggttcgcgtgcgttcgtttttcgtttttgttcgcgttagtttcgcgtagtcgttttttgttttttttttat

SEQ ID NO: 31556 - DNA, 856 bp, Artificial Sequence
  chemically treated genomic DNA (Homo sapiens) CpG-island No: 31556
ataaaaaaaaaacaaaaaacgactacgcgaaactaacgcgaacaaaaacgaaaaacgaacgcacgcgaaccgaaaccaactactcgcgctcgactcgaaaacgacgacgcgaaaaaaacgaactacgccaaccaaaaaaaccgccgaaaaaacgctcccgccgccgaaccccgcgaaccgaatcgaccttacacccgattaattccgcttttcctaaaaaaaacgaccgaaccgcgctcgaaccgccaacacctacccgcgcctaacgaacttcttccctctcctacgcgcaaccaccgccgcaacccccatactccccgcccccgccgccccccgataacctccgctcctactactactactactactactaccgctaacccgcgacgccccgacccgacccgcaaccgaaaaacaaacctcgaaactaataatacccacgcgattacccgacaacgcgaacgaactcgcgctccacctatccgccttcgacaaaaacttcgtactacgcctaacgcccgacgacaacttcctaacgcccgaattcaaaatcgaacgcctcgaaaactccgaccgaacgaccgaaaacgaacgaaaactacgcgactacttcttctccgacaccgtaaataaaaaacccgaatcgctaacgacgatcaacctataccgcgaactaaacgactccttcctactaaacgacgaaaaattcaccatccaaccgcaaaacgcgaaaaactccctaactcaaccgcaccgcctacaacgctaaaatcccgccgaaacccgccccctcccgcgaaaacccgaataaaaaataaaaacgaaaaaaaatcaaaaacaaaaaaaaaaaaaccac

SEQ ID NO: 31557 - DNA, 610 bp, Artificial Sequence
  chemically treated genomic DNA (Homo sapiens) CpG-island No: 31557
gggttcggagttacgatttttaagaagtagtattttgattataacgatgttgatggggttgaggatgttgggatggcggtagagtcgcgtcgtcgttgttagtagcgttagtagataatgttttaggttcgcgtcgtggaatttgattattgattcgttcgcgattattagcgtttttacgtatcgcgggatagatacgaaacgtttggcgcgtttagatttgcgtcggttacgatttttttcgaagttcgttcgtcgcggtttgtaagggtttagggttcgtaggatggcggggttttagttcgaggttatttcgtagcgagaggtggggttttcggaaggttcgttcggaatatttcggcgttggagaaggtgtgcgttttggttgttgcgttgcgtcgtcggcgcgttagtattgggtagcgggttaatgatatattcggcgtttcggtagttaaaggtttcgcggagtttttcgtataggtttatagtagcgaacgagttcggttcggcgtttacgtttttagaatagaagtagcgtcgtaggtttgaagagttttcggtgagtttttggagggggacgtttagatgtttagtggagaaggcggga

SEQ ID NO: 31558 - DNA, 610 bp, Artificial Sequence
  chemically treated genomic DNA (Homo sapiens) CpG-island No: 31558
tcccgccttctccactaaacatctaaacgtccccctccaaaaactcaccgaaaactcttcaaacctacgacgctacttctattctaaaaacgtaaacgccgaaccgaactcgttcgctactataaacctatacgaaaaactccgcgaaacctttaactaccgaaacgccgaatatatcattaacccgctacccaatactaacgcgccgacgacgcaacgcaacaaccaaaacgcacaccttctccaacgccgaaatattccgaacgaaccttccgaaaaccccacctctcgctacgaaataacctcgaactaaaaccccgccatcctacgaaccctaaacccttacaaaccgcgacgaacgaacttcgaaaaaaatcgtaaccgacgcaaatctaaacgcgccaaacgtttcgtatctatcccgcgatacgtaaaaacgctaataatcgcgaacgaatcaataatcaaattccacgacgcgaacctaaaacattatctactaacgctactaacaacgacgacgcgactctaccgccatcccaacatcctcaaccccatcaacatcgttataatcaaaatactacttcttaaaaatcgtaactccgaaccc

SEQ ID NO: 31559 - DNA, 610 bp, Artificial Sequence
  chemically treated genomic DNA (Homo sapiens) CpG-island No: 31559
tttcgttttttttattgagtatttgggcgtttttttttaggggtttatcgggggttttttagatttgcgacgttgtttttattttggggacgtgaacgtcgagtcggattcgttcgttgttgtgagtttgtgcggggggtttcgcggagtttttggttatcgaggcgtcgagtatgttattagttcgttgtttaatgttagcgcgtcggcggcgtagcgtaatagttagggcgtatattttttttagcgtcggggtgtttcgggcgggtttttcggagattttatttttcgttgcggggtggtttcgggttggaatttcgttattttacgggttttggatttttataagtcgcggcgggcgggtttcggggagagtcgtagtcggcgtaggtttgggcgcgttaagcgtttcgtgtttatttcgcggtacgtggagacgttggtggtcgcggacgagttaatggttaagttttacggcgcggatttggaatattatttgttgacgttgttggtaacggcggcgcgattttatcgttattttagtatttttaattttattaatatcgttgtggttaaggtgttgttttttagagatcgtgatttcgggttt

SEQ ID NO: 31560 - DNA, 610 bp, Artificial Sequence
  chemically treated genomic DNA (Homo sapiens) CpG-island No: 31560
aaacccgaaatcacgatctctaaaaaacaacaccttaaccacaacgatattaataaaattaaaaatactaaaataacgataaaatcgcgccgccgttaccaacaacgtcaacaaataatattccaaatccgcgccgtaaaacttaaccattaactcgtccgcgaccaccaacgtctccacgtaccgcgaaataaacacgaaacgcttaacgcgcccaaacctacgccgactacgactctccccgaaacccgcccgccgcgacttataaaaatccaaaacccgtaaaataacgaaattccaacccgaaaccaccccgcaacgaaaaataaaatctccgaaaaacccgcccgaaacaccccgacgctaaaaaaaatatacgccctaactattacgctacgccgccgacgcgctaacattaaacaacgaactaataacatactcgacgcctcgataaccaaaaactccgcgaaaccccccgcacaaactcacaacaacgaacgaatccgactcgacgttcacgtccccaaaataaaaacaacgtcgcaaatctaaaaaacccccgataaacccctaaaaaaaaacgcccaaatactcaataaaaaaaacgaaa

SEQ ID NO: 31561 - DNA, 1477 bp, Artificial Sequence
  chemically treated genomic DNA (Homo sapiens) CpG-island No: 31561
agggcgaggtttaagcgttggttagtggtcggcgcgaacgttggagttataggagtttcggttcgagatatcggagttagtagtagggtcgcgaacgcgatgtcggggaggttagttgtttgcggttggcgatcgtgaggaagcggtttcgttttagtacgtgtttcggttcggatttcgtttcgggcgtttttcggttattcggagttcgcggagtagtttcgtcggtggcgagggcgggggaggttattcggagtagggtttcgaaatttcgcgggaaggggtcgcggtttaggattttaggttttagggtgggatgtggaatacgcgtacgtatatatattcgatatatcgtttatatttcgacgagtatacggatatataaatataggtttcgtatatatatatttagttgcgcgtatatatatacgcgtacgtatattaaagatattagatttcgaaatatattcggagaacgcgattatatagtagataagcgcggagttatacgtttatatttacgtttatatttaagtatatatttggcggtttcggtcggtcgggaggtcgtataaagttgtaggttttattaagggagtgtttcgggaggttcgggcgtttttcgcgcgttttgcgcgttaagggagggggcgtcgtttttcggcggcgagttaggttttgttcgcgttcggacgtcgtagtttagttcggggatagttttcgttcggtcgttcggggcgtagtcgcggttcggttatcgtaggagcgttcgtcggttcggtttttttttgttcgttcgtcggtttttcgttggggttcgttggttcgggcgtttcgtagtttcggcgtcgtttcggattagtcgttcgttagcgtcgcgcggaatttgcgaaataataaatagttcgatatgttcgaggcggcggtcgcggggttcggtttttttttgagtttcgggttttgttcgattcgggtagtttagggggcgtcgtcgcgataatttgtttcggtttagcgcgttatatacgcgtatacgtatacgcgcgtatatacgttttgttatcgttttttcgggcggtttcgggattagggtatattcgtagtcgcggtttaggcgcgttttatattcgtaatatttttggacgcgtagttagtatatacggatatattcgtatatatttatattcgttttagattcgtttttatatacgtattttcggtatatttggtatttattcggatttacgcggttttcggtagtatatattatatattttagatattttttatacgtatatagcgtacggatatatacgtttcggattcgtttttacgtttttatatatgtatacggattttaaaagtatatacgttatatacgcgttttcggatttatatttaggcgggatttagagagtatttttggttataggtataatataaatatataatttattcgtagatataaaataaatag

SEQ ID NO: 31562 - DNA, 1477 bp, Artificial Sequence
  chemically treated genomic DNA (Homo sapiens) CpG-island No: 31562
ctatttattttatatctacgaataaattatatatttatattatacctataaccaaaaatactctctaaatcccgcctaaatataaatccgaaaacgcgtatataacgtatatacttttaaaatccgtatacatatataaaaacgtaaaaacgaatccgaaacgtatatatccgtacgctatatacgtataaaaaatatctaaaatatataatatatactaccgaaaaccgcgtaaatccgaataaataccaaatataccgaaaatacgtatataaaaacgaatctaaaacgaatataaatatatacgaatatatccgtatatactaactacgcgtccaaaaatattacgaatataaaacgcgcctaaaccgcgactacgaatataccctaatcccgaaaccgcccgaaaaaacgataacaaaacgtatatacgcgcgtatacgtatacgcgtatataacgcgctaaaccgaaacaaattatcgcgacgacgccccctaaactacccgaatcgaacaaaacccgaaactcaaaaaaaaaccgaaccccgcgaccgccgcctcgaacatatcgaactatttattatttcgcaaattccgcgcgacgctaacgaacgactaatccgaaacgacgccgaaactacgaaacgcccgaaccaacgaaccccaacgaaaaaccgacgaacgaacaaaaaaaaaccgaaccgacgaacgctcctacgataaccgaaccgcgactacgccccgaacgaccgaacgaaaactatccccgaactaaactacgacgtccgaacgcgaacaaaacctaactcgccgccgaaaaacgacgccccctcccttaacgcgcaaaacgcgcgaaaaacgcccgaacctcccgaaacactcccttaataaaacctacaactttatacgacctcccgaccgaccgaaaccgccaaatatatacttaaatataaacgtaaatataaacgtataactccgcgcttatctactatataatcgcgttctccgaatatatttcgaaatctaatatctttaatatacgtacgcgtatatatatacgcgcaactaaatatatatatacgaaacctatatttatatatccgtatactcgtcgaaatataaacgatatatcgaatatatatacgtacgcgtattccacatcccaccctaaaacctaaaatcctaaaccgcgaccccttcccgcgaaatttcgaaaccctactccgaataacctcccccgccctcgccaccgacgaaactactccgcgaactccgaataaccgaaaaacgcccgaaacgaaatccgaaccgaaacacgtactaaaacgaaaccgcttcctcacgatcgccaaccgcaaacaactaacctccccgacatcgcgttcgcgaccctactactaactccgatatctcgaaccgaaactcctataactccaacgttcgcgccgaccactaaccaacgcttaaacctcgccct

SEQ ID NO: 31563 - DNA, 1477 bp, Artificial Sequence
  chemically treated genomic DNA (Homo sapiens) CpG-island No: 31563
ttgtttgttttgtgtttgcgagtgggttgtgtgtttgtgttatgtttgtggttaagggtgttttttggatttcgtttgagtgtggattcgggaacgcgtgtgtggcgtgtgtgtttttgagattcgtgtatatgtgtgaaggcgtgggaacgggttcggaacgtgtgtgttcgtgcgttgtgtacgtgtggggagtgtttagggtatgtggtgtgtgttgtcgggggtcgcgtgggttcgagtgaatgttaagtgtgtcgggaatgcgtgtgtgggagcgagtttggaacggatgtgagtgtgtgcgaatgtgttcgtgtgtgttggttgcgcgtttaggaatgttgcgagtgtggagcgcgtttgggtcgcggttgcgagtgtgttttggtttcggggtcgttcgagggggcggtggtaggacgtgtgtgcgcgcgtgtgcgtgtgcgcgtgtgtggcgcgttgggtcggaataagttgtcgcggcggcgttttttgggttgttcgggtcgggtagggttcgaggtttaggggaggatcgggtttcgcggtcgtcgtttcgggtatgtcggattgtttgttgtttcgtaagtttcgcgcggcgttggcgggcggttgattcgaggcggcgtcggggttgcggggcgttcgggttagcgggttttagcgaggggtcggcgggcgggtaggggagggtcggatcggcgggcgtttttgcggtggtcgggtcgcggttgcgtttcgggcggtcgggcgggggttgttttcgggttgggttgcgacgttcgggcgcgggtagggtttggttcgtcgtcgggggacggcgtttttttttttggcgcgtaggacgcgcgggggacgttcgggtttttcgggatatttttttggtggagtttgtaattttgtgcggtttttcggtcggtcgggatcgttaggtgtgtgtttgagtgtgagcgtgagtgtgagcgtgtggtttcgcgtttgtttgttgtgtggtcgcgtttttcgggtgtgtttcggagtttggtgtttttggtgtgcgtgcgcgtgtgtgtgtgcgcgtagttgaatgtatgtatacggagtttgtgtttgtgtgttcgtgtgttcgtcggagtgtggacggtgtgtcggatgtgtgtgcgtgcgcgtgttttatattttattttgaggtttgggattttagatcgcggttttttttcgcggagtttcggggttttgtttcgggtgatttttttcgttttcgttatcggcggggttgtttcgcgggtttcgggtagtcgggagacgttcggggcgggattcgagtcgagatacgtgttggagcggagtcgtttttttacggtcgttagtcgtagataattgattttttcggtatcgcgttcgcggttttgttgttggtttcggtgtttcgggtcggaatttttgtggttttagcgttcgcgtcggttattggttagcgtttgggtttcgtttt

SEQ ID NO: 31564 - DNA, 1477 bp, Artificial Sequence
  chemically treated genomic DNA (Homo sapiens) CpG-island No: 31564
aaaacgaaacccaaacgctaaccaataaccgacgcgaacgctaaaaccacaaaaattccgacccgaaacaccgaaaccaacaacaaaaccgcgaacgcgataccgaaaaaatcaattatctacgactaacgaccgtaaaaaaacgactccgctccaacacgtatctcgactcgaatcccgccccgaacgtctcccgactacccgaaacccgcgaaacaaccccgccgataacgaaaacgaaaaaaatcacccgaaacaaaaccccgaaactccgcgaaaaaaaaccgcgatctaaaatcccaaacctcaaaataaaatataaaacacgcgcacgcacacacatccgacacaccgtccacactccgacgaacacacgaacacacaaacacaaactccgtatacatacattcaactacgcgcacacacacacgcgcacgcacaccaaaaacaccaaactccgaaacacacccgaaaaacgcgaccacacaacaaacaaacgcgaaaccacacgctcacactcacgctcacactcaaacacacacctaacgatcccgaccgaccgaaaaaccgcacaaaattacaaactccaccaaaaaaatatcccgaaaaacccgaacgtcccccgcgcgtcctacgcgccaaaaaaaaaaacgccgtcccccgacgacgaaccaaaccctacccgcgcccgaacgtcgcaacccaacccgaaaacaacccccgcccgaccgcccgaaacgcaaccgcgacccgaccaccgcaaaaacgcccgccgatccgaccctcccctacccgcccgccgacccctcgctaaaacccgctaacccgaacgccccgcaaccccgacgccgcctcgaatcaaccgcccgccaacgccgcgcgaaacttacgaaacaacaaacaatccgacatacccgaaacgacgaccgcgaaacccgatcctcccctaaacctcgaaccctacccgacccgaacaacccaaaaaacgccgccgcgacaacttattccgacccaacgcgccacacacgcgcacacgcacacgcgcgcacacacgtcctaccaccgccccctcgaacgaccccgaaaccaaaacacactcgcaaccgcgacccaaacgcgctccacactcgcaacattcctaaacgcgcaaccaacacacacgaacacattcgcacacactcacatccgttccaaactcgctcccacacacgcattcccgacacacttaacattcactcgaacccacgcgacccccgacaacacacaccacataccctaaacactccccacacgtacacaacgcacgaacacacacgttccgaacccgttcccacgccttcacacatatacacgaatctcaaaaacacacacgccacacacgcgttcccgaatccacactcaaacgaaatccaaaaaacacccttaaccacaaacataacacaaacacacaacccactcgcaaacacaaaacaaacaa

SEQ ID NO: 31565 - DNA, 833 bp, Artificial Sequence
  chemically treated genomic DNA (Homo sapiens) CpG-island No: 31565
ttcgtcgatatatattatttttttttgcgtatagaatttacggatatataatattcgtagttacgtaatatttcgggtatataatcgtttattttacgtttagatatatatagggagtacgttcgtaacgttcggttatttaatatttatattttttttcgagttacgttacgggtttcgaggttcggcggggtaggttcggttcggtcgtcgcgcgtttatttgtcggagtttcggttttcggcgcgtagagttggaaggtgagtgttagtacgagcgtttgggtacgggttatggttggagcgtcgtcgttcgtttcggggttcggcgcgggggacgtcgttttcggagttcgagtttagttcgaggcgagtcggagttcgagtcggagcggagcggcgcggcgcggagcgggattggcgtcgagtttagagcgggagtcggagtaagcggggcgttgacgttaggttcggtcgcgggttcggcggtttcgcggcgttttttgttggttacggcgggtgttgtagcgggttcggtcgttcgttagttttggcgcgtttttttttcgttttcgtatttttttcgttatgaggtttcgcggttgggtttggacgtttacggacgtttttacggatcgggtattaatattgttaggcgagtacgtttatggtttacgtttagttttcgtatagcgtttttagggacggtgatttagggatattcggtttttgttttattcgatgtttgaattttttgtattttggcgtttttaaatgcgtgttttatatatttttaggaatagggcgtttattatttggttaagagcggttgtt

SEQ ID NO: 31566 - DNA, 833 bp, Artificial Sequence
  chemically treated genomic DNA (Homo sapiens) CpG-island No: 31566
aacaaccgctcttaaccaaataataaacgccctattcctaaaaatatataaaacacgcatttaaaaacgccaaaatacaaaaaattcaaacatcgaataaaacaaaaaccgaatatccctaaatcaccgtccctaaaaacgctatacgaaaactaaacgtaaaccataaacgtactcgcctaacaatattaatacccgatccgtaaaaacgtccgtaaacgtccaaacccaaccgcgaaacctcataacgaaaaaaatacgaaaacgaaaaaaaaacgcgccaaaactaacgaacgaccgaacccgctacaacacccgccgtaaccaacaaaaaacgccgcgaaaccgccgaacccgcgaccgaacctaacgtcaacgccccgcttactccgactcccgctctaaactcgacgccaatcccgctccgcgccgcgccgctccgctccgactcgaactccgactcgcctcgaactaaactcgaactccgaaaacgacgtcccccgcgccgaaccccgaaacgaacgacgacgctccaaccataacccgtacccaaacgctcgtactaacactcaccttccaactctacgcgccgaaaaccgaaactccgacaaataaacgcgcgacgaccgaaccgaacctaccccgccgaacctcgaaacccgtaacgtaactcgaaaaaaaatataaatattaaataaccgaacgttacgaacgtactccctatatatatctaaacgtaaaataaacgattatatacccgaaatattacgtaactacgaatattatatatccgtaaattctatacgcaaaaaaaaataatatatatcgacgaa

SEQ ID NO: 31567 - DNA, 833 bp, Artificial Sequence
  chemically treated genomic DNA (Homo sapiens) CpG-island No: 31567
aataatcgtttttggttaggtgatgagcgttttgtttttggaggtatgtagaatacgtatttgaaggcgttaaggtataagggatttaggtatcggatgggatagaggtcgggtgtttttgggttatcgtttttgagagcgttgtacgggagttaggcgtgggttatgagcgtgttcgtttggtagtgttggtgttcggttcgtggagacgttcgtgggcgtttagatttagtcgcggggttttatggcggggaggatgcgggagcgggggaggggcgcgttagggttagcgggcggtcggattcgttgtagtattcgtcgtggttagtagggagcgtcgcgagatcgtcgaattcgcggtcgggtttgacgttagcgtttcgtttgtttcggttttcgttttggattcggcgttagtttcgtttcgcgtcgcgtcgtttcgtttcggttcgggtttcggttcgtttcgggttgggttcgggtttcgggggcggcgtttttcgcgtcgggtttcgggacgggcggcgacgttttaattatggttcgtgtttaggcgttcgtgttggtatttattttttagttttgcgcgtcggagatcgagatttcggtaggtaagcgcgcggcggtcggatcgagtttgtttcgtcgagtttcggggttcgtggcgtagttcggaagaaagtgtgagtgttgagtgatcgggcgttacgagcgtgttttttgtgtgtgtttgagcgtaggatgggcgattgtgtgttcggggtgttgcgtgattgcgaatgttgtgtgttcgtgagttttgtgcgtaagaaaaggtgatgtgtgtcggcgag

SEQ ID NO: 31568 - DNA, 833 bp, Artificial Sequence
  chemically treated genomic DNA (Homo sapiens) CpG-island No: 31568
ctcgccgacacacatcaccttttcttacgcacaaaactcacgaacacacaacattcgcaatcacgcaacaccccgaacacacaatcgcccatcctacgctcaaacacacacaaaaaacacgctcgtaacgcccgatcactcaacactcacactttcttccgaactacgccacgaaccccgaaactcgacgaaacaaactcgatccgaccgccgcgcgcttacctaccgaaatctcgatctccgacgcgcaaaactaaaaaataaataccaacacgaacgcctaaacacgaaccataattaaaacgtcgccgcccgtcccgaaacccgacgcgaaaaacgccgcccccgaaacccgaacccaacccgaaacgaaccgaaacccgaaccgaaacgaaacgacgcgacgcgaaacgaaactaacgccgaatccaaaacgaaaaccgaaacaaacgaaacgctaacgtcaaacccgaccgcgaattcgacgatctcgcgacgctccctactaaccacgacgaatactacaacgaatccgaccgcccgctaaccctaacgcgcccctcccccgctcccgcatcctccccgccataaaaccccgcgactaaatctaaacgcccacgaacgtctccacgaaccgaacaccaacactaccaaacgaacacgctcataacccacgcctaactcccgtacaacgctctcaaaaacgataacccaaaaacacccgacctctatcccatccgatacctaaatcccttataccttaacgccttcaaatacgtattctacatacctccaaaaacaaaacgctcatcacctaaccaaaaacgattatt

SEQ ID NO: 31569 - DNA, 711 bp, Artificial Sequence
  chemically treated genomic DNA (Homo sapiens) CpG-island No: 31569
tttcgcggattttatttgtgtaatgggtattaaggttttagtttcgtaagatgtcgagaggtaagagttagacgttaagggttagttcggggcgatttcgtaaagtttttagcgaaagtagcgttcggggaggggcgggttttgtagttgaaaggatcggacggggtgcggatgtgtcgtcgggtatttttaagaataggcgttttttcgttagtgggggagcgggtttgtttttaataacggggagggtgttgagagttgcgatttcgtcggcgagttcgaagggggcggttcggttttcgcgttttttcgtttttggaggtaggaatgtagagcgggggagttagggcggtcggcggtcggtttagtttttatgatgcggggggcgggttcgggggaggcggcgatcgatttttaggtttagcggttaggtcgggtttttcgggaggaattttcggtttaggattgattaaggttcgttttttttttcggtcgtggagattttcggcgcgtagtcggggggaggggcgttaatgagattcggttgcgcgtcgcggatagggaggggattcgaggaaggggcgggttaggggtcggggttatttttcgacgcggggcggagtcgggtttcggagtcgtacggttaggttaggttttgaatttgagttttcgttttttgggtcggcggaggagagtgggggtgtattagtg

SEQ ID NO: 31570 - DNA, 711 bp, Artificial Sequence
  chemically treated genomic DNA (Homo sapiens) CpG-island No: 31570
cactaatacacccccactctcctccgccgacccaaaaaacgaaaactcaaattcaaaacctaacctaaccgtacgactccgaaacccgactccgccccgcgtcgaaaaataaccccgacccctaacccgccccttcctcgaatcccctccctatccgcgacgcgcaaccgaatctcattaacgcccctccccccgactacgcgccgaaaatctccacgaccgaaaaaaaaaacgaaccttaatcaatcctaaaccgaaaattcctcccgaaaaacccgacctaaccgctaaacctaaaaatcgatcgccgcctcccccgaacccgccccccgcatcataaaaactaaaccgaccgccgaccgccctaactcccccgctctacattcctacctccaaaaacgaaaaaacgcgaaaaccgaaccgcccccttcgaactcgccgacgaaatcgcaactctcaacaccctccccgttattaaaaacaaacccgctcccccactaacgaaaaaacgcctattcttaaaaatacccgacgacacatccgcaccccgtccgatcctttcaactacaaaacccgcccctccccgaacgctactttcgctaaaaactttacgaaatcgccccgaactaacccttaacgtctaactcttacctctcgacatcttacgaaactaaaaccttaatacccattacacaaataaaatccgcgaaa

SEQ ID NO: 31571 - DNA, 711 bp, Artificial Sequence
  chemically treated genomic DNA (Homo sapiens) CpG-island No: 31571
tattgatgtatttttattttttttcgtcgatttagagggcgggagtttaggtttaaggtttggtttggtcgtgcggtttcgggattcggtttcgtttcgcgtcggggggtggtttcggtttttggttcgtttttttttcgggttttttttttgttcgcggcgcgtagtcgggttttattagcgttttttttttcggttgcgcgtcgggggtttttacggtcggggggaggggcgggttttaattaattttaggtcggaaatttttttcggggggttcggtttgatcgttgagtttggaaatcggtcgtcgtttttttcgaattcgtttttcgtattatggaaattgggtcgatcgtcggtcgttttggttttttcgttttgtatttttgtttttaggggcgggagggcgcgaaggtcgggtcgtttttttcgggttcgtcggcggggtcgtagtttttagtatttttttcgttattgggaataagttcgtttttttattggcgaaggggcgtttgtttttaggagtattcggcggtatattcgtatttcgttcggtttttttagttataaggttcgttttttttcgggcgttgttttcgttgagggttttgcggagtcgtttcgggttggtttttggcgtttggtttttgtttttcggtattttgcgaggttgaagttttggtgtttattgtatagatgaagttcgcgagg

SEQ ID NO: 31572 - DNA, 711 bp, Artificial Sequence
  chemically treated genomic DNA (Homo sapiens) CpG-island No: 31572
cctcgcgaacttcatctatacaataaacaccaaaacttcaacctcgcaaaataccgaaaaacaaaaaccaaacgccaaaaaccaacccgaaacgactccgcaaaaccctcaacgaaaacaacgcccgaaaaaaaacgaaccttataactaaaaaaaccgaacgaaatacgaatataccgccgaatactcctaaaaacaaacgccccttcgccaataaaaaaacgaacttattcccaataacgaaaaaaatactaaaaactacgaccccgccgacgaacccgaaaaaaacgacccgaccttcgcgccctcccgcccctaaaaacaaaaatacaaaacgaaaaaaccaaaacgaccgacgatcgacccaatttccataatacgaaaaacgaattcgaaaaaaacgacgaccgatttccaaactcaacgatcaaaccgaaccccccgaaaaaaatttccgacctaaaattaattaaaacccgcccctccccccgaccgtaaaaacccccgacgcgcaaccgaaaaaaaaaacgctaataaaacccgactacgcgccgcgaacaaaaaaaaaacccgaaaaaaaaacgaaccaaaaaccgaaaccaccccccgacgcgaaacgaaaccgaatcccgaaaccgcacgaccaaaccaaaccttaaacctaaactcccgccctctaaatcgacgaaaaaaaataaaaatacatcaata

SEQ ID NO: 31573 - DNA, 684 bp, Artificial Sequence
  chemically treated genomic DNA (Homo sapiens) CpG-island No: 31573
attacgagcgtttttagcgtcgcgaacgttttcgacggcgagcgtagtcgtagtcgcgttcgtattcgtagaggttcgggcggggagcgcgggcgtcggcggcggtttaggcggcggtttaagcgagagacgcggttttcggggttttttcgtattttttcgtatttttcggggttttcggtcgttatttcgtcgtcgtttgggcgttttgcggagagaagatgggaggtaaggattggatcgacgggtttttagttttagggcgttaggttcggggcgtaaattcgggagggaagtttcggtcgtttagtttaggtcgtttggagatttttggcggttattttcggattttttcgggcggcgaggcggggagtcgttcgcgttcgggtttttcgtagcggagtttcgagttaggtacgcgcggtagaagtcggagttggttcggttagcgggcggagaggagggaggggggcgtaggttgttttttggcgtatttcgggttgtaaatttgtcgtttgcgttcggttcgtaagttcgcgggttttgggtttcgggaaacgtgcggtttttagttgtcgcgtttttagggtaagtatttttcgggttcgattttattttcgtacgtggttgtatcgtagtaaatggggcgggggcgttcgggttttttaggttcgtaggggtcgt

SEQ ID NO: 31574 - DNA, 684 bp, Artificial Sequence
  chemically treated genomic DNA (Homo sapiens) CpG-island No: 31574
acgacccctacgaacctaaaaaacccgaacgcccccgccccatttactacgatacaaccacgtacgaaaataaaatcgaacccgaaaaatacttaccctaaaaacgcgacaactaaaaaccgcacgtttcccgaaacccaaaacccgcgaacttacgaaccgaacgcaaacgacaaatttacaacccgaaatacgccaaaaaacaacctacgcccccctccctcctctccgcccgctaaccgaaccaactccgacttctaccgcgcgtacctaactcgaaactccgctacgaaaaacccgaacgcgaacgactccccgcctcgccgcccgaaaaaatccgaaaataaccgccaaaaatctccaaacgacctaaactaaacgaccgaaacttccctcccgaatttacgccccgaacctaacgccctaaaactaaaaacccgtcgatccaatccttacctcccatcttctctccgcaaaacgcccaaacgacgacgaaataacgaccgaaaaccccgaaaaatacgaaaaaatacgaaaaaaccccgaaaaccgcgtctctcgcttaaaccgccgcctaaaccgccgccgacgcccgcgctccccgcccgaacctctacgaatacgaacgcgactacgactacgctcgccgtcgaaaacgttcgcgacgctaaaaacgctcgtaat

SEQ ID NO: 31575 - DNA, 684 bp, Artificial Sequence
  chemically treated genomic DNA (Homo sapiens) CpG-island No: 31575
gcgatttttgcggatttgggaggttcgagcgttttcgttttatttgttacggtgtagttacgtgcgggggtggggtcgagttcgggaggtatttattttggagacgcggtagttgggggtcgtacgtttttcgaggtttaagattcgcgggtttgcggatcggacgtaggcggtagatttgtagttcgggatgcgttagagaatagtttgcgtttttttttttttttttcgttcgttggtcgggttaatttcggtttttgtcgcgcgtgtttggttcggagtttcgttgcggaaaattcgagcgcgggcggtttttcgtttcgtcgttcgggaaaattcgggggtggtcgttagggatttttaagcggtttgggttgggcggtcggagtttttttttcggatttgcgtttcgaatttggcgttttgaagttagaggttcgtcggtttagtttttgttttttatttttttttcgtagagcgtttagacgacggcgagatgacggtcgggagtttcgaagaatgcggggaggtgcggaggagtttcgagggtcgcgtttttcgtttgggtcgtcgtttgggtcgtcgtcggcgttcgcgtttttcgttcgagtttttgcgggtgcgggcgcggttgcggttgcgttcgtcgtcgggggcgttcgcggcgttgggggcgttcgtggt

SEQ ID NO: 31576 - DNA, 684 bp, Artificial Sequence
  chemically treated genomic DNA (Homo sapiens) CpG-island No: 31576
accacgaacgcccccaacgccgcgaacgcccccgacgacgaacgcaaccgcaaccgcgcccgcacccgcaaaaactcgaacgaaaaacgcgaacgccgacgacgacccaaacgacgacccaaacgaaaaacgcgaccctcgaaactcctccgcacctccccgcattcttcgaaactcccgaccgtcatctcgccgtcgtctaaacgctctacgaaaaaaaaataaaaaacaaaaactaaaccgacgaacctctaacttcaaaacgccaaattcgaaacgcaaatccgaaaaaaaaactccgaccgcccaacccaaaccgcttaaaaatccctaacgaccacccccgaattttcccgaacgacgaaacgaaaaaccgcccgcgctcgaattttccgcaacgaaactccgaaccaaacacgcgcgacaaaaaccgaaattaacccgaccaacgaacgaaaaaaaaaaaaaaaaacgcaaactattctctaacgcatcccgaactacaaatctaccgcctacgtccgatccgcaaacccgcgaatcttaaacctcgaaaaacgtacgacccccaactaccgcgtctccaaaataaatacctcccgaactcgaccccacccccgcacgtaactacaccgtaacaaataaaacgaaaacgctcgaacctcccaaatccgcaaaaatcgc

SEQ ID NO: 31577 - DNA, 729 bp, Artificial Sequence
  chemically treated genomic DNA (Homo sapiens) CpG-island No: 31577
attcgcgttttcgaggcgtcgttattatggcggagtttggttaggtcggtagtcgtttcgcgcggattaggcgtttttttttcgttttcgcggtttttttattatttatggggtttgttttcgttcggtcggattttttttcgttttttttattcgttttttagatttatttttaggattttttcgtagtttttaaagaagcgttttatatcgcgttttcgggtttggtagtttaggcggtcgatgtatattcgcggtatttcggtaacggtagtgatggttggtttcggttttagttttttttaggcggcggcgggtaaagggagagtacggcggtagcggcggcggcggtaacgggcgggcggcgggacggacgtagtcgaatttcggcgacgtacgcgagtacgtagttcgcgagcgcgcgtttttatttttttcgttttttttcgaggcggaaggtaatcggagagagcgcgcgttcgtttttcgttcggttaggattgggggaggagtttgttcgggggcgcgtcgacgtgcggcggggtaaggtgatcgataggcggcgttgcggtacgttttcgcgcgagttcgttaaaggggtttttgtatcgtttttagtagttagttggtttcgtttttttttcggaagtgttcgtattttttagagtttagcgagcgagcgtttgtgtttttgttttttgaatcgggtgtggtttggatttcggagtt

SEQ ID NO: 31578 - DNA, 729 bp, Artificial Sequence
  chemically treated genomic DNA (Homo sapiens) CpG-island No: 31578
aactccgaaatccaaaccacacccgattcaaaaaacaaaaacacaaacgctcgctcgctaaactctaaaaaatacgaacacttccgaaaaaaaaacgaaaccaactaactactaaaaacgatacaaaaacccctttaacgaactcgcgcgaaaacgtaccgcaacgccgcctatcgatcaccttaccccgccgcacgtcgacgcgcccccgaacaaactcctcccccaatcctaaccgaacgaaaaacgaacgcgcgctctctccgattaccttccgcctcgaaaaaaaacgaaaaaaataaaaacgcgcgctcgcgaactacgtactcgcgtacgtcgccgaaattcgactacgtccgtcccgccgcccgcccgttaccgccgccgccgctaccgccgtactctccctttacccgccgccgcctaaaaaaaactaaaaccgaaaccaaccatcactaccgttaccgaaataccgcgaatatacatcgaccgcctaaactaccaaacccgaaaacgcgatataaaacgcttctttaaaaactacgaaaaaatcctaaaaataaatctaaaaaacgaataaaaaaaacgaaaaaaaatccgaccgaacgaaaacaaaccccataaataataaaaaaaccgcgaaaacgaaaaaaaaacgcctaatccgcgcgaaacgactaccgacctaaccaaactccgccataataacgacgcctcgaaaacgcgaat

SEQ ID NO: 31579 - DNA, 729 bp, Artificial Sequence
  chemically treated genomic DNA (Homo sapiens) CpG-island No: 31579
agtttcgaaatttaaattatattcggtttaaaggataaaagtataaacgttcgttcgttgggttttaggaggtgcggatattttcgggggaggggcgaagttagttggttgttgaaggcggtgtaggaatttttttggcgagttcgcgcgaggacgtgtcgtagcgtcgtttgtcgattattttgtttcgtcgtacgtcggcgcgttttcgggtaagttttttttttagttttggtcgagcgggaagcgaacgcgcgtttttttcggttatttttcgtttcggggaagggcgggggaagtggaagcgcgcgttcgcgagttgcgtgttcgcgtacgtcgtcggggttcggttgcgttcgtttcgtcgttcgttcgttgtcgtcgtcgtcgttgtcgtcgtgttttttttttgttcgtcgtcgtttaaggggggttggggtcggggttagttattattgtcgttgtcgggatgtcgcgggtgtatatcggtcgtttgagttattaggttcgggagcgcgatgtggagcgtttttttaagggttacgggaagattttggaggtggatttgaagaacgggtgaggagggcgaaagagggttcggtcgggcggggatagattttataggtggtggggaggtcgcggggacgggagagggacgtttggttcgcgcggagcggttatcggtttggttaggtttcgttatagtggcggcgtttcgggggcgcgggt

SEQ ID NO: 31580 - DNA, 729 bp, Artificial Sequence
  chemically treated genomic DNA (Homo sapiens) CpG-island No: 31580
acccgcgcccccgaaacgccgccactataacgaaacctaaccaaaccgataaccgctccgcgcgaaccaaacgtccctctcccgtccccgcgacctccccaccacctataaaatctatccccgcccgaccgaaccctctttcgccctcctcacccgttcttcaaatccacctccaaaatcttcccgtaacccttaaaaaaacgctccacatcgcgctcccgaacctaataactcaaacgaccgatatacacccgcgacatcccgacaacgacaataataactaaccccgaccccaaccccccttaaacgacgacgaacaaaaaaaaaacacgacgacaacgacgacgacgacaacgaacgaacgacgaaacgaacgcaaccgaaccccgacgacgtacgcgaacacgcaactcgcgaacgcgcgcttccacttcccccgcccttccccgaaacgaaaaataaccgaaaaaaacgcgcgttcgcttcccgctcgaccaaaactaaaaaaaaaacttacccgaaaacgcgccgacgtacgacgaaacaaaataatcgacaaacgacgctacgacacgtcctcgcgcgaactcgccaaaaaaattcctacaccgccttcaacaaccaactaacttcgcccctcccccgaaaatatccgcacctcctaaaacccaacgaacgaacgtttatacttttatcctttaaaccgaatataatttaaatttcgaaact

SEQ ID NO: 31581 - DNA, 682 bp, Artificial Sequence
  chemically treated genomic DNA (Homo sapiens) CpG-island No: 31581
ggatcgaagagggcgtacgggttcggtttttttacgcgttttttagggattcggtagttagatagacggataggcggatcgttagggagtttaagtattcggatatacgtacgagcgtagaataaagggtcggatatgttttagttcgtttcgtttgcgtttcggttttgcgcgcgggggttcgggttatttgcgtaggtgagttgggtggggtcgggttcgtcgaggtttcggttttagttttttgcgcggttcgggtcgcggttttcgattcggtgttcggagagttggggttcggtcgttttttttttttggtttttggtgaaattgagttagcgtcgtcggggggcgggggtcgatatttattttttgcgttgttcggtttcggttttaacgtcggtgcgttgcggtcgtttttagcgcggagttttaggttcggttcgtttcgcggtttcgtagtttcggcgttttttcggtagttagtttttcggaggggttttcgggttttatttagtttagtttcgcgagggagtttcgcgttcgaagcgtatttttagtcgggaggggacgcggtcgggacgcgagggttcggtttttggggcggcggtttttagttttttttttcggtcggggtttgtttttttagttttagatttgaggttcgatgtaaatgattttttcg

SEQ ID NO: 31582 - DNA, 682 bp, Artificial Sequence
  chemically treated genomic DNA (Homo sapiens) CpG-island No: 31582
cgaaaaaatcatttacatcgaacctcaaatctaaaactaaaaaaacaaaccccgaccgaaaaaaaaaactaaaaaccgccgccccaaaaaccgaaccctcgcgtcccgaccgcgtcccctcccgactaaaaatacgcttcgaacgcgaaactccctcgcgaaactaaactaaataaaacccgaaaacccctccgaaaaactaactaccgaaaaaacgccgaaactacgaaaccgcgaaacgaaccgaacctaaaactccgcgctaaaaacgaccgcaacgcaccgacgttaaaaccgaaaccgaacaacgcaaaaaataaatatcgacccccgccccccgacgacgctaactcaatttcaccaaaaaccaaaaaaaaaaaacgaccgaaccccaactctccgaacaccgaatcgaaaaccgcgacccgaaccgcgcaaaaaactaaaaccgaaacctcgacgaacccgaccccacccaactcacctacgcaaataacccgaacccccgcgcgcaaaaccgaaacgcaaacgaaacgaactaaaacatatccgaccctttattctacgctcgtacgtatatccgaatacttaaactccctaacgatccgcctatccgtctatctaactaccgaatccctaaaaaacgcgtaaaaaaaccgaacccgtacgccctcttcgatcc

SEQ ID NO: 31583 - DNA, 682 bp, Artificial Sequence
  chemically treated genomic DNA (Homo sapiens) CpG-island No: 31583
cggaaagattatttgtatcgggttttaggtttggggttgggaaagtaggtttcggtcggaaaggaagattggaggtcgtcgttttagaggtcggattttcgcgtttcggtcgcgttttttttcggttggggatgcgtttcgggcgcggggttttttcgcgaggttggattgggtggagttcgagagttttttcggggagttggttgtcggggaggcgtcggggttgcggggtcgcggggcgggtcgggtttggagtttcgcgttagaggcggtcgtagcgtatcggcgttggggtcggggtcgggtagcgtaaagggtgaatgtcggttttcgtttttcgacggcgttgatttagttttattagaaattagggggagaaggcggtcgagttttagtttttcgagtatcgggtcggaagtcgcgattcgagtcgcgtaggaagttgggatcggaatttcggcggattcggttttatttaatttatttgcgtaggtaattcgggttttcgcgcgtaaggtcgaggcgtaggcggagcgggttggagtatgttcggttttttgttttgcgttcgtgcgtgtgttcgggtatttgagttttttagcggttcgtttgttcgtttgtttggttgtcgggtttttggagggcgcgtgggagggtcgggttcgtgcgtttttttcgattt

SEQ ID NO: 31584 - DNA, 682 bp, Artificial Sequence
  chemically treated genomic DNA (Homo sapiens) CpG-island No: 31584
aaatcgaaaaaaacgcacgaacccgaccctcccacgcgccctccaaaaacccgacaaccaaacaaacgaacaaacgaaccgctaaaaaactcaaatacccgaacacacgcacgaacgcaaaacaaaaaaccgaacatactccaacccgctccgcctacgcctcgaccttacgcgcgaaaacccgaattacctacgcaaataaattaaataaaaccgaatccgccgaaattccgatcccaacttcctacgcgactcgaatcgcgacttccgacccgatactcgaaaaactaaaactcgaccgccttctccccctaatttctaataaaactaaatcaacgccgtcgaaaaacgaaaaccgacattcaccctttacgctacccgaccccgaccccaacgccgatacgctacgaccgcctctaacgcgaaactccaaacccgacccgccccgcgaccccgcaaccccgacgcctccccgacaaccaactccccgaaaaaactctcgaactccacccaatccaacctcgcgaaaaaaccccgcgcccgaaacgcatccccaaccgaaaaaaaacgcgaccgaaacgcgaaaatccgacctctaaaacgacgacctccaatcttcctttccgaccgaaacctactttcccaaccccaaacctaaaacccgatacaaataatctttccg

SEQ ID NO: 31585 - DNA, 546 bp, Artificial Sequence
  chemically treated genomic DNA (Homo sapiens) CpG-island No: 31585
gcgtaggcgtagaggaggttagcgttttttgttgtttcgtttcgcggtttttaggagataggggttacggggagagtatagttattcggcgcgaagagttttttgtatttcgtttttttttgaggttttcggatcgtttaggaaatgtttgggagttcgtttgcggagggtatagcgtcgattttcgtttttcgtttaggattcgaatgaatttggagagcggatgttagtagtggtcgaggcgttaggataggaaggatcgttagattttttaagattagtttttttcgttatcgtttttatttttttgttcgttgttttttttttaatgtttagtagcgcgtataggtttatttgtaagagttttttggttattgttatggtttcggtttgacggattcgtattataatttttaagagtttaagcgcgcgtgaggattgtaggtttcgagcggcgtttagttttttgggaattgtgttttgggttaggtttgattgattttgagggaggtcggtagtcgtgaatgaattacgatttttagtagt

SEQ ID NO: 31586 - DNA, 546 bp, Artificial Sequence
  chemically treated genomic DNA (Homo sapiens) CpG-island No: 31586
actactaaaaatcgtaattcattcacgactaccgacctccctcaaaatcaatcaaacctaacccaaaacacaattcccaaaaaactaaacgccgctcgaaacctacaatcctcacgcgcgcttaaactcttaaaaattataatacgaatccgtcaaaccgaaaccataacaataaccaaaaaactcttacaaataaacctatacgcgctactaaacattaaaaaaaaaacaacgaacaaaaaaataaaaacgataacgaaaaaaactaatcttaaaaaatctaacgatccttcctatcctaacgcctcgaccactactaacatccgctctccaaattcattcgaatcctaaacgaaaaacgaaaatcgacgctataccctccgcaaacgaactcccaaacatttcctaaacgatccgaaaacctcaaaaaaaaacgaaatacaaaaaactcttcgcgccgaataactatactctccccgtaacccctatctcctaaaaaccgcgaaacgaaacaacaaaaaacgctaacctcctctacgcctacgc

SEQ ID NO: 31587 - DNA, 546 bp, Artificial Sequence
  chemically treated genomic DNA (Homo sapiens) CpG-island No: 31587
gttgttgggagtcgtagtttatttacgattgtcggttttttttagagttagttaagtttgatttagaatataatttttagagggttaggcgtcgttcggagtttgtagtttttacgcgcgtttagatttttgggagttgtagtacgaattcgttaggtcggaattatggtagtgattaaggagtttttatagatggatttgtacgcgttgttaggtattgaggagaaggtagcggataaagaggtgagaacggtggcgaggaaggttgattttgagaggtttggcggttttttttgttttagcgtttcggttattgttggtattcgttttttaggtttattcgggttttgggcggggagcgagggtcggcgttatgtttttcgtaggcgggtttttagatattttttggacggttcgagggttttaagaggaagcggggtatagagggtttttcgcgtcgggtggttgtgtttttttcgtggtttttgttttttagaggtcgcggggcgaggtagtaaggaacgttagttttttttgcgtttgcgt

SEQ ID NO: 31588 - DNA, 546 bp, Artificial Sequence
  chemically treated genomic DNA (Homo sapiens) CpG-island No: 31588
acgcaaacgcaaaaaaaactaacgttccttactacctcgccccgcgacctctaaaaaacaaaaaccacgaaaaaaacacaaccacccgacgcgaaaaaccctctataccccgcttcctcttaaaaccctcgaaccgtccaaaaaatatctaaaaacccgcctacgaaaaacataacgccgaccctcgctccccgcccaaaacccgaataaacctaaaaaacgaataccaacaataaccgaaacgctaaaacaaaaaaaaccgccaaacctctcaaaatcaaccttcctcgccaccgttctcacctctttatccgctaccttctcctcaatacctaacaacgcgtacaaatccatctataaaaactccttaatcactaccataattccgacctaacgaattcgtactacaactcccaaaaatctaaacgcgcgtaaaaactacaaactccgaacgacgcctaaccctctaaaaattatattctaaatcaaacttaactaactctaaaaaaaaccgacaatcgtaaataaactacgactcccaacaac

SEQ ID NO: 31589 - DNA, 536 bp, Artificial Sequence
  chemically treated genomic DNA (Homo sapiens) CpG-island No: 31589
tcgcgttcgtgggaggttcgtacgtgtcgggttcggagaggcggggaggcggtcggcgtttagcggtcgaggcgcgggttttgtattttggtagcggtcgagttcggttgttttagtgttttttttatttcgcgttgggttaggtagggcgcgttttcgtcgacgaagatttgtttaaggtgttcgagtttttcgcgagaggggatagttacgaataataatagtatttagcgtagattaggcggggaggaaagttttcggttcgtagtagagcggagttcgttaaggttggaggaaaagggatgtagagcgggagggtgaaaatttgaaagaagagggtagcgggaatattgtgtgggtaggaacgggtttcgggggcgacgttcgtagggggagacgggtgcggggtgcgttgtttaaggtgtaggggaggtgattggcgcgcggcgggcgcggagttcggagttgatattggttggcgggcggaggggagagcggggaatagttgtttggggcgttgggtattttcgggcgcg

SEQ ID NO: 31590 - DNA, 536 bp, Artificial Sequence
  chemically treated genomic DNA (Homo sapiens) CpG-island No: 31590
cgcgcccgaaaatacccaacgccccaaacaactattccccgctctcccctccgcccgccaaccaatatcaactccgaactccgcgcccgccgcgcgccaatcacctcccctacaccttaaacaacgcaccccgcacccgtctccccctacgaacgtcgcccccgaaacccgttcctacccacacaatattcccgctaccctcttctttcaaattttcaccctcccgctctacatcccttttcctccaaccttaacgaactccgctctactacgaaccgaaaactttcctccccgcctaatctacgctaaatactattattattcgtaactatcccctctcgcgaaaaactcgaacaccttaaacaaatcttcgtcgacgaaaacgcgccctacctaacccaacgcgaaataaaaaaaacactaaaacaaccgaactcgaccgctaccaaaatacaaaacccgcgcctcgaccgctaaacgccgaccgcctccccgcctctccgaacccgacacgtacgaacctcccacgaacgcga

SEQ ID NO: 31591 - DNA, 536 bp, Artificial Sequence
  chemically treated genomic DNA (Homo sapiens) CpG-island No: 31591
cgcgttcgggggtgtttagcgttttagatagttgtttttcgttttttttttcgttcgttagttagtgttagtttcgggtttcgcgttcgtcgcgcgttagttattttttttgtattttggatagcgtatttcgtattcgtttttttttgcgggcgtcgttttcgggattcgtttttgtttatatagtgttttcgttgttttttttttttaggtttttattttttcgttttgtatttttttttttttagttttggcggatttcgttttgttgcgggtcggaaattttttttttcgtttagtttgcgttgggtattgttgttattcgtgattgttttttttcgcggggagttcggatattttggataggttttcgtcggcgggagcgcgttttgtttggtttaacgcgaggtaaaggaggtattggggtagtcggattcggtcgttgttagggtgtagagttcgcgtttcggtcgttggacgtcggtcgttttttcgttttttcggattcgatacgtgcgagttttttacggacgcgg

SEQ ID NO: 31592 - DNA, 536 bp, Artificial Sequence
  chemically treated genomic DNA (Homo sapiens) CpG-island No: 31592
ccgcgtccgtaaaaaactcgcacgtatcgaatccgaaaaaacgaaaaaacgaccgacgtccaacgaccgaaacgcgaactctacaccctaacaacgaccgaatccgactaccccaatacctcctttacctcgcgttaaaccaaacaaaacgcgctcccgccgacgaaaacctatccaaaatatccgaactccccgcgaaaaaaaacaatcacgaataacaacaatacccaacgcaaactaaacgaaaaaaaaaatttccgacccgcaacaaaacgaaatccgccaaaactaaaaaaaaaaaaatacaaaacgaaaaaataaaaacctaaaaaaaaaaaacaacgaaaacactatataaacaaaaacgaatcccgaaaacgacgcccgcaaaaaaaaacgaatacgaaatacgctatccaaaatacaaaaaaaataactaacgcgcgacgaacgcgaaacccgaaactaacactaactaacgaacgaaaaaaaaaacgaaaaacaactatctaaaacgctaaacacccccgaacgcg

SEQ ID NO: 31593 - DNA, 4293 bp, Artificial Sequence
  chemically treated genomic DNA (Homo sapiens) CpG-island No: 31593
ggatgatttttttcggacgtagatgagggacgggcggatgattttttttcggacgtagatgagggacgggtggatgattttttttcggacgtagatgagggacgggtggatgattttttttcggacgtagatgagggacgggcggatgattttttttcggacgtagatgagggacgggcggatgatttttttcgggacgtagatgagggacgggcggatgatttttttcgggacgtagatgagggacgggcggatgatttttttcggacgtagatgaggaacgggcggatgattttttttagacgtagatgagggacgggcggatgatttttttcgggacgtcgatgaggaacgggtggatgatttttttaggacgtagatgagggacgggtggatgatttttttaggacgtagatgagggacgggcggatgatttttttttagacgtagatgagggacgggtggatgatttttttaggacgtagatgagggacgggtggatgattttttttagacgtagatgagggacgggtggatgattttttttaggacgtagatgaggaacgggtggatgatttttttaggacgtagatgagggacgggcggatgatttttttttagacgtagatgaggaacgggcggatgattttttttaggacgtagatgagggacgggcggatgatttttttttagacgtagatgagggatgggtggatgatttttttaggacgtagatgagggacgggtggatgatttttttcggacgtagatgaggaacgggcggatgattttttttcggacgtagatgagggacgggtggatgatttttttaggacgtagatgagggacgggtggatgattttttttagacgtagatgagggacgggtagatgattttttttcggacgtagatgagggacgggtggatgattttttttagacgtagatgaggaacgggcggatgattttttttcggacgtagatgagggacgggcggatgatttttttaggacgtagatgagggacgggcggatgatttttttttagacgtagatgagggacgggcggatgatttttttcgggacgtcgatgaggaacgggtggatgatttttttaggacgtagatgagggacgggcggatgattttttttcggacgtagatgagggacgggcggatgatttttttttagacgtagatgagggacgggcggatgatttttttttagacgtagatgagggacgggtggatgatttttttaggacgtagatgagggacgggtggatgatttttttttagacgtagatgagggacgggtggatgattttttttagacgtagatgagggacgggcggatgattttttttaggacgtagatgagggacgggcggatgattttttttcggacgtagatgagggacgggcggatgatttttttttagacgtagatgagggacgggcggatgatttttttcgggacgtcgatgaggaacgggtggatgatttttttaggatgtcgatgagggacgggcggatgatttttttttagacgtagatgagggacgggcggatgatttttttcgggacgtcgatgaggaacgggtggatgatttttttaggacgtagatgagggacgggcggatgatttttttttagacgtagatgagggaggggtggatgatttttttaggacgtagatgagggacgggcggatgatttcgttttagacgtagatgagggacgggcggatgattttttcggacgtagatgagggacgggcggatgatttttttttagacgtagatgaggaacgggcggatgattttttttaggacgtagatgagggacgggtggatgattttttttcggacgtagatgagggacgggtggatgatttttttttggacgtagatgagggacgggtggatgattttttttggacgtagatgaggaacgggcggatgatttttttcggacgtagatgagggaggggtggatgatttttttcggacgtagatgagggacgggtggatgatttttttaggacgtagatgagggacgggcggatgatttttttttagacgtagatgaggaacgggcggatgattttttttaggacgtagatgagggacgggcggatgattttttttcggacgtagatgagggacgggtggatgatttttttcggacgtagatgaggaacgggcggatgatttttttttagacgtagatgaggaacgggcggatgattttttttaggacgtagatgaggaacgggcggatgattttttttcggacgtagatgagggacgggcggatgatttttttcggacgtagatgagggacgggtggatgattttttttagacgtagatgaggaacgggcggatgattttttttcggacgtagatgagggacgggtggatgattttttttcggacgtagatgagggacgggcggatgatttttttttagacgtagatgagggacgggtggatgatttttttttagacgtagatgagggacgggcggatgatttttttaggacgtagatgagggacgggtggatgatttttttttagacgtagatgaggaacgggcggatgatttttttcgggacgtcgatgaggaacgggtggatgatttttttaggacgtagatgaggaacgggcgaatgatttttttcgggacgtcgatgaggaacgggtggatgatttttttaggacgtagatgaggaacgggcggatgatttttttcgggacgtcgatgaggaacgggtggatgatttttttaggacgtagatgagggacgggtggatgatttttttttagacgtagatgagggacgggcggatgatttttttttagacgtagatgagggacgggcggatgatttttttttagacgtagatgagggacgggcggatgatttttttaggacgtagatgagggacgggcggatgatttttttttagacgtagatgagggacgggcggatgatttttttttagacgtagatgagggacgggcggatgatttttttaggacgtagatgagggacgggtggatgatttttttttagacgtagatgaggaacgggtggatgatttttttcgggacgtcgatgaggaacgggtggatgatttttttaggacgtagatgaggaacgggcggatgatttttttcgggacgtcgatgaggaacgggtggatgatttttttaggacgtagatgagggacgggtggatgatttttttttagacgtagatgagggacgggcggatgatttttttttagacgtagatgagggacgggcggatgatttttttttagacgtagatgagggacgggcggatgatttttttaggacgtagatgagggacgggcggatgatttttttttagacgtagatgagggacgggcggatgatttttttttagacgtagatgagggacgggcggatgatttttttcggacgtagatgagggacgggcggatgatttttttcgggacgtcgatgaggaacgggtggatgatttttttaggacgtagatgaggaacgggcggatgatttttttttagacgtagatgaggaaagggcggatgattttttttaggacgtagatgagggacgggcggatgatttttttttagacgtagatgagggacgggcggatgatttttttcggacgtagatgagggacgggcggatgattttttttcggacgtagatgagcgacgggtggatgatttttttttagacgtagatgagggatgggcggatgattttttttcggacgtagatgaggaacgagtagatgattttttttcggacgtagatgaggaacgagtagatgatttttttttagacgtagatgagggacgggcggatgattttttttcggacgtagatgagggacgggcggatgattttttttcggacgtagatgagggacgggttgatgattttttttcggatatagatgagggacgggcggatgattttttttcggacgtagatgagggacgggcggatgattttttcgggacgtagatgagggacgggcggatgattttttttcggacgtagatgagggacgggtggatgattttttttcggacgtagatgagggacgggtggatgattttttttcggacgtagatgagggacgggcggatgatttttttttagacgtagatgagggacgggtggatgatttttttaggatttaaatgaaggacgggtggatgaattttttttagacgtagatgagggacgggtggattattttttttag

SEQ ID NO: 31594 - DNA, 4293 bp, Artificial Sequence
  chemically treated genomic DNA (Homo sapiens) CpG-island No: 31594
ctaaaaaaaataatccacccgtccctcatctacgtctaaaaaaaattcatccacccgtccttcatttaaatcctaaaaaaatcatccacccgtccctcatctacgtctaaaaaaaaatcatccgcccgtccctcatctacgtccgaaaaaaaatcatccacccgtccctcatctacgtccgaaaaaaaatcatccacccgtccctcatctacgtccgaaaaaaaatcatccgcccgtccctcatctacgtcccgaaaaaatcatccgcccgtccctcatctacgtccgaaaaaaaatcatccgcccgtccctcatctatatccgaaaaaaaatcatcaacccgtccctcatctacgtccgaaaaaaaatcatccgcccgtccctcatctacgtccgaaaaaaaatcatccgcccgtccctcatctacgtctaaaaaaaaatcatctactcgttcctcatctacgtccgaaaaaaaatcatctactcgttcctcatctacgtccgaaaaaaaatcatccgcccatccctcatctacgtctaaaaaaaaatcatccacccgtcgctcatctacgtccgaaaaaaaatcatccgcccgtccctcatctacgtccgaaaaaaatcatccgcccgtccctcatctacgtctaaaaaaaaatcatccgcccgtccctcatctacgtcctaaaaaaaatcatccgccctttcctcatctacgtctaaaaaaaaatcatccgcccgttcctcatctacgtcctaaaaaaatcatccacccgttcctcatcgacgtcccgaaaaaaatcatccgcccgtccctcatctacgtccgaaaaaaatcatccgcccgtccctcatctacgtctaaaaaaaaatcatccgcccgtccctcatctacgtctaaaaaaaaatcatccgcccgtccctcatctacgtcctaaaaaaatcatccgcccgtccctcatctacgtctaaaaaaaaatcatccgcccgtccctcatctacgtctaaaaaaaaatcatccgcccgtccctcatctacgtctaaaaaaaaatcatccacccgtccctcatctacgtcctaaaaaaatcatccacccgttcctcatcgacgtcccgaaaaaaatcatccgcccgttcctcatctacgtcctaaaaaaatcatccacccgttcctcatcgacgtcccgaaaaaaatcatccacccgttcctcatctacgtctaaaaaaaaatcatccacccgtccctcatctacgtcctaaaaaaatcatccgcccgtccctcatctacgtctaaaaaaaaatcatccgcccgtccctcatctacgtctaaaaaaaaatcatccgcccgtccctcatctacgtcctaaaaaaatcatccgcccgtccctcatctacgtctaaaaaaaaatcatccgcccgtccctcatctacgtctaaaaaaaaatcatccgcccgtccctcatctacgtctaaaaaaaaatcatccacccgtccctcatctacgtcctaaaaaaatcatccacccgttcctcatcgacgtcccgaaaaaaatcatccgcccgttcctcatctacgtcctaaaaaaatcatccacccgttcctcatcgacgtcccgaaaaaaatcattcgcccgttcctcatctacgtcctaaaaaaatcatccacccgttcctcatcgacgtcccgaaaaaaatcatccgcccgttcctcatctacgtctaaaaaaaaatcatccacccgtccctcatctacgtcctaaaaaaatcatccgcccgtccctcatctacgtctaaaaaaaaatcatccacccgtccctcatctacgtctaaaaaaaaatcatccgcccgtccctcatctacgtccgaaaaaaaatcatccacccgtccctcatctacgtccgaaaaaaaatcatccgcccgttcctcatctacgtctaaaaaaaatcatccacccgtccctcatctacgtccgaaaaaaatcatccgcccgtccctcatctacgtccgaaaaaaaatcatccgcccgttcctcatctacgtcctaaaaaaaatcatccgcccgttcctcatctacgtctaaaaaaaaatcatccgcccgttcctcatctacgtccgaaaaaaatcatccacccgtccctcatctacgtccgaaaaaaaatcatccgcccgtccctcatctacgtcctaaaaaaaatcatccgcccgttcctcatctacgtctaaaaaaaaatcatccgcccgtccctcatctacgtcctaaaaaaatcatccacccgtccctcatctacgtccgaaaaaaatcatccacccctccctcatctacgtccgaaaaaaatcatccgcccgttcctcatctacgtccaaaaaaaatcatccacccgtccctcatctacgtccaaaaaaaaatcatccacccgtccctcatctacgtccgaaaaaaaatcatccacccgtccctcatctacgtcctaaaaaaaatcatccgcccgttcctcatctacgtctaaaaaaaaatcatccgcccgtccctcatctacgtccgaaaaaatcatccgcccgtccctcatctacgtctaaaacgaaatcatccgcccgtccctcatctacgtcctaaaaaaatcatccacccctccctcatctacgtctaaaaaaaaatcatccgcccgtccctcatctacgtcctaaaaaaatcatccacccgttcctcatcgacgtcccgaaaaaaatcatccgcccgtccctcatctacgtctaaaaaaaaatcatccgcccgtccctcatcgacatcctaaaaaaatcatccacccgttcctcatcgacgtcccgaaaaaaatcatccgcccgtccctcatctacgtctaaaaaaaaatcatccgcccgtccctcatctacgtccgaaaaaaaatcatccgcccgtccctcatctacgtcctaaaaaaaatcatccgcccgtccctcatctacgtctaaaaaaaatcatccacccgtccctcatctacgtctaaaaaaaaatcatccacccgtccctcatctacgtcctaaaaaaatcatccacccgtccctcatctacgtctaaaaaaaaatcatccgcccgtccctcatctacgtctaaaaaaaaatcatccgcccgtccctcatctacgtccgaaaaaaaatcatccgcccgtccctcatctacgtcctaaaaaaatcatccacccgttcctcatcgacgtcccgaaaaaaatcatccgcccgtccctcatctacgtctaaaaaaaaatcatccgcccgtccctcatctacgtcctaaaaaaatcatccgcccgtccctcatctacgtccgaaaaaaaatcatccgcccgttcctcatctacgtctaaaaaaaatcatccacccgtccctcatctacgtccgaaaaaaaatcatctacccgtccctcatctacgtctaaaaaaaatcatccacccgtccctcatctacgtcctaaaaaaatcatccacccgtccctcatctacgtccgaaaaaaaatcatccgcccgttcctcatctacgtccgaaaaaaatcatccacccgtccctcatctacgtcctaaaaaaatcatccacccatccctcatctacgtctaaaaaaaaatcatccgcccgtccctcatctacgtcctaaaaaaaatcatccgcccgttcctcatctacgtctaaaaaaaaatcatccgcccgtccctcatctacgtcctaaaaaaatcatccacccgttcctcatctacgtcctaaaaaaaatcatccacccgtccctcatctacgtctaaaaaaaatcatccacccgtccctcatctacgtcctaaaaaaatcatccacccgtccctcatctacgtctaaaaaaaaatcatccgcccgtccctcatctacgtcctaaaaaaatcatccacccgtccctcatctacgtcctaaaaaaatcatccacccgttcctcatcgacgtcccgaaaaaaatcatccgcccgtccctcatctacgtctaaaaaaaatcatccgcccgttcctcatctacgtccgaaaaaaatcatccgcccgtccctcatctacgtcccgaaaaaaatcatccgcccgtccctcatctacgtcccgaaaaaaatcatccgcccgtccctcatctacgtccgaaaaaaaatcatccgcccgtccctcatctacgtccgaaaaaaaatcatccacccgtccctcatctacgtccgaaaaaaaatcatccacccgtccctcatctacgtccgaaaaaaaatcatccgcccgtccctcatctacgtccgaaaaaaatcatcc

SEQ ID NO: 31595 - DNA, 4293 bp, Artificial Sequence
  chemically treated genomic DNA (Homo sapiens) CpG-island No: 31595
ttggagggaataatttattcgttttttatttgcgtttggaaggaatttatttattcgttttttatttgggttttgaaggaattatttattcgttttttatttgcgtttggaaggaagttattcgttcgttttttatttgcgttcggaaggaagttatttattcgttttttatttgcgttcggaaggaagttatttattcgttttttatttgcgttcggaaggaagttattcgttcgttttttatttgcgtttcgaaggaattattcgttcgttttttatttgcgttcggaaggaagttattcgttcgttttttatttgtgttcggaaggaagttattagttcgttttttatttgcgttcggaaggaagttattcgttcgttttttatttgcgttcggaaggaagttattcgttcgttttttatttgcgtttggaaggaagttatttgttcgttttttatttgcgttcggaaggaagttatttgttcgttttttatttgcgttcggaaggaagttattcgtttattttttatttgcgtttggaaggaagttatttattcgtcgtttatttgcgttcggaaggaagttattcgttcgttttttatttgcgttcggaaggaattattcgttcgttttttatttgcgtttggaaggaagttattcgttcgttttttatttgcgttttgaaggaagttattcgttttttttttatttgcgtttggaaggaagttattcgttcgttttttatttgcgttttgaaggaattatttattcgttttttatcggcgtttcgaaggaagttattcgttcgttttttatttgcgttcggaaggaattattcgttcgttttttatttgcgtttggaaggaagttattcgttcgttttttatttgcgtttggaaggaagttattcgttcgttttttatttgcgttttgaaggaattattcgttcgttttttatttgcgtttggaaggaagttattcgttcgttttttatttgcgtttggaaggaagttattcgttcgttttttatttgcgtttggaaggaagttatttattcgttttttatttgcgttttgaaggaattatttattcgttttttatcggcgtttcgaaggaagttattcgttcgttttttatttgcgttttgaaggaattatttattcgttttttatcggcgtttcgaaggaagttatttattcgttttttatttgcgtttggaaggaagttatttattcgttttttatttgcgttttgaaggaattattcgttcgttttttatttgcgtttggaaggaagttattcgttcgttttttatttgcgtttggaaggaagttattcgttcgttttttatttgcgttttgaaggaattattcgttcgttttttatttgcgtttggaaggaagttattcgttcgttttttatttgcgtttggaaggaagttattcgttcgttttttatttgcgtttggaaggaagttatttattcgttttttatttgcgttttgaaggaattatttattcgttttttatcggcgtttcgaaggaagttattcgttcgttttttatttgcgttttgaaggaattatttattcgttttttatcggcgtttcgaaggaagttattcgttcgttttttatttgcgttttgaaggaattatttattcgttttttatcggcgtttcgaaggaagttattcgttcgttttttatttgcgtttggaaggaagttatttattcgttttttatttgcgttttgaaggaattattcgttcgttttttatttgcgtttggaaggaagttatttattcgttttttatttgcgtttggaaggaagttattcgttcgttttttatttgcgttcggaaggaagttatttattcgttttttatttgcgttcggaaggaggttattcgttcgttttttatttgcgtttggaaggaattatttattcgttttttatttgcgttcgaaggaagttattcgttcgttttttatttgcgttcggaaggaggttattcgttcgttttttatttgcgttttgaaggaggttattcgttcgttttttatttgcgtttggaaggaaattattcgttcgttttttatttgcgttcgaaggaagttatttattcgttttttatttgcgttcggaaggaagttattcgttcgttttttatttgcgttttgaaggaagttattcgttcgttttttatttgcgtttggaaggaagttattcgttcgttttttatttgcgttttgaaggaattatttattcgttttttatttgcgttcggaaggaattatttattttttttttatttgcgttcggaagaggttattcgttcgttttttatttgcgtttagaaggaattatttattcgttttttatttgcgtttagaaggaagttatttattcgttttttatttgcgttcggaaggaagttatttattcgttttttatttgcgttttgaaggaagttattcgttcgttttttatttgcgtttggaaggaagttattcgttcgttttttatttgcgttcggaagaattattcgttcgttttttatttgcgtttggaacgaagttattcgttcgttttttatttgcgttttgaaggaattatttattttttttttatttgcgtttggaaggaagttattcgttcgttttttatttgcgttttgaaggaattatttattcgttttttatcggcgtttcgaaggaagttattcgttcgttttttatttgcgtttggaaggaagttattcgttcgttttttatcggtattttgaaggaattatttattcgttttttatcggcgtttcgaaggaagttattcgttcgttttttatttgcgtttggaaggaagttattcgttcgttttttatttgcgttcggaaggaagttattcgttcgttttttatttgcgttttgaaggaagttattcgttcgttttttatttgcgtttggaaggaattatttattcgttttttatttgcgtttggaaggaagttatttattcgttttttatttgcgttttgaaggaattatttattcgttttttatttgcgtttggaaggaagttattcgttcgttttttatttgcgtttggaaggaagttattcgttcgttttttatttgcgttcggaaggaggttattcgttcgttttttatttgcgttttgaaggaattatttattcgttttttatcggcgtttcgaaggaagttattcgttcgttttttatttgcgtttggaaggaagttattcgttcgttttttatttgcgttttgaaggaattattcgttcgttttttatttgcgttcggaaggaggttattcgttcgttttttatttgcgtttggaaggaattatttattcgttttttatttgcgttcggaaggaagttatttgttcgttttttatttgcgtttggaaggaattatttattcgttttttatttgcgttttgaaggaattatttattcgttttttatttgcgttcggaaggaggttattcgttcgttttttatttgcgttcggaaggaattatttattcgttttttatttgcgttttgaaggaattatttatttattttttatttgcgtttggaaggaagttattcgttcgttttttatttgcgttttgaaggaagttattcgttcgttttttatttgcgtttggaaggaagttattcgttcgttttttatttgcgttttgaaggaattatttattcgttttttatttgcgttttgaaggaagttatttattcgttttttatttgcgtttggaaggaattatttattcgttttttatttgcgttttgaaggaattatttattcgttttttatttgcgtttggaaggaagttattcgttcgttttttatttgcgttttgaaggaattatttattcgttttttatttgcgttttgaaggaattatttattcgttttttatcggcgtttcgaaggaagttattcgttcgttttttatttgcgtttggaaggaattattcgttcgttttttatttgcgttcggaaggaattattcgttcgttttttatttgcgtttcgaaggaagttattcgttcgttttttatttgcgtttcgaaggaagttattcgttcgttttttatttgcgttcggaaggaagttattcgttcgttttttatttgcgttcggaaggaagttatttattcgttttttatttgcgttcggaaggaagttatttattcgttttttatttgcgttcggaaggaagttattcgttcgttttttatttgcgttcggaaggaattattt

SEQ ID NO: 31596 - DNA, 4293 bp, Artificial Sequence
  chemically treated genomic DNA (Homo sapiens) CpG-island No: 31596
aaataattccttccgaacgcaaataaaaaacgaacgaataacttccttccgaacgcaaataaaaaacgaataaataacttccttccgaacgcaaataaaaaacgaataaataacttccttccgaacgcaaataaaaaacgaacgaataacttccttccgaacgcaaataaaaaacgaacgaataacttccttcgaaacgcaaataaaaaacgaacgaataacttccttcgaaacgcaaataaaaaacgaacgaataattccttccgaacgcaaataaaaaacgaacgaataattccttccaaacgcaaataaaaaacgaacgaataacttccttcgaaacgccgataaaaaacgaataaataattccttcaaaacgcaaataaaaaacgaataaataattccttcaaaacgcaaataaaaaacgaacgaataacttccttccaaacgcaaataaaaaacgaataaataattccttcaaaacgcaaataaaaaacgaataaataattccttccaaacgcaaataaaaaacgaataaataacttccttcaaaacgcaaataaaaaacgaataaataattccttcaaaacgcaaataaaaaacgaacgaataacttccttccaaacgcaaataaaaaacgaacgaataacttccttcaaaacgcaaataaaaaacgaacgaataacttccttccaaacgcaaataaaaaataaataaataattccttcaaaacgcaaataaaaaacgaataaataattccttccgaacgcaaataaaaaacgaacgaataacctccttccgaacgcaaataaaaaacgaataaataattccttcaaaacgcaaataaaaaacgaataaataattccttccaaacgcaaataaaaaacgaacaaataacttccttccgaacgcaaataaaaaacgaataaataattccttccaaacgcaaataaaaaacgaacgaataacctccttccgaacgcaaataaaaaacgaacgaataattccttcaaaacgcaaataaaaaacgaacgaataacttccttccaaacgcaaataaaaaacgaacgaataacttccttcgaaacgccgataaaaaacgaataaataattccttcaaaacgcaaataaaaaacgaacgaataacctccttccgaacgcaaataaaaaacgaacgaataacttccttccaaacgcaaataaaaaacgaacgaataacttccttccaaacgcaaataaaaaacgaataaataattccttcaaaacgcaaataaaaaacgaataaataacttccttccaaacgcaaataaaaaacgaataaataattccttccaaacgcaaataaaaaacgaacgaataacttccttcaaaacgcaaataaaaaacgaacgaataacttccttccgaacgcaaataaaaaacgaacgaataacttccttccaaacgcaaataaaaaacgaacgaataacttccttcgaaacgccgataaaaaacgaataaataattccttcaaaataccgataaaaaacgaacgaataacttccttccaaacgcaaataaaaaacgaacgaataacttccttcgaaacgccgataaaaaacgaataaataattccttcaaaacgcaaataaaaaacgaacgaataacttccttccaaacgcaaataaaaaaaaaataaataattccttcaaaacgcaaataaaaaacgaacgaataacttcgttccaaacgcaaataaaaaacgaacgaataattcttccgaacgcaaataaaaaacgaacgaataacttccttccaaacgcaaataaaaaacgaacgaataacttccttcaaaacgcaaataaaaaacgaataaataacttccttccgaacgcaaataaaaaacgaataaataacttccttctaaacgcaaataaaaaacgaataaataattccttctaaacgcaaataaaaaacgaacgaataacctcttccgaacgcaaataaaaaaaaaataaataattccttccgaacgcaaataaaaaacgaataaataattccttcaaaacgcaaataaaaaacgaacgaataacttccttccaaacgcaaataaaaaacgaacgaataacttccttcaaaacgcaaataaaaaacgaacgaataacttccttccgaacgcaaataaaaaacgaataaataacttccttcgaacgcaaataaaaaacgaacgaataatttccttccaaacgcaaataaaaaacgaacgaataacctccttcaaaacgcaaataaaaaacgaacgaataacctccttccgaacgcaaataaaaaacgaacgaataacttccttcgaacgcaaataaaaaacgaataaataattccttccaaacgcaaataaaaaacgaacgaataacctccttccgaacgcaaataaaaaacgaataaataacttccttccgaacgcaaataaaaaacgaacgaataacttccttccaaacgcaaataaaaaacgaataaataacttccttccaaacgcaaataaaaaacgaacgaataattccttcaaaacgcaaataaaaaacgaataaataacttccttccaaacgcaaataaaaaacgaacgaataacttccttcgaaacgccgataaaaaacgaataaataattccttcaaaacgcaaataaaaaacgaacgaataacttccttcgaaacgccgataaaaaacgaataaataattccttcaaaacgcaaataaaaaacgaacgaataacttccttcgaaacgccgataaaaaacgaataaataattccttcaaaacgcaaataaaaaacgaataaataacttccttccaaacgcaaataaaaaacgaacgaataacttccttccaaacgcaaataaaaaacgaacgaataacttccttccaaacgcaaataaaaaacgaacgaataattccttcaaaacgcaaataaaaaacgaacgaataacttccttccaaacgcaaataaaaaacgaacgaataacttccttccaaacgcaaataaaaaacgaacgaataattccttcaaaacgcaaataaaaaacgaataaataacttccttccaaacgcaaataaaaaacgaataaataacttccttcgaaacgccgataaaaaacgaataaataattccttcaaaacgcaaataaaaaacgaacgaataacttccttcgaaacgccgataaaaaacgaataaataattccttcaaaacgcaaataaaaaacgaataaataacttccttccaaacgcaaataaaaaacgaacgaataacttccttccaaacgcaaataaaaaacgaacgaataacttccttccaaacgcaaataaaaaacgaacgaataattccttcaaaacgcaaataaaaaacgaacgaataacttccttccaaacgcaaataaaaaacgaacgaataacttccttccaaacgcaaataaaaaacgaacgaataattccttccgaacgcaaataaaaaacgaacgaataacttccttcgaaacgccgataaaaaacgaataaataattccttcaaaacgcaaataaaaaacgaacgaataacttccttccaaacgcaaataaaaaaaaaacgaataacttccttcaaaacgcaaataaaaaacgaacgaataacttccttccaaacgcaaataaaaaacgaacgaataattccttccgaacgcaaataaaaaacgaacgaataacttccttccgaacgcaaataaacgacgaataaataacttccttccaaacgcaaataaaaaataaacgaataacttccttccgaacgcaaataaaaaacgaacaaataacttccttccgaacgcaaataaaaaacgaacaaataacttccttccaaacgcaaataaaaaacgaacgaataacttccttccgaacgcaaataaaaaacgaacgaataacttccttccgaacgcaaataaaaaacgaactaataacttccttccgaacacaaataaaaaacgaacgaataacttccttccgaacgcaaataaaaaacgaacgaataattccttcgaaacgcaaataaaaaacgaacgaataacttccttccgaacgcaaataaaaaacgaataaataacttccttccgaacgcaaataaaaaacgaataaataacttccttccgaacgcaaataaaaaacgaacgaataacttccttccaaacgcaaataaaaaacgaataaataattccttcaaaacccaaataaaaaacgaataaataaattccttccaaacgcaaataaaaaacgaataaattattccctccaa

SEQ ID NO: 31597 - DNA, 639 bp, Artificial Sequence
  chemically treated genomic DNA (Homo sapiens) CpG-island No: 31597
tattaaacgtagcggtattatcgtttttagcgcgcgtattacgggcgtacgtattatacgttggcgttgatcggtaaggtgaattcgtattttgcgggtatggggttgatgtcgggttatgtttatcgcgcgttttatttttgttcgttgtacggtataagcgaggatgacgttatcgttagtatttatcggatttttaaaaatgatgtcgcgtcggaagatatcgtcgttatcgtgattgagtcggtttagggcgaaggcggtttttacgtttcgtcgttagtttttatgtagcgtttatcgttttgtgtgacgagtacgggattatgttgattgtcgatgaagtgtagagcggcgcggggcgtatcggtacgttgtttgcgatggagtagatgggcgttgcgtcggattttattatttttgcgaaatcgatcgcgggcggtttttcgttggcggtagttatcgggcgcgcggaagtaatggatgcgtcgttttaggcggtttgggcggtatttatgcgggtaatcgattgtttgcgtggttgcgttggaagtgttgaaggtgtgtgagtaggaaaatttgttgtaaaaagttagcgatttggggtagaagttgaaagacggattgttggcgatataa

SEQ ID NO: 31598 - DNA, 639 bp, Artificial Sequence
  chemically treated genomic DNA (Homo sapiens) CpG-island No: 31598
ttatatcgccaacaatccgtctttcaacttctaccccaaatcgctaactttttacaacaaattttcctactcacacaccttcaacacttccaacgcaaccacgcaaacaatcgattacccgcataaataccgcccaaaccgcctaaaacgacgcatccattacttccgcgcgcccgataactaccgccaacgaaaaaccgcccgcgatcgatttcgcaaaaataataaaatccgacgcaacgcccatctactccatcgcaaacaacgtaccgatacgccccgcgccgctctacacttcatcgacaatcaacataatcccgtactcgtcacacaaaacgataaacgctacataaaaactaacgacgaaacgtaaaaaccgccttcgccctaaaccgactcaatcacgataacgacgatatcttccgacgcgacatcatttttaaaaatccgataaatactaacgataacgtcatcctcgcttataccgtacaacgaacaaaaataaaacgcgcgataaacataacccgacatcaaccccatacccgcaaaatacgaattcaccttaccgatcaacgccaacgtataatacgtacgcccgtaatacgcgcgctaaaaacgataataccgctacgtttaata

SEQ ID NO: 31599 - DNA, 639 bp, Artificial Sequence
  chemically treated genomic DNA (Homo sapiens) CpG-island No: 31599
ttgtatcgttagtaattcgttttttaatttttgttttagatcgttggttttttgtagtagatttttttgtttatatatttttaatatttttagcgtagttacgtaggtaatcggttattcgtataggtgtcgtttagatcgtttggagcgacgtatttattattttcgcgcgttcggtgattgtcgttagcgggaagtcgttcgcgatcgatttcgtaaaggtggtaagattcggcgtaacgtttatttgttttatcgtaaatagcgtgtcggtacgtttcgcgtcgttttgtattttatcggtaattagtatgatttcgtgttcgttatatagagcggtaaacgttgtataaaggttggcgacgaggcgtagaaatcgttttcgttttgaatcggtttaattacgatggcggcgatatttttcggcgcggtattatttttgaagattcggtggatgttggcgatagcgttattttcgtttatgtcgtgtagcgggtaaggataaagcgcgcgataaatatgattcggtattagttttatgttcgtagagtacggatttattttgtcggttagcgttagcgtgtaatgcgtgcgttcgtgatacgcgcgttaaaagcgatggtgtcgttacgtttggtg

SEQ ID NO: 31600 - DNA, 639 bp, Artificial Sequence
  chemically treated genomic DNA (Homo sapiens) CpG-island No: 31600
caccaaacgtaacgacaccatcgcttttaacgcgcgtatcacgaacgcacgcattacacgctaacgctaaccgacaaaataaatccgtactctacgaacataaaactaataccgaatcatatttatcgcgcgctttatccttacccgctacacgacataaacgaaaataacgctatcgccaacatccaccgaatcttcaaaaataataccgcgccgaaaaatatcgccgccatcgtaattaaaccgattcaaaacgaaaacgatttctacgcctcgtcgccaacctttatacaacgtttaccgctctatataacgaacacgaaatcatactaattaccgataaaatacaaaacgacgcgaaacgtaccgacacgctatttacgataaaacaaataaacgttacgccgaatcttaccacctttacgaaatcgatcgcgaacgacttcccgctaacgacaatcaccgaacgcgcgaaaataataaatacgtcgctccaaacgatctaaacgacacctatacgaataaccgattacctacgtaactacgctaaaaatattaaaaatatataaacaaaaaaatctactacaaaaaaccaacgatctaaaacaaaaattaaaaaacgaattactaacgatacaa

SEQ ID NO: 31601 - DNA, 500 bp, Artificial Sequence
  chemically treated genomic DNA (Homo sapiens) CpG-island No: 31601
agcgttggcggacgttataaattgttaacgttaattcgtttaaggtttttattaggttacgttcgtgtagtacggttcgtgttgattcgtaagagttattaagaatagttgtttttgaaagttttacgggattcgggtgaaggagatgaacggttaaggagtcgtggttgtcgcgagcgttattgcgtgttgtttaaagcggtatagaaaacgtaatattcggggattagttcgttttagggtttttatattttttttcgatttggaatcgcgggatttcggaaatttacgttgttcgcgtcgggttgggtcgttttagaggtcgtagcgtttacgtttttttttcgttttttcgttttttagtttcggtcgaagttatttcggagttggcggagggcgattcgaggttatttgtttttttggggtcgaggataaaggggttttgatcgttattttttttcgcgaagggtaatatttaattttacggagagtcgttttag

SEQ ID NO: 31602 - DNA, 500 bp, Artificial Sequence
  chemically treated genomic DNA (Homo sapiens) CpG-island No: 31602
ctaaaacgactctccgtaaaattaaatattacccttcgcgaaaaaaaataacgatcaaaacccctttatcctcgaccccaaaaaaacaaataacctcgaatcgccctccgccaactccgaaataacttcgaccgaaactaaaaaacgaaaaaacgaaaaaaaaacgtaaacgctacgacctctaaaacgacccaacccgacgcgaacaacgtaaatttccgaaatcccgcgattccaaatcgaaaaaaaatataaaaaccctaaaacgaactaatccccgaatattacgttttctataccgctttaaacaacacgcaataacgctcgcgacaaccacgactccttaaccgttcatctccttcacccgaatcccgtaaaactttcaaaaacaactattcttaataactcttacgaatcaacacgaaccgtactacacgaacgtaacctaataaaaaccttaaacgaattaacgttaacaatttataacgtccgccaacgct

SEQ ID NO: 31603 - DNA, 500 bp, Artificial Sequence
  chemically treated genomic DNA (Homo sapiens) CpG-island No: 31603
ttgaagcggtttttcgtggagttggatgttgtttttcgcgggagggagtggcggttaagatttttttattttcggttttagaggggtaggtggtttcgggtcgtttttcgttaatttcgaggtggtttcggtcggggttggagggcggggaggcgggggaggggcgtgggcgttgcggtttttggggcggtttaattcggcgcgggtagcgtgggttttcgaggtttcgcggttttaggtcgagggaaggtgtaggggttttgaagcgggttggttttcgaatgttgcgttttttgtgtcgttttgggtaatacgtagtggcgttcgcggtagttacggttttttgatcgtttattttttttattcgggtttcgtggaatttttagaggtaattgtttttggtggtttttgcgggttagtacgagtcgtgttgtacgagcgtgatttagtgaaggttttgggcgagttggcgttaataatttatggcgttcgttagcgtt

SEQ ID NO: 31604 - DNA, 500 bp, Artificial Sequence
  chemically treated genomic DNA (Homo sapiens) CpG-island No: 31604
aacgctaacgaacgccataaattattaacgccaactcgcccaaaaccttcactaaatcacgctcgtacaacacgactcgtactaacccgcaaaaaccaccaaaaacaattacctctaaaaattccacgaaacccgaataaaaaaaataaacgatcaaaaaaccgtaactaccgcgaacgccactacgtattacccaaaacgacacaaaaaacgcaacattcgaaaaccaacccgcttcaaaacccctacaccttccctcgacctaaaaccgcgaaacctcgaaaacccacgctacccgcgccgaattaaaccgccccaaaaaccgcaacgcccacgcccctcccccgcctccccgccctccaaccccgaccgaaaccacctcgaaattaacgaaaaacgacccgaaaccacctacccctctaaaaccgaaaataaaaaaatcttaaccgccactccctcccgcgaaaaacaacatccaactccacgaaaaaccgcttcaa

SEQ ID NO: 31605 - DNA, 747 bp, Artificial Sequence
  chemically treated genomic DNA (Homo sapiens) CpG-island No: 31605
tcggataacgaacgtattttaagttattcgagggaagagaagacgcgaaggtattttagggatcgtatttttgtaggtaaattcgggttgggcgttttcgtcgggaggttggttagtgttcgaatgcggaggtagaaaagttgcggcggtcgaataacgagtttatcgcggtttcgttcgggttagttttcggtttttatggttaacgtttatttcggcggtcgttattcggagttgaacggagcgcgtgcgcgttcggggatttcgtcggcgtttggttggtttcgttgtttcggtttgtgttcgttttcgaggcgggttttgtcgtaaagtaggtttggtttagaggaagtagggaaatagcgcgtttcgttcgcgttaggattaggttaatatttgtttggtcggggacgacgggagtcgttcgtgttttggtttcgtattgggtttagtagaagtagtagcggggaaagtcgagacgttttgaacgtttttttgggtcgggtttttacgtaagagcgtcgttgttttggtgacgtgacgtttttttttaggattgtgcgtcggggtggggaaatagacgtgtaatcgttattttgcgtattaatttattagaggtcgggttaggttgttttaacgtaggtagaggggtgtggtagatttttaatcgttcggggtttcgtgatttttattaatgaattcgtatattggcgttattatttaatatatcgacggtaatgaatgttt

SEQ ID NO: 31606 - DNA, 747 bp, Artificial Sequence
  chemically treated genomic DNA (Homo sapiens) CpG-island No: 31606
aaacattcattaccgtcgatatattaaataataacgccaatatacgaattcattaataaaaatcacgaaaccccgaacgattaaaaatctaccacacccctctacctacgttaaaacaacctaacccgacctctaataaattaatacgcaaaataacgattacacgtctatttccccaccccgacgcacaatcctaaaaaaaaacgtcacgtcaccaaaacaacgacgctcttacgtaaaaacccgacccaaaaaaacgttcaaaacgtctcgactttccccgctactacttctactaaacccaatacgaaaccaaaacacgaacgactcccgtcgtccccgaccaaacaaatattaacctaatcctaacgcgaacgaaacgcgctatttccctacttcctctaaaccaaacctactttacgacaaaacccgcctcgaaaacgaacacaaaccgaaacaacgaaaccaaccaaacgccgacgaaatccccgaacgcgcacgcgctccgttcaactccgaataacgaccgccgaaataaacgttaaccataaaaaccgaaaactaacccgaacgaaaccgcgataaactcgttattcgaccgccgcaacttttctacctccgcattcgaacactaaccaacctcccgacgaaaacgcccaacccgaatttacctacaaaaatacgatccctaaaataccttcgcgtcttctcttccctcgaataacttaaaatacgttcgttatccga

SEQ ID NO: 31607 - DNA, 747 bp, Artificial Sequence
  chemically treated genomic DNA (Homo sapiens) CpG-island No: 31607
aaatatttattatcgtcggtgtgttgagtggtaacgttagtgtgcgaatttattaatggaaattacgggatttcgagcggttggagatttgttatatttttttgtttgcgttaagatagtttgattcgatttttggtaaattaatgcgtaaaatggcggttgtacgtttgtttttttatttcggcgtataattttgaggaaggacgttacgttattagggtaacgacgtttttgcgtaaaggttcggtttaagggaacgtttagggcgtttcggtttttttcgttgttgtttttgttaggtttagtgcgagattagagtacgagcgattttcgtcgttttcggttaggtagatgttggtttagttttggcgcgaacgaagcgcgttatttttttgttttttttaggttaagtttgttttacggtagggttcgtttcgggagcgagtatagatcggggtagcgaggttagttaggcgtcgacgaggttttcgaacgcgtacgcgtttcgtttagtttcgggtggcggtcgtcggagtagacgttagttatggaaatcgagagttggttcgggcggggtcgcggtgagttcgttattcggtcgtcgtagtttttttgttttcgtattcgggtattaattaatttttcggcgggagcgtttagttcgagtttatttgtaaaaatgcggtttttgggatgttttcgcgtttttttttttttcgggtgatttgaggtacgttcgttgttcga

SEQ ID NO: 31608 - DNA, 747 bp, Artificial Sequence
  chemically treated genomic DNA (Homo sapiens) CpG-island No: 31608
tcgaacaacgaacgtacctcaaatcacccgaaaaaaaaaaaaacgcgaaaacatcccaaaaaccgcatttttacaaataaactcgaactaaacgctcccgccgaaaaattaattaatacccgaatacgaaaacaaaaaaactacgacgaccgaataacgaactcaccgcgaccccgcccgaaccaactctcgatttccataactaacgtctactccgacgaccgccacccgaaactaaacgaaacgcgtacgcgttcgaaaacctcgtcgacgcctaactaacctcgctaccccgatctatactcgctcccgaaacgaaccctaccgtaaaacaaacttaacctaaaaaaaacaaaaaaataacgcgcttcgttcgcgccaaaactaaaccaacatctacctaaccgaaaacgacgaaaatcgctcgtactctaatctcgcactaaacctaacaaaaacaacaacgaaaaaaaccgaaacgccctaaacgttcccttaaaccgaacctttacgcaaaaacgtcgttaccctaataacgtaacgtccttcctcaaaattatacgccgaaataaaaaaacaaacgtacaaccgccattttacgcattaatttaccaaaaatcgaatcaaactatcttaacgcaaacaaaaaaatataacaaatctccaaccgctcgaaatcccgtaatttccattaataaattcgcacactaacgttaccactcaacacaccgacgataataaatattt

SEQ ID NO: 31609 - DNA, 542 bp, Artificial Sequence
  chemically treated genomic DNA (Homo sapiens) CpG-island No: 31609
gatagcggcgcggacgggtttgggtgtcgtggaagtcgttgtggttggttagttttaagtagttaataggggcgttcggggtagggaggtttgttattgggcgaggtgaagtgaggaaggggagggacgttttttttgcgttttgtattcgtttgtcgttcgtcggttttacggtggtcgggcgtggggttattcgagtagtttggtcgtggttatcggcggttttgggtgtttgaggtttgcgggtagcgtcggtttttacgtcggtcggagtatgcgattaatcggttttattcgtatgcgttttgttttggttgttttttggttttgacggtcggagtgtcggattttagatggggattttaggtgggagtcgcggggttatatcggggttatttcgggttgagttcgtttgatcggttttcgcgttttttttttttcggttatcgttgtcgggtttatttcgtttttattggtttcggttaggttgttattgaggcggagatacgggtgatgattggttttttggggagagaggaagt

SEQ ID NO: 31610 - DNA, 542 bp, Artificial Sequence
  chemically treated genomic DNA (Homo sapiens) CpG-island No: 31610
acttcctctctccccaaaaaaccaatcatcacccgtatctccgcctcaataacaacctaaccgaaaccaataaaaacgaaataaacccgacaacgataaccgaaaaaaaaaaaacgcgaaaaccgatcaaacgaactcaacccgaaataaccccgatataaccccgcgactcccacctaaaatccccatctaaaatccgacactccgaccgtcaaaaccaaaaaacaaccaaaacaaaacgcatacgaataaaaccgattaatcgcatactccgaccgacgtaaaaaccgacgctacccgcaaacctcaaacacccaaaaccgccgataaccacgaccaaactactcgaataaccccacgcccgaccaccgtaaaaccgacgaacgacaaacgaatacaaaacgcaaaaaaaacgtccctccccttcctcacttcacctcgcccaataacaaacctccctaccccgaacgcccctattaactacttaaaactaaccaaccacaacgacttccacgacacccaaacccgtccgcgccgctatc

SEQ ID NO: 31611 - DNA, 542 bp, Artificial Sequence
  chemically treated genomic DNA (Homo sapiens) CpG-island No: 31611
attttttttttttttagaaagttaattattattcgtgttttcgttttagtaatagtttggtcggaattaatgggagcgaggtgagttcggtagcggtggtcgggggaggaggggcgcgggagtcggttagacgagtttagttcggggtgatttcgatgtgatttcgcggtttttatttagggtttttatttaggattcgatatttcggtcgttagggttagaaggtagttaggataagacgtatgcggatgaggtcggttagtcgtatgtttcggtcggcgtgggggtcggcgttattcgtaagttttaagtatttagagtcgtcggtggttacggttaggttgttcgagtagttttacgttcggttatcgtaagatcgacggacgatagacggatgtagaacgtaaaaaagacgtttttttttttttttattttatttcgtttagtgatagatttttttatttcgagcgtttttattaattgtttagggttggttagttatagcgatttttacggtatttaaattcgttcgcgtcgttatt

SEQ ID NO: 31612 - DNA, 542 bp, Artificial Sequence
  chemically treated genomic DNA (Homo sapiens) CpG-island No: 31612
aataacgacgcgaacgaatttaaataccgtaaaaatcgctataactaaccaaccctaaacaattaataaaaacgctcgaaataaaaaaatctatcactaaacgaaataaaataaaaaaaaaaaaaaacgtcttttttacgttctacatccgtctatcgtccgtcgatcttacgataaccgaacgtaaaactactcgaacaacctaaccgtaaccaccgacgactctaaatacttaaaacttacgaataacgccgacccccacgccgaccgaaacatacgactaaccgacctcatccgcatacgtcttatcctaactaccttctaaccctaacgaccgaaatatcgaatcctaaataaaaaccctaaataaaaaccgcgaaatcacatcgaaatcaccccgaactaaactcgtctaaccgactcccgcgcccctcctcccccgaccaccgctaccgaactcacctcgctcccattaattccgaccaaactattactaaaacgaaaacacgaataataattaactttctaaaaaaaaaaaaaat

SEQ ID NO: 31613 - DNA, 630 bp, Artificial Sequence
  chemically treated genomic DNA (Homo sapiens) CpG-island No: 31613
cgaggggcgttcgcgcggtcgttttttttttacgtgttttttttttacgtcgtcgttcggtcgttagggtttcggcggtttttcgttcggttagggagggggttttggtttcgttttggtcgttttttgtttatttttttttcgtcgagggtaaaaaaaaaatttttttttttttttttttcgaaagtcgcgatcgagtggttcggttcgcgcgcgtagttcgcgtttagcgttttttagtcggggtggcggcggcggcggcggcggcggcgggggaggggtgcggcgggggaggggaggaggtttggtttcgcggtcgtagtcgttatcgttcgtttcgatttttcggatcgtcgcggggttacgggttcgagtttcggattcgcgtttcggattcgtttcggttcggtcgcgcggtgggtgtttcgttttcgttcggtttcgcgcgttcgcggtttttattcgggtttggggggggagtcggggcggtcgtttatttggcggcgggggcggcggcggcgggggtagcggtggcggcggcggcggcggcggcgggaagaggtggtagtcgggggggttgtggcggtcgcggtttcggtcgtggttcggttcgcgttcgagtattttttt

SEQ ID NO: 31614 - DNA, 630 bp, Artificial Sequence
  chemically treated genomic DNA (Homo sapiens) CpG-island No: 31614
aaaaaaatactcgaacgcgaaccgaaccacgaccgaaaccgcgaccgccacaacccccccgactaccacctcttcccgccgccgccgccgccgccgccaccgctacccccgccgccgccgcccccgccgccaaataaacgaccgccccgactccccccccaaacccgaataaaaaccgcgaacgcgcgaaaccgaacgaaaacgaaacacccaccgcgcgaccgaaccgaaacgaatccgaaacgcgaatccgaaactcgaacccgtaaccccgcgacgatccgaaaaatcgaaacgaacgataacgactacgaccgcgaaaccaaacctcctcccctcccccgccgcacccctcccccgccgccgccgccgccgccgccgccaccccgactaaaaaacgctaaacgcgaactacgcgcgcgaaccgaaccactcgatcgcgactttcgaaaaaaaaaaaaaaaaaaattttttttttaccctcgacgaaaaaaaaataaacaaaaaacgaccaaaacgaaaccaaaaccccctccctaaccgaacgaaaaaccgccgaaaccctaacgaccgaacgacgacgtaaaaaaaaaacacgtaaaaaaaaaacgaccgcgcgaacgcccctcg

SEQ ID NO: 31615 - DNA, 630 bp, Artificial Sequence
  chemically treated genomic DNA (Homo sapiens) CpG-island No: 31615
gagggagtattcgggcgcgggtcgggttacgatcggggtcgcgatcgttatagttttttcggttgttattttttttcgtcgtcgtcgtcgtcgtcgttatcgttgttttcgtcgtcgtcgttttcgtcgttaggtaagcggtcgtttcgattttttttttaagttcgagtgggagtcgcgggcgcgcgaagtcgggcgggggcgaggtatttatcgcgcggtcgagtcgaggcgaattcggagcgcgaattcggggttcgggttcgtggtttcgcggcggttcgggaggtcggggcgggcggtggcggttgcgatcgcggggttaggtttttttttttttttcgtcgtatttttttttcgtcgtcgtcgtcgtcgtcgtcgttatttcggttggagagcgttgggcgcgagttgcgcgcgcggatcgggttattcggtcgcggttttcgggggaggaggaggaggaggttttttttttattttcggcggggagggggtaggtaggaaacggttaaggcgaagttagggttttttttttggtcgagcgagggatcgtcgagattttggcggtcggacggcggcgtgggggaggggtacgtgggggaggggcggtcgcgcgagcgtttttcg

SEQ ID NO: 31616 - DNA, 630 bp, Artificial Sequence
  chemically treated genomic DNA (Homo sapiens) CpG-island No: 31616
cgaaaaacgctcgcgcgaccgcccctcccccacgtacccctcccccacgccgccgtccgaccgccaaaatctcgacgatccctcgctcgaccaaaaaaaaaaccctaacttcgccttaaccgtttcctacctaccccctccccgccgaaaataaaaaaaaaacctcctcctcctcctcccccgaaaaccgcgaccgaataacccgatccgcgcgcgcaactcgcgcccaacgctctccaaccgaaataacgacgacgacgacgacgacgacgaaaaaaaaatacgacgaaaaaaaaaaaaaaacctaaccccgcgatcgcaaccgccaccgcccgccccgacctcccgaaccgccgcgaaaccacgaacccgaaccccgaattcgcgctccgaattcgcctcgactcgaccgcgcgataaatacctcgcccccgcccgacttcgcgcgcccgcgactcccactcgaacttaaaaaaaaaatcgaaacgaccgcttacctaacgacgaaaacgacgacgacgaaaacaacgataacgacgacgacgacgacgacgaaaaaaaataacaaccgaaaaaactataacgatcgcgaccccgatcgtaacccgacccgcgcccgaatactccctc

SEQ ID NO: 31617 - DNA, 657 bp, Artificial Sequence
  chemically treated genomic DNA (Homo sapiens) CpG-island No: 31617
ttcgttttcggttttcgagaatcgcgcgaagaggattttgtcgttgtttttcggtcgttttcgatttagtttggcgagttttattatggcgcggaagcgttcgcgttgttcgggagattttttttgcggatgtacgaagttggttcgagggcgtttagtcgttcgtcgtagaggcgtttttattttttcgtcgttcgcggcgtttcgtaggtcgttcgtttatcgcgtaggggttgaaggcgtttcgtttggcgcgtaggaagttggagaggttgtcgtatttgtagaattttacgattattatgagggggtttgcggcgggatcgggcggcggtcgtgcgttcggaattcggggcgcgttgcgggcgcgtttcgcgtttgtattcgcgttttttttcgttcgcggcgtttcgcgttcggggtttcgtcgttttagcgggtcgttcgtttcgtattttgcggtttggtgtacgtttcgaggaggttgattacgttgaggtggttgtcgatgtgaatgaggattttgagtttcgatattagcgcgcggtgttcgttggtcgtggcgttttttggaggggatacgggttttatatcggtttcgattttggtaggttttcgtttttcgttattcggcgtttttgggagggggagggttat

SEQ ID NO: 31618 - DNA, 657 bp, Artificial Sequence
  chemically treated genomic DNA (Homo sapiens) CpG-island No: 31618
ataaccctccccctcccaaaaacgccgaataacgaaaaacgaaaacctaccaaaatcgaaaccgatataaaacccgtatcccctccaaaaaacgccacgaccaacgaacaccgcgcgctaatatcgaaactcaaaatcctcattcacatcgacaaccacctcaacgtaatcaacctcctcgaaacgtacaccaaaccgcaaaatacgaaacgaacgacccgctaaaacgacgaaaccccgaacgcgaaacgccgcgaacgaaaaaaaacgcgaatacaaacgcgaaacgcgcccgcaacgcgccccgaattccgaacgcacgaccgccgcccgatcccgccgcaaaccccctcataataatcgtaaaattctacaaatacgacaacctctccaacttcctacgcgccaaacgaaacgccttcaacccctacgcgataaacgaacgacctacgaaacgccgcgaacgacgaaaaaataaaaacgcctctacgacgaacgactaaacgccctcgaaccaacttcgtacatccgcaaaaaaaatctcccgaacaacgcgaacgcttccgcgccataataaaactcgccaaactaaatcgaaaacgaccgaaaaacaacgacaaaatcctcttcgcgcgattctcgaaaaccgaaaacgaa

SEQ ID NO: 31619 - DNA, 657 bp, Artificial Sequence
  chemically treated genomic DNA (Homo sapiens) CpG-island No: 31619
gtaatttttttttttttaaaagcgtcgggtggcggggaacggggatttgttagggtcggggtcggtgtgaggttcgtgttttttttagagggcgttacggttagcgagtatcgcgcgttgatgtcggagtttaagatttttatttatatcggtaattattttaacgtggttaattttttcggggcgtgtattaagtcgtagggtacggagcgggcggttcgttgggacggcgagatttcgggcgcggggcgtcgcgggcgggagggggcgcgggtgtaaacgcggagcgcgttcgtagcgcgtttcgggtttcgaacgtacggtcgtcgttcggtttcgtcgtaggtttttttatggtgatcgtggagttttgtaagtacggtaatttttttaattttttgcgcgttaagcgggacgtttttagtttttgcgcggtgagcgggcggtttgcggggcgtcgcgggcggcgggggaatggaggcgtttttgcggcggacgattgggcgttttcgagttagtttcgtgtattcgtaggagaagtttttcgagtagcgcggacgttttcgcgttatggtggagttcgttaggttggatcggaggcggtcggggagtagcgatagggtttttttcgcgcggttttcgaagatcgagggcgga

SEQ ID NO: 31620 - DNA, 657 bp, Artificial Sequence
  chemically treated genomic DNA (Homo sapiens) CpG-island No: 31620
tccgccctcgatcttcgaaaaccgcgcgaaaaaaaccctatcgctactccccgaccgcctccgatccaacctaacgaactccaccataacgcgaaaacgtccgcgctactcgaaaaacttctcctacgaatacacgaaactaactcgaaaacgcccaatcgtccgccgcaaaaacgcctccattcccccgccgcccgcgacgccccgcaaaccgcccgctcaccgcgcaaaaactaaaaacgtcccgcttaacgcgcaaaaaattaaaaaaattaccgtacttacaaaactccacgatcaccataaaaaaacctacgacgaaaccgaacgacgaccgtacgttcgaaacccgaaacgcgctacgaacgcgctccgcgtttacacccgcgccccctcccgcccgcgacgccccgcgcccgaaatctcgccgtcccaacgaaccgcccgctccgtaccctacgacttaatacacgccccgaaaaaattaaccacgttaaaataattaccgatataaataaaaatcttaaactccgacatcaacgcgcgatactcgctaaccgtaacgccctctaaaaaaaacacgaacctcacaccgaccccgaccctaacaaatccccgttccccgccacccgacgcttttaaaaaaaaaaaaattac

SEQ ID NO: 31621 - DNA, 530 bp, Artificial Sequence
  chemically treated genomic DNA (Homo sapiens) CpG-island No: 31621
gagttttttcgttttacgagcgcggttttagcggaggttggtttttgtcggtttttcgttattttgatggttttcgttttgggaatttttcgatttgggagtatttaggaaagatttcgcgttcgtattcgcgcgggtttaggcgcgtttcgtcgtttttttttcgcgttcgggaataggagttagaggggcgcggggttgcggcgtagcggagtcgcggttaggcggtttaggcggggttagaatagtggtcgcggtgtttcgggttcgtcgttcgttttttattcgtagttatatcgcgtatacgcgggttttgcggttgttttttttgataaaggagttcgttcggcgttcggattgcgcgtatcggaggttttgaaggagcggtttttggagcgcgttttgcgtcggagttttggaggatgttatagattcggagggggtgtcggggttttgttttagattcgttttaacgttgcgaggataacgattttttagttcgttttaggtaggaggcgtagtggtttttt

SEQ ID NO: 31622 - DNA, 530 bp, Artificial Sequence
  chemically treated genomic DNA (Homo sapiens) CpG-island No: 31622
aaaaaaccactacgcctcctacctaaaacgaactaaaaaatcgttatcctcgcaacgttaaaacgaatctaaaacaaaaccccgacaccccctccgaatctataacatcctccaaaactccgacgcaaaacgcgctccaaaaaccgctccttcaaaacctccgatacgcgcaatccgaacgccgaacgaactcctttatcaaaaaaaacaaccgcaaaacccgcgtatacgcgatataactacgaataaaaaacgaacgacgaacccgaaacaccgcgaccactattctaaccccgcctaaaccgcctaaccgcgactccgctacgccgcaaccccgcgcccctctaactcctattcccgaacgcgaaaaaaaaacgacgaaacgcgcctaaacccgcgcgaatacgaacgcgaaatctttcctaaatactcccaaatcgaaaaattcccaaaacgaaaaccatcaaaataacgaaaaaccgacaaaaaccaacctccgctaaaaccgcgctcgtaaaacgaaaaaactc

SEQ ID NO: 31623 - DNA, 530 bp, Artificial Sequence
  chemically treated genomic DNA (Homo sapiens) CpG-island No: 31623
aggggattattgcgttttttgtttgaggcgggttggggggtcgttgttttcgtagcgttaaggcgagtttgggataggatttcggtatttttttcggatttgtggtattttttaggatttcggcgtaggacgcgttttaggagtcgtttttttagggttttcggtgcgcgtagttcgggcgtcggacgagtttttttattagaaagggtagtcgtagagttcgcgtgtgcgcgatgtggttgcgggtggggagcgggcggcgggttcgggatatcgcggttattgttttagtttcgtttgggtcgtttgatcgcggtttcgttgcgtcgtagtttcgcgtttttttggtttttgttttcgggcgcggggagaaggcggcggggcgcgtttgggttcgcgcgggtgcgaacgcgaggttttttttgggtgtttttaggtcggaggatttttagggcgggggttattagggtggcgaggaatcggtagggattagttttcgttaggatcgcgttcgtggagcggggaggttt

SEQ ID NO: 31624 - DNA, 530 bp, Artificial Sequence
  chemically treated genomic DNA (Homo sapiens) CpG-island No: 31624
aaacctccccgctccacgaacgcgatcctaacgaaaactaatccctaccgattcctcgccaccctaataacccccgccctaaaaatcctccgacctaaaaacacccaaaaaaaacctcgcgttcgcacccgcgcgaacccaaacgcgccccgccgccttctccccgcgcccgaaaacaaaaaccaaaaaaacgcgaaactacgacgcaacgaaaccgcgatcaaacgacccaaacgaaactaaaacaataaccgcgatatcccgaacccgccgcccgctccccacccgcaaccacatcgcgcacacgcgaactctacgactaccctttctaataaaaaaactcgtccgacgcccgaactacgcgcaccgaaaaccctaaaaaaacgactcctaaaacgcgtcctacgccgaaatcctaaaaaataccacaaatccgaaaaaaataccgaaatcctatcccaaactcgccttaacgctacgaaaacaacgaccccccaacccgcctcaaacaaaaaacgcaataatcccct

SEQ ID NO: 31625 - DNA, 1062 bp, Artificial Sequence
  chemically treated genomic DNA (Homo sapiens) CpG-island No: 31625
tagttcgcgattcgtttttttaagattcgttttaagtgttagcgtgtatttgtattcgttcgtttcgggcgcgcggtggttttcggtttttgttttcgtcgtcgtcggttacggggagggggaagttcgtttcgagcgttttttgggggatcgatcgcgagcggaggcgttgggcgtcgggaagtgcgtatttaagttcggggttcggtcgggatggattttcggcgcgcgtgggtcgggacggcgcggcgcggggatttcgcggggaagcgagtaagggcgcgaaggattcgggtttagcgcgtagttcggtagggttcggtttcgaggacgcggagttatcgacggagacgcggatttaggggtcgggagagttatttttgcgtcgaggcgcggttcggtcgttttggttttgattcggttgcggttttcgttcgttttttttttatttcgaggtttcgcgttttaagcgtcgtgttttttttaggcgttcgcgtattagggttatcgtgtttttcgttcgtattcggcggagcggttttagcgttcgttttaggtgcgcggtatttttttttcggttagttttacgttcgggcgggtggttcgttcgtcgcgtttatcgtttaggagttttaggtagagttatagtcgtaggtatagcgcggcgtttcgttgtattttcggtcgttgcgcgtgggttcgattcgagcggtcgcggttcggggttgaaagtgttcgcgcgggcgtcggttggtttggggcggggcggggcggggcgggggtcggaggcgggttcgggatttaggtcgtttttcgcgttttttttttttcgttttttttagttcgtcgcggggcgttcggtgtattcgagtagtgcgcgtttcgtattatagggttcgggtttttttttgggcggtttcgggcgcggggacgcgggtaacgtagacggtttcgcgatgcgtttcggaggtgatggagtttggtgggtaaaggggagtaaaatgcggtacgcgttttttttcgttttttttttttatcggtaaaatttagattaaataagaa

SEQ ID NO: 31626 - DNA, 1062 bp, Artificial Sequence
  chemically treated genomic DNA (Homo sapiens) CpG-island No: 31626
ttcttatttaatctaaattttaccgataaaaaaaaaaaacgaaaaaaaacgcgtaccgcattttactcccctttacccaccaaactccatcacctccgaaacgcatcgcgaaaccgtctacgttacccgcgtccccgcgcccgaaaccgcccaaaaaaaaacccgaaccctataatacgaaacgcgcactactcgaatacaccgaacgccccgcgacgaactaaaaaaaacgaaaaaaaaaaaacgcgaaaaacgacctaaatcccgaacccgcctccgacccccgccccgccccgccccgccccaaaccaaccgacgcccgcgcgaacactttcaaccccgaaccgcgaccgctcgaatcgaacccacgcgcaacgaccgaaaatacaacgaaacgccgcgctatacctacgactataactctacctaaaactcctaaacgataaacgcgacgaacgaaccacccgcccgaacgtaaaactaaccgaaaaaaaaataccgcgcacctaaaacgaacgctaaaaccgctccgccgaatacgaacgaaaaacacgataaccctaatacgcgaacgcctaaaaaaaacacgacgcttaaaacgcgaaacctcgaaataaaaaaaaaacgaacgaaaaccgcaaccgaatcaaaaccaaaacgaccgaaccgcgcctcgacgcaaaaataactctcccgacccctaaatccgcgtctccgtcgataactccgcgtcctcgaaaccgaaccctaccgaactacgcgctaaacccgaatccttcgcgcccttactcgcttccccgcgaaatccccgcgccgcgccgtcccgacccacgcgcgccgaaaatccatcccgaccgaaccccgaacttaaatacgcacttcccgacgcccaacgcctccgctcgcgatcgatcccccaaaaaacgctcgaaacgaacttccccctccccgtaaccgacgacgacgaaaacaaaaaccgaaaaccaccgcgcgcccgaaacgaacgaatacaaatacacgctaacacttaaaacgaatcttaaaaaaacgaatcgcgaacta

SEQ ID NO: 31627 - DNA, 1062 bp, Artificial Sequence
  chemically treated genomic DNA (Homo sapiens) CpG-island No: 31627
tttttgtttagtttagattttatcgatggaaagaaaggacggaaaagagcgcgtgtcgtattttgtttttttttgtttattaggttttattattttcggagcgtatcgcgagatcgtttgcgttattcgcgttttcgcgttcggagtcgtttaggagggggttcggattttgtggtgcggagcgcgtattgttcgggtgtatcggacgtttcgcggcgggttgggagggacggggggaggggggcgcggggagcggtttgaatttcgggttcgttttcggttttcgtttcgtttcgtttcgttttaggttagtcggcgttcgcgcggatatttttagtttcgagtcgcggtcgttcgggtcggatttacgcgtagcggtcggagatgtagcggggcgtcgcgttgtgtttgcgattgtggttttgtttgggatttttggacggtgagcgcggcgaacgggttattcgttcgagcgtggggttggtcggggagggggtatcgcgtatttggggcgggcgttgagatcgtttcgtcgggtacgggcgggggatacggtggttttggtgcgcggacgtttgaggggagtacggcgtttggggcgcgggatttcgggatgaggaaggggcgggcggggatcgtagtcgggttagggttagggcggtcgggtcgcgtttcggcgtaggggtagttttttcggtttttgaattcgcgttttcgtcggtggtttcgcgttttcggagtcgggttttgtcgggttgcgcgttgagttcggatttttcgcgtttttattcgttttttcgcggggttttcgcgtcgcgtcgtttcgatttacgcgcgtcggagatttatttcggtcgggtttcggatttgggtgcgtatttttcgacgtttagcgttttcgttcgcggtcggttttttagagggcgttcgaggcgggttttttttttttcgtggtcggcgacggcggggataggggtcggggattatcgcgcgttcgaggcggacgggtgtaggtgtacgttggtatttgagacgaattttgaggaggcgaatcgcgggttg

SEQ ID NO: 31628 - DNA, 1062 bp, Artificial Sequence
  chemically treated genomic DNA (Homo sapiens) CpG-island No: 31628
caacccgcgattcgcctcctcaaaattcgtctcaaataccaacgtacacctacacccgtccgcctcgaacgcgcgataatccccgacccctatccccgccgtcgccgaccacgaaaaaaaaaaaacccgcctcgaacgccctctaaaaaaccgaccgcgaacgaaaacgctaaacgtcgaaaaatacgcacccaaatccgaaacccgaccgaaataaatctccgacgcgcgtaaatcgaaacgacgcgacgcgaaaaccccgcgaaaaaacgaataaaaacgcgaaaaatccgaactcaacgcgcaacccgacaaaacccgactccgaaaacgcgaaaccaccgacgaaaacgcgaattcaaaaaccgaaaaaactacccctacgccgaaacgcgacccgaccgccctaaccctaacccgactacgatccccgcccgccccttcctcatcccgaaatcccgcgccccaaacgccgtactcccctcaaacgtccgcgcaccaaaaccaccgtatcccccgcccgtacccgacgaaacgatctcaacgcccgccccaaatacgcgataccccctccccgaccaaccccacgctcgaacgaataacccgttcgccgcgctcaccgtccaaaaatcccaaacaaaaccacaatcgcaaacacaacgcgacgccccgctacatctccgaccgctacgcgtaaatccgacccgaacgaccgcgactcgaaactaaaaatatccgcgcgaacgccgactaacctaaaacgaaacgaaacgaaacgaaaaccgaaaacgaacccgaaattcaaaccgctccccgcgcccccctccccccgtccctcccaacccgccgcgaaacgtccgatacacccgaacaatacgcgctccgcaccacaaaatccgaaccccctcctaaacgactccgaacgcgaaaacgcgaataacgcaaacgatctcgcgatacgctccgaaaataataaaacctaataaacaaaaaaaaacaaaatacgacacgcgctcttttccgtcctttctttccatcgataaaatctaaactaaacaaaaa

SEQ ID NO: 31629 - DNA, 876 bp, Artificial Sequence
  chemically treated genomic DNA (Homo sapiens) CpG-island No: 31629
ttacgatatgcgtatacgacgaattttcgtatttagcggggtaggtttcgttttttatttttttagtcggtaggatttgtttttttttgaggatgagtgaggatagtcgtagttcggcggggacggttcgttagtttagagcgtcggtattcgagtttcgtcgtcggagtcgcgtttggagtcgcggtgggggaggggtagcggcggttcgcgttgcgtcgagttttttagaatttttagcggtcgcggggaaagtttacgggatgtaggcggcggcggcggtagtggtagcggttattcggcggttcgcggcggattatggttttggttcggcgtcgttgggttttttttacggcgttttcgagtagcgtcgtagagcgggtcgattttcgggaaggaattgattagcgattgagcggcggtcggcgcgtttagcgttttgaatatgcggtagtttttgcgggcgatttcgggtttcggataggcggcggcggaggcggcggttcgggagggaaggaggcggcggcgtcggcggaggtggcggcggagacggtcggcgttcggcgcggagttttagggaggtagtttagcgcggtttcgggtttcgtcgagaaggatgttgtttcgaaagaaatttaaaaacgaagtgtttaagtcggtcgaggtgtaggggaagtacgtgaagaaggagacgtcgtttttgtttcggagtgagtgttaggcggggcgtgtttatatttggtttaggcggttaggtgtttcggggattttggcgggggcgtcggcgggtttttagggtttttttttcgtttttggtcgcgtgaaatattggttttgagatttttttgtgtttgaagtggtattcgttgattgaaa

SEQ ID NO: 31630 - DNA, 876 bp, Artificial Sequence
  chemically treated genomic DNA (Homo sapiens) CpG-island No: 31630
tttcaatcaacgaataccacttcaaacacaaaaaaatctcaaaaccaatatttcacgcgaccaaaaacgaaaaaaaaaccctaaaaacccgccgacgcccccgccaaaatccccgaaacacctaaccgcctaaaccaaatataaacacgccccgcctaacactcactccgaaacaaaaacgacgtctccttcttcacgtacttcccctacacctcgaccgacttaaacacttcgtttttaaatttctttcgaaacaacatccttctcgacgaaacccgaaaccgcgctaaactacctccctaaaactccgcgccgaacgccgaccgtctccgccgccacctccgccgacgccgccgcctccttccctcccgaaccgccgcctccgccgccgcctatccgaaacccgaaatcgcccgcaaaaactaccgcatattcaaaacgctaaacgcgccgaccgccgctcaatcgctaatcaattccttcccgaaaatcgacccgctctacgacgctactcgaaaacgccgtaaaaaaaacccaacgacgccgaaccaaaaccataatccgccgcgaaccgccgaataaccgctaccactaccgccgccgccgcctacatcccgtaaactttccccgcgaccgctaaaaattctaaaaaactcgacgcaacgcgaaccgccgctacccctcccccaccgcgactccaaacgcgactccgacgacgaaactcgaataccgacgctctaaactaacgaaccgtccccgccgaactacgactatcctcactcatcctcaaaaaaaaacaaatcctaccgactaaaaaaataaaaaacgaaacctaccccgctaaatacgaaaattcgtcgtatacgcatatcgtaa

SEQ ID NO: 31631 - DNA, 876 bp, Artificial Sequence
  chemically treated genomic DNA (Homo sapiens) CpG-island No: 31631
ttttaattaacgaatattattttagatataagaaaattttaaaattagtattttacgcgattaaggacgaaggagaagttttggagattcgtcggcgttttcgttagggttttcggagtatttggtcgtttgggttaggtgtgggtacgtttcgtttgatatttatttcgaagtagaggcgacgtttttttttttacgtattttttttgtatttcggtcggtttggatatttcgtttttgggtttttttcgggatagtatttttttcgacgaggttcgaggtcgcgttgaattgtttttttagggtttcgcgtcgggcgtcggtcgttttcgtcgttattttcgtcggcgtcgtcgtttttttttttttcgagtcgtcgttttcgtcgtcgtttgttcggagttcggggtcgttcgtagggattgtcgtatgtttagggcgttaagcgcgtcggtcgtcgtttagtcgttggttagttttttttcggaagtcggttcgttttgcgacgttgttcggggacgtcgtgaggaaagtttagcgacgtcgggttagggttatggttcgtcgcgggtcgtcgaataatcgttattattatcgtcgtcgtcgtttatatttcgtaaatttttttcgcggtcgttgggaattttgggaagttcgacgtagcgcgggtcgtcgttgttttttttttatcgcggttttaggcgcggtttcggcggcgggattcgggtgtcggcgttttaggttaacgggtcgttttcgtcgagttgcggttgtttttatttatttttagagagaagtaggttttgtcgattgagaagatgaaggacgaaatttgtttcgttgagtgcgggagttcgtcgtatgcgtatgtcgtgg

SEQ ID NO: 31632 - DNA, 876 bp, Artificial Sequence
  chemically treated genomic DNA (Homo sapiens) CpG-island No: 31632
ccacgacatacgcatacgacgaactcccgcactcaacgaaacaaatttcgtccttcatcttctcaatcgacaaaacctacttctctctaaaaataaataaaaacaaccgcaactcgacgaaaacgacccgttaacctaaaacgccgacacccgaatcccgccgccgaaaccgcgcctaaaaccgcgataaaaaaaaaacaacgacgacccgcgctacgtcgaacttcccaaaattcccaacgaccgcgaaaaaaatttacgaaatataaacgacgacgacgataataataacgattattcgacgacccgcgacgaaccataaccctaacccgacgtcgctaaactttcctcacgacgtccccgaacaacgtcgcaaaacgaaccgacttccgaaaaaaaactaaccaacgactaaacgacgaccgacgcgcttaacgccctaaacatacgacaatccctacgaacgaccccgaactccgaacaaacgacgacgaaaacgacgactcgaaaaaaaaaaaaacgacgacgccgacgaaaataacgacgaaaacgaccgacgcccgacgcgaaaccctaaaaaaacaattcaacgcgacctcgaacctcgtcgaaaaaaatactatcccgaaaaaaacccaaaaacgaaatatccaaaccgaccgaaatacaaaaaaaatacgtaaaaaaaaaaacgtcgcctctacttcgaaataaatatcaaacgaaacgtacccacacctaacccaaacgaccaaatactccgaaaaccctaacgaaaacgccgacgaatctccaaaacttctccttcgtccttaatcgcgtaaaatactaattttaaaattttcttatatctaaaataatattcgttaattaaaa

SEQ ID NO: 31633 - DNA, 1036 bp, Artificial Sequence
  chemically treated genomic DNA (Homo sapiens) CpG-island No: 31633
gggcgcggtggcgcggtcgggagggtgttgtgtttttagtaggttttagggcggtattttggttttgcggtcggagtgttcgggcgggtcgttgggcgtcgatttatgttggttgggaacgtgtttttcggtgacgtagtttcgggtggggaacgtggtgcggcggcggcggcggcggcgattgtacgcgttttcgtcgttttcgagaggacgcgtcgtgtagcggttgagtggcggcggcggcgacggtaaattcggagttgtcggtcggcgcgcgggaggaggacgcgggtgcggtttaggaagtaggtttcgggtttcgcgtttaataaagacggggtcgtttttattaggtacggagtcggttttgggtttcggttggcggggaggtttcgtcgggtagttcgcgggcggtcggggagggggaagggtcgtagatcgaacggggatacggggcgtcgggggtttttttaggttttttttttttttacggtttttggcgggacggaagggaaggggtcgggtcgcgagggcgcgggtcgttgggggtcgtagtttgcgacgttaattagtttttgttcgtttttcgtgtagacggagttgcgggcggaggttttatgttgggaagcggcgtcgttcgtgtttgttagcgggaattcgggagtcgcggggtgagttggcgggggtcgggttttaagtgaagatggaggtttcgttgcggtttgtcgcggatattttgaggcggaattcgtagtaggattacgaattcgtttagagggtcggtagcggtatttacggggacgtttataaggtaagtgaggttggtcgtgttttttttttgcggtcgattgggtttcgggaatggggttatttttttgcgaagtattggggcgagaggaggatgtttttattgttgttttttggggagaaagcggtcggggttttttttattcggttttgagtattttcgatttatggtttgttttaatcgttattaataggtagaattaattatatagttgtaaatcgttgttgt

SEQ ID NO: 31634 - DNA, 1036 bp, Artificial Sequence
  chemically treated genomic DNA (Homo sapiens) CpG-island No: 31634
acaacaacgatttacaactatataattaattctacctattaataacgattaaaacaaaccataaatcgaaaatactcaaaaccgaataaaaaaaaccccgaccgctttctccccaaaaaacaacaataaaaacatcctcctctcgccccaatacttcgcaaaaaaataaccccattcccgaaacccaatcgaccgcaaaaaaaaaacacgaccaacctcacttaccttataaacgtccccgtaaataccgctaccgaccctctaaacgaattcgtaatcctactacgaattccgcctcaaaatatccgcgacaaaccgcaacgaaacctccatcttcacttaaaacccgacccccgccaactcaccccgcgactcccgaattcccgctaacaaacacgaacgacgccgcttcccaacataaaacctccgcccgcaactccgtctacacgaaaaacgaacaaaaactaattaacgtcgcaaactacgacccccaacgacccgcgccctcgcgacccgaccccttcccttccgtcccgccaaaaaccgtaaaaaaaaaaaaaacctaaaaaaacccccgacgccccgtatccccgttcgatctacgacccttccccctccccgaccgcccgcgaactacccgacgaaacctccccgccaaccgaaacccaaaaccgactccgtacctaataaaaacgaccccgtctttattaaacgcgaaacccgaaacctacttcctaaaccgcacccgcgtcctcctcccgcgcgccgaccgacaactccgaatttaccgtcgccgccgccgccactcaaccgctacacgacgcgtcctctcgaaaacgacgaaaacgcgtacaatcgccgccgccgccgccgccgcaccacgttccccacccgaaactacgtcaccgaaaaacacgttcccaaccaacataaatcgacgcccaacgacccgcccgaacactccgaccgcaaaaccaaaataccgccctaaaacctactaaaaacacaacaccctcccgaccgcgccaccgcgccc

SEQ ID NO: 31635 - DNA, 1036 bp, Artificial Sequence
  chemically treated genomic DNA (Homo sapiens) CpG-island No: 31635
gtaatagcggtttgtaattgtgtggttagttttgtttgttggtagcgattagaataagttatgagtcgagggtgtttagaatcgagtaaaagggatttcggtcgttttttttttaagaggtaataataaaagtatttttttttcgttttaatatttcgtaggaaagtggttttattttcgggatttagtcgatcgtaggaaaaaagtacggttagttttatttattttatagacgttttcgtaggtgtcgttgtcgattttttggacgagttcgtagttttgttgcgggtttcgttttaggatgttcgcggtaggtcgtagcggggtttttatttttatttagggttcggttttcgttagtttatttcgcggttttcggattttcgttaataagtacgaacggcgtcgttttttaatatggagttttcgttcgtagtttcgtttgtacgagggacgagtaaaggttggttggcgtcgtaggttacgatttttagcggttcgcgttttcgcggttcggttttttttttttcgtttcgttaggggtcgtggaagagaaaggggtttggaagggttttcggcgtttcgtattttcgttcggtttgcggttttttttttttttcggtcgttcgcgaattgttcgacgaggttttttcgttagtcggggtttagggtcggtttcgtatttaatgggggcggtttcgtttttgttgagcgcggagttcgggatttattttttagatcgtattcgcgtttttttttcgcgcgtcggtcggtagtttcgggtttgtcgtcgtcgtcgtcgttatttagtcgttgtacggcgcgttttttcgggggcggcggaggcgcgtatagtcgtcgtcgtcgtcgtcgtcgtattacgttttttattcggggttgcgttatcgggagatacgtttttagttagtatgggtcggcgtttagcggttcgttcgagtatttcggtcgtagaattagagtgtcgttttgaggtttgttgagaatataatattttttcgatcgcgttatcgcgttt

SEQ ID NO: 31636 - DNA, 1036 bp, Artificial Sequence
  chemically treated genomic DNA (Homo sapiens) CpG-island No: 31636
aaacgcgataacgcgatcgaaaaaatattatattctcaacaaacctcaaaacgacactctaattctacgaccgaaatactcgaacgaaccgctaaacgccgacccatactaactaaaaacgtatctcccgataacgcaaccccgaataaaaaacgtaatacgacgacgacgacgacgacgactatacgcgcctccgccgcccccgaaaaaacgcgccgtacaacgactaaataacgacgacgacgacgacaaacccgaaactaccgaccgacgcgcgaaaaaaaaacgcgaatacgatctaaaaaataaatcccgaactccgcgctcaacaaaaacgaaaccgcccccattaaatacgaaaccgaccctaaaccccgactaacgaaaaaacctcgtcgaacaattcgcgaacgaccgaaaaaaaaaaaaaaccgcaaaccgaacgaaaatacgaaacgccgaaaacccttccaaacccctttctcttccacgacccctaacgaaacgaaaaaaaaaaaaccgaaccgcgaaaacgcgaaccgctaaaaatcgtaacctacgacgccaaccaacctttactcgtccctcgtacaaacgaaactacgaacgaaaactccatattaaaaaacgacgccgttcgtacttattaacgaaaatccgaaaaccgcgaaataaactaacgaaaaccgaaccctaaataaaaataaaaaccccgctacgacctaccgcgaacatcctaaaacgaaacccgcaacaaaactacgaactcgtccaaaaaatcgacaacgacacctacgaaaacgtctataaaataaataaaactaaccgtacttttttcctacgatcgactaaatcccgaaaataaaaccactttcctacgaaatattaaaacgaaaaaaaaatacttttattattacctcttaaaaaaaaaacgaccgaaatcccttttactcgattctaaacaccctcgactcataacttattctaatcgctaccaacaaacaaaactaaccacacaattacaaaccgctattac

SEQ ID NO: 31637 - DNA, 646 bp, Artificial Sequence
  chemically treated genomic DNA (Homo sapiens) CpG-island No: 31637
tttcggtatttttaggtcgcgggttttttttttcgcgcgggttcgtatttttttttagtttggtgtatttgggttgacgtcggttcgggattcgtgcggagcgtcgcgagcgcggcggaggtagaggcgcgttgattgttatttttagttcgtgtcggagggatagtacgcgttgcgtaacggagatcgttttttttggtcgtcgtttacggttcgcggcgattatcgtcgttgaagttgtaggcgggtagtcgtgcgtttttcgggatagttagtttcggcggttgtttttttcggatgttagggttagggcgtcgggcggtcgttagtaggagaatgaagagttcggtgggaggaaggagagaaaagtttttgggggcgtcgaaagtttagtttagtcgcggtaagttgagtgtaaaaaaaggtgtttcggtttaggtggcggagttcgttggggcgtcgggtaaggagttagggttgcgtttttgcgggatattaggcgcgaggggttggggttcgtatggggggcgcggaatgggcgttcgtatcgtttagattttggattattttttcggtatttcgtattatcggtttatatattttagttttttttcggtgttaaggagaagagatgtgaggttgcggg

SEQ ID NO: 31638 - DNA, 646 bp, Artificial Sequence
  chemically treated genomic DNA (Homo sapiens) CpG-island No: 31638
cccgcaacctcacatctcttctccttaacaccgaaaaaaaactaaaatatataaaccgataatacgaaataccgaaaaaataatccaaaatctaaacgatacgaacgcccattccgcgccccccatacgaaccccaacccctcgcgcctaatatcccgcaaaaacgcaaccctaactccttacccgacgccccaacgaactccgccacctaaaccgaaacacctttttttacactcaacttaccgcgactaaactaaactttcgacgcccccaaaaacttttctctccttcctcccaccgaactcttcattctcctactaacgaccgcccgacgccctaaccctaacatccgaaaaaaacaaccgccgaaactaactatcccgaaaaacgcacgactacccgcctacaacttcaacgacgataatcgccgcgaaccgtaaacgacgaccaaaaaaaacgatctccgttacgcaacgcgtactatccctccgacacgaactaaaaataacaatcaacgcgcctctacctccgccgcgctcgcgacgctccgcacgaatcccgaaccgacgtcaacccaaatacaccaaactaaaaaaaaatacgaacccgcgcgaaaaaaaaaacccgcgacctaaaaataccgaaa

SEQ ID NO: 31639 - DNA, 646 bp, Artificial Sequence
  chemically treated genomic DNA (Homo sapiens) CpG-island No: 31639
ttcgtaattttatattttttttttttggtatcgagaagaggttggggtgtgtggatcgatagtgcgggatatcgaaaaggtggtttaaggtttgggcggtgcgaacgtttatttcgcgttttttatgcgagttttagtttttcgcgtttggtatttcgtaggggcgtaattttagttttttgttcggcgttttaacgaatttcgttatttgaatcgagatatttttttttgtatttaatttatcgcggttgggttgagttttcggcgtttttaggagtttttttttttttttttttatcgagttttttatttttttgttggcggtcgttcggcgttttggttttggtattcgggaggagtagtcgtcggggttggttgtttcgggagacgtacggttgttcgtttgtagttttaacggcggtggtcgtcgcgagtcgtgagcggcggttaaggagaacggttttcgttgcgtagcgcgtgttgttttttcggtacgggttggaggtggtagttagcgcgtttttgttttcgtcgcgttcgcggcgtttcgtacgagtttcgagtcggcgttagtttaggtgtattaggttggggagaggtgcgagttcgcgcgaagggaggggttcgcggtttgagggtgtcggga

SEQ ID NO: 31640 - DNA, 646 bp, Artificial Sequence
  chemically treated genomic DNA (Homo sapiens) CpG-island No: 31640
tcccgacaccctcaaaccgcgaacccctcccttcgcgcgaactcgcacctctccccaacctaatacacctaaactaacgccgactcgaaactcgtacgaaacgccgcgaacgcgacgaaaacaaaaacgcgctaactaccacctccaacccgtaccgaaaaaacaacacgcgctacgcaacgaaaaccgttctccttaaccgccgctcacgactcgcgacgaccaccgccgttaaaactacaaacgaacaaccgtacgtctcccgaaacaaccaaccccgacgactactcctcccgaataccaaaaccaaaacgccgaacgaccgccaacaaaaaaataaaaaactcgataaaaaaaaaaaaaaaaaaactcctaaaaacgccgaaaactcaacccaaccgcgataaattaaatacaaaaaaaaatatctcgattcaaataacgaaattcgttaaaacgccgaacaaaaaactaaaattacgcccctacgaaataccaaacgcgaaaaactaaaactcgcataaaaaacgcgaaataaacgttcgcaccgcccaaaccttaaaccaccttttcgatatcccgcactatcgatccacacaccccaacctcttctcgataccaaaaaaaaaaaatataaaattacgaa

SEQ ID NO: 31641 - DNA, 650 bp, Artificial Sequence
  chemically treated genomic DNA (Homo sapiens) CpG-island No: 31641
cgcgttcgcgttgtgttgtatttgtttcgtaggttgtcgttgcgtagttttatggtcgtgtatttagtttcgtttatcggtatttttttgtaggattttatcgggtagatttagagtttcgttacggtgtttatttgttgtagtcgtcggcgtcgtttgggttatgcgcggcgttaggcgatagtttttagggttacggcggttagttttagcgcggcgacgtcgagttatttgggttagggtcgggttgggaggtcgaggcgggttagcgcggaggagttggaagcgtttatggtagagcgagggcgggcgcggatcggcgtatagattcggtagcgatcggagatcgggaggacgaggaggtttttaaggattcgggtaggcgagaggagttaaagttgatttaattacggatttttttatatttttatcgtcgagacggtagagtagtttcgcggagagcgggaatgttttaatgcggtgattaagtttgcgcggtaatggaggaagataggtagatagcggcgggggtattttgggcgtcgtgggagcgacgtcgtttaaagtaagcgagttaatggggcggtttttggggtggttagtgttttttttttttttttcgtttttataatacgatagttatttatgta

SEQ ID NO: 31642 - DNA, 650 bp, Artificial Sequence
  chemically treated genomic DNA (Homo sapiens) CpG-island No: 31642
tacataaataactatcgtattataaaaacgaaaaaaaaaaaaaaaacactaaccaccccaaaaaccgccccattaactcgcttactttaaacgacgtcgctcccacgacgcccaaaatacccccgccgctatctacctatcttcctccattaccgcgcaaacttaatcaccgcattaaaacattcccgctctccgcgaaactactctaccgtctcgacgataaaaatataaaaaaatccgtaattaaatcaactttaactcctctcgcctacccgaatccttaaaaacctcctcgtcctcccgatctccgatcgctaccgaatctatacgccgatccgcgcccgccctcgctctaccataaacgcttccaactcctccgcgctaacccgcctcgacctcccaacccgaccctaacccaaataactcgacgtcgccgcgctaaaactaaccgccgtaaccctaaaaactatcgcctaacgccgcgcataacccaaacgacgccgacgactacaacaaataaacaccgtaacgaaactctaaatctacccgataaaatcctacaaaaaaataccgataaacgaaactaaatacacgaccataaaactacgcaacgacaacctacgaaacaaatacaacacaacgcgaacgcg

SEQ ID NO: 31643 - DNA, 650 bp, Artificial Sequence
  chemically treated genomic DNA (Homo sapiens) CpG-island No: 31643
tgtatgggtaattgtcgtgttgtaggggcggggaagagggaggagatattgattattttagaggtcgttttattagttcgtttgttttgggcggcgtcgtttttacggcgtttagggtattttcgtcgttgtttgtttgtttttttttattatcgcgtaggtttggttatcgtattaaggtattttcgtttttcgcggaattgttttgtcgtttcggcggtgaaagtgtgagagggttcgtagttgggttaattttgatttttttcgtttgttcggatttttaagggttttttcgttttttcggttttcggtcgttgtcgggtttgtgcgtcggttcgcgttcgttttcgttttgttatgggcgtttttagttttttcgcgttggttcgtttcggttttttagttcggttttggtttaggtggttcggcgtcgtcgcgttaggattggtcgtcgtggttttggggattgtcgtttggcgtcgcgtatggtttaggcggcgtcggcggttgtagtaggtgggtatcgtggcgaagttttggatttattcggtgaaattttgtaaaggggtgtcggtgagcgaggttgagtgtacggttatggggttgcgtagcggtaatttgcgggataggtatagtatagcgcgggcgcg

SEQ ID NO: 31644 - DNA, 650 bp, Artificial Sequence
  chemically treated genomic DNA (Homo sapiens) CpG-island No: 31644
cgcgcccgcgctatactatacctatcccgcaaattaccgctacgcaaccccataaccgtacactcaacctcgctcaccgacacccctttacaaaatttcaccgaataaatccaaaacttcgccacgatacccacctactacaaccgccgacgccgcctaaaccatacgcgacgccaaacgacaatccccaaaaccacgacgaccaatcctaacgcgacgacgccgaaccacctaaaccaaaaccgaactaaaaaaccgaaacgaaccaacgcgaaaaaactaaaaacgcccataacaaaacgaaaacgaacgcgaaccgacgcacaaacccgacaacgaccgaaaaccgaaaaaacgaaaaaacccttaaaaatccgaacaaacgaaaaaaatcaaaattaacccaactacgaaccctctcacactttcaccgccgaaacgacaaaacaattccgcgaaaaacgaaaataccttaatacgataaccaaacctacgcgataataaaaaaaaacaaacaaacaacgacgaaaataccctaaacgccgtaaaaacgacgccgcccaaaacaaacgaactaataaaacgacctctaaaataatcaatatctcctccctcttccccgcccctacaacacgacaattacccataca

SEQ ID NO: 31645 - DNA, 793 bp, Artificial Sequence
  chemically treated genomic DNA (Homo sapiens) CpG-island No: 31645
tttcgatttaagtttttattacgattcgtaattcgcggttttttttcggcgagggaatgggagcgggggcggaggggtcgtaggtgtagttcggagaaattgggtgagtcgatggtaaggattcggttttcgttttttcgcgggatattatattcgcgtttttcgggtagtggtggcgtagtgtttttattttgtcgtatttttttagtttttttcggtatttttttttgggttgttcgttcggcgtcggtttttttagtggttcgtagcgttcgggtaggagggcgaagtgtatttttcgcgcgtttcgggttttcgggtttcgttcgttcgtcgcgttcgtttcgttttcggtcgtcgttttcgtttcgttcgcgtattttaggtgttttaggatggcggtcgttttttcgtttttttcggttcgttttcgttttcggggttcgcggcgtaggaggttgtttttcgttttgtttcggagtttggtttttatcgttatgatgtttcggtttttttggcgaaggttcgagcgtaaagatattaatttttggttttcgttcgttttttcgttttagttcggacggggcgggggattgggggggtcgtagcgttttttggtcgtggggttcgggatagcgttggtttcgtttcgaattggtttattaggcggcgggcgcgtttcgttagtttcgttttttattttatttatcggttaaattgtgtagattacggcgcgtattgtataatgaatatgtaaaatatttttaattgtatttgttacgaaattaatgat

SEQ ID NO: 31646 - DNA, 793 bp, Artificial Sequence
  chemically treated genomic DNA (Homo sapiens) CpG-island No: 31646
atcattaatttcgtaacaaatacaattaaaaatattttacatattcattatacaatacgcgccgtaatctacacaatttaaccgataaataaaataaaaaacgaaactaacgaaacgcgcccgccgcctaataaaccaattcgaaacgaaaccaacgctatcccgaaccccacgaccaaaaaacgctacgacccccccaatcccccgccccgtccgaactaaaacgaaaaaacgaacgaaaaccaaaaattaatatctttacgctcgaaccttcgccaaaaaaaccgaaacatcataacgataaaaaccaaactccgaaacaaaacgaaaaacaacctcctacgccgcgaaccccgaaaacgaaaacgaaccgaaaaaaacgaaaaaacgaccgccatcctaaaacacctaaaatacgcgaacgaaacgaaaacgacgaccgaaaacgaaacgaacgcgacgaacgaacgaaacccgaaaacccgaaacgcgcgaaaaatacacttcgccctcctacccgaacgctacgaaccactaaaaaaaccgacgccgaacgaacaacccaaaaaaaaataccgaaaaaaactaaaaaaatacgacaaaataaaaacactacgccaccactacccgaaaaacgcgaatataatatcccgcgaaaaaacgaaaaccgaatccttaccatcgactcacccaatttctccgaactacacctacgacccctccgcccccgctcccattccctcgccgaaaaaaaaccgcgaattacgaatcgtaataaaaacttaaatcgaaa

SEQ ID NO: 31647 - DNA, 793 bp, Artificial Sequence
  chemically treated genomic DNA (Homo sapiens) CpG-island No: 31647
gttattaatttcgtagtaagtgtagttgaaggtgttttgtatgtttattgtgtagtgcgcgtcgtagtttgtatagtttggtcggtaggtgggatgaagggcggggttggcggagcgcgttcgtcgtttggtaggttagttcggagcggagttaacgttatttcgggttttacggttagggggcgttgcggtttttttaatttttcgtttcgttcgggttggggcggaggagcgggcggggattaaaggttggtgtttttgcgttcggattttcgttagaggggtcgggatattatgacggtgggagttaggtttcgaagtaaggcggagagtagttttttgcgtcgcgggtttcgagggcgagggcgaatcgagggggacgaggaggcggtcgttattttggagtatttggagtacgcggacgaggcggaggcggcggtcgagagcgggacgagcgcggcggacgagcggggttcggggattcggggcgcgcggagggtgtatttcgtttttttgttcgagcgttacgagttattggaggagtcggcgtcgagcgagtagtttaggaagaggtatcggaggaagttgaagaagtacggtaaggtaggggtattgcgttattattgttcggggggcgcgggtgtggtgtttcgcgggggagcgggagtcgggtttttattatcgatttatttagttttttcgggttgtatttgcgattttttcgttttcgtttttattttttcgtcggagggaagtcgcgagttgcgagtcgtgatagaaatttaaatcgggg

SEQ ID NO: 31648 - DNA, 793 bp, Artificial Sequence
  chemically treated genomic DNA (Homo sapiens) CpG-island No: 31648
ccccgatttaaatttctatcacgactcgcaactcgcgacttccctccgacgaaaaaataaaaacgaaaacgaaaaaatcgcaaatacaacccgaaaaaactaaataaatcgataataaaaacccgactcccgctcccccgcgaaacaccacacccgcgccccccgaacaataataacgcaatacccctaccttaccgtacttcttcaacttcctccgatacctcttcctaaactactcgctcgacgccgactcctccaataactcgtaacgctcgaacaaaaaaacgaaatacaccctccgcgcgccccgaatccccgaaccccgctcgtccgccgcgctcgtcccgctctcgaccgccgcctccgcctcgtccgcgtactccaaatactccaaaataacgaccgcctcctcgtccccctcgattcgccctcgccctcgaaacccgcgacgcaaaaaactactctccgccttacttcgaaacctaactcccaccgtcataatatcccgacccctctaacgaaaatccgaacgcaaaaacaccaacctttaatccccgcccgctcctccgccccaacccgaacgaaacgaaaaattaaaaaaaccgcaacgccccctaaccgtaaaacccgaaataacgttaactccgctccgaactaacctaccaaacgacgaacgcgctccgccaaccccgcccttcatcccacctaccgaccaaactatacaaactacgacgcgcactacacaataaacatacaaaacaccttcaactacacttactacgaaattaataac

SEQ ID NO: 31649 - DNA, 943 bp, Artificial Sequence
  chemically treated genomic DNA (Homo sapiens) CpG-island No: 31649
acggtttcgtttttttttatttgttttttttttttttttgttcgttcgagggtggtaaaggcgatgggtgggcggggtttataaatcgtttcgttttttttcgtttttttttcgttttttgacgtcgttcgcgttttttcgtttttcgcgcggggatgaagttattacgtgattttatattcggcgcgggagttttgagttcgcgcgcgttttttcgtttgtttgtcggtttttttcgtagcgtgatcgggcgtcgtcgcggaggggaggggggttttttacgtcgttggcggcgggggggtcgtttcggagtgtagatcgttttttttttttgtttatttttcgtcgtttttttttgttttcgttttgtcggttgtacgtcgtcgtcgcgggcgcggaggaggaggagagcgcggacgttttagggtcggttcggtttcgtcgcggcgttttttttttttattttgagtcgtagcgcgcggcgtcggtcgagggcgatggggttgggttgaggcgaggcggcggcggcgatagcggcggtcgggtttttcgcggtttttggggttggttcggtcgcgagggaggtcgcggaggaggcggcgcggcggcggttagtgagcggtttcggtgagcggggcgaggggcgggtgggtagcggcgtcgggggaggtcgaggaggcgaatggtggtgtcggggcggcgggtatcgggcgaggtcgcggttagttttttcgggtcggagttgggtatcgcggggacggggagtgtcgggggtaggtgaggttagggtaggagtttacgcggtgggtgcgaaggtttgggggggacgcgtcgtttgtcgggggcgagcgtgggggtcgggcgtttggtggttggtagttagagttttcggaaagttttgtgggaggtggaggttttgtgggtagaggcgtaggggtgttgg

SEQ ID NO: 31650 - DNA, 943 bp, Artificial Sequence
  chemically treated genomic DNA (Homo sapiens) CpG-island No: 31650
ccaacacccctacgcctctacccacaaaacctccacctcccacaaaactttccgaaaactctaactaccaaccaccaaacgcccgacccccacgctcgcccccgacaaacgacgcgtcccccccaaaccttcgcacccaccgcgtaaactcctaccctaacctcacctacccccgacactccccgtccccgcgatacccaactccgacccgaaaaaactaaccgcgacctcgcccgatacccgccgccccgacaccaccattcgcctcctcgacctcccccgacgccgctacccacccgcccctcgccccgctcaccgaaaccgctcactaaccgccgccgcgccgcctcctccgcgacctccctcgcgaccgaaccaaccccaaaaaccgcgaaaaacccgaccgccgctatcgccgccgccgcctcgcctcaacccaaccccatcgccctcgaccgacgccgcgcgctacgactcaaaataaaaaaaaaaaacgccgcgacgaaaccgaaccgaccctaaaacgtccgcgctctcctcctcctccgcgcccgcgacgacgacgtacaaccgacaaaacgaaaacaaaaaaaaacgacgaaaaataaacaaaaaaaaaaaacgatctacactccgaaacgacccccccgccgccaacgacgtaaaaaacccccctcccctccgcgacgacgcccgatcacgctacgaaaaaaaccgacaaacaaacgaaaaaacgcgcgcgaactcaaaactcccgcgccgaatataaaatcacgtaataacttcatccccgcgcgaaaaacgaaaaaacgcgaacgacgtcaaaaaacgaaaaaaaaacgaaaaaaaacgaaacgatttataaaccccgcccacccatcgcctttaccaccctcgaacgaacaaaaaaaaaaaaaaaacaaataaaaaaaaacgaaaccgt

SEQ ID NO: 31651 - DNA, 943 bp, Artificial Sequence
  chemically treated genomic DNA (Homo sapiens) CpG-island No: 31651
ttagtatttttacgtttttgtttataggatttttattttttataggatttttcgaaagttttgattattaattattaagcgttcggtttttacgttcgttttcggtaggcggcgcgttttttttaggttttcgtatttatcgcgtgggtttttgttttggttttatttgttttcgatatttttcgttttcgcgatgtttaatttcggttcgagaaggttggtcgcgatttcgttcggtattcgtcgtttcgatattattattcgttttttcgatttttttcggcgtcgttgtttattcgtttttcgtttcgtttatcggggtcgtttattggtcgtcgtcgcgtcgtttttttcgcggtttttttcgcggtcggattagttttaggggtcgcgggggattcggtcgtcgttgtcgtcgtcgtcgtttcgttttagtttagttttatcgttttcggtcggcgtcgcgcgttgcggtttagggtgagggaaggaggcgtcgcggcggggtcgggtcggttttgggacgttcgcgttttttttttttttcgcgttcgcggcggcggcgtgtagtcggtagggcgagaataagggagggcggcgggaggtgggtaggggaggggggcggtttgtatttcgaaacggttttttcgtcgttagcgacgtagagaatttttttttttttcgcggcggcgttcgattacgttgcggggagagtcggtaggtaggcgggggagcgcgcgcgggtttaggattttcgcgtcggatgtgaggttacgtggtggttttattttcgcgcggagggcggaggggcgcgggcgacgttaggaggcggggaaggggcggggaggggcggggcgatttataggtttcgtttatttatcgtttttgttattttcgaacgggtaaaagaaagaaagaggtaggtaaggggaggcgaggtcgt

SEQ ID NO: 31652 - DNA, 943 bp, Artificial Sequence
  chemically treated genomic DNA (Homo sapiens) CpG-island No: 31652
acgacctcgcctccccttacctacctctttctttcttttacccgttcgaaaataacaaaaacgataaataaacgaaacctataaatcgccccgcccctccccgccccttccccgcctcctaacgtcgcccgcgcccctccgccctccgcgcgaaaataaaaccaccacgtaacctcacatccgacgcgaaaatcctaaacccgcgcgcgctcccccgcctacctaccgactctccccgcaacgtaatcgaacgccgccgcgaaaaaaaaaaaaattctctacgtcgctaacgacgaaaaaaccgtttcgaaatacaaaccgcccccctcccctacccacctcccgccgccctcccttattctcgccctaccgactacacgccgccgccgcgaacgcgaaaaaaaaaaaaaacgcgaacgtcccaaaaccgacccgaccccgccgcgacgcctccttccctcaccctaaaccgcaacgcgcgacgccgaccgaaaacgataaaactaaactaaaacgaaacgacgacgacgacaacgacgaccgaatcccccgcgacccctaaaactaatccgaccgcgaaaaaaaccgcgaaaaaaacgacgcgacgacgaccaataaacgaccccgataaacgaaacgaaaaacgaataaacaacgacgccgaaaaaaatcgaaaaaacgaataataatatcgaaacgacgaataccgaacgaaatcgcgaccaaccttctcgaaccgaaattaaacatcgcgaaaacgaaaaatatcgaaaacaaataaaaccaaaacaaaaacccacgcgataaatacgaaaacctaaaaaaaacgcgccgcctaccgaaaacgaacgtaaaaaccgaacgcttaataattaataatcaaaactttcgaaaaatcctataaaaaataaaaatcctataaacaaaaacgtaaaaatactaa

SEQ ID NO: 31653 - DNA, 1110 bp, Artificial Sequence
  chemically treated genomic DNA (Homo sapiens) CpG-island No: 31653
aatcggaatcgggatttcgtttggggagcgcgttaagaaataggggaggcgagcgttgagggaagggatggatggtcggggttataggcggtttttgcggggatgtcggggtttcgtttgagtcgcgtagaggatgttcgcggcgcgtcgtcggtcgtttcgattcgggtttttcgagcgtagtcgttggtttttttttattcgcgttttaggtcgttatataaaggggatggcgaggcgcgtcggtcgtcgggaggtggaggggcgacgggtttgggacgaggtggtcgagtcgcgacgttcgtcgcgtttttcgtttttgtttgtttcgtttcgcgttttttttttgcggaggagttttatcgtcgcggcgtttttattttgttcgttattcgggtgagtagcggttttatttgttcgtcggttttattagtttttatggtcggtcggttagttcgtgacggtcgttacggtattgtttcgcgcggtttgtttgtttttgtcgttgtttttgtcgtcgtcgtcgagttttcggcgcgcgaggataaacgtgggtgcgttcgtgcgcgaggtgtgcgcgcgtggggagagtcgggcgtcgggcgcgggagacgcggggcgtgcgtgtgcgcgttgcgattgttgggttggttttagtaggagagcgaggtcgcggcgtggaatttgaagttagaattgagcgaatcggcggatcgagcgggaaggaggagagtcgcgtaggaggaggggttcgggggcggagtcgtaaatcgtgacgagttcggcgtcggggttaggtaagatacgttttttcgtttcgttttttcgggttacgttttttgttagtttggtatcgttagtttttttagcgcgttcgcgggtcgcgtcgttaggttatcgggagatggggcgggagggaggcgggacggatatttgttttagttaatcggcggttggcggattttcgttcgtttttttcgtgttatttttttaggacgtatcgtttttttttgtataagtttaattgatcgaagttgagcgtttaattagttttttaagtcggaagtttttttgacgtttttaatggggtggggggttattatttttttg

SEQ ID NO: 31654 - DNA, 1110 bp, Artificial Sequence
  chemically treated genomic DNA (Homo sapiens) CpG-island No: 31654
caaaaaaataataaccccccaccccattaaaaacgtcaaaaaaacttccgacttaaaaaactaattaaacgctcaacttcgatcaattaaacttatacaaaaaaaaacgatacgtcctaaaaaaataacacgaaaaaaacgaacgaaaatccgccaaccgccgattaactaaaacaaatatccgtcccgcctccctcccgccccatctcccgataacctaacgacgcgacccgcgaacgcgctaaaaaaactaacgataccaaactaacaaaaaacgtaacccgaaaaaacgaaacgaaaaaacgtatcttacctaaccccgacgccgaactcgtcacgatttacgactccgcccccgaacccctcctcctacgcgactctcctccttcccgctcgatccgccgattcgctcaattctaacttcaaattccacgccgcgacctcgctctcctactaaaaccaacccaacaatcgcaacgcgcacacgcacgccccgcgtctcccgcgcccgacgcccgactctccccacgcgcgcacacctcgcgcacgaacgcacccacgtttatcctcgcgcgccgaaaactcgacgacgacgacaaaaacaacgacaaaaacaaacaaaccgcgcgaaacaataccgtaacgaccgtcacgaactaaccgaccgaccataaaaactaataaaaccgacgaacaaataaaaccgctactcacccgaataacgaacaaaataaaaacgccgcgacgataaaactcctccgcaaaaaaaaaacgcgaaacgaaacaaacaaaaacgaaaaacgcgacgaacgtcgcgactcgaccacctcgtcccaaacccgtcgcccctccacctcccgacgaccgacgcgcctcgccatcccctttatataacgacctaaaacgcgaataaaaaaaaaccaacgactacgctcgaaaaacccgaatcgaaacgaccgacgacgcgccgcgaacatcctctacgcgactcaaacgaaaccccgacatccccgcaaaaaccgcctataaccccgaccatccatcccttccctcaacgctcgcctcccctatttcttaacgcgctccccaaacgaaatcccgattccgatt

SEQ ID NO: 31655 - DNA, 1110 bp, Artificial Sequence
  chemically treated genomic DNA (Homo sapiens) CpG-island No: 31655
taaggaggtggtgattttttattttattgagaacgttaggggagttttcgatttgaaaaattagttagacgtttagtttcggttaattaagtttatataaagaggggcggtgcgttttgaggaggtggtacgggggaggcgagcggaagttcgttagtcgtcgattggttgggataaatgttcgtttcgtttttttttcgttttatttttcggtggtttagcggcgcggttcgcgggcgcgttgaggaggttggcggtgttagattggtagggggcgtgattcgaggaggcggggcgggggggcgtgttttgtttggtttcggcgtcgggttcgttacggtttgcggtttcgttttcgaatttttttttttacgcggtttttttttttttcgttcggttcgtcggttcgtttagttttagttttaggttttacgtcgcggtttcgtttttttattaaagttagtttagtagtcgtagcgcgtatacgtacgtttcgcgtttttcgcgttcggcgttcggttttttttacgcgcgtatatttcgcgtacggacgtatttacgtttgttttcgcgcgtcgggggttcggcggcggcggtaggggtagcggtagaagtaggtagatcgcgcggggtagtatcgtagcggtcgttacgggttggtcggtcggttatggaggttgatggggtcggcgagtagatgagatcgttatttattcgggtaacgagtagggtgagggcgtcgcggcggtggggttttttcgtagggggagggcgcggggcgaggtagataaaggcggggggcgcggcgggcgtcgcggttcggttatttcgttttaggttcgtcgtttttttatttttcggcggtcggcgcgtttcgttattttttttgtgtggcggtttggggcgcgggtgggagggggttagcggttgcgttcgggaggttcgagtcggggcggtcggcggcgcgtcgcgggtattttttgcgcggtttaggcgggatttcgatattttcgtagaggtcgtttgtgatttcgattatttatttttttttttagcgttcgttttttttgttttttagcgcgttttttaggcggggtttcggtttcggtt

SEQ ID NO: 31656 - DNA, 1110 bp, Artificial Sequence
  chemically treated genomic DNA (Homo sapiens) CpG-island No: 31656
aaccgaaaccgaaaccccgcctaaaaaacgcgctaaaaaacaaaaaaaacgaacgctaaaaaaaaaaataaataatcgaaatcacaaacgacctctacgaaaatatcgaaatcccgcctaaaccgcgcaaaaaatacccgcgacgcgccgccgaccgccccgactcgaacctcccgaacgcaaccgctaaccccctcccacccgcgccccaaaccgccacacaaaaaaaataacgaaacgcgccgaccgccgaaaaataaaaaaacgacgaacctaaaacgaaataaccgaaccgcgacgcccgccgcgccccccgcctttatctacctcgccccgcgccctccccctacgaaaaaaccccaccgccgcgacgccctcaccctactcgttacccgaataaataacgatctcatctactcgccgaccccatcaacctccataaccgaccgaccaacccgtaacgaccgctacgatactaccccgcgcgatctacctacttctaccgctacccctaccgccgccgccgaacccccgacgcgcgaaaacaaacgtaaatacgtccgtacgcgaaatatacgcgcgtaaaaaaaaccgaacgccgaacgcgaaaaacgcgaaacgtacgtatacgcgctacgactactaaactaactttaataaaaaaacgaaaccgcgacgtaaaacctaaaactaaaactaaacgaaccgacgaaccgaacgaaaaaaaaaaaaaccgcgtaaaaaaaaaaattcgaaaacgaaaccgcaaaccgtaacgaacccgacgccgaaaccaaacaaaacacgcccccccgccccgcctcctcgaatcacgccccctaccaatctaacaccgccaacctcctcaacgcgcccgcgaaccgcgccgctaaaccaccgaaaaataaaacgaaaaaaaaacgaaacgaacatttatcccaaccaatcgacgactaacgaacttccgctcgcctcccccgtaccacctcctcaaaacgcaccgcccctctttatataaacttaattaaccgaaactaaacgtctaactaatttttcaaatcgaaaactcccctaacgttctcaataaaataaaaaatcaccacctcctta

SEQ ID NO: 31657 - DNA, 1215 bp, Artificial Sequence
  chemically treated genomic DNA (Homo sapiens) CpG-island No: 31657
gcgcggttttggggattgtttattatggattggtgaatttgggttttttttcgaggtggtggtttatttcgtttgttttttgtttcgtttttcgattcgtacgttttttttttaattcgcgcgtacgaatggttaaaaaaagggtgtgaggttcgagttcgttagttaggtcgttagtatttcgcgcgcgtttttagcgaggattcgtacgagttgttcggttttgtgtttgcgttgtttgaaattgtggaattcgttaggtttttggggaattatagttttagttggtttcggagttcgtgcgtgttaggggcgagtggtcgtcgcgagacggtttttgtttttcgtgtttttgtagcgtggagattggaatcggtaattttaaaggacgttacgtttaatcgtagcgttggcgcgggcggaggttaaaatacgggggttttgagattgaggaaaacgcgttaagtttttttcggtggcggagtgttaaagattttagcggtttaggcgttcggcgagcggggtcgttgtttgttgcgtttttggttttttcggggcgggcgtagatgggcgtcgttttcgggatgtagttggtgttggtgtaaggcgggagcgagcggcggtcggggttttcgtttttgggagcggatggttattttttcgcggggagggcgagtcgattagatttttttggggtcggggattcggcgggttcggggtagggatttatttgtcgtatttatatttattcgggttggatttgtcggcgttatcgtcgcggatttcgttttgggttatgattaggtaaggagggtttgggaggaggggtcggttttcgggcgcgggggtaagttcggtcggcgcgggagaggagttgtcggggagatttcgggatcgtgttggtttcgtattttggtcgatttgttagggggagtcgtgtgtgtttcgggcgtggcgtttgttttgtcgtcgtcgggacgcgagaaggtaggtgcgggttgggcgtaaataggttaatttcgcggcgagggcgttcggcgcgggggtgtgggtcgaggacgtcgtcgttagtttttttcgatcgggtagttcggtggttgttcgtttttttagtttttttttcgttttcgagagcggtgaaggatggggagaaagaaacgtttttacgtaggttgttttgtgtcggtaattgcgaaattttatcgcgtatttttt

SEQ ID NO: 31658 - DNA, 1215 bp, Artificial Sequence
  chemically treated genomic DNA (Homo sapiens) CpG-island No: 31658
aaaaaatacgcgataaaatttcgcaattaccgacacaaaacaacctacgtaaaaacgtttctttctccccatccttcaccgctctcgaaaacgaaaaaaaaactaaaaaaacgaacaaccaccgaactacccgatcgaaaaaaactaacgacgacgtcctcgacccacacccccgcgccgaacgccctcgccgcgaaattaacctatttacgcccaacccgcacctaccttctcgcgtcccgacgacgacaaaacaaacgccacgcccgaaacacacacgactccccctaacaaatcgaccaaaatacgaaaccaacacgatcccgaaatctccccgacaactcctctcccgcgccgaccgaacttacccccgcgcccgaaaaccgacccctcctcccaaaccctccttacctaatcataacccaaaacgaaatccgcgacgataacgccgacaaatccaacccgaataaatataaatacgacaaataaatccctaccccgaacccgccgaatccccgaccccaaaaaaatctaatcgactcgccctccccgcgaaaaaataaccatccgctcccaaaaacgaaaaccccgaccgccgctcgctcccgccttacaccaacaccaactacatcccgaaaacgacgcccatctacgcccgccccgaaaaaaccaaaaacgcaacaaacaacgaccccgctcgccgaacgcctaaaccgctaaaatctttaacactccgccaccgaaaaaaacttaacgcgttttcctcaatctcaaaacccccgtattttaacctccgcccgcgccaacgctacgattaaacgtaacgtcctttaaaattaccgattccaatctccacgctacaaaaacacgaaaaacaaaaaccgtctcgcgacgaccactcgcccctaacacgcacgaactccgaaaccaactaaaactataattccccaaaaacctaacgaattccacaatttcaaacaacgcaaacacaaaaccgaacaactcgtacgaatcctcgctaaaaacgcgcgcgaaatactaacgacctaactaacgaactcgaacctcacaccctttttttaaccattcgtacgcgcgaattaaaaaaaaaacgtacgaatcgaaaaacgaaacaaaaaacaaacgaaataaaccaccacctcgaaaaaaaacccaaattcaccaatccataataaacaatccccaaaaccgcgc

SEQ ID NO: 31659 - DNA, 1215 bp, Artificial Sequence
  chemically treated genomic DNA (Homo sapiens) CpG-island No: 31659
agaaaatgcgcggtaaaatttcgtaattatcgatatagggtaatttgcgtggaaacgtttttttttttttattttttatcgttttcgggaacggaaagaaagttggaaggacgagtagttatcgggttgttcggtcgggggaggttggcggcggcgttttcggtttatattttcgcgtcgggcgttttcgtcgcggagttggtttatttacgtttagttcgtatttgttttttcgcgtttcggcggcggtaagataggcgttacgttcgaggtatatacggttttttttggtaggtcgattagggtgcgaggttaatacggtttcggggttttttcggtagtttttttttcgcgtcggtcgaatttgttttcgcgttcgggagtcggtttttttttttaggttttttttatttggttatggtttaaagcgaagttcgcggcggtgacgtcggtaagtttaattcgaatgagtgtgggtgcgataggtgagtttttgtttcgagttcgtcgggttttcggttttaggaaaatttggtcggttcgtttttttcgcgggggagtgattattcgtttttaagagcgggaatttcgatcgtcgttcgttttcgttttgtattaatattaattatatttcgggagcggcgtttatttgcgttcgtttcgggagagttaggagcgtaataagtagcggtttcgttcgtcgaacgtttgaatcgttagggtttttagtatttcgttatcgaggggaatttggcgcgttttttttagttttaggattttcgtgttttagttttcgttcgcgttagcgttgcgattgaacgtggcgttttttgaaattgtcggttttagtttttacgttgtagagatacgaaaggtaggagtcgtttcgcgacggttattcgtttttggtacgtacgggtttcggagttagttgggattgtagttttttaaaagtttaacgggttttatagttttaaataacgtaggtatagagtcgggtagttcgtgcgggttttcgttgagggcgcgcgcgaggtgttagcggtttggttggcgggttcgagttttatattttttttttaattattcgtgcgcgcgagttgagggaaaagcgtacgggtcgggagacgggatagagagtagacgggatgggttattatttcgagaaggagtttaaatttattaatttatgatgaataatttttaaaatcgcgt

SEQ ID NO: 31660 - DNA, 1215 bp, Artificial Sequence
  chemically treated genomic DNA (Homo sapiens) CpG-island No: 31660
acgcgattttaaaaattattcatcataaattaataaatttaaactccttctcgaaataataacccatcccgtctactctctatcccgtctcccgacccgtacgcttttccctcaactcgcgcgcacgaataattaaaaaaaaaatataaaactcgaacccgccaaccaaaccgctaacacctcgcgcgcgccctcaacgaaaacccgcacgaactacccgactctatacctacgttatttaaaactataaaacccgttaaacttttaaaaaactacaatcccaactaactccgaaacccgtacgtaccaaaaacgaataaccgtcgcgaaacgactcctacctttcgtatctctacaacgtaaaaactaaaaccgacaatttcaaaaaacgccacgttcaatcgcaacgctaacgcgaacgaaaactaaaacacgaaaatcctaaaactaaaaaaaacgcgccaaattcccctcgataacgaaatactaaaaaccctaacgattcaaacgttcgacgaacgaaaccgctacttattacgctcctaactctcccgaaacgaacgcaaataaacgccgctcccgaaatataattaatattaatacaaaacgaaaacgaacgacgatcgaaattcccgctcttaaaaacgaataatcactcccccgcgaaaaaaacgaaccgaccaaattttcctaaaaccgaaaacccgacgaactcgaaacaaaaactcacctatcgcacccacactcattcgaattaaacttaccgacgtcaccgccgcgaacttcgctttaaaccataaccaaataaaaaaaacctaaaaaaaaaaaccgactcccgaacgcgaaaacaaattcgaccgacgcgaaaaaaaaactaccgaaaaaaccccgaaaccgtattaacctcgcaccctaatcgacctaccaaaaaaaaccgtatatacctcgaacgtaacgcctatcttaccgccgccgaaacgcgaaaaaacaaatacgaactaaacgtaaataaaccaactccgcgacgaaaacgcccgacgcgaaaatataaaccgaaaacgccgccgccaacctcccccgaccgaacaacccgataactactcgtccttccaactttctttccgttcccgaaaacgataaaaaataaaaaaaaaaaaacgtttccacgcaaattaccctatatcgataattacgaaattttaccgcgcattttct

SEQ ID NO: 31661 - DNA, 677 bp, Artificial Sequence
  chemically treated genomic DNA (Homo sapiens) CpG-island No: 31661
tttagattttacgatcgtcggattcgagttggcgtaattcgttacggttattgtaatatagtattaatttttaaggaagaggttttttttcgttagcgtttttttcgttaatatttttttttcgttgtaggttttcggatcgagtcgttttttagtcgcgggtacgcgagcgtttatttcggtacggtttagtttttttttagtcgttagtttttaaaatgttttagcgtttttgtttttttcgtttatttcggtcggagtaggcgtcgtgggttcggaatttgagtcgttttttttttttgggtatggcgatcgtatcggggcgaggtttgtttagcgggtcgggttttcgggttatgttttcggtcggagagtcggtttcgggagtcgtaagttagtttcgttcggtttcgcggttattttatatcggaggtcgttaattttcgcgagaatataggttcgggtttcgagtcgcgttgtcggacgacgtttttttacgcgaattaattatcgttaggtgtaaggatacgttattattcggtattcgcgaattaagttgggttcgggttttaggtggagagagagttgttgtattgggtggtgtcgcgtatcgtcgtatttcgtgtgagatgaatggtgttttagaattatagtttatatttgtgttgattagaatt

SEQ ID NO: 31662 - DNA, 677 bp, Artificial Sequence
  chemically treated genomic DNA (Homo sapiens) CpG-island No: 31662
aattctaatcaacacaaatataaactataattctaaaacaccattcatctcacacgaaatacgacgatacgcgacaccacccaatacaacaactctctctccacctaaaacccgaacccaacttaattcgcgaataccgaataataacgtatccttacacctaacgataattaattcgcgtaaaaaaacgtcgtccgacaacgcgactcgaaacccgaacctatattctcgcgaaaattaacgacctccgatataaaataaccgcgaaaccgaacgaaactaacttacgactcccgaaaccgactctccgaccgaaaacataacccgaaaacccgacccgctaaacaaacctcgccccgatacgatcgccatacccaaaaaaaaaaaacgactcaaattccgaacccacgacgcctactccgaccgaaataaacgaaaaaaacaaaaacgctaaaacattttaaaaactaacgactaaaaaaaaactaaaccgtaccgaaataaacgctcgcgtacccgcgactaaaaaacgactcgatccgaaaacctacaacgaaaaaaaaatattaacgaaaaaaacgctaacgaaaaaaaacctcttccttaaaaattaatactatattacaataaccgtaacgaattacgccaactcgaatccgacgatcgtaaaatctaaa

SEQ ID NO: 31663 - DNA, 677 bp, Artificial Sequence
  chemically treated genomic DNA (Homo sapiens) CpG-island No: 31663
aattttaattaatataggtgtgggttatggttttgagatattatttattttatacgaggtacggcgatacgcgatattatttagtataatagttttttttttatttggaattcggatttagtttgattcgcgggtgtcggatgatgacgtatttttgtatttggcgatgattggttcgcgtggagaggcgtcgttcgataacgcgattcggaattcggatttatgttttcgcgagagttagcggttttcggtgtgggatggtcgcggagtcgggcggagttggtttgcggttttcggggtcggtttttcggtcggagatatggttcgggggttcggttcgttaggtaggtttcgtttcgatacggtcgttatgtttaagagaggaaagcgatttaagtttcgggtttacgacgtttgtttcggtcgaggtgggcgaggggggtaggggcgttgaaatattttgggggttggcggttgggagggggttggatcgtgtcgaggtgagcgttcgcgtgttcgcggttggagggcggttcggttcgggggtttgtagcgaggaggaggtgttggcggggaagacgttgacgagagaaggttttttttttgagggttggtgttgtgttgtagtgatcgtggcggattacgttaattcggattcggcggtcgtgaggtttgga

SEQ ID NO: 31664 - DNA, 677 bp, Artificial Sequence
  chemically treated genomic DNA (Homo sapiens) CpG-island No: 31664
tccaaacctcacgaccgccgaatccgaattaacgtaatccgccacgatcactacaacacaacaccaaccctcaaaaaaaaaaccttctctcgtcaacgtcttccccgccaacacctcctcctcgctacaaacccccgaaccgaaccgccctccaaccgcgaacacgcgaacgctcacctcgacacgatccaaccccctcccaaccgccaacccccaaaatatttcaacgcccctacccccctcgcccacctcgaccgaaacaaacgtcgtaaacccgaaacttaaatcgctttcctctcttaaacataacgaccgtatcgaaacgaaacctacctaacgaaccgaacccccgaaccatatctccgaccgaaaaaccgaccccgaaaaccgcaaaccaactccgcccgactccgcgaccatcccacaccgaaaaccgctaactctcgcgaaaacataaatccgaattccgaatcgcgttatcgaacgacgcctctccacgcgaaccaatcatcgccaaatacaaaaatacgtcatcatccgacacccgcgaatcaaactaaatccgaattccaaataaaaaaaaaactattatactaaataatatcgcgtatcgccgtacctcgtataaaataaataatatctcaaaaccataacccacacctatattaattaaaatt

SEQ ID NO: 31665 - DNA, 1020 bp, Artificial Sequence
  chemically treated genomic DNA (Homo sapiens) CpG-island No: 31665
ggcgatcgtttattgtttttaggtcgggtttaagttttcgtttttttttatgtcgtataataaagcggggcgttcgtttttattcggttagttcgggttatttcgcgcgttggcggcgttcggtttttttttcgagggcgtagcggtcgacggtggtcggggtgggggagggcgcgtagcgtcgcgggttgggttcggggttggagaacgggtgcggggttcgtaggtttcggagatcggggtcggggcgtagcgtttggggattagcgtttcggcgcgcgtttgttcggtttattcgtttggagtcggacgcgtagtggtatagacgtatagcgggatagacggacgtcggagagattttgatagtcgttcggttttcgcgttcgttcggcgtttttcggttgttttttcggagcgtttatttttcgcgcgatttggttgagcgcgtcgtttttcgtcgtgagtcgttttcggttggggagtcgtttgcgtttcgatttttgggtgtttatgtttatcgatcgcgtcgttcgtagttgtcgcggggttcgttgttttagtcgttcgcgtcgtttcggttcggtttcggtttcggttttttttttcgtcgcggcgttatggcgttagcgggcgttgggtcggggacgcggggacgcggggggacgggggtcgcggggattcgggggaagttagagtcggaggttcgtagcgcgggttagggattgtaggggttagggacggcggggcgggggacgggggcggggggcggagacgttaggtgttagggacgatgggggttcgatattacggggacgttgcggatgtttagggtcgggtacgcgggatttgagggatcgggagtttcggagggtggattttgcggggattgtttggcgggtcggtaatcgcggagcgacgcgcgttagggcggtgggtatcggttgagtggggatttgagcggagagcgggggggtaggaaggtttttagaggtttgagttgttttgaggggtttgtacgga

SEQ ID NO: 31666 - DNA, 1020 bp, Artificial Sequence
  chemically treated genomic DNA (Homo sapiens) CpG-island No: 31666
tccgtacaaacccctcaaaacaactcaaacctctaaaaaccttcctacccccccgctctccgctcaaatccccactcaaccgatacccaccgccctaacgcgcgtcgctccgcgattaccgacccgccaaacaatccccgcaaaatccaccctccgaaactcccgatccctcaaatcccgcgtacccgaccctaaacatccgcaacgtccccgtaatatcgaacccccatcgtccctaacacctaacgtctccgccccccgcccccgtcccccgccccgccgtccctaacccctacaatccctaacccgcgctacgaacctccgactctaacttcccccgaatccccgcgacccccgtccccccgcgtccccgcgtccccgacccaacgcccgctaacgccataacgccgcgacgaaaaaaaaaaccgaaaccgaaaccgaaccgaaacgacgcgaacgactaaaacaacgaaccccgcgacaactacgaacgacgcgatcgataaacataaacacccaaaaatcgaaacgcaaacgactccccaaccgaaaacgactcacgacgaaaaacgacgcgctcaaccaaatcgcgcgaaaaataaacgctccgaaaaaacaaccgaaaaacgccgaacgaacgcgaaaaccgaacgactatcaaaatctctccgacgtccgtctatcccgctatacgtctataccactacgcgtccgactccaaacgaataaaccgaacaaacgcgcgccgaaacgctaatccccaaacgctacgccccgaccccgatctccgaaacctacgaaccccgcacccgttctccaaccccgaacccaacccgcgacgctacgcgccctcccccaccccgaccaccgtcgaccgctacgccctcgaaaaaaaaaccgaacgccgccaacgcgcgaaataacccgaactaaccgaataaaaacgaacgccccgctttattatacgacataaaaaaaaacgaaaacttaaacccgacctaaaaacaataaacgatcgcc

SEQ ID NO: 31667 - DNA, 1020 bp, Artificial Sequence
  chemically treated genomic DNA (Homo sapiens) CpG-island No: 31667
ttcgtgtaaattttttaaggtaatttaggtttttgaaagtttttttattttttcgtttttcgtttaggtttttatttaatcggtgtttatcgttttggcgcgcgtcgtttcgcgattatcggttcgttaaatagttttcgtaaagtttatttttcggggttttcggttttttaggtttcgcgtgttcggttttgggtattcgtagcgttttcgtggtatcggatttttatcgtttttgatatttggcgttttcgtttttcgttttcgtttttcgtttcgtcgtttttggtttttgtagtttttggttcgcgttgcggattttcggttttggtttttttcgggttttcgcggttttcgttttttcgcgttttcgcgttttcggtttagcgttcgttgacgttatgacgtcgcggcggagggaggggtcggggtcggggtcgggtcggggcggcgcgagcggttggagtaacgggtttcgcggtagttgcgggcgacgcggtcgatggatatgggtatttagggatcggggcgtaagcggttttttaatcgggagcggtttacggcggaggacgacgcgtttaattagatcgcgcgggaggtgagcgtttcgggagggtagtcggggggcgtcgggcgggcgcgggggtcggacggttgttagggttttttcggcgttcgtttgtttcgttgtgcgtttgtgttattgcgcgttcggttttaggcgggtgggtcgggtaggcgcgcgtcggggcgttgatttttaggcgttgcgtttcggtttcgattttcgaggtttgcggatttcgtattcgttttttagtttcgggtttagttcgcgacgttgcgcgtttttttttatttcggttatcgtcggtcgttgcgttttcgggagaggagtcgggcgtcgttagcgcgcgaggtggttcgggttggtcgggtgggggcgagcgtttcgttttgttgtgcggtatgggaggaggcgggggtttaggttcgatttggaggtagtggacggtcgtt

SEQ ID NO: 31668 - DNA, 1020 bp, Artificial Sequence
  chemically treated genomic DNA (Homo sapiens) CpG-island No: 31668
aacgaccgtccactacctccaaatcgaacctaaacccccgcctcctcccataccgcacaacaaaacgaaacgctcgcccccacccgaccaacccgaaccacctcgcgcgctaacgacgcccgactcctctcccgaaaacgcaacgaccgacgataaccgaaataaaaaaaaacgcgcaacgtcgcgaactaaacccgaaactaaaaaacgaatacgaaatccgcaaacctcgaaaatcgaaaccgaaacgcaacgcctaaaaatcaacgccccgacgcgcgcctacccgacccacccgcctaaaaccgaacgcgcaataacacaaacgcacaacgaaacaaacgaacgccgaaaaaaccctaacaaccgtccgacccccgcgcccgcccgacgccccccgactaccctcccgaaacgctcacctcccgcgcgatctaattaaacgcgtcgtcctccgccgtaaaccgctcccgattaaaaaaccgcttacgccccgatccctaaatacccatatccatcgaccgcgtcgcccgcaactaccgcgaaacccgttactccaaccgctcgcgccgccccgacccgaccccgaccccgacccctccctccgccgcgacgtcataacgtcaacgaacgctaaaccgaaaacgcgaaaacgcgaaaaaacgaaaaccgcgaaaacccgaaaaaaaccaaaaccgaaaatccgcaacgcgaaccaaaaactacaaaaaccaaaaacgacgaaacgaaaaacgaaaacgaaaaacgaaaacgccaaatatcaaaaacgataaaaatccgataccacgaaaacgctacgaatacccaaaaccgaacacgcgaaacctaaaaaaccgaaaaccccgaaaaataaactttacgaaaactatttaacgaaccgataatcgcgaaacgacgcgcgccaaaacgataaacaccgattaaataaaaacctaaacgaaaaacgaaaaaataaaaaaactttcaaaaacctaaattaccttaaaaaatttacacgaa

SEQ ID NO: 31669 - DNA, 780 bp, Artificial Sequence
  chemically treated genomic DNA (Homo sapiens) CpG-island No: 31669
gcgtggtcgcgaaggggaagagtagaggtatcggttcggttgtaggtgggagggtgttcgggtgaggggtgagcgcggggtcggggagcggcggcgggggattgggcgacggtttcggggtcgggtcgcgggcggagattgataggcgtgggcggcgatagttgtagtttcgaagtttttagcgtggagttacgcgttagcgcgcggaggggagtggggcgtggggtaagtagaggggcgtacggaggggagtatggagggacgtggggagtatggagagacgtgggggcgtacggagggacggcggggtttggagcgagtataggggcgtacggaggggtatttgggcgtggggcgagtataggggcgtacggagaggagtatggagggatatggggcgtacggaggggtagcggggtttggggtcgagtagaggggcgtatggaggggagtatggagggacgtggggcgcgcggaggggcggcggggcgtgggacgcgcggttttttttcgcgaagttggagaggtttcgggtcgtagggtatttattgtgcgttttggacgaagtttattttggaggtagcggtttcgagggacgtcggaaggaacggtcgttttttttagggttttcgtttgtatttgcgggttggtagattcggggcgttattttttttttagggtttcggagggaggcggaagaaggcgtaggtgcgaaggatgaaaaattaaaattaaatttaaatgaaagttagtgatgtttgaaagtgggaaagtttttag

SEQ ID NO: 31670 - DNA, 780 bp, Artificial Sequence
  chemically treated genomic DNA (Homo sapiens) CpG-island No: 31670
ctaaaaactttcccactttcaaacatcactaactttcatttaaatttaattttaatttttcatccttcgcacctacgccttcttccgcctccctccgaaaccctaaaaaaaaaataacgccccgaatctaccaacccgcaaatacaaacgaaaaccctaaaaaaaacgaccgttccttccgacgtccctcgaaaccgctacctccaaaataaacttcgtccaaaacgcacaataaataccctacgacccgaaacctctccaacttcgcgaaaaaaaaccgcgcgtcccacgccccgccgcccctccgcgcgccccacgtccctccatactcccctccatacgcccctctactcgaccccaaaccccgctacccctccgtacgccccatatccctccatactcctctccgtacgcccctatactcgccccacgcccaaatacccctccgtacgcccctatactcgctccaaaccccgccgtccctccgtacgcccccacgtctctccatactccccacgtccctccatactcccctccgtacgcccctctacttaccccacgccccactcccctccgcgcgctaacgcgtaactccacgctaaaaacttcgaaactacaactatcgccgcccacgcctatcaatctccgcccgcgacccgaccccgaaaccgtcgcccaatcccccgccgccgctccccgaccccgcgctcacccctcacccgaacaccctcccacctacaaccgaaccgatacctctactcttccccttcgcgaccacgc

SEQ ID NO: 31671 - DNA, 780 bp, Artificial Sequence
  chemically treated genomic DNA (Homo sapiens) CpG-island No: 31671
ttgggggtttttttatttttaaatattattgatttttatttggatttggttttggttttttatttttcgtatttgcgttttttttcgttttttttcggggttttgggagagaagtgacgtttcggatttgttagttcgtaggtgtaggcggggattttgaggaaagcggtcgtttttttcggcgtttttcggagtcgttgtttttagggtaggtttcgtttagggcgtatagtgggtgttttgcgattcgaggtttttttaatttcgcgaggaagaatcgcgcgttttacgtttcgtcgttttttcgcgcgttttacgtttttttatgtttttttttatgcgtttttttgttcgattttaggtttcgttgttttttcgtacgttttatgtttttttatgttttttttcgtgcgtttttgtgttcgttttacgtttagatgttttttcgtgcgtttttatgttcgttttaggtttcgtcgttttttcgtgcgtttttacgtttttttatgttttttacgtttttttatgttttttttcgtgcgtttttttgtttgttttacgttttattttttttcgcgcgttggcgcgtgattttacgttgggagtttcggagttgtagttgtcgtcgtttacgtttgttagttttcgttcgcggttcggtttcggggtcgtcgtttagtttttcgtcgtcgtttttcgatttcgcgtttattttttattcggatatttttttatttgtagtcgagtcggtgtttttgtttttttttttcgcgattacgt

SEQ ID NO: 31672 - DNA, 780 bp, Artificial Sequence
  chemically treated genomic DNA (Homo sapiens) CpG-island No: 31672
acgtaatcgcgaaaaaaaaaaacaaaaacaccgactcgactacaaataaaaaaatatccgaataaaaaataaacgcgaaatcgaaaaacgacgacgaaaaactaaacgacgaccccgaaaccgaaccgcgaacgaaaactaacaaacgtaaacgacgacaactacaactccgaaactcccaacgtaaaatcacgcgccaacgcgcgaaaaaaaataaaacgtaaaacaaacaaaaaaacgcacgaaaaaaaacataaaaaaacgtaaaaaacataaaaaaacgtaaaaacgcacgaaaaaacgacgaaacctaaaacgaacataaaaacgcacgaaaaaacatctaaacgtaaaacgaacacaaaaacgcacgaaaaaaaacataaaaaaacataaaacgtacgaaaaaacaacgaaacctaaaatcgaacaaaaaaacgcataaaaaaaaacataaaaaaacgtaaaacgcgcgaaaaaacgacgaaacgtaaaacgcgcgattcttcctcgcgaaattaaaaaaacctcgaatcgcaaaacacccactatacgccctaaacgaaacctaccctaaaaacaacgactccgaaaaacgccgaaaaaaacgaccgctttcctcaaaatccccgcctacacctacgaactaacaaatccgaaacgtcacttctctcccaaaaccccgaaaaaaaacgaaaaaaaacgcaaatacgaaaaataaaaaaccaaaaccaaatccaaataaaaatcaataatatttaaaaataaaaaaacccccaa

SEQ ID NO: 31673 - DNA, 1525 bp, Artificial Sequence
  chemically treated genomic DNA (Homo sapiens) CpG-island No: 31673
tttcgttttcgattcgggagcgtttttattttaggtttttcgcgtttttcgcgggtcgttatttcgaggttttttaggcggtttttgagggtttgtagcgagcggttgagttgttttacgacgtggtcggggtttcgcggtaggtcgtttatagtgtttttgttcgtggttttcgcgtcgcgcgttttgtcgttcgttagtttttcgtagcgcgttagtttgttcgtgagttcgcggatggtttcgcgttgcgcgtttagcgtttttttttgttgtacgacggtttcgcgtagttgtagtatcgcggtttttagttttttttcgggattttgcgcgtcgttttgtatgggtatcgcgggtagcgggtagtcggcgtgtatcgtttttgggggtagtgtcgtgtatacgaagcggttatcgggcgtcgggttgttttgggttttagcggttacggcgagcgttacgttggcggttagtagcgttagtatttcgtcgtcgttgtcgcgtttagttcggtatgggcgagcgggcgtcgtcggggcgtttcgcgggaggcgttttcgttgttggtagtagtcgcgttgtcgtttcgagggtcgcgtgtatcgcggggtagaagttttttgtcgttttatagtcgtatttatcgcgttgttcggtattttggtttgtcgggttcgcgcgtttttttttaagttgaggggcggagggggtcggcgtgtggggcgcgcgttacgagttttgattggttcggtcgggtgcgcgttacgtagtgggcggagcggggcggggcgggggcgtttttcgttgcgcgtttggcggtcgggcgggagcgtgggtcggagtttgaggcgagagcgcgaggtttcgggttttgttttaggaaaggaggtttgaggtggaaaacgatattggggttttcgagagtttcggttggtcgtgtttaggcgtttttcgaatttattcgaggacgcgggcgttataggttgaggagaaagtgggaatttttcggtgtttcggtgttttttttttagggtggtttttggcgcggtacggggtttcgttgcgcgtttgtcgtcgtttttagggaggcgttttttttagtaggagtagttttttaggcgggattcgaatttcgattgttatcgcgagttattttcgcggtaggcgtgggttttttcgttaaggttcggttattttattttcgaggcgggaaggagtcgtacgacggtcgttttcggatgtaacggttttcgggacgcgttttatggtttcgtttttatttttcgcgttaattcggaaaacgttcgggaagaatttcgggggtttcggggatcgggattaggattaggcgtcggacgttgatgggaaggaggggatattcggagttagggataaagttacgaggttattcgtagagttttcgcgcgcgtgtttatcgattgttttttgggcggtgattttatttagtaagatttgagtttaggggcggggtgatatttaattggagttattatgatggagt

SEQ ID NO: 31674 - DNA, 1525 bp, Artificial Sequence
  chemically treated genomic DNA (Homo sapiens) CpG-island No: 31674
actccatcataataactccaattaaatatcaccccgcccctaaactcaaatcttactaaataaaatcaccgcccaaaaaacaatcgataaacacgcgcgcgaaaactctacgaataacctcgtaactttatccctaactccgaatatcccctccttcccatcaacgtccgacgcctaatcctaatcccgatccccgaaacccccgaaattcttcccgaacgttttccgaattaacgcgaaaaataaaaacgaaaccataaaacgcgtcccgaaaaccgttacatccgaaaacgaccgtcgtacgactccttcccgcctcgaaaataaaataaccgaaccttaacgaaaaaacccacgcctaccgcgaaaataactcgcgataacaatcgaaattcgaatcccgcctaaaaaactactcctactaaaaaaaacgcctccctaaaaacgacgacaaacgcgcaacgaaaccccgtaccgcgccaaaaaccaccctaaaaaaaaaacaccgaaacaccgaaaaattcccactttctcctcaacctataacgcccgcgtcctcgaataaattcgaaaaacgcctaaacacgaccaaccgaaactctcgaaaaccccaatatcgttttccacctcaaacctcctttcctaaaacaaaacccgaaacctcgcgctctcgcctcaaactccgacccacgctcccgcccgaccgccaaacgcgcaacgaaaaacgcccccgccccgccccgctccgcccactacgtaacgcgcacccgaccgaaccaatcaaaactcgtaacgcgcgccccacacgccgaccccctccgcccctcaacttaaaaaaaaacgcgcgaacccgacaaaccaaaataccgaacaacgcgataaatacgactataaaacgacaaaaaacttctaccccgcgatacacgcgaccctcgaaacgacaacgcgactactaccaacaacgaaaacgcctcccgcgaaacgccccgacgacgcccgctcgcccataccgaactaaacgcgacaacgacgacgaaatactaacgctactaaccgccaacgtaacgctcgccgtaaccgctaaaacccaaaacaacccgacgcccgataaccgcttcgtatacacgacactacccccaaaaacgatacacgccgactacccgctacccgcgatacccatacaaaacgacgcgcaaaatcccgaaaaaaaactaaaaaccgcgatactacaactacgcgaaaccgtcgtacaacaaaaaaaaacgctaaacgcgcaacgcgaaaccatccgcgaactcacgaacaaactaacgcgctacgaaaaactaacgaacgacaaaacgcgcgacgcgaaaaccacgaacaaaaacactataaacgacctaccgcgaaaccccgaccacgtcgtaaaacaactcaaccgctcgctacaaaccctcaaaaaccgcctaaaaaacctcgaaataacgacccgcgaaaaacgcgaaaaacctaaaataaaaacgctcccgaatcgaaaacgaaa

SEQ ID NO: 31675 - DNA, 1525 bp, Artificial Sequence
  chemically treated genomic DNA (Homo sapiens) CpG-island No: 31675
gttttattatgatgattttagttagatgttatttcgtttttgagtttaggttttgttgaataaggttatcgtttagggggtagtcgatgaatacgcgcgcgagggttttgcgagtggtttcgtgattttgtttttaatttcgggtgtttttttttttttattagcgttcggcgtttggttttggtttcggttttcgaggttttcgggatttttttcgagcgtttttcgagttggcgcggggggtggaggcggggttatggagcgcgtttcggggatcgttgtattcggaggcggtcgtcgtgcggttttttttcgtttcgagagtgaggtggtcgggttttgacgagaaggtttacgtttgtcgcgggggtggttcgcgatggtagtcggggttcgagtttcgtttggggggttgtttttgttggagaaaacgtttttttgagggcggcggtaaacgcgtagcgaggtttcgtgtcgcgttagaagttattttgagaaaggggtatcgggatatcgaggggtttttattttttttttagtttgtgacgttcgcgttttcgggtgggttcgaggggcgtttgggtacggttagtcgaggttttcgagagttttagtgtcgttttttattttaggtttttttttttgaggtagagttcgggatttcgcgttttcgttttaggtttcggtttacgttttcgttcggtcgttaggcgcgtaacggaaagcgttttcgtttcgtttcgtttcgtttattgcgtgacgcgtattcggtcgagttaattagagttcgtggcgcgcgttttatacgtcggtttttttcgttttttagtttaagaaagggcgcgcggattcggtaggttagagtgtcgagtagcgcggtgggtgcggttgtgagacggtaggagatttttgtttcgcggtgtacgcgattttcgagacgatagcgcggttattgttagtagcgaaggcgtttttcgcggagcgtttcgacggcgttcgttcgtttatgtcgagttgagcgcggtagcggcggcgggatgttggcgttgttggtcgttagcgtggcgttcgtcgtggtcgttggggtttaggatagttcggcgttcggtagtcgtttcgtgtgtacggtattgtttttagaggcggtgtacgtcggttgttcgttgttcgcgatgtttatgtagggcggcgcgtagagtttcgaggaggagttgagggtcgcggtgttgtagttgcgcgagatcgtcgtgtagtagaaggagacgttgggcgcgtagcgcgaggttattcgcgagtttacgggtaagttagcgcgttgcgaggggttggcgggcggtaaggcgcgcggcgcgggggttacgggtaaggatattatgggcgatttgtcgcgggatttcggttacgtcgtggagtagtttagtcgttcgttgtagatttttaaggatcgtttggagagtttcgaggtagcggttcgcggggagcgcgggggatttggaatggggacgttttcgagtcgggggcggaa

SEQ ID NO: 31676 - DNA, 1525 bp, Artificial Sequence
  chemically treated genomic DNA (Homo sapiens) CpG-island No: 31676
ttccgcccccgactcgaaaacgtccccattccaaatcccccgcgctccccgcgaaccgctacctcgaaactctccaaacgatccttaaaaatctacaacgaacgactaaactactccacgacgtaaccgaaatcccgcgacaaatcgcccataatatccttacccgtaacccccgcgccgcgcgccttaccgcccgccaacccctcgcaacgcgctaacttacccgtaaactcgcgaataacctcgcgctacgcgcccaacgtctccttctactacacgacgatctcgcgcaactacaacaccgcgaccctcaactcctcctcgaaactctacgcgccgccctacataaacatcgcgaacaacgaacaaccgacgtacaccgcctctaaaaacaataccgtacacacgaaacgactaccgaacgccgaactatcctaaaccccaacgaccacgacgaacgccacgctaacgaccaacaacgccaacatcccgccgccgctaccgcgctcaactcgacataaacgaacgaacgccgtcgaaacgctccgcgaaaaacgccttcgctactaacaataaccgcgctatcgtctcgaaaatcgcgtacaccgcgaaacaaaaatctcctaccgtctcacaaccgcacccaccgcgctactcgacactctaacctaccgaatccgcgcgccctttcttaaactaaaaaacgaaaaaaaccgacgtataaaacgcgcgccacgaactctaattaactcgaccgaatacgcgtcacgcaataaacgaaacgaaacgaaacgaaaacgctttccgttacgcgcctaacgaccgaacgaaaacgtaaaccgaaacctaaaacgaaaacgcgaaatcccgaactctacctcaaaaaaaaaaacctaaaataaaaaacgacactaaaactctcgaaaacctcgactaaccgtacccaaacgcccctcgaacccacccgaaaacgcgaacgtcacaaactaaaaaaaaaataaaaacccctcgatatcccgatacccctttctcaaaataacttctaacgcgacacgaaacctcgctacgcgtttaccgccgccctcaaaaaaacgttttctccaacaaaaacaaccccccaaacgaaactcgaaccccgactaccatcgcgaaccacccccgcgacaaacgtaaaccttctcgtcaaaacccgaccacctcactctcgaaacgaaaaaaaaccgcacgacgaccgcctccgaatacaacgatccccgaaacgcgctccataaccccgcctccaccccccgcgccaactcgaaaaacgctcgaaaaaaatcccgaaaacctcgaaaaccgaaaccaaaaccaaacgccgaacgctaataaaaaaaaaaaaacacccgaaattaaaaacaaaatcacgaaaccactcgcaaaaccctcgcgcgcgtattcatcgactaccccctaaacgataaccttattcaacaaaacctaaactcaaaaacgaaataacatctaactaaaatcatcataataaaac

SEQ ID NO: 31677 - DNA, 979 bp, Artificial Sequence
  chemically treated genomic DNA (Homo sapiens) CpG-island No: 31677
tcgcggagtcggcgttagagcgcggaattatcgcgagaattttggtttttgtagtcgcgatttttcgtcggttttttttttttttttcgtttttttttttgttttttttttttcggggcgtgtggaattcggttttgtcggcgtagggtaatgcgtagagcggggtcggcgttgttcgaggcgagtaggtagcgttgtaaggggaaggatttagaagcgcggcgggagtagcgattgcgttttagtcgttgagcggtttgtaggtttatagttcgcgaaggtattttcgggggcgtgtggttttgaggtggtcggggaggtcgtaggcggcggtcggagcgtagaggagcggttttagtcgggcggaggggtgtgagttcggttcgtggcggttacgtttttcgggagatgttgtgacggattcgtacgggaggagttcgcgtttggtttggcgattcggtggattcggttcgcggcggcgcgtttattcgtttcgtttaggtagggggaagggagggagggggttgggttcgcgcggcggagggcgggtcgcgcggtttggattcgcggcggcggcggcggcggcggcggcggggtttttgtttcgcgagcgtcgggtttaggtcgggcgtgcgcggggttaacggatggggttcgagggggcgagcggtggcggtggcgggtacggtaggttcgcgggcgtcgggtttcgttatataatttcggatcggaggagcggcggtatatggcggcggagcggcgttggtggttcgcgttttgcgtcggtagtcgggtttttttacggacggtcggggtcgcgatttttttttattgtttttttacgcgatggattcgttggcgggttttttttcgagggaagcggtcggcgtgttgagtttgttttgtgttggcgtgtgttttatatgcgtttgggtttggttatagtgagtagttttggcggggaagaagttggattcgg

SEQ ID NO: 31678 - DNA, 979 bp, Artificial Sequence
  chemically treated genomic DNA (Homo sapiens) CpG-island No: 31678
ccgaatccaacttcttccccgccaaaactactcactataaccaaacccaaacgcatataaaacacacgccaacacaaaacaaactcaacacgccgaccgcttccctcgaaaaaaaacccgccaacgaatccatcgcgtaaaaaaacaataaaaaaaaatcgcgaccccgaccgtccgtaaaaaaacccgactaccgacgcaaaacgcgaaccaccaacgccgctccgccgccatataccgccgctcctccgatccgaaattatataacgaaacccgacgcccgcgaacctaccgtacccgccaccgccaccgctcgccccctcgaaccccatccgttaaccccgcgcacgcccgacctaaacccgacgctcgcgaaacaaaaaccccgccgccgccgccgccgccgccgccgcgaatccaaaccgcgcgacccgccctccgccgcgcgaacccaaccccctccctcccttccccctacctaaacgaaacgaataaacgcgccgccgcgaaccgaatccaccgaatcgccaaaccaaacgcgaactcctcccgtacgaatccgtcacaacatctcccgaaaaacgtaaccgccacgaaccgaactcacacccctccgcccgactaaaaccgctcctctacgctccgaccgccgcctacgacctccccgaccacctcaaaaccacacgcccccgaaaataccttcgcgaactataaacctacaaaccgctcaacgactaaaacgcaatcgctactcccgccgcgcttctaaatccttccccttacaacgctacctactcgcctcgaacaacgccgaccccgctctacgcattaccctacgccgacaaaaccgaattccacacgccccgaaaaaaaaaaaacaaaaaaaaaaacgaaaaaaaaaaaaaaaaccgacgaaaaatcgcgactacaaaaaccaaaattctcgcgataattccgcgctctaacgccgactccgcga

SEQ ID NO: 31679 - DNA, 979 bp, Artificial Sequence
  chemically treated genomic DNA (Homo sapiens) CpG-island No: 31679
tcgagtttaatttttttttcgttaggattatttattgtggttaggtttaagcgtatgtggaatatacgttaatataggataggtttagtacgtcggtcgtttttttcggggaaaggttcgttaacgagtttatcgcgtgggagaatagtgggaaagggtcgcggtttcggtcgttcgtaaagggattcgattgtcggcgtaggacgcgaattattagcgtcgtttcgtcgttatgtgtcgtcgttttttcggttcgagattatgtaacgaagttcggcgttcgcgagtttgtcgtattcgttatcgttatcgttcgttttttcgagttttattcgttggtttcgcgtacgttcggtttaggttcggcgttcgcggggtagaagtttcgtcgtcgtcgtcgtcgtcgtcgtcgcgggtttaggtcgcgcgattcgtttttcgtcgcgcgggtttaatttttttttttttttttttttatttgaacggggcgggtgagcgcgtcgtcgcgggtcgagtttatcgggtcgttaggttaagcgcgagtttttttcgtgcgggttcgttatagtatttttcgggagacgtggtcgttacgggtcgggtttatattttttcgttcggttgaagtcgtttttttgcgtttcggtcgtcgtttgcgattttttcggttattttagagttatacgttttcgagagtgttttcgcgggttgtaggtttgtagatcgtttagcggttaaaacgtagtcgttgttttcgtcgcgtttttgggtttttttttttgtaacgttgtttgttcgtttcggatagcgtcggtttcgttttgcgtattattttgcgtcgataaaatcgagttttatacgtttcggaagggagggagtagaggaaagggcggagagggaggggagaatcggcgggagatcgcggttgtagggattagagttttcgcgatggtttcgcgttttagcgtcggtttcgcgg

SEQ ID NO: 31680 - DNA, 979 bp, Artificial Sequence
  chemically treated genomic DNA (Homo sapiens) CpG-island No: 31680
ccgcgaaaccgacgctaaaacgcgaaaccatcgcgaaaactctaatccctacaaccgcgatctcccgccgattctcccctccctctccgccctttcctctactccctcccttccgaaacgtataaaactcgattttatcgacgcaaaataatacgcaaaacgaaaccgacgctatccgaaacgaacaaacaacgttacaaaaaaaaaaacccaaaaacgcgacgaaaacaacgactacgttttaaccgctaaacgatctacaaacctacaacccgcgaaaacactctcgaaaacgtataactctaaaataaccgaaaaaatcgcaaacgacgaccgaaacgcaaaaaaacgacttcaaccgaacgaaaaaatataaacccgacccgtaacgaccacgtctcccgaaaaatactataacgaacccgcacgaaaaaaactcgcgcttaacctaacgacccgataaactcgacccgcgacgacgcgctcacccgccccgttcaaataaaaaaaaaaaaaaaaaaaaattaaacccgcgcgacgaaaaacgaatcgcgcgacctaaacccgcgacgacgacgacgacgacgacgacgaaacttctaccccgcgaacgccgaacctaaaccgaacgtacgcgaaaccaacgaataaaactcgaaaaaacgaacgataacgataacgaatacgacaaactcgcgaacgccgaacttcgttacataatctcgaaccgaaaaaacgacgacacataacgacgaaacgacgctaataattcgcgtcctacgccgacaatcgaatccctttacgaacgaccgaaaccgcgaccctttcccactattctcccacgcgataaactcgttaacgaacctttccccgaaaaaaacgaccgacgtactaaacctatcctatattaacgtatattccacatacgcttaaacctaaccacaataaataatcctaacgaaaaaaaaattaaactcga

SEQ ID NO: 31681 - DNA, 1099 bp, Artificial Sequence
  chemically treated genomic DNA (Homo sapiens) CpG-island No: 31681
tagtcgaaaggattaagttcgcgcgattttcgaaggcgttgacgtacgtagggcggtcgggcgggggttttataggtttttagcgtcgttttttgtcggggagggaagttcgcggttttgcggatcgcgtcgtcgcggtcgagggtttgcgttaggtttagggtagggcgagggtgtgtcgtttttcgtgcggttaggttcggggttcgggggtggtttcgcggcgaagtttcgttttcggtatcgttttttaggcgcgcgagtcgatttcgcgcgcgttaattttttttcgggttatcgttttttttttttttcgggtcgcgagttttttgcgcgtcgttttggggttgcgtttattcgtgtgcgcgttcgttcgttcgttagtttttttaacgcgcgtttggtcgttcgacgacgcgggagtcgtacgcgtcggacgaggttcgttgcgttttttgttgtttagcgcgggttcgttgaggcggagtttttagttttcggttaggatacggtttgggtcgtcgaattttcggtcgaagagcggcggcggtagcggcggtgaggagatcgggtcggggaaaggtagatatggcggggttgtgggtatcgggggagggtggtttcgtcgtttttgcggttacgtcgaaggttcgttggcgggcggcgtatcggggataggggaggggtaggggatggaattaggttgtatgggtttcggttcggcgttagagcggggttgcgggtcgcgagggcggttcgcgaggtttttcgcgggattttcggcgggcgtttgaggaaaaagacgtcgttttagggtttttgttacgttttttatagcgcgttatatttcgttttcgggtgggcgataatttcgcggttttttattttttgtttatttttttcgcgtcggtgttttttttggagtttcgtttgtttgttggagagtcgcgttttcgggaagtcgggttttcgaatttagggtcgttcgtcggggatagcggattcgcggggtaggcgtattttggcgaggatgttgtcggggaggttgggtattgggcgttagggtttttttttttgaatttggggaaaatcgggattg

SEQ ID NO: 31682 - DNA, 1099 bp, Artificial Sequence
  chemically treated genomic DNA (Homo sapiens) CpG-island No: 31682
caatcccgattttccccaaattcaaaaaaaaaaaccctaacgcccaatacccaacctccccgacaacatcctcgccaaaatacgcctaccccgcgaatccgctatccccgacgaacgaccctaaattcgaaaacccgacttcccgaaaacgcgactctccaacaaacaaacgaaactccaaaaaaaacaccgacgcgaaaaaaataaacaaaaaataaaaaaccgcgaaattatcgcccacccgaaaacgaaatataacgcgctataaaaaacgtaacaaaaaccctaaaacgacgtctttttcctcaaacgcccgccgaaaatcccgcgaaaaacctcgcgaaccgccctcgcgacccgcaaccccgctctaacgccgaaccgaaacccatacaacctaattccatcccctacccctcccctatccccgatacgccgcccgccaacgaaccttcgacgtaaccgcaaaaacgacgaaaccaccctcccccgatacccacaaccccgccatatctacctttccccgacccgatctcctcaccgccgctaccgccgccgctcttcgaccgaaaattcgacgacccaaaccgtatcctaaccgaaaactaaaaactccgcctcaacgaacccgcgctaaacaacaaaaaacgcaacgaacctcgtccgacgcgtacgactcccgcgtcgtcgaacgaccaaacgcgcgttaaaaaaactaacgaacgaacgaacgcgcacacgaataaacgcaaccccaaaacgacgcgcaaaaaactcgcgacccgaaaaaaaaaaaaaacgataacccgaaaaaaaattaacgcgcgcgaaatcgactcgcgcgcctaaaaaacgataccgaaaacgaaacttcgccgcgaaaccacccccgaaccccgaacctaaccgcacgaaaaacgacacaccctcgccctaccctaaacctaacgcaaaccctcgaccgcgacgacgcgatccgcaaaaccgcgaacttccctccccgacaaaaaacgacgctaaaaacctataaaacccccgcccgaccgccctacgtacgtcaacgccttcgaaaatcgcgcgaacttaatcctttcgacta

SEQ ID NO: 31683 - DNA, 1099 bp, Artificial Sequence
  chemically treated genomic DNA (Homo sapiens) CpG-island No: 31683
taatttcggttttttttaagtttaaggggaagggttttggcgtttaatgtttagttttttcgataatattttcgttagggtgcgtttgtttcgcgggttcgttgttttcggcgggcggttttgggttcgaggattcggtttttcggaggcgcgattttttagtaaataagcggagttttagaaaaaatatcgacgcgaagggggtggatagagggtgggaagtcgcggggttgtcgtttattcggaggcggaatgtaacgcgttgtgggaaacgtggtaggagttttgaggcggcgtttttttttttaggcgttcgtcgagggtttcgcggaaagtttcgcgggtcgttttcgcggttcgtagtttcgttttggcgtcgagtcggagtttatgtaatttggttttattttttgttttttttttgttttcggtgcgtcgttcgttagcgagttttcgacgtggtcgtaggggcgacgggattattttttttcgatatttatagtttcgttatgtttgttttttttcggttcggtttttttatcgtcgttgtcgtcgtcgtttttcggtcggagattcggcggtttagatcgtgttttggtcgggaattgagggtttcgttttaacgggttcgcgttgggtaatagggagcgtagcgagtttcgttcggcgcgtgcggttttcgcgtcgtcgggcggttaagcgcgcgttgagaggattggcgggcggacgagcgcgtatacgagtgagcgtagttttaaagcggcgcgtagggggttcgcggttcggaagaggggaggggcgatgattcgggaaagggttggcgcgcgcgggatcggttcgcgcgtttgaggggcggtgtcgggggcggggtttcgtcgcgaggttattttcgagtttcgggtttagtcgtacgggaggcgatatattttcgttttattttgagtttggcgtagattttcgatcgcgacggcgcggttcgtagaatcgcgggttttttttttcggtaaaaagcggcgttgaaggtttgtgggattttcgttcggtcgttttacgtgcgttagcgttttcgggggtcgcgcgggtttggttttttcggttg

SEQ ID NO: 31684 - DNA, 1099 bp, Artificial Sequence
  chemically treated genomic DNA (Homo sapiens) CpG-island No: 31684
caaccgaaaaaaccaaacccgcgcgacccccgaaaacgctaacgcacgtaaaacgaccgaacgaaaatcccacaaaccttcaacgccgctttttaccgaaaaaaaaaacccgcgattctacgaaccgcgccgtcgcgatcgaaaatctacgccaaactcaaaataaaacgaaaatatatcgcctcccgtacgactaaacccgaaactcgaaaataacctcgcgacgaaaccccgcccccgacaccgcccctcaaacgcgcgaaccgatcccgcgcgcgccaaccctttcccgaatcatcgcccctcccctcttccgaaccgcgaaccccctacgcgccgctttaaaactacgctcactcgtatacgcgctcgtccgcccgccaatcctctcaacgcgcgcttaaccgcccgacgacgcgaaaaccgcacgcgccgaacgaaactcgctacgctccctattacccaacgcgaacccgttaaaacgaaaccctcaattcccgaccaaaacacgatctaaaccgccgaatctccgaccgaaaaacgacgacgacaacgacgataaaaaaaccgaaccgaaaaaaaacaaacataacgaaactataaatatcgaaaaaaaataatcccgtcgcccctacgaccacgtcgaaaactcgctaacgaacgacgcaccgaaaacaaaaaaaaaacaaaaaataaaaccaaattacataaactccgactcgacgccaaaacgaaactacgaaccgcgaaaacgacccgcgaaactttccgcgaaaccctcgacgaacgcctaaaaaaaaaaacgccgcctcaaaactcctaccacgtttcccacaacgcgttacattccgcctccgaataaacgacaaccccgcgacttcccaccctctatccacccccttcgcgtcgatattttttctaaaactccgcttatttactaaaaaatcgcgcctccgaaaaaccgaatcctcgaacccaaaaccgcccgccgaaaacaacgaacccgcgaaacaaacgcaccctaacgaaaatattatcgaaaaaactaaacattaaacgccaaaacccttccccttaaacttaaaaaaaaccgaaatta

SEQ ID NO: 31685 - DNA, 599 bp, Artificial Sequence
  chemically treated genomic DNA (Homo sapiens) CpG-island No: 31685
cgttgcgcgcggttatttaggaataatggggcgtgggggagggggcgggcgcgatttgggggcgttgttgtaggggcggcggggcgggtagaattgtataggggcgtttttgttgggtcgggcgtttttggagtcgtttcgtagggagtcgcgtagggcgcgcggagtgttcggggacggagttttcggcggggggtggaggcggaggggttcgggcgcggcgtgtcgggtgcgtttcgtagtttttttatagtattttttgtttcggtgcgggtttgtttttttttgttttcgtcgttttttttgttagttttcgtgtcggttttttttagcgttattcgattttaaaaattttgggcggcgagtttttaggtgtcgagtcgtttaggcggggaggttgaattgtaaacgttattatttaatggatatggagttgttcggtgtttcggatcggttaggttatttttaggaaagaggcgttgagcgaacgttagtttggacggtgttagttttttggaagtagttcgtttaggtaggagttgttaattagacgcgtattgtgaaggagatcgtggaaaattaaaagtgggtttttgtaa

SEQ ID NO: 31686 - DNA, 599 bp, Artificial Sequence
  chemically treated genomic DNA (Homo sapiens) CpG-island No: 31686
ttacaaaaacccacttttaattttccacgatctccttcacaatacgcgtctaattaacaactcctacctaaacgaactacttccaaaaaactaacaccgtccaaactaacgttcgctcaacgcctctttcctaaaaataacctaaccgatccgaaacaccgaacaactccatatccattaaataataacgtttacaattcaacctccccgcctaaacgactcgacacctaaaaactcgccgcccaaaatttttaaaatcgaataacgctaaaaaaaaccgacacgaaaactaacaaaaaaaacgacgaaaacaaaaaaaaacaaacccgcaccgaaacaaaaaatactataaaaaaactacgaaacgcacccgacacgccgcgcccgaacccctccgcctccaccccccgccgaaaactccgtccccgaacactccgcgcgccctacgcgactccctacgaaacgactccaaaaacgcccgacccaacaaaaacgcccctatacaattctacccgccccgccgcccctacaacaacgcccccaaatcgcgcccgccccctcccccacgccccattattcctaaataaccgcgcgcaacg

SEQ ID NO: 31687 - DNA, 599 bp, Artificial Sequence
  chemically treated genomic DNA (Homo sapiens) CpG-island No: 31687
ttgtaggaatttatttttgattttttacggttttttttataatgcgcgtttggttagtagtttttgtttgggcgagttgtttttaggagattaatatcgtttaggttggcgttcgtttagcgttttttttttagaggtagtttggtcgattcgaggtatcgggtagttttatgtttattgaataatggcgtttgtaatttagttttttcgtttgggcgattcgatatttgaaaattcgtcgtttaaggtttttgaaatcgggtaacgttggagagaatcgatacgaaggttgataagggagacggcgagagtaaagaaaggtaagttcgtatcggggtagagaatgttatgggagagttgcgaggcgtattcgatacgtcgcgttcgagttttttcgtttttatttttcgtcgagggtttcgttttcgggtatttcgcgcgttttgcgcggttttttacgggacggttttaggagcgttcggtttagtaaaagcgtttttgtgtaattttgttcgtttcgtcgtttttgtagtagcgtttttaaatcgcgttcgtttttttttttacgttttattgtttttgggtggtcgcgcgtagcg

SEQ ID NO: 31688 - DNA, 599 bp, Artificial Sequence
  chemically treated genomic DNA (Homo sapiens) CpG-island No: 31688
cgctacgcgcgaccacccaaaaacaataaaacgtaaaaaaaaaaacgaacgcgatttaaaaacgctactacaaaaacgacgaaacgaacaaaattacacaaaaacgcttttactaaaccgaacgctcctaaaaccgtcccgtaaaaaaccgcgcaaaacgcgcgaaatacccgaaaacgaaaccctcgacgaaaaataaaaacgaaaaaactcgaacgcgacgtatcgaatacgcctcgcaactctcccataacattctctaccccgatacgaacttacctttctttactctcgccgtctcccttatcaaccttcgtatcgattctctccaacgttacccgatttcaaaaaccttaaacgacgaattttcaaatatcgaatcgcccaaacgaaaaaactaaattacaaacgccattattcaataaacataaaactacccgatacctcgaatcgaccaaactacctctaaaaaaaaaacgctaaacgaacgccaacctaaacgatattaatctcctaaaaacaactcgcccaaacaaaaactactaaccaaacgcgcattataaaaaaaaccgtaaaaaatcaaaaataaattcctacaa

SEQ ID NO: 31689 - DNA, 996 bp, Artificial Sequence
  chemically treated genomic DNA (Homo sapiens) CpG-island No: 31689
tcgttcgggaaaggattaataattgtcgataattcggagggcgaaaacgttcgcggcgtaggggaagtaaattaggagatgcgcgggtttagcgttagcggcgggaggagggagcgcggtcgtcgtaggcgggagcgaaggcggggacggagggcgggttcgttttattcgatttcggattggtcgagtttagagagtcgagtgacgttagcgggggagaacgtttgatttgtgtggtgggcgcgggcggtggggggaagcgtagtgcgtaggcgtaattgtttggttttgttcgtttcggcgtttcggtttagttttcgcggataagtttagatatcgcgcgttttttttttttcgggttcgtttttttttttttttcggcgtcgtcgaagataaataatagttggtcggcgagcgtttagtgtgtttttcgtcgtcggattcggcgggttgcgtgggatcggcgggatttcggttagtcggttatggcggggttgtattcgttgggagtgagcgtttttttcgattagggcgggaggaagtatatggaggacgttatttaaatcgttgtggagttcgaatcgacggttgaagaaaagttttcgtcgcggcggtcgttgttttagtcgttgttttcgcggtcgtcgtcggtcgtttttttcggcggcgaagtttcggggaaaggtttagcggtggtagttcgagaggttcgcgattttttttcggacgtcggggtttcgtcggtatttagtcgttgttgtcgtcgtcgttttttcgtggtttttttcgtcgtgtgcgacgggtacggcgggcgggaggcggtatagtttgttcgggagtatttgtggggttttattaagaagtagaagggttttatttcgttcgagtcggttaaggtttgcgttgttattcgtaaaggttttttcgtttgttattttgttatgtggaagaaattgggtaagttttttggtttgtttggcgttcgtttttttttta

SEQ ID NO: 31690 - DNA, 996 bp, Artificial Sequence
  chemically treated genomic DNA (Homo sapiens) CpG-island No: 31690
taaaaaaaaaacgaacgccaaacaaaccaaaaaacttacccaatttcttccacataacaaaataacaaacgaaaaaacctttacgaataacaacgcaaaccttaaccgactcgaacgaaataaaacccttctacttcttaataaaaccccacaaatactcccgaacaaactataccgcctcccgcccgccgtacccgtcgcacacgacgaaaaaaaccacgaaaaaacgacgacgacaacaacgactaaataccgacgaaaccccgacgtccgaaaaaaaatcgcgaacctctcgaactaccaccgctaaacctttccccgaaacttcgccgccgaaaaaaacgaccgacgacgaccgcgaaaacaacgactaaaacaacgaccgccgcgacgaaaacttttcttcaaccgtcgattcgaactccacaacgatttaaataacgtcctccatatacttcctcccgccctaatcgaaaaaaacgctcactcccaacgaatacaaccccgccataaccgactaaccgaaatcccgccgatcccacgcaacccgccgaatccgacgacgaaaaacacactaaacgctcgccgaccaactattatttatcttcgacgacgccgaaaaaaaaaaaaaaacgaacccgaaaaaaaaaaaacgcgcgatatctaaacttatccgcgaaaactaaaccgaaacgccgaaacgaacaaaaccaaacaattacgcctacgcactacgcttccccccaccgcccgcgcccaccacacaaatcaaacgttctcccccgctaacgtcactcgactctctaaactcgaccaatccgaaatcgaataaaacgaacccgccctccgtccccgccttcgctcccgcctacgacgaccgcgctccctcctcccgccgctaacgctaaacccgcgcatctcctaatttacttcccctacgccgcgaacgttttcgccctccgaattatcgacaattattaatcctttcccgaacga

SEQ ID NO: 31691 - DNA, 996 bp, Artificial Sequence
  chemically treated genomic DNA (Homo sapiens) CpG-island No: 31691
tgaaaaaggggcgggcgttaaataagttagggaatttatttagttttttttatatggtaaggtgataagcgagaaagtttttgcggatggtagcgtaaattttagtcggttcggacgaggtgaaatttttttgttttttgatgaaattttataagtgttttcgggtaaattgtgtcgtttttcgttcgtcgtgttcgtcgtatacggcgaaaaaggttacggaggaacggcggcggtagtagcggttaggtgtcggcgaggtttcggcgttcgggagagggtcgcgagtttttcgggttgttatcgttgggttttttttcgagatttcgtcgtcgggaagggcggtcggcgacggtcgcggaggtaacggttgagatagcgatcgtcgcggcgagggtttttttttagtcgtcggttcgggttttataacgatttgagtaacgttttttatgtattttttttcgttttggtcggagaagacgtttatttttagcgagtatagtttcgttatggtcggttggtcgggatttcgtcggttttacgtagttcgtcgaattcggcggcgggagatatattaggcgttcgtcggttaattattgtttattttcgacgacgtcgagaagggggagggggcggattcggagaagggggggcgcgcgatgtttggatttgttcgcgagagttgggtcggagcgtcggagcgagtagagttaggtagttgcgtttgcgtattgcgtttttttttatcgttcgcgtttattatataaattaggcgttttttttcgttgacgttattcggttttttaagttcgattaattcggagtcgagtggagcgagttcgtttttcgttttcgttttcgttttcgtttgcgacggtcgcgtttttttttttcgtcgttggcgttgggttcgcgtattttttagtttgttttttttacgtcgcgggcgttttcgtttttcgggttgtcggtagttgttgattttttttcgagcgg

SEQ ID NO: 31692 - DNA, 996 bp, Artificial Sequence
  chemically treated genomic DNA (Homo sapiens) CpG-island No: 31692
ccgctcgaaaaaaaatcaacaactaccgacaacccgaaaaacgaaaacgcccgcgacgtaaaaaaaacaaactaaaaaatacgcgaacccaacgccaacgacgaaaaaaaaaaacgcgaccgtcgcaaacgaaaacgaaaacgaaaacgaaaaacgaactcgctccactcgactccgaattaatcgaacttaaaaaaccgaataacgtcaacgaaaaaaaacgcctaatttatataataaacgcgaacgataaaaaaaaacgcaatacgcaaacgcaactacctaactctactcgctccgacgctccgacccaactctcgcgaacaaatccaaacatcgcgcgcccccccttctccgaatccgccccctcccccttctcgacgtcgtcgaaaataaacaataattaaccgacgaacgcctaatatatctcccgccgccgaattcgacgaactacgtaaaaccgacgaaatcccgaccaaccgaccataacgaaactatactcgctaaaaataaacgtcttctccgaccaaaacgaaaaaaaatacataaaaaacgttactcaaatcgttataaaacccgaaccgacgactaaaaaaaaaccctcgccgcgacgatcgctatctcaaccgttacctccgcgaccgtcgccgaccgcccttcccgacgacgaaatctcgaaaaaaaacccaacgataacaacccgaaaaactcgcgaccctctcccgaacgccgaaacctcgccgacacctaaccgctactaccgccgccgttcctccgtaacctttttcgccgtatacgacgaacacgacgaacgaaaaacgacacaatttacccgaaaacacttataaaatttcatcaaaaaacaaaaaaatttcacctcgtccgaaccgactaaaatttacgctaccatccgcaaaaactttctcgcttatcaccttaccatataaaaaaaactaaataaattccctaacttatttaacgcccgcccctttttca

SEQ ID NO: 31693 - DNA, 804 bp, Artificial Sequence
  chemically treated genomic DNA (Homo sapiens) CpG-island No: 31693
gtggtatcgatatgtagcggtttttcgggagaggtcggtagtagaagcgaaggaggagtcgagcgcgcggttggggattcgttcgcgttcgtttttagttttttcgtttcgtttttttgcggagcgcgtagtagttcgtgcgtcggcgtaggtttcgttttttcgttgggtttcgtttcgttgttattatagggttttgttttcgcgcgtttcgttttcgtttttttgtgtagtttgaggcggcggtagtatggagggggagagtacgtcggcggtgttttcgggttttgtgttcggcgtattcgttttttagtattttaatacggattcggatacggtgagtcgagggacggggcggggttcggcgtcgtttgggaagagttttgcgcgcggtttgttttttcgttgttgtttcggttttcgttcgttttttcgacgtcgtcgcgttttttttttgcggtcgcggttttgtttttttttttttttagcggtttttgaggtgtttcgtgtttacgaagttttttttagtattagttttttttttgttatttttcgttatttttttttttcgatttaagtgttttatacgtttttattttttttcggcgtttttgtagttgtggaaatttgggcgtgaaaagatggaaagtttacggagcgttttttcgttgttttgcggagtttgcggtaaatttttcgtttttcgcgacgttcgataggcgtttgtaaaattaggcggatttttttatgtagagtagcgtttgtgcgtgtttgttgcgatggtaggatggtaagggaataaaa

SEQ ID NO: 31694 - DNA, 804 bp, Artificial Sequence
  chemically treated genomic DNA (Homo sapiens) CpG-island No: 31694
ttttattcccttaccatcctaccatcgcaacaaacacgcacaaacgctactctacataaaaaaatccgcctaattttacaaacgcctatcgaacgtcgcgaaaaacgaaaaatttaccgcaaactccgcaaaacaacgaaaaaacgctccgtaaactttccatcttttcacgcccaaatttccacaactacaaaaacgccgaaaaaaaataaaaacgtataaaacacttaaatcgaaaaaaaaaaataacgaaaaataacaaaaaaaaaactaatactaaaaaaaacttcgtaaacacgaaacacctcaaaaaccgctaaaaaaaaaaaaaaacaaaaccgcgaccgcaaaaaaaaaacgcgacgacgtcgaaaaaacgaacgaaaaccgaaacaacaacgaaaaaacaaaccgcgcgcaaaactcttcccaaacgacgccgaaccccgccccgtccctcgactcaccgtatccgaatccgtattaaaatactaaaaaacgaatacgccgaacacaaaacccgaaaacaccgccgacgtactctccccctccatactaccgccgcctcaaactacacaaaaaaacgaaaacgaaacgcgcgaaaacaaaaccctataataacaacgaaacgaaacccaacgaaaaaacgaaacctacgccgacgcacgaactactacgcgctccgcaaaaaaacgaaacgaaaaaactaaaaacgaacgcgaacgaatccccaaccgcgcgctcgactcctccttcgcttctactaccgacctctcccgaaaaaccgctacatatcgataccac

SEQ ID NO: 31695 - DNA, 804 bp, Artificial Sequence
  chemically treated genomic DNA (Homo sapiens) CpG-island No: 31695
ttttatttttttattattttattatcgtaataaatacgtatagacgttgttttgtatgaaaaagttcgtttggttttgtaaacgtttgtcgggcgtcgcgagaaacggaaagtttatcgtaggtttcgtagagtagcggaaagacgtttcgtgaattttttatttttttacgtttaagtttttatagttataggggcgtcgaggaaagatgggagcgtgtgggatatttgggtcggaaaagggaaataacggaggatagtagagggagggttaatgttggagaagatttcgtgggtacgaggtattttagggatcgttgagggggagagaaggtagagtcgcgatcgtagggaggaggcgcggcggcgtcgggggagcgggcggggatcggagtaatagcggggaggtaggtcgcgcgtagggttttttttaggcgacgtcggatttcgtttcgtttttcggtttatcgtgttcgagttcgtgttgaggtgttggaaagcgagtgcgtcgagtataaagttcgagagtatcgtcgacgtattttttttttttatgttatcgtcgttttaggttatataagaggacgagggcggggcgcgcggaggtaagattttgtggtggtagcgaggcggggtttagcgaggaggcggggtttgcgtcggcgtacgggttgttgcgcgtttcgtagaggggcggggcgagggggttgagggcgggcgcgggcgggtttttagtcgcgcgttcggtttttttttcgtttttgttgtcggtttttttcggaaggtcgttgtatgtcggtattat

SEQ ID NO: 31696 - DNA, 804 bp, Artificial Sequence
  chemically treated genomic DNA (Homo sapiens) CpG-island No: 31696
ataataccgacatacaacgaccttccgaaaaaaaccgacaacaaaaacgaaaaaaaaaccgaacgcgcgactaaaaacccgcccgcgcccgccctcaaccccctcgccccgcccctctacgaaacgcgcaacaacccgtacgccgacgcaaaccccgcctcctcgctaaaccccgcctcgctaccaccacaaaatcttacctccgcgcgccccgccctcgtcctcttatataacctaaaacgacgataacataaaaaaaaaaaatacgtcgacgatactctcgaactttatactcgacgcactcgctttccaacacctcaacacgaactcgaacacgataaaccgaaaaacgaaacgaaatccgacgtcgcctaaaaaaaaccctacgcgcgacctacctccccgctattactccgatccccgcccgctcccccgacgccgccgcgcctcctccctacgatcgcgactctaccttctctccccctcaacgatccctaaaatacctcgtacccacgaaatcttctccaacattaaccctccctctactatcctccgttatttcccttttccgacccaaatatcccacacgctcccatctttcctcgacgcccctataactataaaaacttaaacgtaaaaaaataaaaaattcacgaaacgtctttccgctactctacgaaacctacgataaactttccgtttctcgcgacgcccgacaaacgtttacaaaaccaaacgaactttttcatacaaaacaacgtctatacgtatttattacgataataaaataataaaaaaataaaa

SEQ ID NO: 31697 - DNA, 544 bp, Artificial Sequence
  chemically treated genomic DNA (Homo sapiens) CpG-island No: 31697
cgtttgcgtaagaggacgtttgcgtaagaggacgtcgttagtttggcgttagcgcgtcgggttttggttcgttttttgtgatattagtttcgttttatttcgtttcgtatattcgtgcgttgtcgcgtatgtttcgagtttcgttttcgtgcgttatagaatggtttcggatatttaggtagtttttgacgtgtcggggaggagtcgggcgcggaggtacgttgagtggagttcggggttgcgtaggggagttgagtcgagcggttgggcgggtttggtcgggtcggcggaggggagacgtcggttgagcggcggcgaatatgcgtttttgatatattggaggtgagtttgtagcgcggggtcgttttttaaggggttgcgttgggtcggcggcgtcgaggtttgtttttggggagttttttcggttcggggtcgtgtttgaggtttcgtcggggcgggtcgggtcgggtttcggggcggttagtttgggggtaattgttttaatcgttttaattgtttttttttttttttggttcgatgtgtg

SEQ ID NO: 31698 - DNA, 544 bp, Artificial Sequence
  chemically treated genomic DNA (Homo sapiens) CpG-island No: 31698
cacacatcgaaccaaaaaaaaaaaaaaacaattaaaacgattaaaacaattacccccaaactaaccgccccgaaacccgacccgacccgccccgacgaaacctcaaacacgaccccgaaccgaaaaaactccccaaaaacaaacctcgacgccgccgacccaacgcaaccccttaaaaaacgaccccgcgctacaaactcacctccaatatatcaaaaacgcatattcgccgccgctcaaccgacgtctcccctccgccgacccgaccaaacccgcccaaccgctcgactcaactcccctacgcaaccccgaactccactcaacgtacctccgcgcccgactcctccccgacacgtcaaaaactacctaaatatccgaaaccattctataacgcacgaaaacgaaactcgaaacatacgcgacaacgcacgaatatacgaaacgaaataaaacgaaactaatatcacaaaaaacgaaccaaaacccgacgcgctaacgccaaactaacgacgtcctcttacgcaaacgtcctcttacgcaaacg

SEQ ID NO: 31699 - DNA, 544 bp, Artificial Sequence
  chemically treated genomic DNA (Homo sapiens) CpG-island No: 31699
tatatatcggattagggaagggaggggatagttagagcggttggaatagttgtttttaggttggtcgtttcggaattcggttcggttcgtttcggcggagttttagatacggtttcgggtcgggaaggttttttaagggtaggtttcggcgtcgtcggtttagcgtagttttttagggagcggtttcgcgttgtaggtttatttttaatgtgttaaaagcgtatgttcgtcgtcgtttaatcgacgtttttttttcgtcggttcggttaggttcgtttagtcgttcggtttagtttttttacgtagtttcgagttttatttagcgtattttcgcgttcggttttttttcgatacgttagggattgtttgggtgttcgaggttattttgtgacgtacgggggcggggttcggagtatgcgcggtagcgtacgggtatgcggggcggggtggggcggggttggtgttatagggggcgggttagagttcggcgcgttgacgttaagttgacggcgtttttttgcgtaggcgtttttttgcgtaggcg

SEQ ID NO: 31700 - DNA, 544 bp, Artificial Sequence
  chemically treated genomic DNA (Homo sapiens) CpG-island No: 31700
cgcctacgcaaaaaaacgcctacgcaaaaaaacgccgtcaacttaacgtcaacgcgccgaactctaacccgccccctataacaccaaccccgccccaccccgccccgcatacccgtacgctaccgcgcatactccgaaccccgcccccgtacgtcacaaaataacctcgaacacccaaacaatccctaacgtatcgaaaaaaaaccgaacgcgaaaatacgctaaataaaactcgaaactacgtaaaaaaactaaaccgaacgactaaacgaacctaaccgaaccgacgaaaaaaaaacgtcgattaaacgacgacgaacatacgcttttaacacattaaaaataaacctacaacgcgaaaccgctccctaaaaaactacgctaaaccgacgacgccgaaacctacccttaaaaaaccttcccgacccgaaaccgtatctaaaactccgccgaaacgaaccgaaccgaattccgaaacgaccaacctaaaaacaactattccaaccgctctaactatcccctcccttccctaatccgatatata

SEQ ID NO: 31701 - DNA, 754 bp, Artificial Sequence
  chemically treated genomic DNA (Homo sapiens) CpG-island No: 31701
gagtacgtagattgtcgatgttagagaagttcggtgcgggtttcgtgtttttttttcgttttaggaagattttagttcgtggttaaatttttttgtcgtttttcggtttgcgcgtttacgttgtcggtttttcgataaaagcgacggcgttttggtgaaaagtagacgttttttatcggtttgcgttttgtagtttaattatgttttagttttttataagttatttgttcgcgtttttcgttaggcgtttagttcggatttgttttcgcggtcgttaaggcgtacgtgaagttttcgggcggggggagcgtaaggaggcgggagtttgcggacgcgaacgtaggtttaggaagggaagcgattttagggcgtacgcgtagagtttggagattgggcggggcgtgtttttcgtaggggttacgaacgaaaggcgagcgcgtggcgtttaggagttcgcgtacgcgttgtggtttcgtttcgtttatgagcgttcgcgcggtcgtcgtagtattttttttttagattcgttcggttcgtttatttaatttagcggaggtttggagtgagagtagggaagtgtggggcgaggtgggcggggcgttgtacgcgtgcgcggttagcgaaagaagggagggggcgggagattcgagataacgttatttcgttaatatttaattaggagtcggtttgatttcgttttttttttttacgttattggttgagaggtttttagatgggcggggtcggtcgtggg

SEQ ID NO: 31702 - DNA, 754 bp, Artificial Sequence
  chemically treated genomic DNA (Homo sapiens) CpG-island No: 31702
cccacgaccgaccccgcccatctaaaaacctctcaaccaataacgtaaaaaaaaaaaacgaaatcaaaccgactcctaattaaatattaacgaaataacgttatctcgaatctcccgccccctcccttctttcgctaaccgcgcacgcgtacaacgccccgcccacctcgccccacacttccctactctcactccaaacctccgctaaattaaataaacgaaccgaacgaatctaaaaaaaaaatactacgacgaccgcgcgaacgctcataaacgaaacgaaaccacaacgcgtacgcgaactcctaaacgccacgcgctcgcctttcgttcgtaacccctacgaaaaacacgccccgcccaatctccaaactctacgcgtacgccctaaaatcgcttcccttcctaaacctacgttcgcgtccgcaaactcccgcctccttacgctccccccgcccgaaaacttcacgtacgccttaacgaccgcgaaaacaaatccgaactaaacgcctaacgaaaaacgcgaacaaataacttataaaaaactaaaacataattaaactacaaaacgcaaaccgataaaaaacgtctacttttcaccaaaacgccgtcgcttttatcgaaaaaccgacaacgtaaacgcgcaaaccgaaaaacgacaaaaaaatttaaccacgaactaaaatcttcctaaaacgaaaaaaaaacacgaaacccgcaccgaacttctctaacatcgacaatctacgtactc

SEQ ID NO: 31703 - DNA, 754 bp, Artificial Sequence
  chemically treated genomic DNA (Homo sapiens) CpG-island No: 31703
tttacggtcggtttcgtttatttgggggttttttagttaataacgtgagaagagggggcggggttaggtcggtttttgattgggtgttgacggggtaacgttgtttcggatttttcgtttttttttttttttcgttggtcgcgtacgcgtgtaacgtttcgtttatttcgttttatatttttttgtttttattttaagttttcgttaggttaagtagacgagtcgggcgggtttgaagaaaagatgttacgacggtcgcgcggacgtttatgggcggggcgagattatagcgcgtgcgcgggtttttgagcgttacgcgttcgtttttcgttcgtaatttttgcgggaggtacgtttcgtttagtttttaggttttgcgcgtgcgttttggaatcgtttttttttttaggtttgcgttcgcgttcgtaaattttcgtttttttgcgtttttttcgttcgggagttttacgtgcgttttggcggtcgcgggggtaggttcgggttggacgtttggcggaggacgcgggtaggtggtttgtgggaggttggggtatagttgagttgtaaggcgtaaatcgatgaggggcgtttgttttttattagggcgtcgtcgtttttgtcgggaaatcggtagcgtaggcgcgtagatcgggaagcggtaagaagatttggttacgagttggggtttttttggaacggagagaaagtacggaattcgtatcgggtttttttggtatcggtagtttacgtgttt

SEQ ID NO: 31704 - DNA, 754 bp, Artificial Sequence
  chemically treated genomic DNA (Homo sapiens) CpG-island No: 31704
aaacacgtaaactaccgataccaaaaaaacccgatacgaattccgtactttctctccgttccaaaaaaaccccaactcgtaaccaaatcttcttaccgcttcccgatctacgcgcctacgctaccgatttcccgacaaaaacgacgacgccctaataaaaaacaaacgcccctcatcgatttacgccttacaactcaactataccccaacctcccacaaaccacctacccgcgtcctccgccaaacgtccaacccgaacctacccccgcgaccgccaaaacgcacgtaaaactcccgaacgaaaaaaacgcaaaaaaacgaaaatttacgaacgcgaacgcaaacctaaaaaaaaaaacgattccaaaacgcacgcgcaaaacctaaaaactaaacgaaacgtacctcccgcaaaaattacgaacgaaaaacgaacgcgtaacgctcaaaaacccgcgcacgcgctataatctcgccccgcccataaacgtccgcgcgaccgtcgtaacatcttttcttcaaacccgcccgactcgtctacttaacctaacgaaaacttaaaataaaaacaaaaaaatataaaacgaaataaacgaaacgttacacgcgtacgcgaccaacgaaaaaaaaaaaaaaacgaaaaatccgaaacaacgttaccccgtcaacacccaatcaaaaaccgacctaaccccgccccctcttctcacgttattaactaaaaaacccccaaataaacgaaaccgaccgtaaa

SEQ ID NO: 31705 - DNA, 729 bp, Artificial Sequence
  chemically treated genomic DNA (Homo sapiens) CpG-island No: 31705
tcgagggacgtgcgtaacgaggagttggttaaattggagatcgtcgtgttggcggtgattttcgcggtggtcgtgttgggtaatagtagcgtattgttggttttgtatcggacgtcgcgtaagacgtttcgtatgtatttttttattcgatattttagtttggtcgatttggtcgtggtatttttttaggtgttgtcgtaaatgtgttgggatattatttatcgttttcgcggtttcgattggttgtgtcgcgtggtgaagtatttgtaggtgttcggtatgtttgcgtcggtttatatgttggtagttatgatagtcgatcgttatatcgcggtgtgttattcgtttaagattttgtaatagttcgcgcgtcgttcgcgttttatgatcgcggtcgtttgggtgttgagtttcgtgttgagtacgtcgtagtatttcgttttttttatgatcgaggtgaataatgttattaaggttcgcgattgttgggttatttttatttagttttggggttttcgtgtttacgtgatttggatgacgggcggtatttttgtggcgttcgtggttattttgggtatttgttacggttttatttgttataatatttggtgtaacgttcgcgggaagacggcgtcgcgttagagtaagggtgtagagtaagcgggtgtggttttttaaaaggggtttttgttcgtattttgtgttagtagcgtgaagtttatttttcgg

SEQ ID NO: 31706 - DNA, 729 bp, Artificial Sequence
  chemically treated genomic DNA (Homo sapiens) CpG-island No: 31706
ccgaaaaataaacttcacgctactaacacaaaatacgaacaaaaaccccttttaaaaaaccacacccgcttactctacacccttactctaacgcgacgccgtcttcccgcgaacgttacaccaaatattataacaaataaaaccgtaacaaatacccaaaataaccacgaacgccacaaaaataccgcccgtcatccaaatcacgtaaacacgaaaaccccaaaactaaataaaaataacccaacaatcgcgaaccttaataacattattcacctcgatcataaaaaaaacgaaatactacgacgtactcaacacgaaactcaacacccaaacgaccgcgatcataaaacgcgaacgacgcgcgaactattacaaaatcttaaacgaataacacaccgcgatataacgatcgactatcataactaccaacatataaaccgacgcaaacataccgaacacctacaaatacttcaccacgcgacacaaccaatcgaaaccgcgaaaacgataaataatatcccaacacatttacgacaacacctaaaaaaataccacgaccaaatcgaccaaactaaaatatcgaataaaaaaatacatacgaaacgtcttacgcgacgtccgatacaaaaccaacaatacgctactattacccaacacgaccaccgcgaaaatcaccgccaacacgacgatctccaatttaaccaactcctcgttacgcacgtccctcga

SEQ ID NO: 31707 - DNA, 729 bp, Artificial Sequence
  chemically treated genomic DNA (Homo sapiens) CpG-island No: 31707
tcgggaaatggattttacgttgttgatatagggtgcgagtaggaattttttttggaaggttatattcgtttgttttgtatttttgttttggcgcgacgtcgttttttcgcggacgttgtattagatgttgtagtagatgaagtcgtagtaggtatttaagatgattacgggcgttataaagatgtcgttcgttatttaggttacgtaggtacgagaattttagggttggatgaaggtggtttagtagtcgcgggttttggtgatattgtttatttcgattatggagaagacgaagtattgcggcgtgtttagtacgaagtttagtatttaggcggtcgcgattatgaggcgcgagcggcgcgcgggttgttgtagagttttgagcgggtggtatatcgcgatgtagcggtcggttgttatgattattagtatgtaggtcgacgtaaatatgtcgaatatttgtaggtgttttattacgcggtatagttagtcggggtcgcggaagcggtaggtgatgttttagtatatttgcggtagtatttggaagaatgttacggttaggtcggttaggttgaggtgtcggatgaagaggtgtatgcgggacgttttgcgcggcgttcggtgtagagttagtagtacgttgttgttgtttagtacggttatcgcgaaagttatcgttagtacggcgatttttagtttggttagtttttcgttgcgtacgtttttcgg

SEQ ID NO: 31708 - DNA, 729 bp, Artificial Sequence
  chemically treated genomic DNA (Homo sapiens) CpG-island No: 31708
ccgaaaaacgtacgcaacgaaaaactaaccaaactaaaaatcgccgtactaacgataactttcgcgataaccgtactaaacaacaacaacgtactactaactctacaccgaacgccgcgcaaaacgtcccgcatacacctcttcatccgacacctcaacctaaccgacctaaccgtaacattcttccaaatactaccgcaaatatactaaaacatcacctaccgcttccgcgaccccgactaactataccgcgtaataaaacacctacaaatattcgacatatttacgtcgacctacatactaataatcataacaaccgaccgctacatcgcgatataccacccgctcaaaactctacaacaacccgcgcgccgctcgcgcctcataatcgcgaccgcctaaatactaaacttcgtactaaacacgccgcaatacttcgtcttctccataatcgaaataaacaatatcaccaaaacccgcgactactaaaccaccttcatccaaccctaaaattctcgtacctacgtaacctaaataacgaacgacatctttataacgcccgtaatcatcttaaatacctactacgacttcatctactacaacatctaatacaacgtccgcgaaaaaacgacgtcgcgccaaaacaaaaatacaaaacaaacgaatataaccttccaaaaaaaattcctactcgcaccctatatcaacaacgtaaaatccatttcccga

SEQ ID NO: 31709 - DNA, 688 bp, Artificial Sequence
  chemically treated genomic DNA (Homo sapiens) CpG-island No: 31709
gcggcggttttagcgtttaagttaggttttaatttaagtacgaggcgaaggggttttttaagcgtaaggtttcgaatttttttatttatttttaattcgaagttcgggattaagaattacgtattgtagttaggggcgtggaagtaatttaaggtacgtaagggttataattcgtaaagaggttaggttcgcgggaattatatacggtatttatttgtgttttggcggtaaattcgttgcgaaaaagaacgtttacggcgattattgtatttatatacggtttttttttattttcgggaaaaaggcggagttagtatacgatattatttttttagtttatttcgcgttattttttttaggtatcggtttaattgtcgatttttttttttaatttttcggggattgtgggcgatgtgcgttttgtttattgacgggtatcggagttttacgtatgtttttttttattttagtgatgacgagagcgggcgggtgagggggcgggaacgtagcgatttttgggttttacgttagtgggagtttaacgacggtttttgggattttttaaggtaggggcgagtttttttgtatgaattatttttagtttcggtcggggcgggttggggggggtggtgacggggaggtcgtttggaagggacgtgtagaattttttttttattattgttggttt

SEQ ID NO: 31710 - DNA, 688 bp, Artificial Sequence
  chemically treated genomic DNA (Homo sapiens) CpG-island No: 31710
aaaccaacaataataaaaaaaaaattctacacgtcccttccaaacgacctccccgtcaccaccccccccaacccgccccgaccgaaactaaaaataattcatacaaaaaaactcgcccctaccttaaaaaatcccaaaaaccgtcgttaaactcccactaacgtaaaacccaaaaatcgctacgttcccgccccctcacccgcccgctctcgtcatcactaaaataaaaaaaaacatacgtaaaactccgatacccgtcaataaacaaaacgcacatcgcccacaatccccgaaaaattaaaaaaaaaaatcgacaattaaaccgatacctaaaaaaaataacgcgaaataaactaaaaaaataatatcgtatactaactccgcctttttcccgaaaataaaaaaaaaccgtatataaatacaataatcgccgtaaacgttctttttcgcaacgaatttaccgccaaaacacaaataaataccgtatataattcccgcgaacctaacctctttacgaattataacccttacgtaccttaaattacttccacgcccctaactacaatacgtaattcttaatcccgaacttcgaattaaaaataaataaaaaaattcgaaaccttacgcttaaaaaaccccttcgcctcgtacttaaattaaaacctaacttaaacgctaaaaccgccgc

SEQ ID NO: 31711 - DNA, 688 bp, Artificial Sequence
  chemically treated genomic DNA (Homo sapiens) CpG-island No: 31711
aagttagtaatggtagagggaagattttgtacgttttttttaggcggttttttcgttattattttttttaattcgtttcgatcggagttgagagtaatttatataaaaggattcgtttttgttttggggaattttagggatcgtcgttaaatttttattaacgtagaatttagagatcgttgcgttttcgtttttttattcgttcgttttcgttattattgaggtggagaagagtatgcgtgaggtttcggtgttcgttagtgggtagagcgtatatcgtttatagttttcgagaagttggggggaggggtcggtaattgaatcggtgtttagagaaggtggcgcggggtaaattgggaaagtgatgtcgtgtattggtttcgtttttttttcgagggtgggggagaatcgtatataagtgtagtagtcgtcgtgaacgttttttttcgtaacgggtttgtcgttagaatataggtaagtgtcgtgtgtggttttcgcgggtttggtttttttacgggttatggtttttgcgtgttttgaattatttttacgtttttggttgtagtacgtgatttttgatttcgagtttcgggttggaagtgggtgggagagttcgaggttttgcgtttaaggagttttttcgtttcgtgtttgagttgaggtttggtttgggcgttggggtcgtcgt

SEQ ID NO: 31712 - DNA, 688 bp, Artificial Sequence
  chemically treated genomic DNA (Homo sapiens) CpG-island No: 31712
acgacgaccccaacgcccaaaccaaacctcaactcaaacacgaaacgaaaaaactccttaaacgcaaaacctcgaactctcccacccacttccaacccgaaactcgaaatcaaaaatcacgtactacaaccaaaaacgtaaaaataattcaaaacacgcaaaaaccataacccgtaaaaaaaccaaacccgcgaaaaccacacacgacacttacctatattctaacgacaaacccgttacgaaaaaaaacgttcacgacgactactacacttatatacgattctcccccaccctcgaaaaaaaaacgaaaccaatacacgacatcactttcccaatttaccccgcgccaccttctctaaacaccgattcaattaccgacccctccccccaacttctcgaaaactataaacgatatacgctctacccactaacgaacaccgaaacctcacgcatactcttctccacctcaataataacgaaaacgaacgaataaaaaaacgaaaacgcaacgatctctaaattctacgttaataaaaatttaacgacgatccctaaaattccccaaaacaaaaacgaatccttttatataaattactctcaactccgatcgaaacgaattaaaaaaaataataacgaaaaaaccgcctaaaaaaaacgtacaaaatcttccctctaccattactaactt

SEQ ID NO: 31713 - DNA, 1000 bp, Artificial Sequence
  chemically treated genomic DNA (Homo sapiens) CpG-island No: 31713
  misc_feature (437)..(437): n is either a, c, g or t
  misc_feature (451)..(451): n is either a, c, g or t
  misc_feature (469)..(470): n is either a, c, g or t
gaagggatggtggtgcgttattgatgcgttaaagggtcgggtttttattcggagttgggagtgtgtggtgggagggtggtcggaatggagacggagggtttacgggaggttttcgaggggcggggtcggatttgggtatacgaggcgggggttggtgtttgcgggtttgagggtggggggagaagggagttggatttcgacgttcggagttggtaagatttgggtcgtggaggtgggtcgtcgcgagggtagcgtagtgggtggggggtgagttgtagtgggagagggtggggggcgggaaaggtcgattttcggagttcgggcgtgggggaggaaaaatttcggtttatcgtttgattcggagtagatattgcggcgcggtgcgtcgtcgttttagtcggagttgagcgtggggttttagtggttaaatagcggtntttcgtgcgagcgntttgaagggcgggataanntagcggattagggtcgtttttcgggttttcggtcgttttagttgtcgtcgtcgtcgtttatatattcggtagaaaggcggttcgaattcgtcgtcgttgtcgttaacgttaataatattagtaattttgttcgtttcggggttcgtcgtttcgcgttcgtcgttggcgtttttttagttggagttttcgttatagttgtttcgttttcgggaataatcggtaatacgttcgtcgaatagaacggtcgttgttttcgttcgttttcgtattaacgagaaacggggtaaaatttttttaattttttcgtttttataagttaaaaggttgttggtttcgttaatttcgttttaattagcgagaggcgttttgtaagagttttatttacggttttttaggacgggaggggtgggaattagtaggtcgtgatggttttgggttcgtgtgggttttgcgttgtgcggaagtagcggagagtttaatttaagtgttgaaaggggagaagagaggagggagtgggggaggaagggtta

SEQ ID NO: 31714 - DNA, 1000 bp, Artificial Sequence
  chemically treated genomic DNA (Homo sapiens) CpG-island No: 31714
  misc_feature (531)..(532): n is either a, c, g or t
  misc_feature (550)..(550): n is either a, c, g or t
  misc_feature (564)..(564): n is either a, c, g or t
taacccttcctcccccactccctcctctcttctcccctttcaacacttaaattaaactctccgctacttccgcacaacgcaaaacccacacgaacccaaaaccatcacgacctactaattcccacccctcccgtcctaaaaaaccgtaaataaaactcttacaaaacgcctctcgctaattaaaacgaaattaacgaaaccaacaaccttttaacttataaaaacgaaaaaattaaaaaaattttaccccgtttctcgttaatacgaaaacgaacgaaaacaacgaccgttctattcgacgaacgtattaccgattattcccgaaaacgaaacaactataacgaaaactccaactaaaaaaacgccaacgacgaacgcgaaacgacgaaccccgaaacgaacaaaattactaatattattaacgttaacgacaacgacgacgaattcgaaccgcctttctaccgaatatataaacgacgacgacgacaactaaaacgaccgaaaacccgaaaaacgaccctaatccgctannttatcccgcccttcaaancgctcgcacgaaanaccgctatttaaccactaaaaccccacgctcaactccgactaaaacgacgacgcaccgcgccgcaatatctactccgaatcaaacgataaaccgaaatttttcctcccccacgcccgaactccgaaaatcgacctttcccgccccccaccctctcccactacaactcaccccccacccactacgctaccctcgcgacgacccacctccacgacccaaatcttaccaactccgaacgtcgaaatccaactcccttctccccccaccctcaaacccgcaaacaccaacccccgcctcgtatacccaaatccgaccccgcccctcgaaaacctcccgtaaaccctccgtctccattccgaccaccctcccaccacacactcccaactccgaataaaaacccgaccctttaacgcatcaataacgcaccaccatcccttc

SEQ ID NO: 31715 - DNA, 1000 bp, Artificial Sequence
  chemically treated genomic DNA (Homo sapiens) CpG-island No: 31715
  misc_feature (531)..(532): n is either a, c, g or t
  misc_feature (550)..(550): n is either a, c, g or t
  misc_feature (564)..(564): n is either a, c, g or t
tggtttttttttttttattttttttttttttttttttttttaatatttgaattgggtttttcgttattttcgtatagcgtaggatttatacgagtttagaattattacggtttgttagtttttatttttttcgttttggaggatcgtaggtggaatttttgtagagcgtttttcgttggttggggcggggttggcgaagttaataattttttggtttgtgaaagcgaaggggttgggaaaattttgtttcgtttttcgttggtgcggaagcgggcggaagtagcggtcgttttgttcggcgaacgtgttgtcgattattttcgaaagcgaagtagttatggcggagattttaattgaggaggcgttaacggcgggcgcggggcggcgggtttcggggcgagtagagttgttggtgttgttggcgttagcggtagcggcggcgggttcgggtcgtttttttgtcggatgtgtgggcggcggcggcggtagttgggacggtcgggggttcggggagcggttttggttcgttgnnttgtttcgttttttaagncgttcgtacggggngtcgttgtttagttattgggattttacgtttagtttcgattgggacggcgacgtatcgcgtcgtagtgtttatttcggattaagcggtgagtcggggtttttttttttttacgttcgagtttcgggggtcgatttttttcgttttttatttttttttattataatttattttttatttattgcgttgttttcgcggcggtttatttttacggtttaaattttgttagtttcgggcgtcgggatttaatttttttttttttttatttttagattcgtaagtattaattttcgtttcgtgtgtttagattcgatttcgtttttcgaaaatttttcgtgagtttttcgtttttatttcggttatttttttattatatatttttaatttcgggtggaaattcgattttttagcgtattagtaacgtattattattttttt

SEQ ID NO: 31716 - DNA, 1000 bp, Artificial Sequence
  chemically treated genomic DNA (Homo sapiens) CpG-island No: 31716
  misc_feature (437)..(437): n is either a, c, g or t
  misc_feature (451)..(451): n is either a, c, g or t
  misc_feature (469)..(470): n is either a, c, g or t
aaaaaaataataatacgttactaatacgctaaaaaatcgaatttccacccgaaattaaaaatatataataaaaaaataaccgaaataaaaacgaaaaactcacgaaaaattttcgaaaaacgaaatcgaatctaaacacacgaaacgaaaattaatacttacgaatctaaaaataaaaaaaaaaaaaaattaaatcccgacgcccgaaactaacaaaatttaaaccgtaaaaataaaccgccgcgaaaacaacgcaataaataaaaaataaattataataaaaaaaaataaaaaacgaaaaaaatcgacccccgaaactcgaacgtaaaaaaaaaaaaaccccgactcaccgcttaatccgaaataaacactacgacgcgatacgtcgccgtcccaatcgaaactaaacgtaaaatcccaataactaaacaacgacnccccgtacgaacgncttaaaaaacgaaacaanncaacgaaccaaaaccgctccccgaacccccgaccgtcccaactaccgccgccgccgcccacacatccgacaaaaaaacgacccgaacccgccgccgctaccgctaacgccaacaacaccaacaactctactcgccccgaaacccgccgccccgcgcccgccgttaacgcctcctcaattaaaatctccgccataactacttcgctttcgaaaataatcgacaacacgttcgccgaacaaaacgaccgctacttccgcccgcttccgcaccaacgaaaaacgaaacaaaattttcccaaccccttcgctttcacaaaccaaaaaattattaacttcgccaaccccgccccaaccaacgaaaaacgctctacaaaaattccacctacgatcctccaaaacgaaaaaaataaaaactaacaaaccgtaataattctaaactcgtataaatcctacgctatacgaaaataacgaaaaacccaattcaaatattaaaaaaaaaaaaaaaaaaaaaaaataaaaaaaaaaaaacca

SEQ ID NO: 31717 - DNA, 724 bp, Artificial Sequence
  chemically treated genomic DNA (Homo sapiens) CpG-island No: 31717
  misc_feature (126)..(126): n is either a, c, g or t
  misc_feature (251)..(251): n is either a, c, g or t
tgcgcgggggtgggaggcgtagagcgagggagggggtatcgaagggggtaggtcgagggtgggtacggaggttaaatttcgtaggttcgggaagagaggagttggcgggagaggaatcggaagtgncgggttttcgttgttcggggttttcgttgtggttttttcgggaagtggttgtgtttttatcggagaaagtttcgatggtttttatcgtttagtgttcgttcgggtagtttacgaaggcgtaggantttgattaagaattggtcgttgtaggagattttgtgtttcgtaaatattttttttaagttcgcgggggttacgttttcgttgaggttgtcgatgtaaagtttgtttatggtggcggtttcggggtaggacgcggtttcgggtaaggtcgaacgagcgggcgcgcgcggcgagttttttaggttaagaggcggagaggtcggcggtaggagcgaaatttttttttgtattttattttagaagttgtttcgagtttagggcgtgagaaggcggtttgagggcgcgtagaggtcgcgggagagttcggggagagtttaggagaagtgttcgcggcgcgtagggagacggacgatacggcgtatttttttttttcggttcgaaattttttcgagaggttggtgtgttacgttttttcgcggtcgttttgggtcgttttaaataaaatcgatttgaaaaaaaatggagcggaaaaaaa

SEQ ID NO: 31718 - DNA, 724 bp, Artificial Sequence
  chemically treated genomic DNA (Homo sapiens) CpG-island No: 31718
  misc_feature (474)..(474): n is either a, c, g or t
  misc_feature (599)..(599): n is either a, c, g or t
tttttttccgctccattttttttcaaatcgattttatttaaaacgacccaaaacgaccgcgaaaaaacgtaacacaccaacctctcgaaaaaatttcgaaccgaaaaaaaaaaatacgccgtatcgtccgtctccctacgcgccgcgaacacttctcctaaactctccccgaactctcccgcgacctctacgcgccctcaaaccgccttctcacgccctaaactcgaaacaacttctaaaataaaatacaaaaaaaaatttcgctcctaccgccgacctctccgcctcttaacctaaaaaactcgccgcgcgcgcccgctcgttcgaccttacccgaaaccgcgtcctaccccgaaaccgccaccataaacaaactttacatcgacaacctcaacgaaaacgtaacccccgcgaacttaaaaaaaatatttacgaaacacaaaatctcctacaacgaccaattcttaatcaaantcctacgccttcgtaaactacccgaacgaacactaaacgataaaaaccatcgaaactttctccgataaaaacacaaccacttcccgaaaaaaccacaacgaaaaccccgaacaacgaaaacccgncacttccgattcctctcccgccaactcctctcttcccgaacctacgaaatttaacctccgtacccaccctcgacctacccccttcgataccccctccctcgctctacgcctcccacccccgcgca

SEQ ID NO: 31719 - DNA, 724 bp, Artificial Sequence
  chemically treated genomic DNA (Homo sapiens) CpG-island No: 31719
  misc_feature (474)..(474): n is either a, c, g or t
  misc_feature (599)..(599): n is either a, c, g or t
ttttttttcgttttatttttttttaagtcgattttatttagagcggtttagggcggtcgcggagaaacgtgatatattagtttttcggaggggtttcggatcgaagggaagaagtgcgtcgtgtcgttcgtttttttgcgcgtcgcgggtattttttttgggtttttttcgaattttttcgcgatttttgcgcgtttttaggtcgtttttttacgttttgggttcgggataatttttggggtggggtgtaaagaaaggtttcgtttttgtcgtcggttttttcgttttttggtttaggaggttcgtcgcgcgcgttcgttcgttcggttttgttcgggatcgcgttttgtttcgagatcgttattatgaataagttttatatcggtaattttaacgagagcgtgattttcgcggatttggagaaagtgtttgcggagtataagattttttatagcggttagtttttggttaaanttttacgttttcgtggattgttcggacgagtattgggcgatgaaggttatcgaaatttttttcggtaagaatatagttatttttcggaaaagttataacgagagtttcgaataacggagattcgntattttcggtttttttttcgttaattttttttttttcgggtttgcggggtttggttttcgtatttattttcgatttatttttttcgatgttttttttttcgttttgcgttttttattttcgcgta

SEQ ID NO: 31720 - DNA, 724 bp, Artificial Sequence
  chemically treated genomic DNA (Homo sapiens) CpG-island No: 31720
  misc_feature (126)..(126): n is either a, c, g or t
  misc_feature (251)..(251): n is either a, c, g or t
tacgcgaaaataaaaaacgcaaaacgaaaaaaaaaacatcgaaaaaaataaatcgaaaataaatacgaaaaccaaaccccgcaaacccgaaaaaaaaaaaattaacgaaaaaaaaaccgaaaatancgaatctccgttattcgaaactctcgttataacttttccgaaaaataactatattcttaccgaaaaaaatttcgataaccttcatcgcccaatactcgtccgaacaatccacgaaaacgtaaaantttaaccaaaaactaaccgctataaaaaatcttatactccgcaaacactttctccaaatccgcgaaaatcacgctctcgttaaaattaccgatataaaacttattcataataacgatctcgaaacaaaacgcgatcccgaacaaaaccgaacgaacgaacgcgcgcgacgaacctcctaaaccaaaaaacgaaaaaaccgacgacaaaaacgaaacctttctttacaccccaccccaaaaattatcccgaacccaaaacgtaaaaaaacgacctaaaaacgcgcaaaaatcgcgaaaaaattcgaaaaaaacccaaaaaaaatacccgcgacgcgcaaaaaaacgaacgacacgacgcacttcttcccttcgatccgaaacccctccgaaaaactaatatatcacgtttctccgcgaccgccctaaaccgctctaaataaaatcgacttaaaaaaaaataaaacgaaaaaaaa

SEQ ID NO: 31721 - DNA, 559 bp, Artificial Sequence
  chemically treated genomic DNA (Homo sapiens) CpG-island No: 31721
agcggtttttttataaatttttacggtgggaattattgtaaaggtatcggttttttcggtttagaatatttcgcgggattttagttgtttttgggtttttttttttagcgtaattattaattttaatatgtaacgcgtttcgtggtttaagcgttcgaatgaaggttcggggttaaagttatgtgtttgattgcgttatacgtttcgttattttttttacgtttttttttttagcgtatattttggtcgttattttgtgcgcgaggttatggaatttttgagtttcgttaattttatggtcgagcgttttagggatcggttaatcgtaatttagatttcgtaggaaagtttcgtttttattcgtatggaggcgggaattgttacgaagtttttgtggagggagaggaagtagttgcggaaagttaataagagtggggaatcgatgacgttaattaatggggacgcggggatattacggttaatgagaatggagaaggtttaggatacgtgggtgggggaagttgagcgttgagattaagggttaaagttgggaggtgag

SEQ ID NO: 31722 - DNA, 559 bp, Artificial Sequence
  chemically treated genomic DNA (Homo sapiens) CpG-island No: 31722
ctcacctcccaactttaacccttaatctcaacgctcaacttcccccacccacgtatcctaaaccttctccattctcattaaccgtaatatccccgcgtccccattaattaacgtcatcgattccccactcttattaactttccgcaactacttcctctccctccacaaaaacttcgtaacaattcccgcctccatacgaataaaaacgaaactttcctacgaaatctaaattacgattaaccgatccctaaaacgctcgaccataaaattaacgaaactcaaaaattccataacctcgcgcacaaaataacgaccaaaatatacgctaaaaaaaaaaacgtaaaaaaaataacgaaacgtataacgcaatcaaacacataactttaaccccgaaccttcattcgaacgcttaaaccacgaaacgcgttacatattaaaattaataattacgctaaaaaaaaaaacccaaaaacaactaaaatcccgcgaaatattctaaaccgaaaaaaccgatacctttacaataattcccaccgtaaaaatttataaaaaaaccgct

SEQ ID NO: 31723 - DNA, 559 bp, Artificial Sequence
  chemically treated genomic DNA (Homo sapiens) CpG-island No: 31723
tttattttttagttttagtttttggttttagcgtttagttttttttatttacgtgttttggattttttttatttttattggtcgtaatattttcgcgtttttattggttgacgttatcgattttttatttttattggtttttcgtagttgttttttttttttttataggagtttcgtggtaattttcgtttttatgcggatagaggcggggtttttttacgagatttggattacgattggtcgatttttgaaacgttcgattatagagttggcgggatttagaggttttataatttcgcgtataagatggcgattaaggtgtacgttgaagaaaaaggcgtgggagagatgacgggacgtgtgacgtagttagatatatgattttggtttcgagtttttattcgggcgtttgggttacggggcgcgttgtatgttgggattggtagttgcgttgagggggggggtttaaggatagttgagatttcgcgagatattttaggtcgggagagtcgatgtttttgtagtaatttttatcgtggaggtttgtggaaagatcgtt

SEQ ID NO: 31724 - DNA, 559 bp, Artificial Sequence
  chemically treated genomic DNA (Homo sapiens) CpG-island No: 31724
aacgatctttccacaaacctccacgataaaaattactacaaaaacatcgactctcccgacctaaaatatctcgcgaaatctcaactatccttaaaccccccccctcaacgcaactaccaatcccaacatacaacgcgccccgtaacccaaacgcccgaataaaaactcgaaaccaaaatcatatatctaactacgtcacacgtcccgtcatctctcccacgcctttttcttcaacgtacaccttaatcgccatcttatacgcgaaattataaaacctctaaatcccgccaactctataatcgaacgtttcaaaaatcgaccaatcgtaatccaaatctcgtaaaaaaaccccgcctctatccgcataaaaacgaaaattaccacgaaactcctataaaaaaaaaaaaaacaactacgaaaaaccaataaaaataaaaaatcgataacgtcaaccaataaaaacgcgaaaatattacgaccaataaaaataaaaaaaatccaaaacacgtaaataaaaaaaactaaacgctaaaaccaaaaactaaaactaaaaaataaa

SEQ ID NO: 31725 - DNA, 1006 bp, Artificial Sequence
  chemically treated genomic DNA (Homo sapiens) CpG-island No: 31725
tcgcgtttaagtgtgtgcgtgcgtgtttgtgtgtgtggcggcgtgcgcgcgcgagtggggacgcgtagggtttggagagaaggcgcgggttttttaaggagttagagggggtcgggtcggggcgcgtcgttgcgggcggggagtcgggagtagggaggtcgagttatcgtttttcgggttcgcgtttcgtttttttttttttttttcgtcgtcgtcgtcgtcgtcgtcgtcgttatcgtcgtcgcggtcgtcggggagcgcggagtcgcgggtaggtcgggtcgtatcggagtttcgcgttcgtcggcgtttcgttcgagttttgcgttcgcgttttgcgtttcgcgatgcgcgttaatttgcgggtcggggatttagggtcggcgttttaggaggcggcggcgggaggatcgcgtttcgattcgaggtcgggtttgttgcgcgtttttagttcgatcggtatcggtatttgtttgagcgtttcggcggttcgagcgcgttttaagttcgggcgttatcgttgttattttcgcgaggtgagttggggtcgagggttttcgcgaagggcggggggaggcgcggagcgcgttttcgggggattcggggaggatcgggcggcgtacgcggcggagttggcggggtttttgtattttcgagttggcgttttcggggggtggtttgttggggagtaaggcgtttcgtcgatattgcggttcgcgtgttcgggggcgtcggggaatttaggggaattttagttttttagcgagggggcgggaaggagggaagtggcgttggggtgggcggggggcgcgttggaaatgtatagagcggttttttatagtgtgcgtcggttttggggatttggtcgttaggcgttttttgtattcggtgtagtttcggatttggcggggcgatattgcgttttattttttatcgggtagcgcgggtttgaaagtttttggagatggtatttttagttttttggtttggttgttgtggaggggcg

SEQ ID NO: 31726 - DNA, 1006 bp, Artificial Sequence
  chemically treated genomic DNA (Homo sapiens) CpG-island No: 31726
cgcccctccacaacaaccaaaccaaaaaactaaaaataccatctccaaaaactttcaaacccgcgctacccgataaaaaataaaacgcaatatcgccccgccaaatccgaaactacaccgaatacaaaaaacgcctaacgaccaaatccccaaaaccgacgcacactataaaaaaccgctctatacatttccaacgcgccccccgcccaccccaacgccacttccctccttcccgccccctcgctaaaaaactaaaattcccctaaattccccgacgcccccgaacacgcgaaccgcaatatcgacgaaacgccttactccccaacaaaccaccccccgaaaacgccaactcgaaaatacaaaaaccccgccaactccgccgcgtacgccgcccgatcctccccgaatcccccgaaaacgcgctccgcgcctccccccgcccttcgcgaaaaccctcgaccccaactcacctcgcgaaaataacaacgataacgcccgaacttaaaacgcgctcgaaccgccgaaacgctcaaacaaataccgataccgatcgaactaaaaacgcgcaacaaacccgacctcgaatcgaaacgcgatcctcccgccgccgcctcctaaaacgccgaccctaaatccccgacccgcaaattaacgcgcatcgcgaaacgcaaaacgcgaacgcaaaactcgaacgaaacgccgacgaacgcgaaactccgatacgacccgacctacccgcgactccgcgctccccgacgaccgcgacgacgataacgacgacgacgacgacgacgacgacgaaaaaaaaaaaaaaaaacgaaacgcgaacccgaaaaacgataactcgacctccctactcccgactccccgcccgcaacgacgcgccccgacccgaccccctctaactccttaaaaaacccgcgccttctctccaaaccctacgcgtccccactcgcgcgcgcacgccgccacacacacaaacacgcacgcacacacttaaacgcga

SEQ ID NO: 31727 - DNA, 1006 bp, Artificial Sequence
  chemically treated genomic DNA (Homo sapiens) CpG-island No: 31727
cgtttttttataatagttaggttagggagttaggggtattatttttaagggtttttaaattcgcgttgttcgatggaaaataaggcgtagtgtcgtttcgttaggttcggggttatatcgggtataagggacgtttggcggttaagtttttagagtcggcgtatattgtggggggtcgttttgtgtatttttagcgcgtttttcgtttattttaacgttatttttttttttttcgttttttcgttagggagttggagtttttttaagtttttcggcgttttcgagtacgcgggtcgtagtgtcggcggggcgttttgttttttagtaggttatttttcgagagcgttaattcgggagtgtaggggtttcgttaatttcgtcgcgtgcgtcgttcgatttttttcggatttttcggaagcgcgtttcgcgttttttttcgtttttcgcggggattttcggttttaatttatttcgcggaggtggtagcggtggcgttcgggtttggggcgcgttcgggtcgtcggggcgtttaggtaagtgtcggtgtcgatcgggttgggggcgcgtagtaggttcggtttcgggtcgggacgcgattttttcgtcgtcgttttttagggcgtcggttttgggttttcggttcgtaagttggcgcgtatcgcggagcgtagggcgcgggcgtagggttcgggcggggcgtcggcggacgcggggtttcggtgcggttcggtttgttcgcggtttcgcgtttttcggcggtcgcggcggcggtggcggcggcggcggcggcggcggcggcgggagggggaggagggggcggggcgcgagttcgggaggcggtggttcggtttttttgttttcggtttttcgttcgtagcgacgcgtttcggttcggttttttttggttttttaaagggttcgcgttttttttttaggttttgcgcgtttttattcgcgcgcgtacgtcgttatatatatagatacgtacgtatatatttgggcgcga

SEQ ID NO: 31728 - DNA, 1006 bp, Artificial Sequence
  chemically treated genomic DNA (Homo sapiens) CpG-island No: 31728
tcgcgcccaaatatatacgtacgtatctatatatataacgacgtacgcgcgcgaataaaaacgcgcaaaacctaaaaaaaaaacgcgaaccctttaaaaaaccaaaaaaaaccgaaccgaaacgcgtcgctacgaacgaaaaaccgaaaacaaaaaaaccgaaccaccgcctcccgaactcgcgccccgccccctcctccccctcccgccgccgccgccgccgccgccgccgccaccgccgccgcgaccgccgaaaaacgcgaaaccgcgaacaaaccgaaccgcaccgaaaccccgcgtccgccgacgccccgcccgaaccctacgcccgcgccctacgctccgcgatacgcgccaacttacgaaccgaaaacccaaaaccgacgccctaaaaaacgacgacgaaaaaatcgcgtcccgacccgaaaccgaacctactacgcgcccccaacccgatcgacaccgacacttacctaaacgccccgacgacccgaacgcgccccaaacccgaacgccaccgctaccacctccgcgaaataaattaaaaccgaaaatccccgcgaaaaacgaaaaaaaacgcgaaacgcgcttccgaaaaatccgaaaaaaatcgaacgacgcacgcgacgaaattaacgaaacccctacactcccgaattaacgctctcgaaaaataacctactaaaaaacaaaacgccccgccgacactacgacccgcgtactcgaaaacgccgaaaaacttaaaaaaactccaactccctaacgaaaaaacgaaaaaaaaaaaaataacgttaaaataaacgaaaaacgcgctaaaaatacacaaaacgaccccccacaatatacgccgactctaaaaacttaaccgccaaacgtcccttatacccgatataaccccgaacctaacgaaacgacactacgccttattttccatcgaacaacgcgaatttaaaaacccttaaaaataatacccctaactccctaacctaactattataaaaaaacg

SEQ ID NO: 31729 - DNA, 657 bp, Artificial Sequence
  chemically treated genomic DNA (Homo sapiens) CpG-island No: 31729
gggttggtcgttttcgggtttcggtatatggttttttcgtcgtcggtttttttcgggttttttagagcgtttcgcgtcgcgcgtatgtttcgtcgtcgtcgtttggtatggggtcgggcgattttcgggggcgggttcgagggcgggggtcgagcgggttgtatttagtcgcggatcggggtagttggggtcgtcgatagttttttcgttcgttcgcgagtattttgtcgttcgtcgtcgaatagtgtcgagtttttttttttcggtttgttttcgcgtatggcgcgtgagcgtgtgtttgtgtacgaggtcgtgtgtatgtgtgtgtgtgagcgcgtgtgtgagtcgtcggggtatcgtcggtgtcgttcgttagtcgtcgaacgtcgcggttatagttatcgtttgcgttcgttgtcggtcgcgcgtttaggtgtacgcgttttcgtcgtcgttcgtattcgtttcgaggttcggtcgtcgttttggtttttgttttttcgtagttttttcgttagtggttttcgatcgttacggtcgagttcgttcgtagtgtgattcggattcgttgtttattttatttttagtatgtgttgtttcgatgttttcggttgtatagacgattagggttattagtttgtatttttttgagatatt

SEQ ID NO: 31730 - DNA, 657 bp, Artificial Sequence
  chemically treated genomic DNA (Homo sapiens) CpG-island No: 31730
aatatctcaaaaaaatacaaactaataaccctaatcgtctatacaaccgaaaacatcgaaacaacacatactaaaaataaaataaacaacgaatccgaatcacactacgaacgaactcgaccgtaacgatcgaaaaccactaacgaaaaaactacgaaaaaacaaaaaccaaaacgacgaccgaacctcgaaacgaatacgaacgacgacgaaaacgcgtacacctaaacgcgcgaccgacaacgaacgcaaacgataactataaccgcgacgttcgacgactaacgaacgacaccgacgataccccgacgactcacacacgcgctcacacacacacatacacacgacctcgtacacaaacacacgctcacgcgccatacgcgaaaacaaaccgaaaaaaaaaaactcgacactattcgacgacgaacgacaaaatactcgcgaacgaacgaaaaaactatcgacgaccccaactaccccgatccgcgactaaatacaacccgctcgacccccgccctcgaacccgcccccgaaaatcgcccgaccccataccaaacgacgacgacgaaacatacgcgcgacgcgaaacgctctaaaaaacccgaaaaaaaccgacgacgaaaaaaccatataccgaaacccgaaaacgaccaaccc

SEQ ID NO: 31731 - DNA, 657 bp, Artificial Sequence
  chemically treated genomic DNA (Homo sapiens) CpG-island No: 31731
aatattttaagagggtgtaagttaatagttttaatcgtttgtatagtcgagggtatcgaggtagtatatgttgagggtggggtgagtagcggattcgaattatattgcggacgaattcggtcgtggcgatcgaaggttattagcgagaggattgcgaggaggtaagggttaggacggcggtcgagtttcgaggcggatacggacggcggcgggagcgcgtgtatttgggcgcgcggtcggtagcgggcgtaggcggtggttgtggtcgcggcgttcggcggttggcgggcggtatcggcggtgtttcggcggtttatatacgcgtttatatatatatatatatacggtttcgtatataaatatacgtttacgcgttatacgcgggagtaggtcggagggaggaggttcggtattgttcggcggcgagcgatagagtgttcgcggacgagcgggagggttgtcggcggttttagttatttcggttcgcgattaggtgtagttcgttcggttttcgttttcggattcgttttcgggggtcgttcggttttatgttaagcggcggcggcggagtatgcgcgcgacgcgggacgttttgaggagttcggagggaatcggcgacgaggggattatgtatcgggattcggaggcggttagttt

SEQ ID NO: 31732 - DNA, 657 bp, Artificial Sequence
  chemically treated genomic DNA (Homo sapiens) CpG-island No: 31732
aaactaaccgcctccgaatcccgatacataatcccctcgtcgccgattccctccgaactcctcaaaacgtcccgcgtcgcgcgcatactccgccgccgccgcttaacataaaaccgaacgacccccgaaaacgaatccgaaaacgaaaaccgaacgaactacacctaatcgcgaaccgaaataactaaaaccgccgacaaccctcccgctcgtccgcgaacactctatcgctcgccgccgaacaataccgaacctcctccctccgacctactcccgcgtataacgcgtaaacgtatatttatatacgaaaccgtatatatatatatatataaacgcgtatataaaccgccgaaacaccgccgataccgcccgccaaccgccgaacgccgcgaccacaaccaccgcctacgcccgctaccgaccgcgcgcccaaatacacgcgctcccgccgccgtccgtatccgcctcgaaactcgaccgccgtcctaacccttacctcctcgcaatcctctcgctaataaccttcgatcgccacgaccgaattcgtccgcaatataattcgaatccgctactcaccccaccctcaacatatactacctcgataccctcgactatacaaacgattaaaactattaacttacaccctcttaaaatatt

SEQ ID NO: 31733 - DNA, 818 bp, Artificial Sequence
  chemically treated genomic DNA (Homo sapiens) CpG-island No: 31733
cgtcgttaggagcgtcgggtaatagcggcgttaggatcgtgatagaaaatttcgcgaggaggaatagttgcgttaggagagggaggaatagtagttgagtcgttaagagcgtgatagaaaatttcgtttagaggaatagaaagtgcgtcgttaggaataagagagaaaatttatggaggacgaatagtagttgcgtcgttaggagggttaataatagttgcgttaggagtcggatagaaaatttcgcgaagacgaatagttgttttaggaaagggaagaatagtagttgtatcgttaagagcgtgatagaaaatttttcgaggaggaatcgtagttgttcgttaggagcgcgaataatagttgcgttacgatcgcgatagaaaatttcgtgaagaggaatagttgttttaggaaggggaggaatagtagttgcgtcgttaagagcgtgatagaaaatttcgcgaagaggaatagtagtttcgtcgttagatacgagagagaaaatttttttaggaggaatagtagttgcgtcgttaggaattggagagaaaatttcgtgaggaggaatagttgcgttaagaaacggagtaagagtagttgcgtcgttaagaacgttatagaaaaattttagaggaagagtagtttcgttcggaaagggaagaatagtagttgcgtcgttagagcgtcgatagaaaatttcgcgaggaggaatagtttcgttagagagaggaggaatagtagttgcgtagtagagagtttgatagaaaatttcgcgagaggaatagttacgttaggagagggaagaatagtagttgcgt

SEQ ID NO: 31734 - DNA, 818 bp, Artificial Sequence
  chemically treated genomic DNA (Homo sapiens) CpG-island No: 31734
acgcaactactattcttccctctcctaacgtaactattcctctcgcgaaattttctatcaaactctctactacgcaactactattcctcctctctctaacgaaactattcctcctcgcgaaattttctatcgacgctctaacgacgcaactactattcttccctttccgaacgaaactactcttcctctaaaatttttctataacgttcttaacgacgcaactactcttactccgtttcttaacgcaactattcctcctcacgaaattttctctccaattcctaacgacgcaactactattcctcctaaaaaaattttctctctcgtatctaacgacgaaactactattcctcttcgcgaaattttctatcacgctcttaacgacgcaactactattcctccccttcctaaaacaactattcctcttcacgaaattttctatcgcgatcgtaacgcaactattattcgcgctcctaacgaacaactacgattcctcctcgaaaaattttctatcacgctcttaacgatacaactactattcttccctttcctaaaacaactattcgtcttcgcgaaattttctatccgactcctaacgcaactattattaaccctcctaacgacgcaactactattcgtcctccataaattttctctcttattcctaacgacgcactttctattcctctaaacgaaattttctatcacgctcttaacgactcaactactattcctccctctcctaacgcaactattcctcctcgcgaaattttctatcacgatcctaacgccgctattacccgacgctcctaacgacg

SEQ ID NO: 31735 - DNA, 818 bp, Artificial Sequence
  chemically treated genomic DNA (Homo sapiens) CpG-island No: 31735
gcgtagttgttgttttttttttttttggcgtagttgtttttttcgcggaattttttgttagattttttgttgcgtagttgttgttttttttttttttggcggagttgttttttttcgcggaattttttgtcggcgttttggcggcgtagttgttgttttttttttttcggacggagttgttttttttttaggatttttttgtagcgtttttggcggcgtagttgtttttgtttcgttttttggcgtagttgtttttttttacggaattttttttttagtttttggcggcgtagttgttgttttttttggaggaattttttttttcgtatttgacggcggagttgttgttttttttcgcggaattttttgttacgtttttggcggcgtagttgttgttttttttttttttggagtagttgtttttttttacggaattttttgtcgcggtcgtgacgtagttgttgttcgcgtttttggcgggtagttgcggttttttttcgaggaattttttgttacgtttttggcggtgtagttgttgttttttttttttttggagtagttgttcgttttcgcggaattttttgttcggtttttggcgtagttgttgttggtttttttggcggcgtagttgttgttcgttttttatgaatttttttttttgtttttggcggcgtattttttgtttttttaaacggaattttttgttacgtttttggcggtttagttgttgttttttttttttttggcgtagttgttttttttcgcggaattttttgttacggttttgacgtcgttgttgttcgacgtttttggcggcg

SEQ ID NO: 31736 - DNA, 818 bp, Artificial Sequence
  chemically treated genomic DNA (Homo sapiens) CpG-island No: 31736
cgccgccaaaaacgtcgaacaacaacgacgtcaaaaccgtaacaaaaaattccgcgaaaaaaaacaactacgccaaaaaaaaaaaaaacaacaactaaaccgccaaaaacgtaacaaaaaattccgtttaaaaaaacaaaaaatacgccgccaaaaacaaaaaaaaaaattcataaaaaacgaacaacaactacgccgccaaaaaaaccaacaacaactacgccaaaaaccgaacaaaaaattccgcgaaaacgaacaactactccaaaaaaaaaaaaaacaacaactacaccgccaaaaacgtaacaaaaaattcctcgaaaaaaaaccgcaactacccgccaaaaacgcgaacaacaactacgtcacgaccgcgacaaaaaattccgtaaaaaaaaacaactactccaaaaaaaaaaaaaacaacaactacgccgccaaaaacgtaacaaaaaattccgcgaaaaaaaacaacaactccgccgtcaaatacgaaaaaaaaaattcctccaaaaaaaacaacaactacgccgccaaaaactaaaaaaaaaattccgtaaaaaaaaacaactacgccaaaaaacgaaacaaaaacaactacgccgccaaaaacgctacaaaaaaatcctaaaaaaaaaacaactccgtccgaaaaaaaaaaaacaacaactacgccgccaaaacgccgacaaaaaattccgcgaaaaaaaacaactccgccaaaaaaaaaaaaaacaacaactacgcaacaaaaaatctaacaaaaaattccgcgaaaaaaacaactacgccaaaaaaaaaaaaaacaacaactacgc

SEQ ID NO: 31737 - DNA, 541 bp, Artificial Sequence
  chemically treated genomic DNA (Homo sapiens) CpG-island No: 31737
gacgaggaagagaggttcgagtagcgattgaagcgcgaggaggtggagagattcgagtaggaggagaggcgcgacgagcggttgaagcgcgaggagtcggatgaagagaggcgttatagttgttgaagagcgaggagtaggaggagaggcgttagtagtaattaaggcgcgagtagtaggaaaggcgcgagtagcggttgaagcgcgaggaggaggaagagaggttcgagtagcggttgaagcgcgagtatgaggaagagaggcgcgagtaggagttagttgaggaggagtaggaataggttcgggagcggattaagagtcgtatttcgaagtggtagtggtagttagaaagcgaggtcgacgtacggtaaagtaaagtttattcgaggtttcgtaagtaggaagggtagaggcgtcgttaagagtaggaggaaaagaggcggcgtcgggagagtgagttgtaatggtaggaggaggaacgggtttatcggtagtagtaggaagaggagtagcgtcgggattttatatggtagtggtaggt

SEQ ID NO: 31738 - DNA, 541 bp, Artificial Sequence
  chemically treated genomic DNA (Homo sapiens) CpG-island No: 31738
acctaccactaccatataaaatcccgacgctactcctcttcctactactaccgataaacccgttcctcctcctaccattacaactcactctcccgacgccgcctcttttcctcctactcttaacgacgcctctacccttcctacttacgaaacctcgaataaactttactttaccgtacgtcgacctcgctttctaactaccactaccacttcgaaatacgactcttaatccgctcccgaacctattcctactcctcctcaactaactcctactcgcgcctctcttcctcatactcgcgcttcaaccgctactcgaacctctcttcctcctcctcgcgcttcaaccgctactcgcgcctttcctactactcgcgccttaattactactaacgcctctcctcctactcctcgctcttcaacaactataacgcctctcttcatccgactcctcgcgcttcaaccgctcgtcgcgcctctcctcctactcgaatctctccacctcctcgcgcttcaatcgctactcgaacctctcttcctcgtc

SEQ ID NO: 31739 - DNA, 541 bp, Artificial Sequence
  chemically treated genomic DNA (Homo sapiens) CpG-island No: 31739
gtttgttattgttatgtgaagtttcggcgttgtttttttttttgttgttgtcggtgagttcgtttttttttttgttattgtagtttattttttcggcgtcgttttttttttttttgtttttggcggcgtttttgttttttttgtttgcggggtttcgagtagattttgttttgtcgtgcgtcggtttcgttttttagttgttattgttatttcgggatgcggtttttaattcgttttcgggtttgtttttgtttttttttagttagtttttgttcgcgttttttttttttatgttcgcgttttagtcgttgttcgagtttttttttttttttttcgcgttttagtcgttgttcgcgttttttttgttgttcgcgttttagttgttgttggcgtttttttttttgtttttcgttttttagtagttgtggcgtttttttttattcggtttttcgcgttttagtcgttcgtcgcgtttttttttttgttcgagtttttttattttttcgcgttttagtcgttgttcgagtttttttttttcgtt

SEQ ID NO: 31740 - DNA, 541 bp, Artificial Sequence
  chemically treated genomic DNA (Homo sapiens) CpG-island No: 31740
aacgaaaaaaaaaaactcgaacaacgactaaaacgcgaaaaaataaaaaaactcgaacaaaaaaaaaaacgcgacgaacgactaaaacgcgaaaaaccgaataaaaaaaaacgccacaactactaaaaaacgaaaaacaaaaaaaaaaacgccaacaacaactaaaacgcgaacaacaaaaaaaacgcgaacaacgactaaaacgcgaaaaaaaaaaaaaaaaactcgaacaacgactaaaacgcgaacataaaaaaaaaaaacgcgaacaaaaactaactaaaaaaaaacaaaaacaaacccgaaaacgaattaaaaaccgcatcccgaaataacaataacaactaaaaaacgaaaccgacgcacgacaaaacaaaatctactcgaaaccccgcaaacaaaaaaaacaaaaacgccgccaaaaacaaaaaaaaaaaaaacgacgccgaaaaaataaactacaataacaaaaaaaaaaacgaactcaccgacaacaacaaaaaaaaaaacaacgccgaaacttcacataacaataacaaac

SEQ ID NO: 31741 - DNA, 553 bp, Artificial Sequence
  chemically treated genomic DNA (Homo sapiens) CpG-island No: 31741
agcgggttagttatcggcgcggtagcggttgttattttttttttagaggtttttattagtgttttaatttgttttatatcgatgcggttatatagcgttttgaacggatttattttgtggtttagtagtcggttgttggatattattttaggttagtttcgtattgaggaatgtttttgtacgttcggttagtttcggtagtatcggttttaggtaagttattagtacgcggaataggttgatgtttattgagtaaattgtttgtaggtcggtatcgcggtttttttgtttcgttattatttacggagtttgtttatcgatatagcggttagttagattagttagcgttatgatttcgcgtacggttttattaaatttacggtttttttacgttttattaattattttagcggtattagtgaaggttttgtataattgcgggttagttagttcgtttgttagtacgtcgttaaaacgtttgttgataaagttcgtattacgggaggttaggttaattattttgttaacgatatcggtatttatacgttgaacg

SEQ ID NO: 31742 - DNA, 553 bp, Artificial Sequence
  chemically treated genomic DNA (Homo sapiens) CpG-island No: 31742
cgttcaacgtataaataccgatatcgttaacaaaataattaacctaacctcccgtaatacgaactttatcaacaaacgttttaacgacgtactaacaaacgaactaactaacccgcaattatacaaaaccttcactaataccgctaaaataattaataaaacgtaaaaaaaccgtaaatttaataaaaccgtacgcgaaatcataacgctaactaatctaactaaccgctatatcgataaacaaactccgtaaataataacgaaacaaaaaaaccgcgataccgacctacaaacaatttactcaataaacatcaacctattccgcgtactaataacttacctaaaaccgatactaccgaaactaaccgaacgtacaaaaacattcctcaatacgaaactaacctaaaataatatccaacaaccgactactaaaccacaaaataaatccgttcaaaacgctatataaccgcatcgatataaaacaaattaaaacactaataaaaacctctaaaaaaaaaataacaaccgctaccgcgccgataactaacccgct

SEQ ID NO: 31743 - DNA, 553 bp, Artificial Sequence
  chemically treated genomic DNA (Homo sapiens) CpG-island No: 31743
cgtttagcgtgtgaatgtcgatatcgttaataaagtggttaatttggtttttcgtaatgcgggttttattaataagcgttttgacggcgtgttggtaagcgaattggttgattcgtagttgtataaaatttttattgatgtcgttgaagtgattggtgaagcgtgggaaagtcgtgaatttggtaaagtcgtgcgcgaaattatggcgttggttgatttggttaatcgttatgtcgatgaataggtttcgtgggtggtggcgaaataggaaggtcgcgatgtcgatttgtaggtaatttgtttaatgggtattaatttgtttcgcgtgttgatgatttatttgaagtcggtattgtcgaaattgatcgagcgtgtagaagtattttttaatacggaattgatttgggatggtatttagtaatcgattgttgggttataaagtgaattcgtttaaggcgttgtataatcgtatcgatatgaggtaggttgaagtattggtggaagtttttaaagaagaagtaatagtcgttgtcgcgtcggtaattggttcgtt

SEQ ID NO: 31744 - DNA, 553 bp, Artificial Sequence
  chemically treated genomic DNA (Homo sapiens) CpG-island No: 31744
aacgaaccaattaccgacgcgacaacgactattacttcttctttaaaaacttccaccaatacttcaacctacctcatatcgatacgattatacaacgccttaaacgaattcactttataacccaacaatcgattactaaataccatcccaaatcaattccgtattaaaaaatacttctacacgctcgatcaatttcgacaataccgacttcaaataaatcatcaacacgcgaaacaaattaatacccattaaacaaattacctacaaatcgacatcgcgaccttcctatttcgccaccacccacgaaacctattcatcgacataacgattaaccaaatcaaccaacgccataatttcgcgcacgactttaccaaattcacgactttcccacgcttcaccaatcacttcaacgacatcaataaaaattttatacaactacgaatcaaccaattcgcttaccaacacgccgtcaaaacgcttattaataaaacccgcattacgaaaaaccaaattaaccactttattaacgatatcgacattcacacgctaaacg

SEQ ID NO: 31745 - DNA, 1007 bp, Artificial Sequence
  chemically treated genomic DNA (Homo sapiens) CpG-island No: 31745
cgggcgtgcgtacgaggagtaggtgttcgggcgagtttcgagttgtacgttttcgagttcggtttcggttgtttagggcgaagtacgggttttcgtagtcgtgtttgcgtcgattcgttttttttttaatttttatttttgggcgcgtcgtttcggggcgtgttttgggttatttcggtttttatatagcggtcggcgcgttcgggtcgtttagatgcgagtattgcggttgggcgttgaggattagtcgttttttgtttggattttatagtttcgcgtcgtgtattgtcgttttatttttgcgcgtttagtttgttaagtagcgtgtttcggttgtaggcgttatgtagcgggcgcgatttacgttttgggtcgttgcgttgattttgttggtgttgtttcgcgggtcgtcggtggcgcgggttggcgcgagttcggcgggtttgggtttcgtggtgcgttgcgagtcgtgcgacgcgcgtgtattggtttagtgcgcgttttcgttcgtcgtgtgcgcggagttggtgcgcgagtcgggttgcggttgttgtttgacgtgcgtattgagcgagggttagtcgtgcggtatttatatcgagcgttgtggtttcggttttcgttgttagtcgtcgttcgacgaggcgcgatcgttgtaggcgttgttggacggtcgcgggttttgcgttaacgttagtgtcgttagtcgtttgcgcgtttatttgttgttagcgtcgttagttttaggtgagtcgttcgcgttaggtgcgttgcgtgtagtattcggcgtattggcgtcgaagggtttgggggttgttgggtgtcgttgcgggagatttcgtttttttttttattggagataatatgtggggaaattgaaggcgtttcgggaaaggtgaaggcggtcgtcggagggattttttttagtcggttttttatttgttcgattttttaagtgtagagtatttgtaaattgtaaagcgtttttagtgaaaatgggttaaagg

SEQ ID NO: 31746 - DNA, 1007 bp, Artificial Sequence
  chemically treated genomic DNA (Homo sapiens) CpG-island No: 31746
cctttaacccattttcactaaaaacgctttacaatttacaaatactctacacttaaaaaatcgaacaaataaaaaaccgactaaaaaaaatccctccgacgaccgccttcacctttcccgaaacgccttcaatttccccacatattatctccaataaaaaaaaaaacgaaatctcccgcaacgacacccaacaacccccaaacccttcgacgccaatacgccgaatactacacgcaacgcacctaacgcgaacgactcacctaaaactaacgacgctaacaacaaataaacgcgcaaacgactaacgacactaacgttaacgcaaaacccgcgaccgtccaacaacgcctacaacgatcgcgcctcgtcgaacgacgactaacaacgaaaaccgaaaccacaacgctcgatataaataccgcacgactaaccctcgctcaatacgcacgtcaaacaacaaccgcaacccgactcgcgcaccaactccgcgcacacgacgaacgaaaacgcgcactaaaccaatacacgcgcgtcgcacgactcgcaacgcaccacgaaacccaaacccgccgaactcgcgccaacccgcgccaccgacgacccgcgaaacaacaccaacaaaatcaacgcaacgacccaaaacgtaaatcgcgcccgctacataacgcctacaaccgaaacacgctacttaacaaactaaacgcgcaaaaataaaacgacaatacacgacgcgaaactataaaatccaaacaaaaaacgactaatcctcaacgcccaaccgcaatactcgcatctaaacgacccgaacgcgccgaccgctatataaaaaccgaaataacccaaaacacgccccgaaacgacgcgcccaaaaataaaaattaaaaaaaaaacgaatcgacgcaaacacgactacgaaaacccgtacttcgccctaaacaaccgaaaccgaactcgaaaacgtacaactcgaaactcgcccgaacacctactcctcgtacgcacgcccg

SEQ ID NO: 31747 - DNA, 1007 bp, Artificial Sequence
  chemically treated genomic DNA (Homo sapiens) CpG-island No: 31747
tttttaatttatttttattgaaagcgttttgtaatttataagtattttgtatttagagaatcgagtaagtagagggtcggttggggagggttttttcggcgatcgtttttatttttttcggagcgtttttagtttttttatatattatttttagtgagaagaaaagcggagtttttcgtagcggtatttagtaatttttaggtttttcggcgttagtgcgtcgggtgttgtacgtagcgtatttggcgcgggcggtttatttggagttggcggcgttggtagtaggtaggcgcgtaggcggttgacggtattagcgttgacgtagagttcgcggtcgtttagtagcgtttgtagcggtcgcgtttcgtcgggcgacggttggtagcgaaggtcggagttatagcgttcggtgtagatgtcgtacggttggttttcgtttagtgcgtacgttaggtagtagtcgtagttcggttcgcgtattagtttcgcgtatacggcgggcggaggcgcgtattgggttagtgtacgcgcgtcgtacggttcgtagcgtattacgggatttaagttcgtcgagttcgcgttagttcgcgttatcggcggttcgcggagtagtattagtagagttagcgtagcggtttagagcgtgggtcgcgttcgttgtatgacgtttgtaatcggggtacgttgtttggtaggttgggcgcgtagggatggggcgatagtatacggcgcgaagttgtggaatttaggtaggaagcggttgatttttagcgtttagtcgtagtgttcgtatttgggcggttcgggcgcgtcggtcgttatatagaagtcggggtggtttaggatacgtttcggaacggcgcgtttaggagtgggggttgggaggggggcgggtcggcgtaggtacggttgcgggggttcgtgtttcgttttgagtagtcggggtcgagttcgggggcgtgtagttcgagattcgttcgggtatttgtttttcgtgcgtacgttcg

SEQ ID NO: 31748 - DNA, 1007 bp, Artificial Sequence
  chemically treated genomic DNA (Homo sapiens) CpG-island No: 31748
cgaacgtacgcacgaaaaacaaatacccgaacgaatctcgaactacacgcccccgaactcgaccccgactactcaaaacgaaacacgaacccccgcaaccgtacctacgccgacccgcccccctcccaacccccactcctaaacgcgccgttccgaaacgtatcctaaaccaccccgacttctatataacgaccgacgcgcccgaaccgcccaaatacgaacactacgactaaacgctaaaaatcaaccgcttcctacctaaattccacaacttcgcgccgtatactatcgccccatccctacgcgcccaacctaccaaacaacgtaccccgattacaaacgtcatacaacgaacgcgacccacgctctaaaccgctacgctaactctactaatactactccgcgaaccgccgataacgcgaactaacgcgaactcgacgaacttaaatcccgtaatacgctacgaaccgtacgacgcgcgtacactaacccaatacgcgcctccgcccgccgtatacgcgaaactaatacgcgaaccgaactacgactactacctaacgtacgcactaaacgaaaaccaaccgtacgacatctacaccgaacgctataactccgaccttcgctaccaaccgtcgcccgacgaaacgcgaccgctacaaacgctactaaacgaccgcgaactctacgtcaacgctaataccgtcaaccgcctacgcgcctacctactaccaacgccgccaactccaaataaaccgcccgcgccaaatacgctacgtacaacacccgacgcactaacgccgaaaaacctaaaaattactaaataccgctacgaaaaactccgcttttcttctcactaaaaataatatataaaaaaactaaaaacgctccgaaaaaaataaaaacgatcgccgaaaaaaccctccccaaccgaccctctacttactcgattctctaaatacaaaatacttataaattacaaaacgctttcaataaaaataaattaaaaa

SEQ ID NO: 31749 - DNA, 1118 bp, Artificial Sequence
  chemically treated genomic DNA (Homo sapiens) CpG-island No: 31749
tgcgggaggagggttcggggaagggtgcgagtcgagttcgaggcgtacggcgagttttgtgggagtgggggacgcgggggcggttttggtttcgtcgcggtatttggatttttatttttcgaggtgagtatttgggggtcgagggcgtagagcgatcgtattttgaatggagtttagggtagttagcgatttgtttcgtggttcgtagtcgttatcgtttcggggcggtcgtttaggcgggtttcgacgcggttcgcgggagttcggggtgttttcgttcgtcgttgttattttgtcgtcgagggtttttttagcgattagtaacgttcgtttttattggtttttgtcgtaagggggggtgtggttacgggtttagtttttgagttcgcgtaatttttggagcgaagttagtcgggttcggagttagaggacgtagttgcgtttgtgcgcgttttcgtcgttgtcgtttttttcgtcgggaggttcgttcgttaacggtttgcgcgtttgcgtcggaagcggaaatggttggagtttttggtttcgttttcgcgttattttgggggttttggaggcggcgtcgcggaggacggagcggaagtgttcgttgtagtttttcggagtcggagcgtagcgtttgcggtcgttcgtgtttcgtcgttttttttttcgcggtcgtgagggagatcgcggttcggtcgtagcggagttgcgaggtgttaggaagggttgcgtggcgcgggaacggtcgggtagcgtcgttttcgtttttttcgggttgttaaggtcgcgggcgggcggggtcgcgttgagggtcgggcggggagggtcgtcggggttcgggtggtcgcggggatcgtgttttcgattcgcggttttgaggggtacgggtcgcgtttcggggtcgggttcgggacggggtgttggggggtgcggcggagttttggggtttgcgagggtcgggggagcgggagaggggtcgggcgggggttgtagttttcgagttattcgggtcgtatttcgttcgtattttttgtttggtatttgggggaagcgggtagtcgcggtttttatagcgttgcgagttgggttgtattttagagtaatgtgttttgttt

SEQ ID NO: 31750 - DNA, 1118 bp, Artificial Sequence
  chemically treated genomic DNA (Homo sapiens) CpG-island No: 31750
aaacaaaacacattactctaaaatacaacccaactcgcaacgctataaaaaccgcgactacccgcttcccccaaataccaaacaaaaaatacgaacgaaatacgacccgaataactcgaaaactacaacccccgcccgacccctctcccgctcccccgaccctcgcaaaccccaaaactccgccgcaccccccaacaccccgtcccgaacccgaccccgaaacgcgacccgtacccctcaaaaccgcgaatcgaaaacacgatccccgcgaccacccgaaccccgacgaccctccccgcccgaccctcaacgcgaccccgcccgcccgcgaccttaacaacccgaaaaaaacgaaaacgacgctacccgaccgttcccgcgccacgcaacccttcctaacacctcgcaactccgctacgaccgaaccgcgatctccctcacgaccgcgaaaaaaaaaacgacgaaacacgaacgaccgcaaacgctacgctccgactccgaaaaactacaacgaacacttccgctccgtcctccgcgacgccgcctccaaaacccccaaaataacgcgaaaacgaaaccaaaaactccaaccatttccgcttccgacgcaaacgcgcaaaccgttaacgaacgaacctcccgacgaaaaaaacgacaacgacgaaaacgcgcacaaacgcaactacgtcctctaactccgaacccgactaacttcgctccaaaaattacgcgaactcaaaaactaaacccgtaaccacacccccccttacgacaaaaaccaataaaaacgaacgttactaatcgctaaaaaaaccctcgacgacaaaataacaacgacgaacgaaaacaccccgaactcccgcgaaccgcgtcgaaacccgcctaaacgaccgccccgaaacgataacgactacgaaccacgaaacaaatcgctaactaccctaaactccattcaaaatacgatcgctctacgccctcgacccccaaatactcacctcgaaaaataaaaatccaaataccgcgacgaaaccaaaaccgcccccgcgtcccccactcccacaaaactcgccgtacgcctcgaactcgactcgcacccttccccgaaccctcctcccgca

SEQ ID NO: 31751 - DNA, 1118 bp, Artificial Sequence
  chemically treated genomic DNA (Homo sapiens) CpG-island No: 31751
ggatagggtatattattttggaatatagtttaattcgtagcgttgtgggggtcgcgattgttcgttttttttagatgttaagtaggggatgcggacgagatgcggttcgggtggttcgagggttgtagttttcgttcggtttttttttcgttttttcgattttcgtaggttttagggtttcgtcgtattttttagtatttcgtttcgggttcgatttcgaggcgcgattcgtgttttttagggtcgcgggtcgggaatacggttttcgcggttattcgggtttcgacggtttttttcgttcggtttttagcgcggtttcgttcgttcgcggttttgatagttcggaagaagcggaggcggcgttgttcggtcgttttcgcgttacgtagttttttttggtatttcgtagtttcgttacggtcgagtcgcggttttttttacggtcgcgggaaggaggacggcggggtacgggcggtcgtaggcgttgcgtttcggtttcgggaagttgtagcgagtattttcgtttcgtttttcgcggcgtcgtttttagggtttttaagatggcgcgagggcggggttaagggttttaattattttcgttttcggcgtagacgcgtaggtcgttggcgggcgggtttttcggcggaagagacgatagcggcggaaacgcgtataggcgtagttgcgttttttggtttcgggttcggttagtttcgttttagagattgcgcgggtttagggattaggttcgtggttatatttttttttgcgataaagattaatggaagcgggcgttgttggtcgttaagagaattttcggcggtaagatggtagcggcgggcgagggtatttcgagttttcgcgggtcgcgtcgggattcgtttaggcggtcgtttcggaacggtaacgattgcgggttacgggataggtcgttggttgttttgggttttatttagggtgcgatcgttttacgttttcgatttttaaatgtttatttcggaaagtagaggtttaggtgtcgcggcggagttagggtcgttttcgcgttttttatttttataggattcgtcgtgcgtttcgggttcggttcgtattttttttcgagtttttttttcgta

SEQ ID NO: 31752 - DNA, 1118 bp, Artificial Sequence
  chemically treated genomic DNA (Homo sapiens) CpG-island No: 31752
tacgaaaaaaaaactcgaaaaaaaatacgaaccgaacccgaaacgcacgacgaatcctataaaaataaaaaacgcgaaaacgaccctaactccgccgcgacacctaaacctctactttccgaaataaacatttaaaaatcgaaaacgtaaaacgatcgcaccctaaataaaacccaaaacaaccaacgacctatcccgtaacccgcaatcgttaccgttccgaaacgaccgcctaaacgaatcccgacgcgacccgcgaaaactcgaaataccctcgcccgccgctaccatcttaccgccgaaaattctcttaacgaccaacaacgcccgcttccattaatctttatcgcaaaaaaaaatataaccacgaacctaatccctaaacccgcgcaatctctaaaacgaaactaaccgaacccgaaaccaaaaaacgcaactacgcctatacgcgtttccgccgctatcgtctcttccgccgaaaaacccgcccgccaacgacctacgcgtctacgccgaaaacgaaaataattaaaacccttaaccccgccctcgcgccatcttaaaaaccctaaaaacgacgccgcgaaaaacgaaacgaaaatactcgctacaacttcccgaaaccgaaacgcaacgcctacgaccgcccgtaccccgccgtcctccttcccgcgaccgtaaaaaaaaccgcgactcgaccgtaacgaaactacgaaataccaaaaaaaactacgtaacgcgaaaacgaccgaacaacgccgcctccgcttcttccgaactatcaaaaccgcgaacgaacgaaaccgcgctaaaaaccgaacgaaaaaaaccgtcgaaacccgaataaccgcgaaaaccgtattcccgacccgcgaccctaaaaaacacgaatcgcgcctcgaaatcgaacccgaaacgaaatactaaaaaatacgacgaaaccctaaaacctacgaaaatcgaaaaaacgaaaaaaaaaccgaacgaaaactacaaccctcgaaccacccgaaccgcatctcgtccgcatcccctacttaacatctaaaaaaaacgaacaatcgcgacccccacaacgctacgaattaaactatattccaaaataatataccctatcc

SEQ ID NO: 31753 - DNA, 1442 bp, Artificial Sequence
  chemically treated genomic DNA (Homo sapiens) CpG-island No: 31753
ttgaagattttcgttatcgtttgttttttcgggtattttttttttgaagattttcgttatcgtttgttttttcgggcgttttttttttgaagattttcgttatcgtttgttttttcgggcgttttttttttgaagattttcgttatcgtttgttttttcgggcgttttttttttgaagattttcgttatcgtttgttttttcgggcgttttttttgtgaagattttcgttatcgtttgtttttttaggcgttttttttttgaagattttcgttatcgtttgttttttcgggtattttttttttgaagattttcgttatcgtttgttttttcgggcgttttttttttgaagattttcgttatcgtttgttttttcgggcgttttttttttgaagattttcgttatcgtttgttttttcgggcgttttttttttgaagatttttattatcgtttgttttttcgggcgttttttttttgaagattttcgttatcgtttgttttttcgggtattttttttttgaagattttcgtcgtcgtttgttttttcgggcgttttttttttgaagattttcgttatcgtttgttttttcgggtatttttttttttgaagattttcgttatcgtttgttttttcgggcgttttttttttgaagattttcgttatcgtttgttttttcgggtatttttttttttgaagattttcgttatcgtttgttttttcgggcgttttttttatgaagattttcgttatcgtttgttttttcgggcgttttttttttgaagattttcgttatcgtttgttttttcgggtattttttttttgaagattttcgtcgtcgtttgttttttcgggcgttcgttttttgaagatcgtcgtcgtcgtttgttttttcgggcgttttttttttgaagatcgtcgtcgtcgtttgttttttcgggcgttttttttttgaagatcgtcgtcgtcgtttgttttttcgggcgttttttttttgaagatcgtcgtcgtcgtttgttttttcgggcgttttttttttgaagatcgtcgtcgtcgtttgttttttcgggcgttttttttttgaagatcgtcgtcgtcgtttgttttttcgggcgttttttttttgaagattttcgttatcgtttgttttttcgggcgttttttttttgaagattttcgttatcgtttgttttttcgggtatttttttttttgaagatcgtcgtcgtcgtttgttttttcgggcgttttttttttgaagatcgtcgtcgtcgtttgttttttcgggtgttttttttttgaagatcgtcgtcgtcgtttgttttttcgggtattttttttttgaagatcgtcgtcgtcgtttgtttttttaggtgtttttaggtttttttttaaaaggtgtgtggcgggtaagggaagatttttagaagtggttttttttaagatt

SEQ ID NO: 31754 - DNA, 1442 bp, Artificial Sequence
  chemically treated genomic DNA (Homo sapiens) CpG-island No: 31754
aatcttaaaaaaaaccacttctaaaaatcttcccttacccgccacacaccttttaaaaaaaaacctaaaaacacctaaaaaaacaaacgacgacgacgatcttcaaaaaaaaaatacccgaaaaaacaaacgacgacgacgatcttcaaaaaaaaaacacccgaaaaaacaaacgacgacgacgatcttcaaaaaaaaaacgcccgaaaaaacaaacgacgacgacgatcttcaaaaaaaaaaatacccgaaaaaacaaacgataacgaaaatcttcaaaaaaaaaacgcccgaaaaaacaaacgataacgaaaatcttcaaaaaaaaaacgcccgaaaaaacaaacgacgacgacgatcttcaaaaaaaaaacgcccgaaaaaacaaacgacgacgacgatcttcaaaaaaaaaacgcccgaaaaaacaaacgacgacgacgatcttcaaaaaaaaaacgcccgaaaaaacaaacgacgacgacgatcttcaaaaaaaaaacgcccgaaaaaacaaacgacgacgacgatcttcaaaaaaaaaacgcccgaaaaaacaaacgacgacgacgatcttcaaaaaacgaacgcccgaaaaaacaaacgacgacgaaaatcttcaaaaaaaaaatacccgaaaaaacaaacgataacgaaaatcttcaaaaaaaaaacgcccgaaaaaacaaacgataacgaaaatcttcataaaaaaaacgcccgaaaaaacaaacgataacgaaaatcttcaaaaaaaaaaatacccgaaaaaacaaacgataacgaaaatcttcaaaaaaaaaacgcccgaaaaaacaaacgataacgaaaatcttcaaaaaaaaaaatacccgaaaaaacaaacgataacgaaaatcttcaaaaaaaaaacgcccgaaaaaacaaacgacgacgaaaatcttcaaaaaaaaaatacccgaaaaaacaaacgataacgaaaatcttcaaaaaaaaaacgcccgaaaaaacaaacgataataaaaatcttcaaaaaaaaaacgcccgaaaaaacaaacgataacgaaaatcttcaaaaaaaaaacgcccgaaaaaacaaacgataacgaaaatcttcaaaaaaaaaacgcccgaaaaaacaaacgataacgaaaatcttcaaaaaaaaaatacccgaaaaaacaaacgataacgaaaatcttcaaaaaaaaaacgcctaaaaaaacaaacgataacgaaaatcttcacaaaaaaaacgcccgaaaaaacaaacgataacgaaaatcttcaaaaaaaaaacgcccgaaaaaacaaacgataacgaaaatcttcaaaaaaaaaacgcccgaaaaaacaaacgataacgaaaatcttcaaaaaaaaaacgcccgaaaaaacaaacgataacgaaaatcttcaaaaaaaaaatacccgaaaaaacaaacgataacgaaaatcttcaa

SEQ ID NO: 31755 - DNA, 1442 bp, Artificial Sequence
  chemically treated genomic DNA (Homo sapiens) CpG-island No: 31755
ggttttggaaagagttatttttgggagtttttttttattcgttatatattttttaaagagaaatttgaagatatttgagaagataggcggcggcggcgatttttagagagaagatgttcgagaagataggcggcggcggcgatttttagagagaggatattcgagaagataggcggcggcggcgatttttagagagaggacgttcgagaagataggcggcggcggcgatttttagagagagagatgttcgagaagataggcggtggcggagatttttagagagaggacgttcgagaagataggcggtggcggagatttttagagagaggacgttcgagaagataggcggcggcggcgatttttagagagaggacgttcgagaagataggcggcggcggcgatttttagagagaggacgttcgagaagataggcggcggcggcgatttttagagagaggacgttcgagaagataggcggcggcggcgatttttagagagaggacgttcgagaagataggcggcggcggcgatttttagagagaggacgttcgagaagataggcggcggcggcgatttttagagagcggacgttcgagaagataggcggcggcggagatttttagagagaggatgttcgagaagataggcggtggcggagatttttagagagaggacgttcgagaggataggcggtggcggagatttttatagagaggacgttcgagaagataggcggtggcggagatttttagagagagagatgttcgagaagataggcggtggcggagatttttagagagaggacgttcgagaagataggcggtggcggagatttttagagagagagatgttcgagaagataggcggtggcggagatttttagagagaggacgttcgagaagataggcggcggcggagatttttaaagagaggatgttcgagaagataggcggtggcggagatttttaaagagaggacgttcgaaaggataggcggtggtggagatttttagagagaggacgttcgagaagataggcggtggcggagatttttagagagaggacgttcgagaagataggcggtggcggagatttttagagagaggacgttcgagaagataggcggtggcggagatttttagagagaggatgttcgaaaagataggcggtggcggagatttttaaagagaggacgtttgagaagataggcggtggcggagatttttatagagaggacgttcgagaagataggcggtggcggagatttttagagagaggacgttcgagaagataggcggtggcggagatttttagagagaggacgttcgagaagataggcggtggcggagatttttagagagaggacgttcgagaagataggcggtggcggagatttttagagagaggatgttcgagaagataggcggtggcggagatttttag

SEQ ID NO: 31756 - DNA, 1442 bp, Artificial Sequence
  chemically treated genomic DNA (Homo sapiens) CpG-island No: 31756
ctaaaaatctccgccaccgcctatcttctcgaacatcctctctctaaaaatctccgccaccgcctatcttctcgaacgtcctctctctaaaaatctccgccaccgcctatcttctcgaacgtcctctctctaaaaatctccgccaccgcctatcttctcgaacgtcctctctctaaaaatctccgccaccgcctatcttctcgaacgtcctctctataaaaatctccgccaccgcctatcttctcaaacgtcctctctttaaaaatctccgccaccgcctatcttttcgaacatcctctctctaaaaatctccgccaccgcctatcttctcgaacgtcctctctctaaaaatctccgccaccgcctatcttctcgaacgtcctctctctaaaaatctccgccaccgcctatcttctcgaacgtcctctctctaaaaatctccaccaccgcctatcctttcgaacgtcctctctttaaaaatctccgccaccgcctatcttctcgaacatcctctctttaaaaatctccgccgccgcctatcttctcgaacgtcctctctctaaaaatctccgccaccgcctatcttctcgaacatctctctctctaaaaatctccgccaccgcctatcttctcgaacgtcctctctctaaaaatctccgccaccgcctatcttctcgaacatctctctctctaaaaatctccgccaccgcctatcttctcgaacgtcctctctataaaaatctccgccaccgcctatcctctcgaacgtcctctctctaaaaatctccgccaccgcctatcttctcgaacatcctctctctaaaaatctccgccgccgcctatcttctcgaacgtccgctctctaaaaatcgccgccgccgcctatcttctcgaacgtcctctctctaaaaatcgccgccgccgcctatcttctcgaacgtcctctctctaaaaatcgccgccgccgcctatcttctcgaacgtcctctctctaaaaatcgccgccgccgcctatcttctcgaacgtcctctctctaaaaatcgccgccgccgcctatcttctcgaacgtcctctctctaaaaatcgccgccgccgcctatcttctcgaacgtcctctctctaaaaatctccgccaccgcctatcttctcgaacgtcctctctctaaaaatctccgccaccgcctatcttctcgaacatctctctctctaaaaatcgccgccgccgcctatcttctcgaacgtcctctctctaaaaatcgccgccgccgcctatcttctcgaatatcctctctctaaaaatcgccgccgccgcctatcttctcgaacatcttctctctaaaaatcgccgccgccgcctatcttctcaaatatcttcaaatttctctttaaaaaatatataacgaataaaaaaaaactcccaaaaataactctttccaaaacc

SEQ ID NO: 31757 - DNA, 927 bp, Artificial Sequence
  chemically treated genomic DNA (Homo sapiens) CpG-island No: 31757
tatttcggtcgggagttggcggttaagttcgcggtataaggagttagggacgttagttttttagttcgcgtttgtatttcggggtggtataaataggatgttagatagcgcgtttcgggtttgtttatgaaaatttgtcgtgcgcgttgggggagggggcggtttggtttaatcgtttttttttcggtcgggggttttcgttcggcgattttttcgtcgttcgtcggtttcgcggggttggaaattttcgtttttttcgttcgagtcgcggggttttgagttgcgtttaggagtagttcgggtcgcgtagtttaaggatcgattaagagcggtggtcgcgttttcggttagttcgggttgcgcgtttttcgtttgtcgatcgcggtcgtttcggtttttttatttttttcggtgatatttattattttcgtgtgcgtttgggttaggtagcgtttcgtcgttgcgttggttggggtcgatcggtaggttcgttaggcggttagtttcgcggggttttagcgtgcgcgcgtttagggttgaggaggggtcgcggcgaggatagtcgggattgggcgtaggttcgtattgtttgtagttttaggatatttcgcggtcgtcgcggtttgcgtttagcgacgtatcgtttttcgtttcgtttcgtttcgtttcgcggtcggttttattttcgtggtcgtcgggtttattttttcgcgacgttattagcggtagtttcggaaagcggggcggggtcgcggtttcggcggagattttgcgttttcggtttattcgtttcgtttttattcggtttcgttcgcgaagttgtttttattcgtttttgtttatcgcgttttttagattttagaatttagaaatttatttaggacgcgaggttatttatcgcggggagtaaaattgttaggattcgtt

SEQ ID NO: 31758 - DNA, 927 bp, Artificial Sequence
  chemically treated genomic DNA (Homo sapiens) CpG-island No: 31758
aacgaatcctaacaattttactccccgcgataaataacctcgcgtcctaaataaatttctaaattctaaaatctaaaaaacgcgataaacaaaaacgaataaaaacaacttcgcgaacgaaaccgaataaaaacgaaacgaataaaccgaaaacgcaaaatctccgccgaaaccgcgaccccgccccgctttccgaaactaccgctaataacgtcgcgaaaaaataaacccgacgaccacgaaaataaaaccgaccgcgaaacgaaacgaaacgaaacgaaaaacgatacgtcgctaaacgcaaaccgcgacgaccgcgaaatatcctaaaactacaaacaatacgaacctacgcccaatcccgactatcctcgccgcgacccctcctcaaccctaaacgcgcgcacgctaaaaccccgcgaaactaaccgcctaacgaacctaccgatcgaccccaaccaacgcaacgacgaaacgctacctaacccaaacgcacacgaaaataataaatatcaccgaaaaaaataaaaaaaccgaaacgaccgcgatcgacaaacgaaaaacgcgcaacccgaactaaccgaaaacgcgaccaccgctcttaatcgatccttaaactacgcgacccgaactactcctaaacgcaactcaaaaccccgcgactcgaacgaaaaaaacgaaaatttccaaccccgcgaaaccgacgaacgacgaaaaaatcgccgaacgaaaacccccgaccgaaaaaaaaacgattaaaccaaaccgccccctcccccaacgcgcacgacaaattttcataaacaaacccgaaacgcgctatctaacatcctatttataccaccccgaaatacaaacgcgaactaaaaaactaacgtccctaactccttataccgcgaacttaaccgccaactcccgaccgaaata

SEQ ID NO: 31759 - DNA, 927 bp, Artificial Sequence
  chemically treated genomic DNA (Homo sapiens) CpG-island No: 31759
ggcgaattttggtaattttatttttcgcgatagatgatttcgcgttttagatgagtttttagattttagaatttagaggacgcggtgaatagagacgagtgggggtagtttcgcgagcgaagtcggatgggggcggggcgggtaggtcggaggcgtaaagttttcgtcgggatcgcgatttcgtttcgtttttcggggttgtcgttggtgacgtcgcgagggggtgggttcggcggttacgggggtggggtcggtcgcggggcggggcggggcgggacgggaggcggtgcgtcgttgagcgtaggtcgcggcggtcgcggagtattttggagttgtagatagtgcgggtttgcgtttagtttcggttgttttcgtcgcgatttttttttagttttgggcgcgcgtacgttggggtttcgcggggttggtcgtttagcgagtttgtcggtcgattttagttagcgtagcgacggggcgttgtttggtttaggcgtatacggaagtggtgagtgttatcgggggaggtggaggagtcggggcggtcgcggtcggtaggcgaggggcgcgtagttcggattggtcggaggcgcggttatcgtttttggtcggtttttaggttgcgcggttcgggttgtttttgagcgtagtttaggatttcgcggttcgggcggggaaggcggggatttttagtttcgcggagtcggcgggcggcgaggaggtcgtcgggcgggggttttcggtcgggagaagagcggttaagttaggtcgtttttttttttagcgcgtacggtaagtttttataaataagttcggagcgcgttgtttgatattttgtttatattatttcgagatataggcgcgggttggagggttgacgtttttagttttttgtatcgcgaatttgatcgttagttttcggtcggggtg

SEQ ID NO: 31760 - DNA, 927 bp, Artificial Sequence
  chemically treated genomic DNA (Homo sapiens) CpG-island No: 31760
caccccgaccgaaaactaacgatcaaattcgcgatacaaaaaactaaaaacgtcaaccctccaacccgcgcctatatctcgaaataatataaacaaaatatcaaacaacgcgctccgaacttatttataaaaacttaccgtacgcgctaaaaaaaaaaacgacctaacttaaccgctcttctcccgaccgaaaacccccgcccgacgacctcctcgccgcccgccgactccgcgaaactaaaaatccccgccttccccgcccgaaccgcgaaatcctaaactacgctcaaaaacaacccgaaccgcgcaacctaaaaaccgaccaaaaacgataaccgcgcctccgaccaatccgaactacgcgcccctcgcctaccgaccgcgaccgccccgactcctccacctcccccgataacactcaccacttccgtatacgcctaaaccaaacaacgccccgtcgctacgctaactaaaatcgaccgacaaactcgctaaacgaccaaccccgcgaaaccccaacgtacgcgcgcccaaaactaaaaaaaaatcgcgacgaaaacaaccgaaactaaacgcaaacccgcactatctacaactccaaaatactccgcgaccgccgcgacctacgctcaacgacgcaccgcctcccgtcccgccccgccccgccccgcgaccgaccccacccccgtaaccgccgaacccaccccctcgcgacgtcaccaacgacaaccccgaaaaacgaaacgaaatcgcgatcccgacgaaaactttacgcctccgacctacccgccccgcccccatccgacttcgctcgcgaaactacccccactcgtctctattcaccgcgtcctctaaattctaaaatctaaaaactcatctaaaacgcgaaatcatctatcgcgaaaaataaaattaccaaaattcgcc

SEQ ID NO: 31761 - DNA, 531 bp, Artificial Sequence
  chemically treated genomic DNA (Homo sapiens) CpG-island No: 31761
ggtttcgtttttttagtcggagtcgcgattggtgggtatttgtcggcggttatcgtttttaagttacgattggcgaaggtcgtcgttatttcggagcgatttagcgtttgttcgttttttcgtcgcgtcgtcggtgtttgcgtttttcgttttatttcgttttttttttttcggtcgaggttcgggggattagagcgagaagcggggattatgtttcgacgtaagttgacggttttcgattattataatttcgtcggttttaattgtaaaggtgaggcggcggttttagttcggtcgcgtgtttttgatttgggcggaggttttagttttagtgttcgtattttattttttcgtcgggattttcggcggtttggttttcgtcggtagttttcgggttttttttttttgggtcgttacgtatttcggtttttcgtcgttttttttcgtttttaaagtttttttatttatttttgtttcggtatgttattttttgtatttgtttaattttaagtattacgtaattattttttt

SEQ ID NO: 31762 - DNA, 531 bp, Artificial Sequence
  chemically treated genomic DNA (Homo sapiens) CpG-island No: 31762
aaaaaaataattacgtaatacttaaaattaaacaaatacaaaaaataacataccgaaacaaaaataaataaaaaaactttaaaaacgaaaaaaaacgacgaaaaaccgaaatacgtaacgacccaaaaaaaaaaaacccgaaaactaccgacgaaaaccaaaccgccgaaaatcccgacgaaaaaataaaatacgaacactaaaactaaaacctccgcccaaatcaaaaacacgcgaccgaactaaaaccgccgcctcacctttacaattaaaaccgacgaaattataataatcgaaaaccgtcaacttacgtcgaaacataatccccgcttctcgctctaatcccccgaacctcgaccgaaaaaaaaaaaacgaaataaaacgaaaaacgcaaacaccgacgacgcgacgaaaaaacgaacaaacgctaaatcgctccgaaataacgacgaccttcgccaatcgtaacttaaaaacgataaccgccgacaaatacccaccaatcgcgactccgactaaaaaaacgaaacc

SEQ ID NO: 31763 - DNA, 531 bp, Artificial Sequence
  chemically treated genomic DNA (Homo sapiens) CpG-island No: 31763
gagaaggtagttacgtgatgtttggagttaagtaagtgtagaaagtaatatgtcgagataggagtaggtgagagggttttaaaggcgggaaggggcggcgaagagtcgaggtacgtggcgatttagaggagaggggttcggaggttgtcggcggaaattaggtcgtcgagggtttcgacggggaggtggggtgcgggtattgaggttgggattttcgtttaggttagggatacgcggtcgggttgaggtcgtcgttttatttttgtagttgaagtcggcggggttgtggtagtcgagagtcgttaatttgcgtcggaatatggttttcgtttttcgttttggtttttcgggtttcggtcgggagagaagaagcgaggtggagcgggaggcgtaggtatcggcgacgcggcgagagggcgggtaggcgttgagtcgtttcgaaatgacggcggttttcgttaatcgtggtttaaaagcggtggtcgtcggtaaatgtttattaatcgcggtttcggttggggaggcggggtt

SEQ ID NO: 31764 - DNA, 531 bp, Artificial Sequence
  chemically treated genomic DNA (Homo sapiens) CpG-island No: 31764
aaccccgcctccccaaccgaaaccgcgattaataaacatttaccgacgaccaccgcttttaaaccacgattaacgaaaaccgccgtcatttcgaaacgactcaacgcctacccgccctctcgccgcgtcgccgatacctacgcctcccgctccacctcgcttcttctctcccgaccgaaacccgaaaaaccaaaacgaaaaacgaaaaccatattccgacgcaaattaacgactctcgactaccacaaccccgccgacttcaactacaaaaataaaacgacgacctcaacccgaccgcgtatccctaacctaaacgaaaatcccaacctcaatacccgcaccccacctccccgtcgaaaccctcgacgacctaatttccgccgacaacctccgaacccctctcctctaaatcgccacgtacctcgactcttcgccgccccttcccgcctttaaaaccctctcacctactcctatctcgacatattactttctacacttacttaactccaaacatcacgtaactaccttctc

SEQ ID NO: 31765 - DNA, 589 bp, Artificial Sequence
  chemically treated genomic DNA (Homo sapiens) CpG-island No: 31765
cgtttcgttggaggcggaatggagggtaaggcgaaggaggatggtgtaggaaacggcgataaggcgttcggttaggttcgcgagttatcgagattcgggttttaatttttttttttttcgtaaacgttcgggttcgaggtatttggcgggtaagggtcgtagcggagcgaagcgggttggttatggggaggttgcggggacgcggggttgtagagagcggtagtggtacggagcgcgcggttggaagcgaaagtaggcggtgtggttaagtttcggcgtacggtttatagggcgttgggtattacgatttggggtcgcgcgttagggttaggcgtagggtacgacgtaatttttttagtattttttggggaggagtttttaatcgtttcgttttagtttgtttgtagtcgttaaaatcgaagcggttgtttttgttatcggggtcgtttgcggaggttcgagaatgcgcgttacgaacgagcgtttttttaagcgtagatatttcgcgagtatttttgtttattaaataatttttaggtgaatggtcgggaagcgtttttcggttaaggttaaggaaatttcggagaaa

SEQ ID NO: 31766 - DNA, 589 bp, Artificial Sequence
  chemically treated genomic DNA (Homo sapiens) CpG-island No: 31766
tttctccgaaatttccttaaccttaaccgaaaaacgcttcccgaccattcacctaaaaattatttaataaacaaaaatactcgcgaaatatctacgcttaaaaaaacgctcgttcgtaacgcgcattctcgaacctccgcaaacgaccccgataacaaaaacaaccgcttcgattttaacgactacaaacaaactaaaacgaaacgattaaaaactcctccccaaaaaatactaaaaaaattacgtcgtaccctacgcctaaccctaacgcgcgaccccaaatcgtaatacccaacgccctataaaccgtacgccgaaacttaaccacaccgcctactttcgcttccaaccgcgcgctccgtaccactaccgctctctacaaccccgcgtccccgcaacctccccataaccaacccgcttcgctccgctacgacccttacccgccaaatacctcgaacccgaacgtttacgaaaaaaaaaaaaattaaaacccgaatctcgataactcgcgaacctaaccgaacgccttatcgccgtttcctacaccatcctccttcgccttaccctccattccgcctccaacgaaacg

SEQ ID NO: 31767 - DNA, 589 bp, Artificial Sequence
  chemically treated genomic DNA (Homo sapiens) CpG-island No: 31767
ttttttcgaggtttttttagttttgatcgaggggcgtttttcggttatttatttagaggttgtttaataaataaggatgttcgcgaaatatttgcgtttggaaaggcgttcgttcgtggcgcgtattttcgggttttcgtaagcgatttcggtgatagggataatcgtttcggttttagcgattgtagatagattgggacgagacggttggaggtttttttttaagggatgttggaggggttgcgtcgtattttgcgtttggttttggcgcgcggttttaggtcgtggtatttagcgttttatgggtcgtgcgtcggggtttggttatatcgtttgttttcgtttttagtcgcgcgtttcgtgttattgtcgttttttgtagtttcgcgttttcgtagtttttttatggttagttcgtttcgtttcgttgcggtttttgttcgttaggtatttcgaattcgggcgtttgcggaaggggggaggattggaattcgggtttcggtagttcgcgggtttggtcgggcgttttgtcgtcgttttttgtattattttttttcgttttgttttttatttcgtttttagcgaggcg

SEQ ID NO: 31768 - DNA, 589 bp, Artificial Sequence
  chemically treated genomic DNA (Homo sapiens) CpG-island No: 31768
cgcctcgctaaaaacgaaataaaaaacaaaacgaaaaaaaataatacaaaaaacgacgacaaaacgcccgaccaaacccgcgaactaccgaaacccgaattccaatcctccccccttccgcaaacgcccgaattcgaaatacctaacgaacaaaaaccgcaacgaaacgaaacgaactaaccataaaaaaactacgaaaacgcgaaactacaaaaaacgacaataacacgaaacgcgcgactaaaaacgaaaacaaacgatataaccaaaccccgacgcacgacccataaaacgctaaataccacgacctaaaaccgcgcgccaaaaccaaacgcaaaatacgacgcaacccctccaacatcccttaaaaaaaaacctccaaccgtctcgtcccaatctatctacaatcgctaaaaccgaaacgattatccctatcaccgaaatcgcttacgaaaacccgaaaatacgcgccacgaacgaacgcctttccaaacgcaaatatttcgcgaacatccttatttattaaacaacctctaaataaataaccgaaaaacgcccctcgatcaaaactaaaaaaacctcgaaaaaa

SEQ ID NO: 31769 - DNA, 525 bp, Artificial Sequence
  chemically treated genomic DNA (Homo sapiens) CpG-island No: 31769
ttagtcgtcgtgcgttcggtatatatgtgtcgtagttcgtgtagtttagcgcggtttagcgatggtcgttttttgcgggcgatttttggtttttgtagcgttcgttcgtcgtttttgtcgttttcggggttgttcggtagtcgttaacgtcgcgggcgtcggtttttcgcgggttatgcggaagcgtttcgggtcggtgagcgcggttgcgggtagttcggtttcgttaattcggtttatttatttagttcgcggttggcggtagcggcggcggtttcggtcgggcggagtcgttatgggagttcgtagtagtagtggaagtagtagtagcggtagtcgcgcgtagttcgcgttagggaagcgtgcgttcgaaaggagtttcggtggcgcggtatgttcgttcggcgtcgtcgttgtcgttttcgcgggcgttcgttcggggttgagcgtcgttttagttcgtagtttttggtagtggtttttttcgagcgttttttaggttttttcggtttttggtttttttgg

SEQ ID NO: 31770 - DNA, 525 bp, Artificial Sequence
  chemically treated genomic DNA (Homo sapiens) CpG-island No: 31770
ccaaaaaaaccaaaaaccgaaaaaacctaaaaaacgctcgaaaaaaaccactaccaaaaactacgaactaaaacgacgctcaaccccgaacgaacgcccgcgaaaacgacaacgacgacgccgaacgaacataccgcgccaccgaaactcctttcgaacgcacgcttccctaacgcgaactacgcgcgactaccgctactactacttccactactactacgaactcccataacgactccgcccgaccgaaaccgccgccgctaccgccaaccgcgaactaaataaataaaccgaattaacgaaaccgaactacccgcaaccgcgctcaccgacccgaaacgcttccgcataacccgcgaaaaaccgacgcccgcgacgttaacgactaccgaacaaccccgaaaacgacaaaaacgacgaacgaacgctacaaaaaccaaaaatcgcccgcaaaaaacgaccatcgctaaaccgcgctaaactacacgaactacgacacatatataccgaacgcacgacgactaa

SEQ ID NO: 31771 - DNA, 525 bp, Artificial Sequence
  chemically treated genomic DNA (Homo sapiens) CpG-island No: 31771
ttaggaagattaggggtcgggaaagtttgggaggcgttcgggagaggttattgttaggggttgcgggttgaggcggcgtttagtttcgggcgggcgttcgcggaggcggtagcggcggcgtcgggcgggtatgtcgcgttatcggagtttttttcgggcgtacgtttttttggcgcgggttgcgcgcggttgtcgttgttgttgtttttattgttgttgcggatttttatggcggtttcgttcggtcggggtcgtcgtcgttgtcgttagtcgcgggttgaatgaatgagtcggattggcggagtcgggttgttcgtagtcgcgtttatcggttcgggacgttttcgtatggttcgcgaggagtcggcgttcgcggcgttggcggttgtcgggtagtttcgggggcggtagaggcggcgagcgggcgttgtaggggttaggggtcgttcgtagggggcggttatcgttgagtcgcgttaaattgtacgggttgcggtatatgtgtgtcgggcgtacggcggttgg

SEQ ID NO: 31772 - DNA, 525 bp, Artificial Sequence
  chemically treated genomic DNA (Homo sapiens) CpG-island No: 31772
ccaaccgccgtacgcccgacacacatataccgcaacccgtacaatttaacgcgactcaacgataaccgccccctacgaacgacccctaacccctacaacgcccgctcgccgcctctaccgcccccgaaactacccgacaaccgccaacgccgcgaacgccgactcctcgcgaaccatacgaaaacgtcccgaaccgataaacgcgactacgaacaacccgactccgccaatccgactcattcattcaacccgcgactaacgacaacgacgacgaccccgaccgaacgaaaccgccataaaaatccgcaacaacaataaaaacaacaacaacgacaaccgcgcgcaacccgcgccaaaaaaacgtacgcccgaaaaaaactccgataacgcgacatacccgcccgacgccgccgctaccgcctccgcgaacgcccgcccgaaactaaacgccgcctcaacccgcaacccctaacaataacctctcccgaacgcctcccaaactttcccgacccctaatcttcctaa

SEQ ID NO: 31773 - DNA, 623 bp, Artificial Sequence
  chemically treated genomic DNA (Homo sapiens) CpG-island No: 31773
gttcgtcgtcggggttttttaaggatgttagtcgtagggaagtgtcgtttttcgtttcggtttttttaggtgtttcgcgtttttagaaaagtttagttttgttgtttttcgcgttttttttttgttttcgcggcgataagagttggggattgcggggattcgttaatatttttcgggggtgattcggattcgttgtttcgcgcgttttttttttttcgagatttcgagttcgcggtggtcgtgacgtcggttaagtttttttttcggttgttcgggagaattttttttgggttttaggcgaatttgggtagcggtcgcgcgacgttggcgcggttgggtttcgagtatttgttttttagttcgttggtttcgcggtttcgggcgggcggggcggcggcggtcgtgagcgtcgtgcgtttttggagacgcggtgttgacgcgttcggttttttttcgttgtattttaatttttggttattgtggtcgttgtatatcgagcgggaagttttttgttggagtcggtcgggtgcgggggtggggtgtggtggggagcgggatggggatgcgttgtatagatgtgtttaggtgtatgggtttgtgggagagataagtagtataattat

SEQ ID NO: 31774 - DNA, 623 bp, Artificial Sequence
  chemically treated genomic DNA (Homo sapiens) CpG-island No: 31774
ataattatactacttatctctcccacaaacccatacacctaaacacatctatacaacgcatccccatcccgctccccaccacaccccacccccgcacccgaccgactccaacaaaaaacttcccgctcgatatacaacgaccacaataaccaaaaattaaaatacaacgaaaaaaaaccgaacgcgtcaacaccgcgtctccaaaaacgcacgacgctcacgaccgccgccgccccgcccgcccgaaaccgcgaaaccaacgaactaaaaaacaaatactcgaaacccaaccgcgccaacgtcgcgcgaccgctacccaaattcgcctaaaacccaaaaaaaattctcccgaacaaccgaaaaaaaaacttaaccgacgtcacgaccaccgcgaactcgaaatctcgaaaaaaaaaaaacgcgcgaaacaacgaatccgaatcacccccgaaaaatattaacgaatccccgcaatccccaactcttatcgccgcgaaaacaaaaaaaaaacgcgaaaaacaacaaaactaaacttttctaaaaacgcgaaacacctaaaaaaaccgaaacgaaaaacgacacttccctacgactaacatccttaaaaaaccccgacgacgaac

SEQ ID NO: 31775 - DNA, 623 bp, Artificial Sequence
  chemically treated genomic DNA (Homo sapiens) CpG-island No: 31775
atggttatattatttattttttttataagtttatatatttgagtatatttgtatagcgtatttttatttcgttttttattatattttattttcgtattcggtcgattttagtaagaggtttttcgttcggtgtgtagcggttatagtggttaggaattaaaatgtagcgaggaggagtcgggcgcgttagtatcgcgtttttaggagcgtacggcgtttacggtcgtcgtcgtttcgttcgttcggagtcgcggggttagcgagttgaggagtaggtgttcggagtttagtcgcgttagcgtcgcgcggtcgttgtttaagttcgtttggggtttaaagagggttttttcgggtaatcggggaaggagtttagtcggcgttacggttatcgcgagttcggagtttcgagaggagaagggcgcgcggagtagcgagttcgggttattttcgggaggtgttggcgggttttcgtagtttttagtttttgtcgtcgcgggggtagagagaagacgcgagagatagtaaggttgggtttttttggagacgcgaggtatttgggagagtcgaggcgagaagcgatatttttttgcggttagtatttttgaaggatttcggcggcgaat

SEQ ID NO: 31776 - DNA, 623 bp, Artificial Sequence
  chemically treated genomic DNA (Homo sapiens) CpG-island No: 31776
attcgccgccgaaatccttcaaaaatactaaccgcaaaaaaatatcgcttctcgcctcgactctcccaaatacctcgcgtctccaaaaaaacccaaccttactatctctcgcgtcttctctctacccccgcgacgacaaaaactaaaaactacgaaaacccgccaacacctcccgaaaataacccgaactcgctactccgcgcgcccttctcctctcgaaactccgaactcgcgataaccgtaacgccgactaaactccttccccgattacccgaaaaaaccctctttaaaccccaaacgaacttaaacaacgaccgcgcgacgctaacgcgactaaactccgaacacctactcctcaactcgctaaccccgcgactccgaacgaacgaaacgacgacgaccgtaaacgccgtacgctcctaaaaacgcgatactaacgcgcccgactcctcctcgctacattttaattcctaaccactataaccgctacacaccgaacgaaaaacctcttactaaaatcgaccgaatacgaaaataaaatataataaaaaacgaaataaaaatacgctatacaaatatactcaaatatataaacttataaaaaaaataaataatataaccat

SEQ ID NO: 31777 - DNA, 783 bp, Artificial Sequence
  chemically treated genomic DNA (Homo sapiens) CpG-island No: 31777
attcgagggtttggcgattcgaaggagggcggggagtgggggcgttggggtggattcgttattttgcggaattcgggttagataatagttttcgagttggggaaatcggtttgcggatgtgatgcgggatcgcgaggatatttgcgtttttttgcgtgtcgtattcgtgtagttttcggtggcgacggggtgatgtgggggcgagggtgagaggaagtttaggcgttagagcgttagaaacgtttttttagtttttttggtattttggaggttgtttcgagggaatacggatagtgtacgacggatttttaagttgttttcggtataacgggaggtcgggagttcggagtttttacgggcggtttaagtgttcgcgagaagttcgtagcgtttaggatcgcgttgagcgttcggggcgcgttaagtcgtatttaagtaaaagagaaacgttgacgggtcggaggcgggttggttgggacgcggaatacgcgcggtttcggagcgtttttcgttttaaggagttttatttttggaaagggatagggaattgttaattagcgagggagggagcgtatcggcgttgggtgatgttagcggattagttgttcgataataaagagagggtattataggagaaagttgtagtagcggtagcggttaaggcggtatatcggagttttcgaggcgaggggtaagtgggcgaagggaggggggacgacggttgttgtcgtagtagttgaaggttaaggaattgaaagggttgtagggggaggtagtgcgagt

SEQ ID NO: 31778 - DNA, 783 bp, Artificial Sequence
  chemically treated genomic DNA (Homo sapiens) CpG-island No: 31778
actcgcactacctccccctacaaccctttcaattccttaaccttcaactactacgacaacaaccgtcgtcccccctcccttcgcccacttacccctcgcctcgaaaactccgatataccgccttaaccgctaccgctactacaactttctcctataataccctctctttattatcgaacaactaatccgctaacatcacccaacgccgatacgctccctccctcgctaattaacaattccctatccctttccaaaaataaaactccttaaaacgaaaaacgctccgaaaccgcgcgtattccgcgtcccaaccaacccgcctccgacccgtcaacgtttctcttttacttaaatacgacttaacgcgccccgaacgctcaacgcgatcctaaacgctacgaacttctcgcgaacacttaaaccgcccgtaaaaactccgaactcccgacctcccgttataccgaaaacaacttaaaaatccgtcgtacactatccgtattccctcgaaacaacctccaaaataccaaaaaaactaaaaaaacgtttctaacgctctaacgcctaaacttcctctcaccctcgcccccacatcaccccgtcgccaccgaaaactacacgaatacgacacgcaaaaaaacgcaaatatcctcgcgatcccgcatcacatccgcaaaccgatttccccaactcgaaaactattatctaacccgaattccgcaaaataacgaatccaccccaacgcccccactccccgccctccttcgaatcgccaaaccctcgaat

SEQ ID NO: 31779 - DNA, 783 bp, Artificial Sequence
  chemically treated genomic DNA (Homo sapiens) CpG-island No: 31779
gttcgtattgtttttttttatagtttttttaattttttggtttttagttgttgcggtagtagtcgtcgtttttttttttttcgtttatttgtttttcgtttcggaggtttcggtgtgtcgttttggtcgttgtcgttgttgtaatttttttttgtaatattttttttttgttatcgagtagttgattcgttgatattatttagcgtcggtgcgttttttttttcgttgattgatagttttttgtttttttttagaagtaaggttttttaaaacgaaaggcgtttcggggtcgcgcgtatttcgcgttttagttaattcgttttcggttcgttagcgttttttttttgtttaggtgcggtttggcgcgtttcgagcgtttaacgcggttttgggcgttgcgggtttttcgcggatatttggatcgttcgtaggggtttcgagttttcgatttttcgttgtgtcgggagtaatttgaaagttcgtcgtgtattgttcgtgttttttcgagataatttttaaagtgttagggaagttaaggaagcgtttttgacgttttggcgtttggatttttttttattttcgtttttatattatttcgtcgttatcgggagttgtacgagtgcgatacgtaagggagcgtaggtgttttcgcggtttcgtattatattcgtaagtcgatttttttagttcgggggttgttatttggttcggatttcgtaggatggcgggtttattttagcgtttttatttttcgttttttttcgggtcgttaggttttcgggt

SEQ ID NO: 31780 - DNA, 783 bp, Artificial Sequence
  chemically treated genomic DNA (Homo sapiens) CpG-island No: 31780
acccgaaaacctaacgacccgaaaaaaaacgaaaaataaaaacgctaaaataaacccgccatcctacgaaatccgaaccaaataacaacccccgaactaaaaaaatcgacttacgaatataatacgaaaccgcgaaaacacctacgctcccttacgtatcgcactcgtacaactcccgataacgacgaaataatataaaaacgaaaataaaaaaaaatccaaacgccaaaacgtcaaaaacgcttccttaacttccctaacactttaaaaattatctcgaaaaaacacgaacaatacacgacgaactttcaaattactcccgacacaacgaaaaatcgaaaactcgaaacccctacgaacgatccaaatatccgcgaaaaacccgcaacgcccaaaaccgcgttaaacgctcgaaacgcgccaaaccgcacctaaacaaaaaaaaaacgctaacgaaccgaaaacgaattaactaaaacgcgaaatacgcgcgaccccgaaacgcctttcgttttaaaaaaccttacttctaaaaaaaaacaaaaaactatcaatcaacgaaaaaaaaaacgcaccgacgctaaataatatcaacgaatcaactactcgataacaaaaaaaaaatattacaaaaaaaaattacaacaacgacaacgaccaaaacgacacaccgaaacctccgaaacgaaaaacaaataaacgaaaaaaaaaaaaacgacgactactaccgcaacaactaaaaaccaaaaaattaaaaaaactataaaaaaaaacaatacgaac

SEQ ID NO: 31781 - DNA, 891 bp, Artificial Sequence
  chemically treated genomic DNA (Homo sapiens) CpG-island No: 31781
tttggcgtcgggcgggttcggcgatttacgtttcgtcgcgggaaattgtgtaagttttttttgttttcgatttcgttttttttttaagtttcgtttcgacgcgttttttttagagtttcgtttatttttttaggtttcgttttttattttggtttcgttttgtttcgcgtttattaggcgtttgtttttttaatggtttcgttttttattcggttttgttttattttaggtttcgtttcgttggtttcgttttttattcgtatttaagttcggtttttttcgtttttcgtttagcggtttgttgttttcgtttttagacggtttcgtgtagttaggttttagagttaatttttcgcgcggatagtcgcgttagtaattttttttgtgtgtttttttttttttatggttcggttttcgttaagttttcggatcgcgtatttttcggttcgttttcgtttcgtcgggttttcgcgcgcgtttattttttgtagtttgtagtttcgtaggtttagcgtggttaggacgtcgttgtcgcgtacgtcggggatattttgttatagcgagaaggtggagtttcgcgtcgagcgttgcgttcggaaggagttgttgggggagaggttggttcgcggcggtttcggttttttttttgcgttttcggtttcgtttttcgggttttttttttcgcgttgttgtcgtcgtagttcgcgggcgttggttacgtcgttgtatttttgatagaggacggttgggggaaagacgggcgggggagagcgtggggcgttcgttagtttttgttcggttttttttcggtttttttaagagttcgcgttatttaatttttgtcgcggttcggatatttggatatagtgaatttatttatttatttatttt

SEQ ID NO: 31782 - DNA, 891 bp, Artificial Sequence
  chemically treated genomic DNA (Homo sapiens) CpG-island No: 31782
aaaataaataaataaataaattcactatatccaaatatccgaaccgcgacaaaaattaaataacgcgaactcttaaaaaaaccgaaaaaaaaccgaacaaaaactaacgaacgccccacgctctcccccgcccgtctttcccccaaccgtcctctatcaaaaatacaacgacgtaaccaacgcccgcgaactacgacgacaacaacgcgaaaaaaaaaacccgaaaaacgaaaccgaaaacgcaaaaaaaaaaccgaaaccgccgcgaaccaacctctcccccaacaactccttccgaacgcaacgctcgacgcgaaactccaccttctcgctataacaaaatatccccgacgtacgcgacaacgacgtcctaaccacgctaaacctacgaaactacaaactacaaaaaataaacgcgcgcgaaaacccgacgaaacgaaaacgaaccgaaaaatacgcgatccgaaaacttaacgaaaaccgaaccataaaaaaaaaaaaacacacaaaaaaaattactaacgcgactatccgcgcgaaaaattaactctaaaacctaactacacgaaaccgtctaaaaacgaaaacaacaaaccgctaaacgaaaaacgaaaaaaaccgaacttaaatacgaataaaaaacgaaaccaacgaaacgaaacctaaaataaaacaaaaccgaataaaaaacgaaaccattaaaaaaacaaacgcctaataaacgcgaaacaaaacgaaaccaaaataaaaaacgaaacctaaaaaaataaacgaaactctaaaaaaaacgcgtcgaaacgaaacttaaaaaaaaaacgaaatcgaaaacaaaaaaaacttacacaatttcccgcgacgaaacgtaaatcgccgaacccgcccgacgccaaa

SEQ ID NO: 31783 - DNA, 891 bp, Artificial Sequence
  chemically treated genomic DNA (Homo sapiens) CpG-island No: 31783
ggaatgaatgaatgaatgaatttattgtgtttaggtattcgaatcgcggtaaaggttaagtgacgcgggtttttgagggaatcgaggaaaagtcgggtaggggttggcgggcgttttacgttttttttcgttcgttttttttttagtcgttttttattaggaatatagcgacgtggttagcgttcgcgaattgcggcggtagtagcgcgaggaggagggttcgggggacgaggtcgagggcgtagaggaggggtcggggtcgtcgcgggttaattttttttttagtagtttttttcgggcgtagcgttcggcgcgaggttttattttttcgttgtggtaggatattttcgacgtacgcggtagcggcgttttggttacgttgagtttgcgggattgtaagttgtaggaggtgggcgcgcgcggggattcggcggggcgggggcgggtcggggagtacgcggttcggggatttagcgggaatcgggttatagagggagggggatatataaagggggttgttggcgcgattgttcgcgcggaaggttggttttaggatttgattatacgaggtcgtttggaagcgaggatagtaaatcgttgagcgagaggcgaggggagtcgggtttgggtgcgggtagggggcggagttagcgggacgaaatttaggataggatagggtcggatgaggagcggaattattggaagagtaaacgtttggtgggcgcggaataaggcggggttaggatgaggggcggaatttgggggggtgggcggggttttgggaagaacgcgtcggggcggggtttaggagaggggcgggatcgaggataagaaaggtttgtataatttttcgcggcgggacgtgggtcgtcgggttcgttcggcgttaga

SEQ ID NO: 31784 - DNA, 891 bp, Artificial Sequence
  chemically treated genomic DNA (Homo sapiens) CpG-island No: 31784
tctaacgccgaacgaacccgacgacccacgtcccgccgcgaaaaattatacaaacctttcttatcctcgatcccgcccctctcctaaaccccgccccgacgcgttcttcccaaaaccccgcccacccccccaaattccgcccctcatcctaaccccgccttattccgcgcccaccaaacgtttactcttccaataattccgctcctcatccgaccctatcctatcctaaatttcgtcccgctaactccgccccctacccgcacccaaacccgactcccctcgcctctcgctcaacgatttactatcctcgcttccaaacgacctcgtataatcaaatcctaaaaccaaccttccgcgcgaacaatcgcgccaacaaccccctttatatatccccctccctctataacccgattcccgctaaatccccgaaccgcgtactccccgacccgcccccgccccgccgaatccccgcgcgcgcccacctcctacaacttacaatcccgcaaactcaacgtaaccaaaacgccgctaccgcgtacgtcgaaaatatcctaccacaacgaaaaaataaaacctcgcgccgaacgctacgcccgaaaaaaactactaaaaaaaaaattaacccgcgacgaccccgacccctcctctacgccctcgacctcgtcccccgaaccctcctcctcgcgctactaccgccgcaattcgcgaacgctaaccacgtcgctatattcctaataaaaaacgactaaaaaaaaaacgaacgaaaaaaaacgtaaaacgcccgccaacccctacccgacttttcctcgattccctcaaaaacccgcgtcacttaacctttaccgcgattcgaatacctaaacacaataaattcattcattcattcattcc

SEQ ID NO: 31785 - DNA, 770 bp, Artificial Sequence
  chemically treated genomic DNA (Homo sapiens) CpG-island No: 31785
acgttacgtagggtatgaatgaataggagtcggtttttatttaatttttattaaggattcggggtaggaggggtagaagttgcgcgtaggtcggcgggcgggagcggatatcgaggtcggcgtgtaggcgtgcgggtgtgcgggagtcgggttcggggggatcggatcgagagcgagaagcgcggtatggagttttaggtagttcgcgtttgtttcgttttgttgtggggttgtgcgttggtcgcggtcgcggcggcgtagggtaaggaaggtgagtgcgcgcggcgtttggatttttggttttcgggttttagtgttttttagagttcggcgttttttgacgcgcgtaattttggaatttatttggtgtcgtttagtttcggcgaattggagttcggagggcgtacgggttgcgatcgaggcgagttttggtttttattcggggttataggggtttcggagaataagcggttttagtttggtcgtacgggtttcggaggttgcggagaagaggacgcggcgtaggttacgcggttgtagtttaggcggcgatttcgggaacgcgtttcggcggggggcgtggggagttttttagagaagggggtgtttgggtagtttttcgcgggtttagttttttagtgatttgaatttattaattcgtttgtcgaggttttgcggagaaggtatattgtgtaggtttcgtattttggggagggggttcgggcgggcgggagttttttgtcgaagtttttgttttttgagattttttt

SEQ ID NO: 31786 - DNA, 770 bp, Artificial Sequence
  chemically treated genomic DNA (Homo sapiens) CpG-island No: 31786
aaaaaaatctcaaaaaacaaaaacttcgacaaaaaactcccgcccgcccgaaccccctccccaaaatacgaaacctacacaatataccttctccgcaaaacctcgacaaacgaattaataaattcaaatcactaaaaaactaaacccgcgaaaaactacccaaacacccccttctctaaaaaactccccacgccccccgccgaaacgcgttcccgaaatcgccgcctaaactacaaccgcgtaacctacgccgcgtcctcttctccgcaacctccgaaacccgtacgaccaaactaaaaccgcttattctccgaaacccctataaccccgaataaaaaccaaaactcgcctcgatcgcaacccgtacgccctccgaactccaattcgccgaaactaaacgacaccaaataaattccaaaattacgcgcgtcaaaaaacgccgaactctaaaaaacactaaaacccgaaaaccaaaaatccaaacgccgcgcgcactcaccttccttaccctacgccgccgcgaccgcgaccaacgcacaaccccacaacaaaacgaaacaaacgcgaactacctaaaactccataccgcgcttctcgctctcgatccgatccccccgaacccgactcccgcacacccgcacgcctacacgccgacctcgatatccgctcccgcccgccgacctacgcgcaacttctacccctcctaccccgaatccttaataaaaattaaataaaaaccgactcctattcattcataccctacgtaacgt

SEQ ID NO: 31787 - DNA, 770 bp, Artificial Sequence
  chemically treated genomic DNA (Homo sapiens) CpG-island No: 31787
gagaaaattttagggaataggggtttcgatagggggttttcgttcgttcgagttttttttttaaaatgcgaggtttgtatagtatgtttttttcgtaaaatttcggtaagcgggttagtgaatttaggttattaagaagttgagttcgcggaaagttgtttaaatatttttttttttaggggattttttacgtttttcgtcgggacgcgttttcgaagtcgtcgtttggattgtaatcgcgtggtttgcgtcgcgttttttttttcgtagttttcgaggttcgtgcgattaagttgaaatcgtttatttttcggagtttttatgatttcgggtgggggttagggttcgtttcgatcgtagttcgtgcgtttttcggattttagttcgtcgggattgggcgatattaggtaggttttaaagttgcgcgcgttaaggagcgtcgggttttagggggtattggggttcgggggttaggggtttagacgtcgcgcgtatttattttttttgttttgcgtcgtcgcggtcgcggttagcgtatagttttatagtagggcgaagtaggcgcgggttgtttggagttttatgtcgcgtttttcgttttcggttcgattttttcgagttcggttttcgtatattcgtacgtttgtacgtcggtttcggtgttcgttttcgttcgtcggtttgcgcgtaatttttgttttttttgtttcgagtttttaatggaagttgggtgagaatcgatttttgtttatttatgttttgcgtgacgt

SEQ ID NO: 31788 - DNA, 770 bp, Artificial Sequence
  chemically treated genomic DNA (Homo sapiens) CpG-island No: 31788
acgtcacgcaaaacataaataaacaaaaatcgattctcacccaacttccattaaaaactcgaaacaaaaaaaacaaaaattacgcgcaaaccgacgaacgaaaacgaacaccgaaaccgacgtacaaacgtacgaatatacgaaaaccgaactcgaaaaaatcgaaccgaaaacgaaaaacgcgacataaaactccaaacaacccgcgcctacttcgccctactataaaactatacgctaaccgcgaccgcgacgacgcaaaacaaaaaaaataaatacgcgcgacgtctaaacccctaacccccgaaccccaataccccctaaaacccgacgctccttaacgcgcgcaactttaaaacctacctaatatcgcccaatcccgacgaactaaaatccgaaaaacgcacgaactacgatcgaaacgaaccctaacccccacccgaaatcataaaaactccgaaaaataaacgatttcaacttaatcgcacgaacctcgaaaactacgaaaaaaaaaacgcgacgcaaaccacgcgattacaatccaaacgacgacttcgaaaacgcgtcccgacgaaaaacgtaaaaaatcccctaaaaaaaaaaatatttaaacaactttccgcgaactcaacttcttaataacctaaattcactaacccgcttaccgaaattttacgaaaaaaacatactatacaaacctcgcattttaaaaaaaaaactcgaacgaacgaaaaccccctatcgaaacccctattccctaaaattttctc

SEQ ID NO: 31789 - DNA, 569 bp, Artificial Sequence
  chemically treated genomic DNA (Homo sapiens) CpG-island No: 31789
ttcgaaagacgtcgagaaaacgtagagttgggtttttttagttcggtttggaatttattatttacggttttttttttgaagagggacgttatggttaaagattgcgttcgggcggttcggttcggttcggttcggtttaacgttggtaaaggataggaggaaaaggataggattttggcgggttcggggtggcggagcggagagatagtaggaggaggtcggggtcgttaggtaggattcgcggaaggtttgtattcgtagttatcgtagtcgcgttattcggagtttaggtgatcgggaattaatatattttttggagaagttatttttaggcggcgtttgcgcgttgtgtggcgtttgcgtattacggagtttgaagtcgcggtcgttttttttacgtttgcggttgttagttttttttgtatcgggagttggtagcggggcgagtttggagttggcggggataggagagcgtggggttacggtttttgtgcgcgggttgggtgatgattgaggatagtgattagttttgtttagcgttttattttttgtttcggggaaagttggat

SEQ ID NO: 31790 - DNA, 569 bp, Artificial Sequence
  chemically treated genomic DNA (Homo sapiens) CpG-island No: 31790
atccaactttccccgaaacaaaaaataaaacgctaaacaaaactaatcactatcctcaatcatcacccaacccgcgcacaaaaaccgtaaccccacgctctcctatccccgccaactccaaactcgccccgctaccaactcccgatacaaaaaaaactaacaaccgcaaacgtaaaaaaaacgaccgcgacttcaaactccgtaatacgcaaacgccacacaacgcgcaaacgccgcctaaaaataacttctccaaaaaatatattaattcccgatcacctaaactccgaataacgcgactacgataactacgaatacaaaccttccgcgaatcctacctaacgaccccgacctcctcctactatctctccgctccgccaccccgaacccgccaaaatcctatccttttcctcctatcctttaccaacgttaaaccgaaccgaaccgaaccgaaccgcccgaacgcaatctttaaccataacgtccctcttcaaaaaaaaaaccgtaaataataaattccaaaccgaactaaaaaaacccaactctacgttttctcgacgtctttcgaa

SEQ ID NO: 31791 - DNA, 569 bp, Artificial Sequence
  chemically treated genomic DNA (Homo sapiens) CpG-island No: 31791
atttagtttttttcggggtaaggggtgaagcgttaagtaaggttgattattgtttttaattattatttaattcgcgtatagaagtcgtggttttacgtttttttattttcgttagttttagattcgtttcgttgttaattttcggtgtaggaggaattggtagtcgtagacgtgaggaaagcggtcgcggttttaaatttcgtagtgcgtaggcgttatataacgcgtaggcgtcgtttagaagtgatttttttaaaaagtgtgttagttttcggttatttgagtttcgggtgacgcggttgcggtagttgcggatataagtttttcgcgggttttgtttggcgatttcgatttttttttgttgttttttcgtttcgttatttcgaattcgttaaggttttgtttttttttttttgttttttgttagcgttgggtcggatcgggtcgagtcgggtcgttcgggcgtagtttttaattatggcgtttttttttaagaagaaaatcgtggatggtgagttttaggtcgggttgaaggggtttagttttgcgttttttcggcgtttttcgag

SEQ ID NO: 31792 - DNA, 569 bp, Artificial Sequence
  chemically treated genomic DNA (Homo sapiens) CpG-island No: 31792
ctcgaaaaacgccgaaaaaacgcaaaactaaaccccttcaacccgacctaaaactcaccatccacgattttcttcttaaaaaaaaacgccataattaaaaactacgcccgaacgacccgactcgacccgatccgacccaacgctaacaaaaaacaaaaaaaaaaaaacaaaaccttaacgaattcgaaataacgaaacgaaaaaacaacaaaaaaaaatcgaaatcgccaaacaaaacccgcgaaaaacttatatccgcaactaccgcaaccgcgtcacccgaaactcaaataaccgaaaactaacacactttttaaaaaaatcacttctaaacgacgcctacgcgttatataacgcctacgcactacgaaatttaaaaccgcgaccgctttcctcacgtctacgactaccaattcctcctacaccgaaaattaacaacgaaacgaatctaaaactaacgaaaataaaaaaacgtaaaaccacgacttctatacgcgaattaaataataattaaaaacaataatcaaccttacttaacgcttcaccccttaccccgaaaaaaactaaat

SEQ ID NO: 31793 - DNA, 1778 bp, Artificial Sequence
  chemically treated genomic DNA (Homo sapiens) CpG-island No: 31793
cgggggtcgggtaggggcgaagacggtggtcggggacggtgggagtcggtcggagtcgggtaggggacgtggtttcgagtggatgggagtgggaggggtgcgcgtcggggtacgtagcgcggtcgggttgggttgtaggttcgcgagtcgcgggttggggtcggagttgttagagaggcggttgcgttataaaagtttgtcggtttttttcgtcgttcgttttcgtcgttttcgttttttttcgtttttttttcgtttttttgtttttttttcggtcgcggttcggaggttgtagcgggcggagtaggggaggggcgggttttcgaatatgtagatgagcgcgtgatggatagttgcgcgttttaatgtttttcggaaattcgagcgttttttttttaattttttattttcgattttagatttttttaaatttcgatcgtcggtttggcgcgcggttgcgtttatcggtttcgcgttgttgtcgtcgttatcgttatttcgtcgtcgtttcggttcgcgggtcgtttaggttagtattcgggtcggtttgttttcgtcggtcgttcgggtgttcgtcgtcgcgtcgcgtttcggtcgggcgtggatggagggcgtcgcgcgttttgttcgttgttcggcgtgacgcgggtttcgcgtttcgcgtttattatgttttattcgtagggttatttgtattaggcgttcggttcgttggcgttttattcgtgttcggtttacggcgcgtcggttttggcggtttcgcgtagcgaggagttggcgcgttcggcgtcgggttcggcgtttagtttttattcgggttcggcggtttttacggcgtaggcggttatcggtttcgggagttcgttgtagtattcggtcgacgtcgtcgtcgtcgtcgtcggtttttcgttttatatggtaatcgggcgcgggcgggacgcgggatttttgggcgtcgggatttagacggggtttaggcggagcggggttcgggttcggcgggcgggggtcgtcgggaatgtggcgcggttggcgatttaggagtcgtcggttcggttggtcgtttcgtaggttgagtcgggtttcgggtggggagggtagcgcggtaggcggggacgtttttgagttcggtcgggattcgcgcgtttttcgcgcgttttttcggttcgtcggttgattttttttgagagtttgggaagtgcgttttcgtcggggtcggggtttggcgtcgtttgtttttggttttcgtatcgtagtttggggaggcgttcggagcgggttgtgtgttcgtttgtattggcgtggggcgcgagggttcgcgttattgcggtttttgagtcgacggtcgggcggttcgtatttattcgcggggtttagggcggtgggggttatcgagttaggtttaggagtcgagtatttagttgcggtttcggagttcggttcgaggcgtttaggtttcggttttattttgtttagcggattatgtttttaaatatcgtgtttgcgggcgcgtgattcgttaagggtcgtttgagtttttcgtggttcgagcgtagtttttgtttcggcgatttgggggcggttcgcgagtttcgaggttattgagttgggttaggttcgggtcgcggcgaagtacgttacgggcgattgaggttattacggggttgtcgcgattgtcggttttcggcggaatttttgggtagcgatcgagtcgttggggttttggcgaaggttgtaaatgtttcgaatttaaacgttaaaggatgaattaaaatgtt

SEQ ID NO: 31794 - DNA, 1778 bp, Artificial Sequence
  chemically treated genomic DNA (Homo sapiens) CpG-island No: 31794
aacattttaattcatcctttaacgtttaaattcgaaacatttacaaccttcgccaaaaccccaacgactcgatcgctacccaaaaattccgccgaaaaccgacaatcgcgacaaccccgtaataacctcaatcgcccgtaacgtacttcgccgcgacccgaacctaacccaactcaataacctcgaaactcgcgaaccgcccccaaatcgccgaaacaaaaactacgctcgaaccacgaaaaactcaaacgacccttaacgaatcacgcgcccgcaaacacgatatttaaaaacataatccgctaaacaaaataaaaccgaaacctaaacgcctcgaaccgaactccgaaaccgcaactaaatactcgactcctaaacctaactcgataacccccaccgccctaaaccccgcgaataaatacgaaccgcccgaccgtcgactcaaaaaccgcaataacgcgaaccctcgcgccccacgccaatacaaacgaacacacaacccgctccgaacgcctccccaaactacgatacgaaaaccaaaaacaaacgacgccaaaccccgaccccgacgaaaacgcacttcccaaactctcaaaaaaaatcaaccgacgaaccgaaaaaacgcgcgaaaaacgcgcgaatcccgaccgaactcaaaaacgtccccgcctaccgcgctaccctccccacccgaaacccgactcaacctacgaaacgaccaaccgaaccgacgactcctaaatcgccaaccgcgccacattcccgacgacccccgcccgccgaacccgaaccccgctccgcctaaaccccgtctaaatcccgacgcccaaaaatcccgcgtcccgcccgcgcccgattaccatataaaacgaaaaaccgacgacgacgacgacgacgtcgaccgaatactacaacgaactcccgaaaccgataaccgcctacgccgtaaaaaccgccgaacccgaataaaaactaaacgccgaacccgacgccgaacgcgccaactcctcgctacgcgaaaccgccaaaaccgacgcgccgtaaaccgaacacgaataaaacgccaacgaaccgaacgcctaatacaaataaccctacgaataaaacataataaacgcgaaacgcgaaacccgcgtcacgccgaacaacgaacaaaacgcgcgacgccctccatccacgcccgaccgaaacgcgacgcgacgacgaacacccgaacgaccgacgaaaacaaaccgacccgaatactaacctaaacgacccgcgaaccgaaacgacgacgaaataacgataacgacgacaacaacgcgaaaccgataaacgcaaccgcgcgccaaaccgacgatcgaaatttaaaaaaatctaaaatcgaaaataaaaaattaaaaaaaaaacgctcgaatttccgaaaaacattaaaacgcgcaactatccatcacgcgctcatctacatattcgaaaacccgcccctcccctactccgcccgctacaacctccgaaccgcgaccgaaaaaaaaacaaaaaaacgaaaaaaaaacgaaaaaaaacgaaaacgacgaaaacgaacgacgaaaaaaaccgacaaacttttataacgcaaccgcctctctaacaactccgaccccaacccgcgactcgcgaacctacaacccaacccgaccgcgctacgtaccccgacgcgcacccctcccactcccatccactcgaaaccacgtcccctacccgactccgaccgactcccaccgtccccgaccaccgtcttcgcccctacccgacccccg

SEQ ID NO: 31795 - DNA, 1778 bp, Artificial Sequence
  chemically treated genomic DNA (Homo sapiens) CpG-island No: 31795
agtattttaatttattttttaacgtttaaattcgaggtatttgtagttttcgttaaggttttagcgattcggtcgttgtttagaaatttcgtcgagggtcggtagtcgcgataatttcgtaatggttttaatcgttcgtaacgtgtttcgtcgcggttcgggtttggtttagtttagtaatttcgagattcgcgagtcgtttttaggtcgtcggagtaggagttgcgttcgggttacggaggatttaggcggtttttagcgggttacgcgttcgtaagtacgatatttgaaagtatggttcgttggatagagtaaggtcgaaatttgggcgtttcgggtcggatttcggagtcgtagttgaatgttcggtttttgggtttaattcggtgatttttatcgttttgagtttcgcgagtgaatgcgaatcgttcggtcgtcggtttagaggtcgtagtgacgcggattttcgcgttttacgttaatgtaggcgagtatatagttcgtttcgaacgtttttttaggttgcggtgcggaaattagggataaacggcgttagatttcggtttcggcggagacgtattttttaggtttttagagaaaattagtcggcgagtcgaggggacgcgcggggggcgcgcgggtttcggtcgggtttagggacgttttcgtttgtcgcgttgttttttttattcggggttcggtttagtttgcggggcggttaatcgagtcggcgatttttgagtcgttagtcgcgttatattttcggcggttttcgttcgtcgaattcgagtttcgtttcgtttgagtttcgtttgggtttcggcgtttaggagtttcgcgtttcgttcgcgttcggttattatgtaggacgggaagtcggcggcggcggcggcggcgtcggtcgagtattgtagcgggttttcgaagtcggtggtcgtttgcgtcgtgaaggtcgtcgagttcgggtaggggttgaacgtcgagttcgacgtcgagcgcgttagtttttcgttgcgcggagtcgttaaagtcgacgcgtcgtaggtcgggtacgagtagagcgttagcgagtcgggcgtttggtataggtagttttgcgggtaggatatggtgggcgcggggcgcggggttcgcgttacgtcgagtagcgggtagggcgcgcggcgttttttatttacgttcggtcggggcgcggcgcggcggcgggtattcggacggtcggcggaggtaggtcggttcgggtattagtttgggcggttcgcgggtcggggcggcggcggggtggcggtggcggcggtagtagcgcggagtcggtgggcgtagtcgcgcgttaggtcggcggtcggggtttgggggagtttggagtcgggagtgaggagttgaggaaggagcgttcgagttttcgagggatattggaacgcgtagttgtttattacgcgtttatttgtatattcgggggttcgttttttttttgtttcgttcgttgtagttttcgggtcgcggtcgggggaggggtagagagacgggagggaggcgggggagggcggaggcgacggaggcgggcggcgggagggatcggtaggtttttgtggcgtagtcgtttttttagtagtttcggttttagttcgcggttcgcggatttgtagtttagttcggtcgcgttgcgtgtttcggcgcgtattttttttatttttatttattcggagttacgttttttgttcggtttcggtcggtttttatcgttttcggttatcgttttcgtttttgttcggttttcg

SEQ ID NO: 31796 - DNA, 1778 bp, Artificial Sequence
  chemically treated genomic DNA (Homo sapiens) CpG-island No: 31796
cgaaaaccgaacaaaaacgaaaacgataaccgaaaacgataaaaaccgaccgaaaccgaacaaaaaacgtaactccgaataaataaaaataaaaaaaatacgcgccgaaacacgcaacgcgaccgaactaaactacaaatccgcgaaccgcgaactaaaaccgaaactactaaaaaaacgactacgccacaaaaacctaccgatccctcccgccgcccgcctccgtcgcctccgccctcccccgcctccctcccgtctctctacccctcccccgaccgcgacccgaaaactacaacgaacgaaacaaaaaaaaaacgaacccccgaatatacaaataaacgcgtaataaacaactacgcgttccaatatccctcgaaaactcgaacgctccttcctcaactcctcactcccgactccaaactcccccaaaccccgaccgccgacctaacgcgcgactacgcccaccgactccgcgctactaccgccgccaccgccaccccgccgccgccccgacccgcgaaccgcccaaactaatacccgaaccgacctacctccgccgaccgtccgaatacccgccgccgcgccgcgccccgaccgaacgtaaataaaaaacgccgcgcgccctacccgctactcgacgtaacgcgaaccccgcgccccgcgcccaccatatcctacccgcaaaactacctataccaaacgcccgactcgctaacgctctactcgtacccgacctacgacgcgtcgactttaacgactccgcgcaacgaaaaactaacgcgctcgacgtcgaactcgacgttcaacccctacccgaactcgacgaccttcacgacgcaaacgaccaccgacttcgaaaacccgctacaatactcgaccgacgccgccgccgccgccgccgacttcccgtcctacataataaccgaacgcgaacgaaacgcgaaactcctaaacgccgaaacccaaacgaaactcaaacgaaacgaaactcgaattcgacgaacgaaaaccgccgaaaatataacgcgactaacgactcaaaaatcgccgactcgattaaccgccccgcaaactaaaccgaaccccgaataaaaaaaacaacgcgacaaacgaaaacgtccctaaacccgaccgaaacccgcgcgccccccgcgcgtcccctcgactcgccgactaattttctctaaaaacctaaaaaatacgtctccgccgaaaccgaaatctaacgccgtttatccctaatttccgcaccgcaacctaaaaaaacgttcgaaacgaactatatactcgcctacattaacgtaaaacgcgaaaatccgcgtcactacgacctctaaaccgacgaccgaacgattcgcattcactcgcgaaactcaaaacgataaaaatcaccgaattaaacccaaaaaccgaacattcaactacgactccgaaatccgacccgaaacgcccaaatttcgaccttactctatccaacgaaccatactttcaaatatcgtacttacgaacgcgtaacccgctaaaaaccgcctaaatcctccgtaacccgaacgcaactcctactccgacgacctaaaaacgactcgcgaatctcgaaattactaaactaaaccaaacccgaaccgcgacgaaacacgttacgaacgattaaaaccattacgaaattatcgcgactaccgaccctcgacgaaatttctaaacaacgaccgaatcgctaaaaccttaacgaaaactacaaatacctcgaatttaaacgttaaaaaataaattaaaatact

SEQ ID NO: 31797 - DNA, 803 bp, Artificial Sequence
  chemically treated genomic DNA (Homo sapiens) CpG-island No: 31797
cgtttacggattattcgtgttcggtcgagtcggacggggagaagttttcgtgtcgcgtcggggattttttgtgcgaatcgggttcggagtgtaaggataagtatgacgatttggaggacgacgaggacgacgacgaggagggcgagcggggtttggcgtcgtttaagttcgtgatttcgtcgtcgtttatcggtttggaggcgtcgttgttgagtttttcgttcgaggtcgcgtttcgcggtggtcgtaagacgttttagggtagtcggacgttttcgggcgcgtcgtttttcgttagtaagtttaagttgtggtcgttggtcgagatcgttacgtcggattttaagtagtcgagtttgggttcgggttgcgggttatcggggttgttcgcggtcgtcgcgtcggttttaatcggggtatcgttaggaggttcgttttattttgtttcgtcgttgttgggtcgttttttttattatacgtcgtttttttacggtaattatataaattacgggaatttgaacgcggcgttgtagggttagggttttttgcggtataattttgcggtcgcggttttcggcgaggttttgtatatcgcgttaaaggcggttagcgacgcgggtaaggcgggcgcgtattcgttcgagttttattatcggttttcgggcggcggttacgagtttaagaaaggtaggcggttcgcggtcggcggcgttcgggaggggagggagagttagtttcggggaggcggagcgttcgggagattcgagggagggttcgggaagaagatttagggggttattttt

SEQ ID NO: 31798 - DNA, 803 bp, Artificial Sequence
  chemically treated genomic DNA (Homo sapiens) CpG-island No: 31798
aaaaataaccccctaaatcttcttcccgaaccctccctcgaatctcccgaacgctccgcctccccgaaactaactctccctcccctcccgaacgccgccgaccgcgaaccgcctacctttcttaaactcgtaaccgccgcccgaaaaccgataataaaactcgaacgaatacgcgcccgccttacccgcgtcgctaaccgcctttaacgcgatatacaaaacctcgccgaaaaccgcgaccgcaaaattataccgcaaaaaaccctaaccctacaacgccgcgttcaaattcccgtaatttatataattaccgtaaaaaaacgacgtataataaaaaaaacgacccaacaacgacgaaacaaaataaaacgaacctcctaacgataccccgattaaaaccgacgcgacgaccgcgaacaaccccgataacccgcaacccgaacccaaactcgactacttaaaatccgacgtaacgatctcgaccaacgaccacaacttaaacttactaacgaaaaacgacgcgcccgaaaacgtccgactaccctaaaacgtcttacgaccaccgcgaaacgcgacctcgaacgaaaaactcaacaacgacgcctccaaaccgataaacgacgacgaaatcacgaacttaaacgacgccaaaccccgctcgccctcctcgtcgtcgtcctcgtcgtcctccaaatcgtcatacttatccttacactccgaacccgattcgcacaaaaaatccccgacgcgacacgaaaacttctccccgtccgactcgaccgaacacgaataatccgtaaacg

SEQ ID NO: 31799 - DNA, 803 bp, Artificial Sequence
  chemically treated genomic DNA (Homo sapiens) CpG-island No: 31799
aggagtggttttttggatttttttttcggattttttttcgggtttttcgggcgtttcgttttttcggggttggtttttttttttttttcgggcgtcgtcggtcgcgggtcgtttattttttttgggttcgtagtcgtcgttcggggatcggtagtgggattcgagcgggtgcgcgttcgttttgttcgcgtcgttggtcgtttttggcgcggtgtgtagggtttcgtcgggggtcgcggtcgtagagttgtatcgtaggagattttggttttgtagcgtcgcgtttaagttttcgtagtttgtgtagttgtcgtagaagggcgacgtgtagtagagggggcggtttagtagcggcgaggtagggtagggcgagttttttggcggtgtttcggttgaggtcggcgcggcggtcgcgggtagtttcggtggttcgtagttcgggtttaggttcggttgtttgaggttcgacgtggcgatttcggttagcgattatagtttgggtttgttggcggggggcggcgcgttcggagacgttcggttgttttggggcgttttgcggttatcgcggggcgcggtttcgggcggggggtttagtagcggcgtttttaagtcggtaagcggcgacgaggttacgggtttgggcggcgttaggtttcgttcgtttttttcgtcgtcgttttcgtcgttttttaggtcgttatatttgtttttgtatttcgagttcgattcgtatagggggttttcggcgcggtacggaagttttttttcgttcgattcggtcgagtacgagtgattcgtgagcg

SEQ ID NO: 31800 - DNA, 803 bp, Artificial Sequence
  chemically treated genomic DNA (Homo sapiens) CpG-island No: 31800
cgctcacgaatcactcgtactcgaccgaatcgaacgaaaaaaaacttccgtaccgcgccgaaaaccccctatacgaatcgaactcgaaatacaaaaacaaatataacgacctaaaaaacgacgaaaacgacgacgaaaaaaacgaacgaaacctaacgccgcccaaacccgtaacctcgtcgccgcttaccgacttaaaaacgccgctactaaaccccccgcccgaaaccgcgccccgcgataaccgcaaaacgccccaaaacaaccgaacgtctccgaacgcgccgccccccgccaacaaacccaaactataatcgctaaccgaaatcgccacgtcgaacctcaaacaaccgaacctaaacccgaactacgaaccaccgaaactacccgcgaccgccgcgccgacctcaaccgaaacaccgccaaaaaactcgccctaccctacctcgccgctactaaaccgccccctctactacacgtcgcccttctacgacaactacacaaactacgaaaacttaaacgcgacgctacaaaaccaaaatctcctacgatacaactctacgaccgcgacccccgacgaaaccctacacaccgcgccaaaaacgaccaacgacgcgaacaaaacgaacgcgcacccgctcgaatcccactaccgatccccgaacgacgactacgaacccaaaaaaaataaacgacccgcgaccgacgacgcccgaaaaaaaaaaaaaaaccaaccccgaaaaaacgaaacgcccgaaaaacccgaaaaaaaatccgaaaaaaaaatccaaaaaaccactcct

SEQ ID NO: 31801 - DNA, 840 bp, Artificial Sequence
  chemically treated genomic DNA (Homo sapiens) CpG-island No: 31801
tcgggtcgtttcggtttcgttttatttcggagtgtttttaggatatttttcggacggttttttattcgtttttcgggatcgttcgcggttttttttcgttttttcgtcggtcgtttcggcggttattgttttaagatggcggcggcggcggtagcgggtgaggtcgggtcgggtcgggtcgggtcgggttgggggtcggggggtttcgggatagcgtttatttgtaattcggcgcgttcggttttttagcgggttttttcggtttcgaagcgcgtttattcgtgttggataaagtgtaggattttcggtaggtttaggggtttcgggttcgtcgtgggttcggggttgttttcgtcgtcgttttttttatttgtcgggttcggttcgggggtaggggcggagatcggggtcgttttagtggggttagggttcgcgtttgagtcgagcggacggtaggaggaggcggcggcggcgatcgcggtggtcgttcgtttttttattatggaggtttcggggtcggttcgcgcgttcgttgtgtttcgcgcgtttgcgcggtcgcgttaatattttttttttttttcgtcgtaattatcgcgcgcgcgttcggcgggggatagtaggaaggggggtcggcggcgagcgcgagtttcgtttattcgggtttatatcgaagggtagcgtgttcgcgcgggggtcggcgggtgggagatcgcgtttcgaggagggcgagggagatttaggtttcgcgcgacggtttttttcgttggagtgagattgaggaaggggtcgttttttgtttttttttttttatttcgttttagagaaagagttttatttttt

SEQ ID NO: 31802 - DNA, 840 bp, Artificial Sequence
  chemically treated genomic DNA (Homo sapiens) CpG-island No: 31802
aaaaaataaaactctttctctaaaacgaaataaaaaaaaaaaaacaaaaaacgaccccttcctcaatctcactccaacgaaaaaaaccgtcgcgcgaaacctaaatctccctcgccctcctcgaaacgcgatctcccacccgccgacccccgcgcgaacacgctacccttcgatataaacccgaataaacgaaactcgcgctcgccgccgaccccccttcctactatcccccgccgaacgcgcgcgcgataattacgacgaaaaaaaaaaaaaatattaacgcgaccgcgcaaacgcgcgaaacacaacgaacgcgcgaaccgaccccgaaacctccataataaaaaaacgaacgaccaccgcgatcgccgccgccgcctcctcctaccgtccgctcgactcaaacgcgaaccctaaccccactaaaacgaccccgatctccgcccctacccccgaaccgaacccgacaaataaaaaaaacgacgacgaaaacaaccccgaacccacgacgaacccgaaacccctaaacctaccgaaaatcctacactttatccaacacgaataaacgcgcttcgaaaccgaaaaaacccgctaaaaaaccgaacgcgccgaattacaaataaacgctatcccgaaaccccccgacccccaacccgacccgacccgacccgacccgacctcacccgctaccgccgccgccgccatcttaaaacaataaccgccgaaacgaccgacgaaaaaacgaaaaaaaaccgcgaacgatcccgaaaaacgaataaaaaaccgtccgaaaaatatcctaaaaacactccgaaataaaacgaaaccgaaacgacccga

SEQ ID NO: 31803 - DNA, 840 bp, Artificial Sequence
  chemically treated genomic DNA (Homo sapiens) CpG-island No: 31803
aaggggtaaggttttttttttggggcgaagtgggaggaggggggtagaaagcggttttttttttagttttattttagcgagggggatcgtcgcgcggggtttgggtttttttcgtttttttcggggcgcgattttttattcgtcggttttcgcgcgggtacgttatttttcggtgtagattcgggtgggcgaggttcgcgttcgtcgtcggtttttttttttattgtttttcgtcgggcgcgcgcgcggtggttgcggcgggggagggggggggtgttggcgcggtcgcgtaggcgcgcgaggtatagcgggcgcgcgggtcggtttcggggtttttatgatggaggagcgagcggttatcgcggtcgtcgtcgtcgtttttttttgtcgttcgttcggtttaggcgcgggttttggttttattggggcggtttcggttttcgtttttgttttcgggtcgggttcggtaggtaagggaggcggcggcggaggtagtttcgggtttacggcgggttcggagtttttgagtttgtcggggattttgtattttatttagtacgagtgggcgcgtttcgaagtcgagaaagttcgttgggaggtcgagcgcgtcgagttataggtgagcgttgtttcgggatttttcgatttttaattcggttcggttcggttcggttcggttttattcgttgtcgtcgtcgtcgttattttggagtaatggtcgtcgggacggtcggcgggggggcgggaggggatcgcgaacggtttcggagggcgagtgaggggtcgttcgaggggtgttttgagggtatttcggggtgggacgggatcgggacggttcga

SEQ ID NO: 31804 - DNA, 840 bp, Artificial Sequence
  chemically treated genomic DNA (Homo sapiens) CpG-island No: 31804
tcgaaccgtcccgatcccgtcccaccccgaaataccctcaaaacacccctcgaacgacccctcactcgccctccgaaaccgttcgcgatcccctcccgcccccccgccgaccgtcccgacgaccattactccaaaataacgacgacgacgacaacgaataaaaccgaaccgaaccgaaccgaaccgaattaaaaatcgaaaaatcccgaaacaacgctcacctataactcgacgcgctcgacctcccaacgaactttctcgacttcgaaacgcgcccactcgtactaaataaaatacaaaatccccgacaaactcaaaaactccgaacccgccgtaaacccgaaactacctccgccgccgcctcccttacctaccgaacccgacccgaaaacaaaaacgaaaaccgaaaccgccccaataaaaccaaaacccgcgcctaaaccgaacgaacgacaaaaaaaaacgacgacgacgaccgcgataaccgctcgctcctccatcataaaaaccccgaaaccgacccgcgcgcccgctatacctcgcgcgcctacgcgaccgcgccaacaccccccccctcccccgccgcaaccaccgcgcgcgcgcccgacgaaaaacaataaaaaaaaaaaccgacgacgaacgcgaacctcgcccacccgaatctacaccgaaaaataacgtacccgcgcgaaaaccgacgaataaaaaatcgcgccccgaaaaaaacgaaaaaaacccaaaccccgcgcgacgatccccctcgctaaaataaaactaaaaaaaaaaccgctttctacccccctcctcccacttcgccccaaaaaaaaaaccttacccctt

SEQ ID NO: 31805 - DNA, 625 bp, Artificial Sequence
  chemically treated genomic DNA (Homo sapiens) CpG-island No: 31805
gatttcgtaagatttaggaacgaatcgagtatttttttgttgggggtattttcggtattgttcgcggtttttacggaggcgttgatggcggcggaggcggcgttcggttgtagagttagcgttaagtttatttcgagcgtcgacgttagtagcgtggtgattaggaaaaagagtagcgtttaggcgtttagacggtcgagcgcgtcggggtttaggttggcggcgtcgtcgattaagttgtatattattagcggtaagatgattattcgtagtagacgtagtagtagttcgttcgggaagacgaaggcgtttaagcgtttcgggtttaacgttagcgtattttcggttttcgatatttttagttttagcgttacgtcggttattacggttattattgttagtagtataagtaggttggttcgaaggtagcggcgtatttggtttcgggaatcgtagtagtcgtttgttgtcgcgttttggttttcgatggaggttagcgttaggttttcgttggcggtgggtttcgtcgttgcgagttttttggagtttcgaggaggatcggttattatgatgggaagtatcggggttttttagcgtttggaagttggttgggagcgtttgggtt

SEQ ID NO: 31806 - DNA, 625 bp, Artificial Sequence
  chemically treated genomic DNA (Homo sapiens) CpG-island No: 31806
aacccaaacgctcccaaccaacttccaaacgctaaaaaaccccgatacttcccatcataataaccgatcctcctcgaaactccaaaaaactcgcaacgacgaaacccaccgccaacgaaaacctaacgctaacctccatcgaaaaccaaaacgcgacaacaaacgactactacgattcccgaaaccaaatacgccgctaccttcgaaccaacctacttatactactaacaataataaccgtaataaccgacgtaacgctaaaactaaaaatatcgaaaaccgaaaatacgctaacgttaaacccgaaacgcttaaacgccttcgtcttcccgaacgaactactactacgtctactacgaataatcatcttaccgctaataatatacaacttaatcgacgacgccgccaacctaaaccccgacgcgctcgaccgtctaaacgcctaaacgctactctttttcctaatcaccacgctactaacgtcgacgctcgaaataaacttaacgctaactctacaaccgaacgccgcctccgccgccatcaacgcctccgtaaaaaccgcgaacaataccgaaaatacccccaacaaaaaaatactcgattcgttcctaaatcttacgaaatc

SEQ ID NO: 31807 - DNA, 625 bp, Artificial Sequence
  chemically treated genomic DNA (Homo sapiens) CpG-island No: 31807
agtttaagcgtttttagttagtttttaggcgttaagaaatttcggtgttttttattatggtggtcgatttttttcgagattttaaggggttcgtagcggcggagtttatcgttaacgggggtttggcgttggtttttatcgaggattaaggcgcggtagtaggcggttattgcggttttcgggattaggtgcgtcgttgttttcgagttaatttgtttgtgttgttgatagtggtggtcgtggtggtcggcgtggcgttgggattgggggtgtcgggggtcgggggtgcgttggcgttgggttcggagcgtttgagcgttttcgttttttcgggcgagttgttgttgcgtttgttgcggatgattattttgtcgttggtggtgtgtagtttgatcggcggcgtcgttagtttggatttcggcgcgttcggtcgtttgggcgtttgggcgttgtttttttttttggttattacgttgttggcgtcggcgttcggagtgggtttggcgttggttttgtagtcgggcgtcgttttcgtcgttattaacgttttcgtgggagtcgcgggtagtgtcgaaaatgtttttagtaaggaggtgttcgattcgtttttggattttgcgaggtt

SEQ ID NO: 31808 - DNA, 625 bp, Artificial Sequence
  chemically treated genomic DNA (Homo sapiens) CpG-island No: 31808
aacctcgcaaaatccaaaaacgaatcgaacacctccttactaaaaacattttcgacactacccgcgactcccacgaaaacgttaataacgacgaaaacgacgcccgactacaaaaccaacgccaaacccactccgaacgccgacgccaacaacgtaataaccaaaaaaaaaaacaacgcccaaacgcccaaacgaccgaacgcgccgaaatccaaactaacgacgccgccgatcaaactacacaccaccaacgacaaaataatcatccgcaacaaacgcaacaacaactcgcccgaaaaaacgaaaacgctcaaacgctccgaacccaacgccaacgcacccccgacccccgacacccccaatcccaacgccacgccgaccaccacgaccaccactatcaacaacacaaacaaattaactcgaaaacaacgacgcacctaatcccgaaaaccgcaataaccgcctactaccgcgccttaatcctcgataaaaaccaacgccaaacccccgttaacgataaactccgccgctacgaaccccttaaaatctcgaaaaaaatcgaccaccataataaaaaacaccgaaatttcttaacgcctaaaaactaactaaaaacgcttaaact

SEQ ID NO: 31809 - DNA, 627 bp, Artificial Sequence
  chemically treated genomic DNA (Homo sapiens) CpG-island No: 31809
gttcggcgcgtcgtcgtcgtatttttatttttatcggcgtttttttcgttttcggtttcggcgttttttatttcgggttgggttagtcgtagcgtttgttgtacgcggtatttttgtttttttcggagttaatgtaattcgtagagttcggttaggttattttttagttagtttcgtagtcggtttcgtttagggtttatcgggaacgagaaggttcggattatggttgcggtttttcgttttagttcggtcgggtttcgcggttatttttttttcggttttattttttcgttttagtagtttgttcgttcgttcgttggtcgggttgttatcgttttatttgtataggcgttcgtttattgggtcgtttattcgcgttttatttgtatggttacgttttcggcgatcgagtaatagtcgtttattggcgaataagttttttgacgaagattttcgggcgtgtaatcgtatcgtttaatacgacgtatgttcgtaattgtttatttatttcgttcgttacgtttttttcgtgtaattgtttcggggttttggttacgtttttttacgcgttataatgaaataagttcgtttttgttttaatgttattggtttgtgtttggtcggttt

SEQ ID NO: 31810 - DNA, 627 bp, Artificial Sequence
  chemically treated genomic DNA (Homo sapiens) CpG-island No: 31810
aaaccgaccaaacacaaaccaataacattaaaacaaaaacgaacttatttcattataacgcgtaaaaaaacgtaaccaaaaccccgaaacaattacacgaaaaaaacgtaacgaacgaaataaataaacaattacgaacatacgtcgtattaaacgatacgattacacgcccgaaaatcttcgtcaaaaaacttattcgccaataaacgactattactcgatcgccgaaaacgtaaccatacaaataaaacgcgaataaacgacccaataaacgaacgcctatacaaataaaacgataacaacccgaccaacgaacgaacgaacaaactactaaaacgaaaaaataaaaccgaaaaaaaaataaccgcgaaacccgaccgaactaaaacgaaaaaccgcaaccataatccgaaccttctcgttcccgataaaccctaaacgaaaccgactacgaaactaactaaaaaataacctaaccgaactctacgaattacattaactccgaaaaaaacaaaaataccgcgtacaacaaacgctacgactaacccaacccgaaataaaaaacgccgaaaccgaaaacgaaaaaaacgccgataaaaataaaaatacgacgacgacgcgccgaac

SEQ ID NO: 31811 - DNA, 627 bp, Artificial Sequence
  chemically treated genomic DNA (Homo sapiens) CpG-island No: 31811
ggatcggttaggtatagattaatggtattgaagtaagggcgggtttgttttattgtgacgcgtgggggggcgtggttagggtttcgaggtagttgtacggagggggcgtggcgagcggagtgagtaggtagttgcgagtatgcgtcgtgttgggcggtgcggttgtacgttcgagagttttcgttaggaagtttattcgttaataggcggttgttgttcggtcgtcgggggcgtggttatgtagataaggcgcgggtgggcggtttaatgggcgggcgtttatgtagatgagacggtgatagttcggttagcgggcgggcgggtaggttgttggggcggggaggtgggatcgggagaggggtggtcgcggggttcggtcgggttggggcggggggtcgtagttatgattcgggttttttcgttttcggtgagttttgagcggggtcggttgcggggttggttggagggtagtttggtcgggttttgcgagttatattggtttcgggagaggtaggagtatcgcgtgtagtaggcgttgcggttggtttagttcggaatggggggcgtcgaggtcgaggacgaggaggacgtcgatgaggatgaagatgcggcggcggcgcgtcgggt

SEQ ID NO: 31812 - DNA, 627 bp, Artificial Sequence
  chemically treated genomic DNA (Homo sapiens) CpG-island No: 31812
acccgacgcgccgccgccgcatcttcatcctcatcgacgtcctcctcgtcctcgacctcgacgccccccattccgaactaaaccaaccgcaacgcctactacacgcgatactcctacctctcccgaaaccaatataactcgcaaaacccgaccaaactaccctccaaccaaccccgcaaccgaccccgctcaaaactcaccgaaaacgaaaaaacccgaatcataactacgaccccccgccccaacccgaccgaaccccgcgaccacccctctcccgatcccacctccccgccccaacaacctacccgcccgcccgctaaccgaactatcaccgtctcatctacataaacgcccgcccattaaaccgcccacccgcgccttatctacataaccacgcccccgacgaccgaacaacaaccgcctattaacgaataaacttcctaacgaaaactctcgaacgtacaaccgcaccgcccaacacgacgcatactcgcaactacctactcactccgctcgccacgccccctccgtacaactacctcgaaaccctaaccacgcccccccacgcgtcacaataaaacaaacccgcccttacttcaataccattaatctatacctaaccgatcc

SEQ ID NO: 31813 - DNA, 535 bp, Artificial Sequence
  chemically treated genomic DNA (Homo sapiens) CpG-island No: 31813
gtgacgcggtttatagagggacgcgttacgtatcgtcgagttgtgttttttcgtcgaagaaagtgaagtgggttcgggaggcggggcgcgcggcgagggaaagtagttcggcgacgggagcgagcgcgcgcgcgttcggcggtaaatttaatttttgtgtagggtggggacgagagattcgcgggttcgtaggtgtggagcggggcgcggagggattcgtgggagtcgtagtgcggcggcgcgcgggtcgggtggggcggggtcgagcgaggcggggcgcgcgcggcggtcgttgagggatcgttggggcgggaggcggcggcggcggcggcgcgcgttgcgggtagtgagtgtggaggcgcggacgcgcggcggatttggaattgttgtagttgttgtcgtcgtcggaggaattttgattttcgtgtttcggatatttcgggtttcgttatggtgagtgaggttggggggtcgtcgaggttgcgggttttgaggcgggtttaacggggtaggatttttgagggggcgatagagt

SEQ ID NO: 31814 - DNA, 535 bp, Artificial Sequence
  chemically treated genomic DNA (Homo sapiens) CpG-island No: 31814
actctatcgccccctcaaaaatcctaccccgttaaacccgcctcaaaacccgcaacctcgacgaccccccaacctcactcaccataacgaaacccgaaatatccgaaacacgaaaatcaaaattcctccgacgacgacaacaactacaacaattccaaatccgccgcgcgtccgcgcctccacactcactacccgcaacgcgcgccgccgccgccgccgcctcccgccccaacgatccctcaacgaccgccgcgcgcgccccgcctcgctcgaccccgccccacccgacccgcgcgccgccgcactacgactcccacgaatccctccgcgccccgctccacacctacgaacccgcgaatctctcgtccccaccctacacaaaaattaaatttaccgccgaacgcgcgcgcgctcgctcccgtcgccgaactactttccctcgccgcgcgccccgcctcccgaacccacttcactttcttcgacgaaaaaacacaactcgacgatacgtaacgcgtccctctataaaccgcgtcac

SEQ ID NO: 31815 - DNA, 535 bp, Artificial Sequence
  chemically treated genomic DNA (Homo sapiens) CpG-island No: 31815
gttttgtcgtttttttaggggttttgtttcgttaagttcgttttagagttcgtagtttcggcgattttttagttttatttattatggcgaggttcggggtgttcggagtacggggattaaggttttttcggcggcgatagtagttgtagtagttttagattcgtcgcgcgttcgcgtttttatatttattgttcgtagcgcgcgtcgtcgtcgtcgtcgtttttcgttttaacggttttttaacggtcgtcgcgcgcgtttcgtttcgttcggtttcgttttattcggttcgcgcgtcgtcgtattgcggtttttacggattttttcgcgtttcgttttatatttacgggttcgcgaatttttcgtttttattttgtataggaattgggtttgtcgtcgggcgcgcgcgcgttcgttttcgtcgtcggattattttttttcgtcgcgcgtttcgtttttcgggtttattttatttttttcggcggaggggtatagttcggcggtgcgtgacgcgtttttttgtgagtcgcgttat

SEQ ID NO: 31816 - DNA, 535 bp, Artificial Sequence
  chemically treated genomic DNA (Homo sapiens) CpG-island No: 31816
ataacgcgactcacaaaaaaacgcgtcacgcaccgccgaactatacccctccgccgaaaaaaataaaataaacccgaaaaacgaaacgcgcgacgaaaaaaaataatccgacgacgaaaacgaacgcgcgcgcgcccgacgacaaacccaattcctatacaaaataaaaacgaaaaattcgcgaacccgtaaatataaaacgaaacgcgaaaaaatccgtaaaaaccgcaatacgacgacgcgcgaaccgaataaaacgaaaccgaacgaaacgaaacgcgcgcgacgaccgttaaaaaaccgttaaaacgaaaaacgacgacgacgacgacgcgcgctacgaacaataaatataaaaacgcgaacgcgcgacgaatctaaaactactacaactactatcgccgccgaaaaaaccttaatccccgtactccgaacaccccgaacctcgccataataaataaaactaaaaaatcgccgaaactacgaactctaaaacgaacttaacgaaacaaaacccctaaaaaaacgacaaaac

SEQ ID NO: 31817 - DNA, 645 bp, Artificial Sequence
  chemically treated genomic DNA (Homo sapiens) CpG-island No: 31817
ttggcggggtttgcgggcgtttttgtatttgttttatttttagaggtcgcggtggtcgttattagttgttgcggttatacgaggttatcgttgtcgtttgagtcgttggaggtagagttgaaggtaggcgattttttttcgttggcgttcgattcgtttttttcgtaattttcgtcgacgtttttcgtaggttttcggcgttttaggggttttaggcgtttagtcgagtattcggagtcgttgttcgcgtagtcgtaaagtagacgacgttggggagttgacggggacgggtcggggtcgggaatacgcgtcgtaggggttcggggtcgtacgcggcgtttatcggtagcgtcgattttcgtagtggagcgttagcgacggtaggattttgcggtttgggtcgttagcgtgggcgttgggtcgcggcgtggtcggggaggtcgaggtttttttcgtttcgtcgtggggtatttagggggtttcgaagggatcgcggaggcgcggtttagtaggttggttttagattgggagcgcgaggttttgcgggttttgggcgagtcgcggcggttcgaagtttcggttatgcgtttacggcggtcggcggttcggggacgttttcgggggtggtgattgttttacgttgcg

SEQ ID NO: 31818 - DNA, 645 bp, Artificial Sequence
  chemically treated genomic DNA (Homo sapiens) CpG-island No: 31818
cgcaacgtaaaacaatcaccacccccgaaaacgtccccgaaccgccgaccgccgtaaacgcataaccgaaacttcgaaccgccgcgactcgcccaaaacccgcaaaacctcgcgctcccaatctaaaaccaacctactaaaccgcgcctccgcgatcccttcgaaaccccctaaataccccacgacgaaacgaaaaaaacctcgacctccccgaccacgccgcgacccaacgcccacgctaacgacccaaaccgcaaaatcctaccgtcgctaacgctccactacgaaaatcgacgctaccgataaacgccgcgtacgaccccgaacccctacgacgcgtattcccgaccccgacccgtccccgtcaactccccaacgtcgtctactttacgactacgcgaacaacgactccgaatactcgactaaacgcctaaaacccctaaaacgccgaaaacctacgaaaaacgtcgacgaaaattacgaaaaaaacgaatcgaacgccaacgaaaaaaaatcgcctaccttcaactctacctccaacgactcaaacgacaacgataacctcgtataaccgcaacaactaataacgaccaccgcgacctctaaaaataaaacaaatacaaaaacgcccgcaaaccccgccaa

SEQ ID NO: 31819 - DNA, 645 bp, Artificial Sequence
  chemically treated genomic DNA (Homo sapiens) CpG-island No: 31819
cgtagcgtggagtagttattattttcgggagcgttttcgggtcgtcggtcgtcgtggacgtatggtcgaggtttcgggtcgtcgcggttcgtttagggttcgtaaggtttcgcgtttttagtttgagattagtttgttgggtcgcgttttcgcggttttttcggggttttttaagtattttacggcggagcgggaagagtttcggttttttcggttacgtcgcggtttagcgtttacgttggcggtttaggtcgtagggttttgtcgtcgttggcgttttattgcggagatcgacgttgtcgatgggcgtcgcgtgcggtttcgagtttttgcggcgcgtgttttcggtttcggttcgttttcgttagttttttagcgtcgtttgttttacggttgcgcgggtagcgatttcgagtgttcggttgggcgtttggggtttttgggacgtcgggggtttgcgggaggcgtcggcgggggttacggggagagcgaatcgagcgttagcgagggagaatcgtttgtttttagttttgtttttagcgatttagacggtagcggtggtttcgtgtggtcgtagtagttggtggcggttatcgcggtttttgggggtggagtaggtgtaggggcgttcgtaggtttcgttaa

SEQ ID NO: 31820 - DNA, 645 bp, Artificial Sequence
  chemically treated genomic DNA (Homo sapiens) CpG-island No: 31820
ttaacgaaacctacgaacgcccctacacctactccacccccaaaaaccgcgataaccgccaccaactactacgaccacacgaaaccaccgctaccgtctaaatcgctaaaaacaaaactaaaaacaaacgattctccctcgctaacgctcgattcgctctccccgtaacccccgccgacgcctcccgcaaacccccgacgtcccaaaaaccccaaacgcccaaccgaacactcgaaatcgctacccgcgcaaccgtaaaacaaacgacgctaaaaaactaacgaaaacgaaccgaaaccgaaaacacgcgccgcaaaaactcgaaaccgcacgcgacgcccatcgacaacgtcgatctccgcaataaaacgccaacgacgacaaaaccctacgacctaaaccgccaacgtaaacgctaaaccgcgacgtaaccgaaaaaaccgaaactcttcccgctccgccgtaaaatacttaaaaaaccccgaaaaaaccgcgaaaacgcgacccaacaaactaatctcaaactaaaaacgcgaaaccttacgaaccctaaacgaaccgcgacgacccgaaacctcgaccatacgtccacgacgaccgacgacccgaaaacgctcccgaaaataataactactccacgctacg

SEQ ID NO: 31821 - DNA, 552 bp, Artificial Sequence
  chemically treated genomic DNA (Homo sapiens) CpG-island No: 31821
cggttcgtagtgtattttatagggagtttcgtcgggtttatttttgtttcgatttttatttcgcgcgttttttcggttttattttttagatttttaggcgacgaatggaaagggggtttttttttttttatttgggacggaggcgttcgtttatggtagttggcggatggaagttacgcggcgtcgtttcgcgaagagagggaatagagggggttgtgtttcggcggtcgttacgtttattttttcgggttttggttttcgtagtcgttcgggtggacgtagtcggtggcgagtattttttagtcggattcgtattattattattttcggcgtttgtttcgcgtttttttatgtcgttgtcgtcgtggtatcgttttttcgcggttggtagtggtattattttaatcgtatcgattggtaatttcgtttacgggaagaggcgggttcggagcgggaggagcgattaggagtttttgggagaaaggattttttttggggtggtagaagcgttcgtttgtttatagttaacggagggtacggtataaaagttaa

SEQ ID NO: 31822 - DNA, 552 bp, Artificial Sequence
  chemically treated genomic DNA (Homo sapiens) CpG-island No: 31822
ttaacttttataccgtaccctccgttaactataaacaaacgaacgcttctaccaccccaaaaaaaatcctttctcccaaaaactcctaatcgctcctcccgctccgaacccgcctcttcccgtaaacgaaattaccaatcgatacgattaaaataataccactaccaaccgcgaaaaaacgataccacgacgacaacgacataaaaaaacgcgaaacaaacgccgaaaataataataatacgaatccgactaaaaaatactcgccaccgactacgtccacccgaacgactacgaaaaccaaaacccgaaaaaataaacgtaacgaccgccgaaacacaaccccctctattccctctcttcgcgaaacgacgccgcgtaacttccatccgccaactaccataaacgaacgcctccgtcccaaataaaaaaaaaaaaaccccctttccattcgtcgcctaaaaatctaaaaaataaaaccgaaaaaacgcgcgaaataaaaatcgaaacaaaaataaacccgacgaaactccctataaaatacactacgaaccg

SEQ ID NO: 31823 - DNA, 552 bp, Artificial Sequence
  chemically treated genomic DNA (Homo sapiens) CpG-island No: 31823
ttgatttttatatcgtatttttcgttggttgtgaataggcgagcgtttttgttattttaggggaggtttttttttttagaagtttttagtcgtttttttcgtttcgagttcgttttttttcgtgggcggggttattagtcggtgcggttgggatggtgttattgttagtcgcgagagggcggtattacggcggtagcgatatgggggggcgcggagtagacgtcggaagtagtggtggtacgggttcgattgaggggtattcgttatcggttgcgtttattcgagcggttgcgagagttaaggttcgagggggtgggcgtggcggtcgtcgaaatataattttttttgtttttttttttcgcggagcggcgtcgcgtagtttttattcgttagttgttatgagcgagcgttttcgttttaggtgagagggaagggattttttttttattcgtcgtttgaggatttgggagatagagtcgagggggcgcgcgaaatgggggtcggagtaagagtggattcggcggggttttttgtggggtgtattgcgggtcg

SEQ ID NO: 31824 - DNA, 552 bp, Artificial Sequence
  chemically treated genomic DNA (Homo sapiens) CpG-island No: 31824
cgacccgcaatacaccccacaaaaaaccccgccgaatccactcttactccgacccccatttcgcgcgccccctcgactctatctcccaaatcctcaaacgacgaataaaaaaaaaatcccttccctctcacctaaaacgaaaacgctcgctcataacaactaacgaataaaaactacgcgacgccgctccgcgaaaaaaaaaaacaaaaaaaattatatttcgacgaccgccacgcccaccccctcgaaccttaactctcgcaaccgctcgaataaacgcaaccgataacgaatacccctcaatcgaacccgtaccaccactacttccgacgtctactccgcgcccccccatatcgctaccgccgtaataccgccctctcgcgactaacaataacaccatcccaaccgcaccgactaataaccccgcccacgaaaaaaaacgaactcgaaacgaaaaaaacgactaaaaacttctaaaaaaaaaaacctcccctaaaataacaaaaacgctcgcctattcacaaccaacgaaaaatacgatataaaaatcaa

SEQ ID NO: 31825 - DNA, 808 bp, Artificial Sequence
  chemically treated genomic DNA (Homo sapiens) CpG-island No: 31825
  misc_feature (468)..(468): n is either a, c, g or t
tttacgggtatagttcgtagtttgggttttgcgttttttttgattaaagttcgtagagaaggaagtgcgagaataaaggaagggttttttgtcggtcgcgtttacggttttcgcgtacgtatacggtcgacggatatagtttagagcgcgatttttttacgtcggggttttcgttttagcggtttttcggatttcggttttatagtacgttcgcgcggttgggaaggttcgagggtacgggggattcgtttttggagttttcgtagtcgaggtttagcggtggtagttgcggggatcgggagtagggggtggggtagggggttcgttcgtttcgggttcgtatttcgttcggtgttcgcgcgacgttttcggttttggtttaacggggtgtgaatcggtgtgttttaaaaatatttgggattttcgcggaacgacggcggtggaacggttacgggggacgttgaagtntcgcgggtttcggtttcgtattattttcggtttgggcgacggaaatttaattgtagtttcgcggcgttatttacggatcggatttcgtagttagattttcggtttcggggcgtttcgtgagtttcgcggtgtattcggttttttttggttttcggttcgtttttttttttttcgggggtttttattttaagtttcgacgtcgttttgtagtagatagttcggttcggtttaggtttcggattcggttttcgtggaaggggaaggggtgtttaagttgttcgggtttaggcggtattttttgagttcggggagttgaggtttcgtttttcgcgttattata

SEQ ID NO: 31826 - DNA, 808 bp, Artificial Sequence
  chemically treated genomic DNA (Homo sapiens) CpG-island No: 31826
  misc_feature (341)..(341): n is either a, c, g or t
tataataacgcgaaaaacgaaacctcaactccccgaactcaaaaaataccgcctaaacccgaacaacttaaacaccccttccccttccacgaaaaccgaatccgaaacctaaaccgaaccgaactatctactacaaaacgacgtcgaaacttaaaataaaaacccccgaaaaaaaaaaaaacgaaccgaaaaccaaaaaaaaccgaatacaccgcgaaactcacgaaacgccccgaaaccgaaaatctaactacgaaatccgatccgtaaataacgccgcgaaactacaattaaatttccgtcgcccaaaccgaaaataatacgaaaccgaaacccgcganacttcaacgtcccccgtaaccgttccaccgccgtcgttccgcgaaaatcccaaatatttttaaaacacaccgattcacaccccgttaaaccaaaaccgaaaacgtcgcgcgaacaccgaacgaaatacgaacccgaaacgaacgaaccccctaccccaccccctactcccgatccccgcaactaccaccgctaaacctcgactacgaaaactccaaaaacgaatcccccgtaccctcgaaccttcccaaccgcgcgaacgtactataaaaccgaaatccgaaaaaccgctaaaacgaaaaccccgacgtaaaaaaatcgcgctctaaactatatccgtcgaccgtatacgtacgcgaaaaccgtaaacgcgaccgacaaaaaacccttcctttattctcgcacttccttctctacgaactttaatcaaaaaaaacgcaaaacccaaactacgaactatacccgtaaa

SEQ ID NO: 31827 - DNA, 808 bp, Artificial Sequence
  chemically treated genomic DNA (Homo sapiens) CpG-island No: 31827
  misc_feature (341)..(341): n is either a, c, g or t
tgtggtggcgcgggggacggggttttagtttttcgggtttaggagatatcgtttggattcgggtagtttaaatattttttttttttttacgaggatcgagttcgaggtttgagtcgggtcgggttgtttgttgtagggcggcgtcgagatttggggtgggagttttcggaggaggaagagacgaatcgggagttagagggagtcgggtatatcgcgggatttacggggcgtttcggggtcgggaatttagttacggaattcggttcgtaggtggcgtcgcgaggttgtagttgggttttcgtcgtttaggtcgagggtggtgcggagtcgggattcgcggngttttagcgtttttcgtggtcgttttatcgtcgtcgtttcgcggagattttaggtgtttttagggtatatcggtttatatttcgttgggttaagatcgagagcgtcgcgcgggtatcggacggggtgcgaattcggggcggacgggttttttgttttattttttattttcgattttcgtagttgttatcgttgggtttcggttgcgaaggttttagaaacgggtttttcgtattttcgggtttttttagtcgcgcgggcgtgttatggagtcgaggttcgggaggtcgttagggcgggggtttcggcgtggaaggatcgcgttttgggttgtgttcgtcggtcgtgtgcgtgcgcggaggtcgtgggcgcggtcggtaggggattttttttttgttttcgtatttttttttttgcgggttttggttagggaggacgtaaggtttaggttgcgagttgtgttcgtggg

SEQ ID NO: 31828 - DNA, 808 bp, Artificial Sequence
  chemically treated genomic DNA (Homo sapiens) CpG-island No: 31828
  misc_feature (468)..(468): n is either a, c, g or t
cccacgaacacaactcgcaacctaaaccttacgtcctccctaaccaaaacccgcaaaaaaaaaaatacgaaaacaaaaaaaaaatcccctaccgaccgcgcccacgacctccgcgcacgcacacgaccgacgaacacaacccaaaacgcgatccttccacgccgaaacccccgccctaacgacctcccgaacctcgactccataacacgcccgcgcgactaaaaaaacccgaaaatacgaaaaacccgtttctaaaaccttcgcaaccgaaacccaacgataacaactacgaaaatcgaaaataaaaaataaaacaaaaaacccgtccgccccgaattcgcaccccgtccgatacccgcgcgacgctctcgatcttaacccaacgaaatataaaccgatataccctaaaaacacctaaaatctccgcgaaacgacgacgataaaacgaccacgaaaaacgctaaaacnccgcgaatcccgactccgcaccaccctcgacctaaacgacgaaaacccaactacaacctcgcgacgccacctacgaaccgaattccgtaactaaattcccgaccccgaaacgccccgtaaatcccgcgatatacccgactccctctaactcccgattcgtctcttcctcctccgaaaactcccaccccaaatctcgacgccgccctacaacaaacaacccgacccgactcaaacctcgaactcgatcctcgtaaaaaaaaaaaaaatatttaaactacccgaatccaaacgatatctcctaaacccgaaaaactaaaaccccgtcccccgcgccaccaca

SEQ ID NO: 31829 - DNA, 526 bp, Artificial Sequence
  chemically treated genomic DNA (Homo sapiens) CpG-island No: 31829
ttcgggagttcgtcggcggcgttggggagcggttcgaggtttaatagttttttttgtggtcgggttattaatttttttttttcgattttatttttgtttcggtagagttatgagattcgtatttcggtcgattagggtatcgcgggatacgtggcgattacgggttagattttgaatatttttgacgtatatgtttattcgtttttttatcgcggcgtggacgatagtatcggttttcgtacgcgtaatattttttgtttttttattaagaacgagaattagggtgcgcgtggcggttcgggcggaggggcggggtttgcgtcgggcggggcgggttcgagcgagcgggggtggtaatatttttttatcgtttttagcgtttcggagtataagggagtcgggttttatgtttgggacgtacgtaatttgcggaaattgcgagggtaggtttcggtcggatttttttttttaatcgatttttttttttatcggtggttttttgttttttttttttttttagaggtta

SEQ ID NO: 31830 - DNA, 526 bp, Artificial Sequence
  chemically treated genomic DNA (Homo sapiens) CpG-island No: 31830
taacctctaaaaaaaaaaaaaaaacaaaaaaccaccgataaaaaaaaaaatcgattaaaaaaaaaaatccgaccgaaacctaccctcgcaatttccgcaaattacgtacgtcccaaacataaaacccgactcccttatactccgaaacgctaaaaacgataaaaaaatattaccacccccgctcgctcgaacccgccccgcccgacgcaaaccccgcccctccgcccgaaccgccacgcgcaccctaattctcgttcttaataaaaaaacaaaaaatattacgcgtacgaaaaccgatactatcgtccacgccgcgataaaaaaacgaataaacatatacgtcaaaaatattcaaaatctaacccgtaatcgccacgtatcccgcgataccctaatcgaccgaaatacgaatctcataactctaccgaaacaaaaataaaatcgaaaaaaaaaaattaataacccgaccacaaaaaaaactattaaacctcgaaccgctccccaacgccgccgacgaactcccgaa

SEQ ID NO: 31831 - DNA, 526 bp, Artificial Sequence
  chemically treated genomic DNA (Homo sapiens) CpG-island No: 31831
tgatttttggggaagggagaggggtaaggaattatcggtggagggagggatcggttggagggagggattcggtcgggatttgttttcgtagttttcgtaggttacgtacgttttaggtatggaattcgatttttttatgtttcgggacgttggaggcggtggggaagtgttgttattttcgttcgttcggattcgtttcgttcggcgtaggtttcgttttttcgttcgggtcgttacgcgtattttggttttcgtttttgatggggaagtagaggatgttgcgcgtgcggaagtcggtgttgtcgtttacgtcgcggtagaaaagcggatgggtatatgcgttagggatgtttaggatttggttcgtggtcgttacgtgtttcgcgatgttttgatcggtcgggatgcggattttatagttttgtcggagtagagatggagtcgagaggaagaagttagtgattcggttatagaggggattgttaaatttcgggtcgttttttagcgtcgtcggcggattttcgga

SEQ ID NO: 31832 - DNA, 526 bp, Artificial Sequence
  chemically treated genomic DNA (Homo sapiens) CpG-island No: 31832
tccgaaaatccgccgacgacgctaaaaaacgacccgaaatttaacaatcccctctataaccgaatcactaacttcttcctctcgactccatctctactccgacaaaactataaaatccgcatcccgaccgatcaaaacatcgcgaaacacgtaacgaccacgaaccaaatcctaaacatccctaacgcatatacccatccgcttttctaccgcgacgtaaacgacaacaccgacttccgcacgcgcaacatcctctacttccccatcaaaaacgaaaaccaaaatacgcgtaacgacccgaacgaaaaaacgaaacctacgccgaacgaaacgaatccgaacgaacgaaaataacaacacttccccaccgcctccaacgtcccgaaacataaaaaaatcgaattccatacctaaaacgtacgtaacctacgaaaactacgaaaacaaatcccgaccgaatccctccctccaaccgatccctccctccaccgataattccttacccctctcccttccccaaaaatca

SEQ ID NO: 31833 - DNA, 600 bp, Artificial Sequence
  chemically treated genomic DNA (Homo sapiens) CpG-island No: 31833
atttatcggcggtcggcgggcgtgagtgggattcggcggattcgggcgttcggtgtgtttcgtcgattgatttcgagttgttcgaattcggtttcggttatcgggggcggggcgtgaaaagggggcgttttttttcgggtgtaggttgaggggttcggattatttttattgcggacgagggattttgatcgcgtttcgttttttttttataacgagtggatttttttcggagtatttttagttttttttttacgggagatttttttagcgtcggtacgagagatgttagcggatttttatttttgatatatttgcgtcgttttcgaaacgcgatttgttcggcgttttttttcgggcgttttttttttcgagtcggtcgggagtcgggacgggggcgcgtagggttcggtaagttttgggcggatttagggagggtttcgtcggtcgttgttcgttggttcgtattcggggttgttcgcggaggtttcgttcgttttttttcgtcgttggttttttggtcgcgggaaggttggagtcgttttggttggtatcggggtttacgtttttttgtcggaggttggttttcgtttttgttttttt

SEQ ID NO: 31834 - DNA, 600 bp, Artificial Sequence
  chemically treated genomic DNA (Homo sapiens) CpG-island No: 31834
aaaaaaacaaaaacgaaaaccaacctccgacaaaaaaacgtaaaccccgataccaaccaaaacgactccaaccttcccgcgaccaaaaaaccaacgacgaaaaaaaacgaacgaaacctccgcgaacaaccccgaatacgaaccaacgaacaacgaccgacgaaaccctccctaaatccgcccaaaacttaccgaaccctacgcgcccccgtcccgactcccgaccgactcgaaaaaaaaaacgcccgaaaaaaaacgccgaacaaatcgcgtttcgaaaacgacgcaaatatatcaaaaataaaaatccgctaacatctctcgtaccgacgctaaaaaaatctcccgtaaaaaaaaaactaaaaatactccgaaaaaaatccactcgttataaaaaaaaaacgaaacgcgatcaaaatccctcgtccgcaataaaaataatccgaacccctcaacctacacccgaaaaaaaacgcccccttttcacgccccgcccccgataaccgaaaccgaattcgaacaactcgaaatcaatcgacgaaacacaccgaacgcccgaatccgccgaatcccactcacgcccgccgaccgccgataaat

SEQ ID NO: 31835 - DNA, 600 bp, Artificial Sequence
  chemically treated genomic DNA (Homo sapiens) CpG-island No: 31835
aagggagtagaggcgagagttagttttcggtaggagggcgtagatttcggtgttagttagaacggttttagttttttcgcggttagagagttagcggcgggaggggacgggcgggattttcgcggatagtttcgggtgcggattagcgggtagcggtcggcgagattttttttggattcgtttagagtttatcggattttgcgcgttttcgtttcggttttcggtcggttcgggggagaaggcgttcgaggggaggcgtcggatagatcgcgtttcggaggcggcgtaggtgtgttaggggtgggggttcgttggtatttttcgtgtcggcgttgggggggtttttcgtggaggaagggttgaaggtgtttcgggaggggtttattcgttatggaaaggaagcggggcgcggttagggtttttcgttcgtagtgggggtggttcgggttttttagtttgtattcgggaggagacgttttttttttacgtttcgttttcggtggtcgaggtcggattcggatagttcggggttagtcgacggagtatatcgggcgttcgaattcgtcgggttttatttacgttcgtcggtcgtcggtaggt

SEQ ID NO: 31836 - DNA, 600 bp, Artificial Sequence
  chemically treated genomic DNA (Homo sapiens) CpG-island No: 31836
acctaccgacgaccgacgaacgtaaataaaacccgacgaattcgaacgcccgatatactccgtcgactaaccccgaactatccgaatccgacctcgaccaccgaaaacgaaacgtaaaaaaaaaacgtctcctcccgaatacaaactaaaaaacccgaaccacccccactacgaacgaaaaaccctaaccgcgccccgcttcctttccataacgaataaacccctcccgaaacaccttcaacccttcctccacgaaaaacccccccaacgccgacacgaaaaataccaacgaacccccacccctaacacacctacgccgcctccgaaacgcgatctatccgacgcctcccctcgaacgccttctcccccgaaccgaccgaaaaccgaaacgaaaacgcgcaaaatccgataaactctaaacgaatccaaaaaaaatctcgccgaccgctacccgctaatccgcacccgaaactatccgcgaaaatcccgcccgtcccctcccgccgctaactctctaaccgcgaaaaaactaaaaccgttctaactaacaccgaaatctacgccctcctaccgaaaactaactctcgcctctactccctt

SEQ ID NO: 31837 - DNA, 534 bp, Artificial Sequence
  chemically treated genomic DNA (Homo sapiens) CpG-island No: 31837
gtcggcgggtaaggcgggttaggtttttttggagtgtttttttatcggcgtttcggacgttcgggtcgggaaagagttgttgtattaggtggtaacgagttgtattttcgagggttcggttttttagtaggcgtagagagagtaggacgttatagtgatcgagggtttggaagttcgttaatttcggaattggatttcgtttaaagtcgtttttttgtttttattggttgtgtagtcgtcgttttagagtcgtgcgaatggggttatgtcgattaaagcgtcgatggatgtggcgtaggtagcgcgtttattgtaaggttcggcgtacggtggcggggttttaggtgttgacgtaggtagtgtttgagatcgttagaagttcggaaaagcgatttaggtgttgtagaagggattttatgaggtgcgcgaaggttttattttcgtttttattttggagacggcgattttttgcgtattgattggaatattcgcgaaatgatacgtttttttgtaatgttattggtcgaaatgtat

SEQ ID NO: 31838 - DNA, 534 bp, Artificial Sequence
  chemically treated genomic DNA (Homo sapiens) CpG-island No: 31838
atacatttcgaccaataacattacaaaaaaacgtatcatttcgcgaatattccaatcaatacgcaaaaaatcgccgtctccaaaataaaaacgaaaataaaaccttcgcgcacctcataaaatcccttctacaacacctaaatcgcttttccgaacttctaacgatctcaaacactacctacgtcaacacctaaaaccccgccaccgtacgccgaaccttacaataaacgcgctacctacgccacatccatcgacgctttaatcgacataaccccattcgcacgactctaaaacgacgactacacaaccaataaaaacaaaaaaacgactttaaacgaaatccaattccgaaattaacgaacttccaaaccctcgatcactataacgtcctactctctctacgcctactaaaaaaccgaaccctcgaaaatacaactcgttaccacctaatacaacaactctttcccgacccgaacgtccgaaacgccgataaaaaaacactccaaaaaaacctaacccgccttacccgccgac

SEQ ID NO: 31839 - DNA, 534 bp, Artificial Sequence
  chemically treated genomic DNA (Homo sapiens) CpG-island No: 31839
atgtatttcgattaatagtattgtagagaggcgtattatttcgcggatgttttaattagtacgtagagagtcgtcgtttttaaggtgaaagcggaagtagggttttcgcgtattttatggaattttttttgtagtatttggatcgttttttcgagtttttggcggttttaagtattatttacgttagtatttgggatttcgttatcgtgcgtcgggttttgtagtgggcgcgttatttgcgttatatttatcggcgttttggtcggtatggttttattcgtacggttttggagcggcggttgtataattagtggaggtaagagggcggttttgggcggggtttagtttcgggattagcgaatttttaggttttcggttattgtgacgttttgttttttttgcgtttgttggagaatcgggttttcggggatgtagttcgttattatttggtgtagtaattttttttcggttcgggcgttcgggacgtcgatgaggagatattttaagagagtttggttcgttttgttcgtcggt

SEQ ID NO: 31840 - DNA, 534 bp, Artificial Sequence
  chemically treated genomic DNA (Homo sapiens) CpG-island No: 31840
accgacgaacaaaacgaaccaaactctcttaaaatatctcctcatcgacgtcccgaacgcccgaaccgaaaaaaaattactacaccaaataataacgaactacatccccgaaaacccgattctccaacaaacgcaaaaaaaacaaaacgtcacaataaccgaaaacctaaaaattcgctaatcccgaaactaaaccccgcccaaaaccgccctcttacctccactaattatacaaccgccgctccaaaaccgtacgaataaaaccataccgaccaaaacgccgataaatataacgcaaataacgcgcccactacaaaacccgacgcacgataacgaaatcccaaatactaacgtaaataatacttaaaaccgccaaaaactcgaaaaaacgatccaaatactacaaaaaaaattccataaaatacgcgaaaaccctacttccgctttcaccttaaaaacgacgactctctacgtactaattaaaacatccgcgaaataatacgcctctctacaatactattaatcgaaatacat

SEQ ID NO: 31841 - DNA, 776 bp, Artificial Sequence
  chemically treated genomic DNA (Homo sapiens) CpG-island No: 31841
atcggcggttttgggtttcgtcggcgagcggttaataggcgcgcgcgtttcgatatttcgtattcgcgtttcgggcgtttcgttcgtcgcgtcgtttttattgtatcgcgcggcgtttcggggagataaagcggattcgtagttttgcgtttcggtttcgtttcgggagtacggcgcgcgtaaattttcggttttttttttcgttttcggttagttttttcgtttcgacgtgcggttgttttttagataaataaggaggtggaggaggcggtttgggggcgcgttaagtagtgaaggcggttagggtgttgtatagttcggcggttcgttagggtcgtggggagaggcggcgcggttcgtattgtaataataaatttgtagtagagggtatttgaggaaaagaggacggcgacgggcggtagtcgttttttttttatgtgtttgttttgagcgaagtagaaaatggtgtttgcggcggcgcggagtcgcgtttagatatataaagagttcgcgaaggatgtatttgtatacggtttcgggtcggattttgttttttagttgggtacgcgcgttttattttttttcgcggggaagttcggggcggggagcgtttttgaaggtcgggtttagaggttttgtggttgcgcgtgtatatatatacgtgtatatagttatacgcgtataattagttagagttgcggtttggcgtgatcggtttaagatatatttttttggtgtttttttttttttttttatacgtttttttattgtttgtt

SEQ ID NO: 31842 - DNA, 776 bp, Artificial Sequence
  chemically treated genomic DNA (Homo sapiens) CpG-island No: 31842
aacaaacaataaaaaaacgtataaaaaaaaaaaaaaaaacaccaaaaaaatatatcttaaaccgatcacgccaaaccgcaactctaactaattatacgcgtataactatatacacgtatatatatacacgcgcaaccacaaaacctctaaacccgaccttcaaaaacgctccccgccccgaacttccccgcgaaaaaaaataaaacgcgcgtacccaactaaaaaacaaaatccgacccgaaaccgtatacaaatacatccttcgcgaactctttatatatctaaacgcgactccgcgccgccgcaaacaccattttctacttcgctcaaaacaaacacataaaaaaaaaacgactaccgcccgtcgccgtcctcttttcctcaaataccctctactacaaatttattattacaatacgaaccgcgccgcctctccccacgaccctaacgaaccgccgaactatacaacaccctaaccgccttcactacttaacgcgcccccaaaccgcctcctccacctccttatttatctaaaaaacaaccgcacgtcgaaacgaaaaaactaaccgaaaacgaaaaaaaaaaccgaaaatttacgcgcgccgtactcccgaaacgaaaccgaaacgcaaaactacgaatccgctttatctccccgaaacgccgcgcgatacaataaaaacgacgcgacgaacgaaacgcccgaaacgcgaatacgaaatatcgaaacgcgcgcgcctattaaccgctcgccgacgaaacccaaaaccgccgat

SEQ ID NO: 31843 - DNA, 776 bp, Artificial Sequence
  chemically treated genomic DNA (Homo sapiens) CpG-island No: 31843
ggtaggtagtgggggagcgtatagggaaggagaaggaagtattaggggagtatgttttgggtcgattacgttaggtcgtagttttggttggttgtgcgcgtgtgattgtgtgtacgtgtgtgtgtgtacgcgtagttataggatttttgggttcggtttttaggggcgtttttcgtttcgggttttttcgcggaagggagtggggcgcgcgtatttagttgaggggtagggttcgattcgaggtcgtgtgtaaatgtatttttcgcggattttttgtgtgtttgagcgcggtttcgcgtcgtcgtaggtattattttttgtttcgtttaggataggtatataaaaggaaggcggttgtcgttcgtcgtcgtttttttttttttagatgttttttgttgtaggtttattattatagtacgggtcgcgtcgtttttttttacggttttggcgggtcgtcgggttgtgtagtattttggtcgtttttattgtttggcgcgtttttaaatcgttttttttatttttttatttgtttgaaaagtaatcgtacgtcgaggcggagaggttggtcgggggcggggaggaaggtcggggatttgcgcgcgtcgtgttttcggggcggggtcggggcgtagagttgcgggttcgttttgttttttcggggcgtcgcgcggtgtagtggggacggcgcggcgagcggggcgttcggggcgcgggtgcggggtgtcggggcgcgcgcgtttgttggtcgttcgtcgacggggtttagagtcgtcgat

SEQ ID NO: 31844 - DNA, 776 bp, Artificial Sequence
  chemically treated genomic DNA (Homo sapiens) CpG-island No: 31844
atcgacgactctaaaccccgtcgacgaacgaccaacaaacgcgcgcgccccgacaccccgcacccgcgccccgaacgccccgctcgccgcgccgtccccactacaccgcgcgacgccccgaaaaaacaaaacgaacccgcaactctacgccccgaccccgccccgaaaacacgacgcgcgcaaatccccgaccttcctccccgcccccgaccaacctctccgcctcgacgtacgattacttttcaaacaaataaaaaaataaaaaaaacgatttaaaaacgcgccaaacaataaaaacgaccaaaatactacacaacccgacgacccgccaaaaccgtaaaaaaaaacgacgcgacccgtactataataataaacctacaacaaaaaacatctaaaaaaaaaaaaacgacgacgaacgacaaccgccttccttttatatacctatcctaaacgaaacaaaaaataatacctacgacgacgcgaaaccgcgctcaaacacacaaaaaatccgcgaaaaatacatttacacacgacctcgaatcgaaccctacccctcaactaaatacgcgcgccccactcccttccgcgaaaaaacccgaaacgaaaaacgcccctaaaaaccgaacccaaaaatcctataactacgcgtacacacacacacgtacacacaatcacacgcgcacaaccaaccaaaactacgacctaacgtaatcgacccaaaacatactcccctaatacttccttctccttccctatacgctcccccactacctacc

SEQ ID NO: 31845 - DNA, 540 bp, Artificial Sequence
  chemically treated genomic DNA (Homo sapiens) CpG-island No: 31845
ttttacgtattatttttattgttatgtcgataaatttcgggagtaaagggtggtacgatttttttcgcgtttttgcgggttgaaggcgggtattaaagtagtgtagttttaagttttttttgtagaagtcgcgttttttattcggttcgggggtagagggggcgcgagagagtaagtgggcgggcgttttatttttcgtatttttttttaggttttggcgtatagggtgggagcgttgcgttgcgtcgcgttgcgtatcgcggttcgtttgtcgtttgttttttgttttagttgggttattttttcgggttgtcggtggagggttaagaggcgttaacgttacgttgttttcggttttttagcgggttttgtttttttttttaaggcggcggcggttgagcggcggagttttttaaatggtttggttagatgcggtaggtttgttgtttagcgttgtcgtcgtcgttattggagaagggtcggtgtagtagttatagcgatagtagtagtagtagtagcgagaggagtagtagtagtagt

SEQ ID NO: 31846 - DNA, 540 bp, Artificial Sequence
  chemically treated genomic DNA (Homo sapiens) CpG-island No: 31846
actactactactactcctctcgctactactactactactatcgctataactactacaccgacccttctccaataacgacgacgacaacgctaaacaacaaacctaccgcatctaaccaaaccatttaaaaaactccgccgctcaaccgccgccgccttaaaaaaaaaaacaaaacccgctaaaaaaccgaaaacaacgtaacgttaacgcctcttaaccctccaccgacaacccgaaaaaataacccaactaaaacaaaaaacaaacgacaaacgaaccgcgatacgcaacgcgacgcaacgcaacgctcccaccctatacgccaaaacctaaaaaaaaatacgaaaaataaaacgcccgcccacttactctctcgcgccccctctacccccgaaccgaataaaaaacgcgacttctacaaaaaaaacttaaaactacactactttaatacccgccttcaacccgcaaaaacgcgaaaaaaatcgtaccaccctttactcccgaaatttatcgacataacaataaaaataatacgtaaaa

SEQ ID NO: 31847 - DNA, 540 bp, Artificial Sequence
  chemically treated genomic DNA (Homo sapiens) CpG-island No: 31847
gttgttgttgttgtttttttcgttgttgttgttgttgttgtcgttgtagttgttgtatcgatttttttttagtggcggcggcggtagcgttgagtagtaaatttgtcgtatttggttaggttatttggggggtttcgtcgtttagtcgtcgtcgttttgggaggggaaatagagttcgttggaaaatcggaaatagcgtaacgttagcgttttttagttttttatcggtagttcggggaggtggtttagttagggtagggggtaggcggtaagcgggtcgcgatgcgtagcgcggcgtagcgtagcgtttttattttgtgcgttaggatttggaggaggatgcggaggatgggacgttcgtttatttgttttttcgcgttttttttgttttcggatcgagtagggagcgcggtttttgtaggggaagtttgggattgtattgttttagtgttcgtttttagttcgtaggggcgcgggaggaatcgtgttattttttgttttcgggatttatcggtatgatagtgggggtggtgcgtgagg

SEQ ID NO: 31848 - DNA, 540 bp, Artificial Sequence
  chemically treated genomic DNA (Homo sapiens) CpG-island No: 31848
cctcacgcaccacccccactatcataccgataaatcccgaaaacaaaaaataacacgattcctcccgcgcccctacgaactaaaaacgaacactaaaacaatacaatcccaaacttcccctacaaaaaccgcgctccctactcgatccgaaaacaaaaaaaacgcgaaaaaacaaataaacgaacgtcccatcctccgcatcctcctccaaatcctaacgcacaaaataaaaacgctacgctacgccgcgctacgcatcgcgacccgcttaccgcctaccccctaccctaactaaaccacctccccgaactaccgataaaaaactaaaaaacgctaacgttacgctatttccgattttccaacgaactctatttcccctcccaaaacgacgacgactaaacgacgaaaccccccaaataacctaaccaaatacgacaaatttactactcaacgctaccgccgccgccactaaaaaaaaatcgatacaacaactacaacgacaacaacaacaacaacaacgaaaaaaacaacaacaacaac

SEQ ID NO: 31849 - DNA, 1087 bp, Artificial Sequence
  chemically treated genomic DNA (Homo sapiens) CpG-island No: 31849
tttcgtttattcgtataaatacgtcgtatttgttggagtttatatcgaagaagaagcgtttgttgtttatagttaaggaggtgttttcgggtagttcggtcggttttttttttatttcgtagtcgtcgatgagtttggttagagcgttacggaattcgatgagtttttgcgcgggtagcgtaatggtttggttttgcgtggagtttaggttaggttttcggttgatcgtttggcggatgcgtaggaagcggtcgcgttggttttttttgagatttatgtagtatttgcggttttcgcgtattaggaattcgtttttgagcgttcggcgcggttcgttttgcgtttgggttaggttcggcggttggttggggtttagttgcgcgtagtgttcgatgaagtcgtttaggtagtcgcggaattttacggttattgatatggagagagtaaggcggtttttgttgtcgttcgcgtttatttcggcgatttttaggaagcggtttttggcgttttgttttacgtttaggtagaagcgtttgttttggatgtttattcgtttggaggttagtttttgcgtttcgtgttgtagtttttttggggtttcgtcgtcgtcgtcgttattgtcgtcgtcgttttcgtcgttattatcgttttcgtcggagtttgagttcgagtcggggtgttttagggagtcgttcgaatttagcgtcgtattattttgttcgttgtcgttgtttcggttcgttatgatgttgcgtttcgttgtcgcgtcgtcgtcgtttgtcgtttcgttcgtcgttttagtcgttttagtcgtcgttgtttttttttttcggtttcgtttgttgtcgtcgtaatttttatagttagttagttattttcgcgagatttgcgggagagacgagatagacgagattcggtaatagggtattgattttttagtatagtagtagggcgttttattgtacgcgtttattcgttcgtcggtacgtgatttgcgtttttttttcgttgttagtttttcgttcgttcgttcgttaggcggcgtttatttatcggtttttattttataattttggttgggtggggg

SEQ ID NO: 31850 - DNA, 1087 bp, Artificial Sequence
  chemically treated genomic DNA (Homo sapiens) CpG-island No: 31850
cccccacccaaccaaaattataaaataaaaaccgataaataaacgccgcctaacgaacgaacgaacgaaaaactaacaacgaaaaaaaaacgcaaatcacgtaccgacgaacgaataaacgcgtacaataaaacgccctactactatactaaaaaatcaataccctattaccgaatctcgtctatctcgtctctcccgcaaatctcgcgaaaataactaactaactataaaaattacgacgacaacaaacgaaaccgaaaaaaaaaaacaacgacgactaaaacgactaaaacgacgaacgaaacgacaaacgacgacgacgcgacaacgaaacgcaacatcataacgaaccgaaacaacgacaacgaacaaaataatacgacgctaaattcgaacgactccctaaaacaccccgactcgaactcaaactccgacgaaaacgataataacgacgaaaacgacgacgacaataacgacgacgacgacgaaaccccaaaaaaactacaacacgaaacgcaaaaactaacctccaaacgaataaacatccaaaacaaacgcttctacctaaacgtaaaacaaaacgccaaaaaccgcttcctaaaaatcgccgaaataaacgcgaacgacaacaaaaaccgccttactctctccatatcaataaccgtaaaattccgcgactacctaaacgacttcatcgaacactacgcgcaactaaaccccaaccaaccgccgaacctaacccaaacgcaaaacgaaccgcgccgaacgctcaaaaacgaattcctaatacgcgaaaaccgcaaatactacataaatctcaaaaaaaaccaacgcgaccgcttcctacgcatccgccaaacgatcaaccgaaaacctaacctaaactccacgcaaaaccaaaccattacgctacccgcgcaaaaactcatcgaattccgtaacgctctaaccaaactcatcgacgactacgaaataaaaaaaaaaccgaccgaactacccgaaaacacctccttaactataaacaacaaacgcttcttcttcgatataaactccaacaaatacgacgtatttatacgaataaacgaaa

SEQ ID NO: 31851 - DNA, 1087 bp, Artificial Sequence
  chemically treated genomic DNA (Homo sapiens) CpG-island No: 31851
tttttatttagttagggttgtagggtgagggtcggtgggtgggcgtcgtttggcgggcgggcggacggggggttggtagcggggagggggcgtaggttacgtgtcggcgggcgggtgggcgcgtatagtagggcgttttgttattgtattggggagttagtgttttgttatcgggtttcgtttgtttcgtttttttcgtagatttcgcgagagtggttgattggttgtgggggttgcggcggtagtaggcggagtcggggagggaaagtagcggcggttgaggcgattgaggcggcgggcggagcggtaggcggcggcggcgcggtagcggagcgtagtattatggcggatcgagatagcggtagcgagtagggtggtgcggcgttgggttcgggcggttttttggggtatttcggttcgggtttaggtttcggcgggggcggtggtggcggcgggggcggcggcggtagtggcggcggcggcggcggggttttaggggggttgtagtacgagacgtaggagttggtttttaagcgggtggatatttagaataagcgtttttatttggacgtgaagtagaacgttaagggtcgttttttgaagatcgtcgaggtgggcgcgggcggtaataagagtcgttttattttttttatgttagtggtcgtggagtttcgcgattatttgggcgattttatcgagtattacgcgtagttgggttttagttagtcgtcggatttggtttaggcgtaggacgagtcgcgtcgggcgtttaaaagcgagtttttggtgcgcgagaatcgtaagtattatatggattttaaggagaattagcgcggtcgttttttgcgtattcgttagacggttaatcgggggtttggtttgggttttacgtagggttagattattgcgttgttcgcgtaggggtttatcgagtttcgtgacgttttggttaagtttatcgacgattacggagtggaggaggagtcggtcgagttgttcgagggtatttttttgattgtggataataagcgtttttttttcgatgtgggttttaataagtacggcgtgtttatgcgagtgagcgagg

SEQ ID NO: 31852 - DNA, 1087 bp, Artificial Sequence
  chemically treated genomic DNA (Homo sapiens) CpG-island No: 31852
cctcgctcactcgcataaacacgccgtacttattaaaacccacatcgaaaaaaaaacgcttattatccacaatcaaaaaaataccctcgaacaactcgaccgactcctcctccactccgtaatcgtcgataaacttaaccaaaacgtcacgaaactcgataaacccctacgcgaacaacgcaataatctaaccctacgtaaaacccaaaccaaacccccgattaaccgtctaacgaatacgcaaaaaacgaccgcgctaattctccttaaaatccatataatacttacgattctcgcgcaccaaaaactcgcttttaaacgcccgacgcgactcgtcctacgcctaaaccaaatccgacgactaactaaaacccaactacgcgtaatactcgataaaatcgcccaaataatcgcgaaactccacgaccactaacataaaaaaaataaaacgactcttattaccgcccgcgcccacctcgacgatcttcaaaaaacgacccttaacgttctacttcacgtccaaataaaaacgcttattctaaatatccacccgcttaaaaaccaactcctacgtctcgtactacaacccccctaaaaccccgccgccgccgccgccactaccgccgccgcccccgccgccaccaccgcccccgccgaaacctaaacccgaaccgaaataccccaaaaaaccgcccgaacccaacgccgcaccaccctactcgctaccgctatctcgatccgccataatactacgctccgctaccgcgccgccgccgcctaccgctccgcccgccgcctcaatcgcctcaaccgccgctactttccctccccgactccgcctactaccgccgcaacccccacaaccaatcaaccactctcgcgaaatctacgaaaaaaacgaaacaaacgaaacccgataacaaaacactaactccccaatacaataacaaaacgccctactatacgcgcccacccgcccgccgacacgtaacctacgccccctccccgctaccaaccccccgtccgcccgcccgccaaacgacgcccacccaccgaccctcaccctacaaccctaactaaataaaaa

SEQ ID NO: 31853 - DNA, 1029 bp, Artificial Sequence
  chemically treated genomic DNA (Homo sapiens) CpG-island No: 31853
ttgtgttacgtggaggcggtaagcgtagaaggatttcgtacgttcggcggtaattgaagattacggttagttttagattttgatttttgtaatttatgagcgttattttcgtatcgtttttcgtatttgattcgtttttgatagttgtagaggtgtaaacgggtgacggaaagagttcgattttttcggtacgcgagacggtttcggcggggggtgtttcgggggcgtagtttcgttcgggaagtggttgtcgatagtagcgaggagcgttaaggttagggttttcgttttttcggttcgtttcgttcgttcgttcgtttcgtttcgtcgtatttacgcgagtgttttagttcgcgcgtcgttttggttttattttttgtgtggtggtcgaagttgttttatttgtttttgggcgtcggcggttttttaagtcgcggttttttcgttttcggttcgggttgcgcgggcggtaaaggcggcggcggtttcgcgtttttatttttggggtttttgttaacgtcgaagagttacgatatgttcgtatcgtcgtcgtcgttatcgtcgtcgggatttttattcgagtttgattcggtcgcggttgggagtagttttacgcgtcgtagtcggtggttaggattattgcgtaggcgaaatatatatttttttttttcggcgacggaaatgcgtaagggatacgcgcgtagtttttggattggtcgcgaggtagtgacgttatagcgacggcgtcgtaattgaggagcgtgtttcggggcggcgggaatcggggtgagcgggcggagggcggggggcgtggtgaagcgtttgggtatcggagtcgtatcgggataaaatttcggagggagtattcgaattcggcgtaacgttagtttcggttcgtagtcgcgtcggtattatttcggagtttacggtttacgcgttcgcggcggtttcgattttttttttgataggaatggttgattttatagaattatatggagtgattcgttttattggattggaaattatttt

SEQ ID NO: 31854 - DNA, 1029 bp, Artificial Sequence
  chemically treated genomic DNA (Homo sapiens) CpG-island No: 31854
aaaataatttccaatccaataaaacgaatcactccatataattctataaaatcaaccattcctatcaaaaaaaaaatcgaaaccgccgcgaacgcgtaaaccgtaaactccgaaataataccgacgcgactacgaaccgaaactaacgttacgccgaattcgaatactccctccgaaattttatcccgatacgactccgatacccaaacgcttcaccacgccccccgccctccgcccgctcaccccgattcccgccgccccgaaacacgctcctcaattacgacgccgtcgctataacgtcactacctcgcgaccaatccaaaaactacgcgcgtatcccttacgcatttccgtcgccgaaaaaaaaaaatatatatttcgcctacgcaataatcctaaccaccgactacgacgcgtaaaactactcccaaccgcgaccgaatcaaactcgaataaaaatcccgacgacgataacgacgacgacgatacgaacatatcgtaactcttcgacgttaacaaaaaccccaaaaataaaaacgcgaaaccgccgccgcctttaccgcccgcgcaacccgaaccgaaaacgaaaaaaccgcgacttaaaaaaccgccgacgcccaaaaacaaataaaacaacttcgaccaccacacaaaaaataaaaccaaaacgacgcgcgaactaaaacactcgcgtaaatacgacgaaacgaaacgaacgaacgaacgaaacgaaccgaaaaaacgaaaaccctaaccttaacgctcctcgctactatcgacaaccacttcccgaacgaaactacgcccccgaaacaccccccgccgaaaccgtctcgcgtaccgaaaaaatcgaactctttccgtcacccgtttacacctctacaactatcaaaaacgaatcaaatacgaaaaacgatacgaaaataacgctcataaattacaaaaatcaaaatctaaaactaaccgtaatcttcaattaccgccgaacgtacgaaatccttctacgcttaccgcctccacgtaacacaa

SEQ ID NO: 31855 - DNA, 1029 bp, Artificial Sequence
  chemically treated genomic DNA (Homo sapiens) CpG-island No: 31855
aaaatagtttttaatttagtgggacgagttattttatataattttgtgaagttaattatttttattaaggagagagtcggggtcgtcgcgagcgcgtgaatcgtgggtttcggggtggtgtcgacgcggttgcgggtcgggattgacgttgcgtcgggttcgagtatttttttcggagttttgtttcggtgcggtttcggtatttagacgttttattacgtttttcgtttttcgttcgtttatttcggttttcgtcgtttcggagtacgttttttaattgcggcgtcgtcgttatggcgttattgtttcgcggttaatttaagggttgcgcgcgtgttttttacgtattttcgtcgtcgggaggaaggggtgtgtgtttcgtttgcgtagtggttttggttatcggttgcggcgcgtggagttgtttttagtcgcgatcgagttagattcgggtgggggtttcggcggcggtagcggcggcggcggtgcgagtatgtcgtggtttttcggcgttaataagggttttaagggtgaaggcgcggggtcgtcgtcgtttttgtcgttcgcgtagttcgggtcgagggcggggggatcgcggtttgggagatcgtcggcgtttaaggataaatggagtaatttcgattattatataaaaaataggattaaggcggcgcgcgagttggagtattcgcgtgagtgcggcggggcggggcgggcgggcgggcgggacgggtcggggaagcgggagttttggttttggcgtttttcgttgttgtcggtagttatttttcgggcgagattgcgttttcggagtatttttcgtcggagtcgtttcgcgtgtcgggaggatcggatttttttcgttattcgtttgtatttttgtagttgttaggagcgggttaggtgcgaaaagcggtgcggaggtggcgtttataggttataggggttagggtttggggttggtcgtggtttttagttatcgtcgagcgtgcgggatttttttgcgtttgtcgtttttacgtggtatag

SEQ ID NO: 31856 - DNA, 1029 bp, Artificial Sequence
  chemically treated genomic DNA (Homo sapiens) CpG-island No: 31856
ctataccacgtaaaaacgacaaacgcaaaaaaatcccgcacgctcgacgataactaaaaaccacgaccaaccccaaaccctaacccctataacctataaacgccacctccgcaccgcttttcgcacctaacccgctcctaacaactacaaaaatacaaacgaataacgaaaaaaatccgatcctcccgacacgcgaaacgactccgacgaaaaatactccgaaaacgcaatctcgcccgaaaaataactaccgacaacaacgaaaaacgccaaaaccaaaactcccgcttccccgacccgtcccgcccgcccgcccgccccgccccgccgcactcacgcgaatactccaactcgcgcgccgccttaatcctattttttatataataatcgaaattactccatttatccttaaacgccgacgatctcccaaaccgcgatccccccgccctcgacccgaactacgcgaacgacaaaaacgacgacgaccccgcgccttcacccttaaaacccttattaacgccgaaaaaccacgacatactcgcaccgccgccgccgctaccgccgccgaaacccccacccgaatctaactcgatcgcgactaaaaacaactccacgcgccgcaaccgataaccaaaaccactacgcaaacgaaacacacaccccttcctcccgacgacgaaaatacgtaaaaaacacgcgcgcaacccttaaattaaccgcgaaacaataacgccataacgacgacgccgcaattaaaaaacgtactccgaaacgacgaaaaccgaaataaacgaacgaaaaacgaaaaacgtaataaaacgtctaaataccgaaaccgcaccgaaacaaaactccgaaaaaaatactcgaacccgacgcaacgtcaatcccgacccgcaaccgcgtcgacaccaccccgaaacccacgattcacgcgctcgcgacgaccccgactctctccttaataaaaataattaacttcacaaaattatataaaataactcgtcccactaaattaaaaactatttt

SEQ ID NO: 31857 - DNA, 511 bp, Artificial Sequence
  chemically treated genomic DNA (Homo sapiens) CpG-island No: 31857
tcgcgggagttgtcgattttgtagtattagtcgtcgtcgtcgtcgtcgttattttgtgtcgtcgattttttttcggtttttttttttagggcggtttttcgcgaagtttacggtcgttatcgtttcgtttcgtcgcgtgttattggttcggttcgcgattaggcgacgtcgtttagtcgtaattggttatataatttgttcgttagtaacgcgtttaacgtcgacgtcggaatttggcgcgggtggggcgggttcgttatttaggggatttcgcggtgtcggtcgattcggaagtatgtttgtttttagcggagcgcgggtgtcgtgttgagagcgtttgtttgtgcgtttcgagcggcgtgggatttttttaagatgtttacgttcgtatagagatttcggatcgcggaattcgcgtttcgaaaggtttgtgggttaaggggggttatttcggtgggatttggggcgggacgatttttattgttgaattttgggcgcggggtagggttag

SEQ ID NO: 31858 - DNA, 511 bp, Artificial Sequence
  chemically treated genomic DNA (Homo sapiens) CpG-island No: 31858
ctaaccctaccccgcgcccaaaattcaacaataaaaatcgtcccgccccaaatcccaccgaaataaccccccttaacccacaaacctttcgaaacgcgaattccgcgatccgaaatctctatacgaacgtaaacatcttaaaaaaatcccacgccgctcgaaacgcacaaacaaacgctctcaacacgacacccgcgctccgctaaaaacaaacatacttccgaatcgaccgacaccgcgaaatcccctaaataacgaacccgccccacccgcgccaaattccgacgtcgacgttaaacgcgttactaacgaacaaattatataaccaattacgactaaacgacgtcgcctaatcgcgaaccgaaccaataacacgcgacgaaacgaaacgataacgaccgtaaacttcgcgaaaaaccgccctaaaaaaaaaaaccgaaaaaaaatcgacgacacaaaataacgacgacgacgacgacgactaatactacaaaatcgacaactcccgcga

SEQ ID NO: 31859 - DNA, 511 bp, Artificial Sequence
  chemically treated genomic DNA (Homo sapiens) CpG-island No: 31859
ttgattttgtttcgcgtttagggtttagtagtgggggtcgtttcgttttagattttatcgagatggttttttttgatttataggtttttcgagacgcgagtttcgcgattcggggtttttgtgcgaacgtgggtattttggaagagttttacgtcgttcggggcgtataggtaggcgtttttagtacggtattcgcgtttcgttagggatagatatgttttcgggtcggtcggtatcgcggagttttttgggtaacgagttcgttttattcgcgttaggtttcggcgtcggcgttaggcgcgttgttgacgggtaggttatgtagttaattgcggttaggcggcgtcgtttggtcgcgggtcgaattaatggtacgcgacggggcggggcggtggcggtcgtggatttcgcgaggagtcgttttgagggaagaagtcgaaggggagtcggcggtataaaatggcggcggcggcggcggcggttggtgttgtagggtcggtagttttcgcgg

SEQ ID NO: 31860 - DNA, 511 bp, Artificial Sequence
  chemically treated genomic DNA (Homo sapiens) CpG-island No: 31860
ccgcgaaaactaccgaccctacaacaccaaccgccgccgccgccgccgccattttataccgccgactccccttcgacttcttccctcaaaacgactcctcgcgaaatccacgaccgccaccgccccgccccgtcgcgtaccattaattcgacccgcgaccaaacgacgccgcctaaccgcaattaactacataacctacccgtcaacaacgcgcctaacgccgacgccgaaacctaacgcgaataaaacgaactcgttacccaaaaaactccgcgataccgaccgacccgaaaacatatctatccctaacgaaacgcgaataccgtactaaaaacgcctacctatacgccccgaacgacgtaaaactcttccaaaatacccacgttcgcacaaaaaccccgaatcgcgaaactcgcgtctcgaaaaacctataaatcaaaaaaaaccatctcgataaaatctaaaacgaaacgacccccactactaaaccctaaacgcgaaacaaaatcaa

SEQ ID NO: 31861 - DNA, 714 bp, Artificial Sequence
  chemically treated genomic DNA (Homo sapiens) CpG-island No: 31861
  misc_feature (189)..(190): n is either a, c, g or t
aagtgttgggatagaaaacgagaaattagggttgttagcggggttcgcgtcggtcgttttttggttcgcgggatatttcgggcgtttagtgtttaggtcgggtaggcggtatttattttggcgtgttttagtattttttggattcgaaagtagcggtcggtgacgcgatttcgtagttagagttgcggnntgaggaagattatggcgtttgtaggtcggcgtttcgaatatttaataacgtacgcgtagcgtcgttgttattttgttcgggtcggaaatggtggttacgagcgttttcgggttagtttttgcgatattttcggggcgaaggtcgtttttcgttagttcgcgggtgtttagttgtgtttttgaattcgcggtggtggtgcgtgttggggagcggatgtggggtcgcggcggggattgaaaggagaacggggtcgtagcgttcgtggttattcgcggacgatggataaatagtagcgtacgcggatcgtttcggagtacggtttcggtcgtagttgtggtttcgagggtatcgtgagggtagcggattcgggtcggggtttcgcggtcggggagttcgggtgcggcgcgggcggggaggggtaggtcgtttttggggttacgaggatgtttaggaatcgaggtggagatggtcgtatcggtgtgaaagtgttcgttgtttttgaattttgtattttgtttatttat

SEQ ID NO: 31862 - DNA, 714 bp, Artificial Sequence
  chemically treated genomic DNA (Homo sapiens) CpG-island No: 31862
  misc_feature (525)..(526): n is either a, c, g or t
ataaataaacaaaatacaaaattcaaaaacaacgaacactttcacaccgatacgaccatctccacctcgattcctaaacatcctcgtaaccccaaaaacgacctacccctccccgcccgcgccgcacccgaactccccgaccgcgaaaccccgacccgaatccgctaccctcacgataccctcgaaaccacaactacgaccgaaaccgtactccgaaacgatccgcgtacgctactatttatccatcgtccgcgaataaccacgaacgctacgaccccgttctcctttcaatccccgccgcgaccccacatccgctccccaacacgcaccaccaccgcgaattcaaaaacacaactaaacacccgcgaactaacgaaaaacgaccttcgccccgaaaatatcgcaaaaactaacccgaaaacgctcgtaaccaccatttccgacccgaacaaaataacaacgacgctacgcgtacgttattaaatattcgaaacgccgacctacaaacgccataatcttcctcannccgcaactctaactacgaaatcgcgtcaccgaccgctactttcgaatccaaaaaatactaaaacacgccaaaataaataccgcctacccgacctaaacactaaacgcccgaaatatcccgcgaaccaaaaaacgaccgacgcgaaccccgctaacaaccctaatttctcgttttctatcccaacactt

SEQ ID NO: 31863 - DNA, 714 bp, Artificial Sequence
  chemically treated genomic DNA (Homo sapiens) CpG-island No: 31863
  misc_feature (525)..(526): n is either a, c, g or t
gtaagtaaataaagtgtaaggtttagaggtaacgggtatttttatatcgatgcgattatttttatttcggtttttgaatattttcgtggttttaggggcggtttgttttttttcgttcgcgtcgtattcgagtttttcggtcgcggggtttcgattcgggttcgttgtttttacggtgttttcggagttatagttgcggtcggggtcgtgtttcgggacggttcgcgtgcgttgttgtttatttatcgttcgcgaatagttacgggcgttgcggtttcgttttttttttagttttcgtcgcggttttatattcgttttttaatacgtattattatcgcgagtttaggagtataattgggtattcgcgggttgacgggagacgattttcgtttcggaagtatcgtaggggttgattcggaagcgttcgtgattattattttcgattcgggtaagatggtagcggcgttgcgcgtgcgttgttgagtgttcgggacgtcggtttgtaggcgttatggttttttttanntcgtagttttggttgcggaatcgcgttatcgatcgttattttcggatttaggaggtgttgaagtacgttagggtgagtgtcgtttgttcggtttgggtattgggcgttcggggtatttcgcgggttaaggggcggtcggcgcgggtttcgttgataattttggtttttcgttttttgttttagtattt

SEQ ID NO: 31864 - DNA, 714 bp, Artificial Sequence
  chemically treated genomic DNA (Homo sapiens) CpG-island No: 31864
  misc_feature (189)..(190): n is either a, c, g or t
aaatactaaaacaaaaaacgaaaaaccaaaattatcaacgaaacccgcgccgaccgccccttaacccgcgaaataccccgaacgcccaatacccaaaccgaacaaacgacactcaccctaacgtacttcaacacctcctaaatccgaaaataacgatcgataacgcgattccgcaaccaaaactacganntaaaaaaaaccataacgcctacaaaccgacgtcccgaacactcaacaacgcacgcgcaacgccgctaccatcttacccgaatcgaaaataataatcacgaacgcttccgaatcaacccctacgatacttccgaaacgaaaatcgtctcccgtcaacccgcgaatacccaattatactcctaaactcgcgataataatacgtattaaaaaacgaatataaaaccgcgacgaaaactaaaaaaaaaacgaaaccgcaacgcccgtaactattcgcgaacgataaataaacaacaacgcacgcgaaccgtcccgaaacacgaccccgaccgcaactataactccgaaaacaccgtaaaaacaacgaacccgaatcgaaaccccgcgaccgaaaaactcgaatacgacgcgaacgaaaaaaaacaaaccgcccctaaaaccacgaaaatattcaaaaaccgaaataaaaataatcgcatcgatataaaaatacccgttacctctaaaccttacactttatttacttac

SEQ ID NO: 31865 - DNA, 651 bp, Artificial Sequence
  chemically treated genomic DNA (Homo sapiens) CpG-island No: 31865
acgagtataggaatgcggtatatatataaacggtatatgcgtatggtatacgcgaatggtatatgtacggtatacgtgtatgggatacgtacggtatacgtaaggaatatatgtatggtatgtaaacggtatatatgtatgttatacgtgtatagtatatatgtaaatggtatacgtgtacggtgtatacgaatggtatatgcgtatggtatatataaatggtatacgtacggtaagtgtatggtatacgcgtatggtatatataaaacggtatatgtaaatggtatatatacggtatatataatatatacggaaacggtatatatataaatgttatatatgtatggtacgtaagtaaacgacgtgtggtatacgcgtatcgtacgtaaatggtacgtgtatgatataaatggtatatgtaaatagtatatatatggtatacgtaaagcgtatggtacgtatatgcgtatagtatacgtttatagtatatacggtatatataaatggtatatatgtacgtggtatacgtgtacggttaatacgtagtatatacgtgtatggtatatatacgaaaatagtatacgtttacggttaatacgtatggtatatgtaattggtatttgtatattgtatagatggtatatatgtata

SEQ ID NO: 31866 - DNA, 651 bp, Artificial Sequence
  chemically treated genomic DNA (Homo sapiens) CpG-island No: 31866
tatacatatataccatctatacaatatacaaataccaattacatataccatacgtattaaccgtaaacgtatactattttcgtatatataccatacacgtatatactacgtattaaccgtacacgtataccacgtacatatataccatttatatataccgtatatactataaacgtatactatacgcatatacgtaccatacgctttacgtataccatatatatactatttacatataccatttatatcatacacgtaccatttacgtacgatacgcgtataccacacgtcgtttacttacgtaccatacatatataacatttatatatataccgtttccgtatatattatatataccgtatatataccatttacatataccgttttatatataccatacgcgtataccatacacttaccgtacgtataccatttatatataccatacgcatataccattcgtatacaccgtacacgtataccatttacatatatactatacacgtataacatacatatataccgtttacataccatacatatattccttacgtataccgtacgtatcccatacacgtataccgtacatataccattcgcgtataccatacgcatataccgtttatatatataccgcattcctatactcgt

SEQ ID NO: 31867 - DNA, 651 bp, Artificial Sequence
  chemically treated genomic DNA (Homo sapiens) CpG-island No: 31867
tgtgtatgtgtgttatttgtgtaatgtgtaggtgttagttgtatgtgttatgcgtgttggtcgtgagcgtgtgttgttttcgtgtatgtgttatgtacgtatgtgttgcgtgttggtcgtgtacgtgtgttacgtgtatgtgtgttatttgtgtatgtcgtgtgtgttgtgagcgtatgttgtgcgtatgtgcgtgttatgcgttttgcgtgtattatgtgtgtgttgtttgtatgtgttatttgtgttatgtacgtgttatttgcgtgcgatgcgcgtgtgttatacgtcgtttgtttgcgtgttatgtatgtgtggtatttgtgtatgtgtcgttttcgtgtgtattgtgtgtgtcgtgtgtgtgttatttgtatgtgtcgttttgtgtgtgttatgcgcgtgtgttatgtatttgtcgtgcgtgtgttatttgtgtgtattatgcgtatgtgttattcgtgtgtatcgtatacgtgtgttatttgtatgtatgttgtgtacgtgtggtatgtatgtgtgtcgtttgtatgttatgtatgtgttttttgcgtgtgtcgtgcgtgttttatgtacgtgtgtcgtgtatgtgttattcgcgtgtattatgcgtatgtgtcgtttgtgtgtgtgtcgtatttttgtgttcgt

SEQ ID NO: 31868 - DNA, 651 bp, Artificial Sequence
  chemically treated genomic DNA (Homo sapiens) CpG-island No: 31868
acgaacacaaaaatacgacacacacacaaacgacacatacgcataatacacgcgaataacacatacacgacacacgtacataaaacacgcacgacacacgcaaaaaacacatacataacatacaaacgacacacatacataccacacgtacacaacatacatacaaataacacacgtatacgatacacacgaataacacatacgcataatacacacaaataacacacgcacgacaaatacataacacacgcgcataacacacacaaaacgacacatacaaataacacacacacgacacacacaatacacacgaaaacgacacatacacaaataccacacatacataacacgcaaacaaacgacgtataacacacgcgcatcgcacgcaaataacacgtacataacacaaataacacatacaaacaacacacacataatacacgcaaaacgcataacacgcacatacgcacaacatacgctcacaacacacacgacatacacaaataacacacatacacgtaacacacgtacacgaccaacacgcaacacatacgtacataacacatacacgaaaacaacacacgctcacgaccaacacgcataacacatacaactaacacctacacattacacaaataacacacatacaca

SEQ ID NO: 31869 - DNA, 660 bp, Artificial Sequence
  chemically treated genomic DNA (Homo sapiens) CpG-island No: 31869
  misc_feature (647)..(647): n is either a, c, g or t
tcgttttgcgcgggagtcgggttttcggtcgttcgttcgtttcggttttttaggacgacgttttttttcgttttcggtttttcggcgattttcggatcgtgcgggttgggttgggtaggtgcggtcgtcgagttcgagtcgtttatttaggtcgtagcgtcgtgcgggtttcgttttcgtttatcgtttcgttttcgtttcgttttcgttcgtcgttttgattggttggatgttgtttaattaggaggttcggcgtttcgattcgcgttttcggttagcgtatcggaagttgtagcgaggtggttgcgtttgcgtagtgtattatcgtaggcgggtttcgcgggttcgggagcgcggcggagacgatgtttgagattagagttacgtttttgggtgagtgggagtcgtcgggagggttgtggggtgggtttcgtatgcggtttcgggcgggttgggcgttcgttttttttcgtttttcgtggagttaggtgcgtcgcgggcgttttcggtttttttttcgcgcgggttttggtgggagtcgagaggcggtttagtttttgtattttgggtcggtagtgacgcgagaacgcgagtttcgaggtttaggcggtcgtgaggggacgtcgtagatggggtcgcggggtttntcgcgtagtttgt

SEQ ID NO: 31870 - DNA, 660 bp, Artificial Sequence
  chemically treated genomic DNA (Homo sapiens) CpG-island No: 31870
  misc_feature (14)..(14): n is either a, c, g or t
acaaactacgcganaaaccccgcgaccccatctacgacgtcccctcacgaccgcctaaacctcgaaactcgcgttctcgcgtcactaccgacccaaaatacaaaaactaaaccgcctctcgactcccaccaaaacccgcgcgaaaaaaaaaccgaaaacgcccgcgacgcacctaactccacgaaaaacgaaaaaaaacgaacgcccaacccgcccgaaaccgcatacgaaacccaccccacaaccctcccgacgactcccactcacccaaaaacgtaactctaatctcaaacatcgtctccgccgcgctcccgaacccgcgaaacccgcctacgataatacactacgcaaacgcaaccacctcgctacaacttccgatacgctaaccgaaaacgcgaatcgaaacgccgaacctcctaattaaacaacatccaaccaatcaaaacgacgaacgaaaacgaaacgaaaacgaaacgataaacgaaaacgaaacccgcacgacgctacgacctaaataaacgactcgaactcgacgaccgcacctacccaacccaacccgcacgatccgaaaatcgccgaaaaaccgaaaacgaaaaaaaacgtcgtcctaaaaaaccgaaacgaacgaacgaccgaaaacccgactcccgcgcaaaacga

SEQ ID NO: 31871 - DNA, 660 bp, Artificial Sequence
  chemically treated genomic DNA (Homo sapiens) CpG-island No: 31871
  misc_feature (14)..(14): n is either a, c, g or t
ataggttgcgcganaggtttcgcggttttatttgcgacgtttttttacggtcgtttgaatttcggggttcgcgttttcgcgttattgtcggtttagggtgtagggattaggtcgtttttcggtttttattagggttcgcgcggggaggagatcggagacgttcgcggcgtatttggttttacgagaaacgggagggagcgggcgtttagttcgttcggagtcgtatacggagtttattttatagttttttcggcggtttttatttatttaagggcgtgattttgattttaggtatcgttttcgtcgcgttttcggattcgcgaggttcgtttgcggtgatgtattgcgtaggcgtaattatttcgttgtaattttcggtgcgttagtcggaaacgcgggtcggggcgtcgggttttttgattgggtagtatttaattaattagggcggcgggcgagggcggggcgagggcggggcggtgggcggggacggggttcgtacggcgttacggtttaggtgagcggttcggattcggcggtcgtatttgtttaatttaattcgtacggttcggaagtcgtcgaggggtcgggagcgggaggggacgtcgttttagagggtcggagcgggcgggcggtcgaggattcggttttcgcgtaggacgg

SEQ ID NO: 31872 - DNA, 660 bp, Artificial Sequence
  chemically treated genomic DNA (Homo sapiens) CpG-island No: 31872
  misc_feature (647)..(647): n is either a, c, g or t
ccgtcctacgcgaaaaccgaatcctcgaccgcccgcccgctccgaccctctaaaacgacgtcccctcccgctcccgacccctcgacgacttccgaaccgtacgaattaaattaaacaaatacgaccgccgaatccgaaccgctcacctaaaccgtaacgccgtacgaaccccgtccccgcccaccgccccgccctcgccccgccctcgcccgccgccctaattaattaaatactacccaatcaaaaaacccgacgccccgacccgcgtttccgactaacgcaccgaaaattacaacgaaataattacgcctacgcaatacatcaccgcaaacgaacctcgcgaatccgaaaacgcgacgaaaacgatacctaaaatcaaaatcacgcccttaaataaataaaaaccgccgaaaaaactataaaataaactccgtatacgactccgaacgaactaaacgcccgctccctcccgtttctcgtaaaaccaaatacgccgcgaacgtctccgatctcctccccgcgcgaaccctaataaaaaccgaaaaacgacctaatccctacaccctaaaccgacaataacgcgaaaacgcgaaccccgaaattcaaacgaccgtaaaaaaacgtcgcaaataaaaccgcgaaacctntcgcgcaacctat

SEQ ID NO: 31873 - DNA, 682 bp, Artificial Sequence
  chemically treated genomic DNA (Homo sapiens) CpG-island No: 31873
gagggagattggagtgtgtgtgtgtgcgtgtttgcgcgtgcgtgtttcggtcgtatttcggttggtgttgcgtgtttttgcgtgtcggggttcgttcgtgcgcgttttttcggggtttgtgcgcgtggtttttcgttcgcgtcggagggcgtgtgcgtggtttcggcgtgggtgtggtcgttcggggaggggtttttcgggggcggggtcggtttggttcgcgcggtgacgcgttttgtagtttcgagcgagcgagcgagcgagcgagttgtcgagcgcgtttcgtttttcgcgcgcgatgtttttttggacggcgttcggtttggttttgagtttgcggttggcgttggcggagcgcgcggagcgcggtgagtgcggcgggcggtcgggtcggggttggggtttttggtgatcgttttgcgcgttgttcgcgtaaggtcgtcgttgttttttgtttcggacgggcgggcgtgttgggaggttgcgggagtcgggcgggggcgcgggcggagcgttttgtttatttgaggttggcggtttaggtgttttaggcgatatcgttcgtgagcgtcggggaataggcgttttcggtcggtatttttgcgggatcgcgggtttggacgggaagagggagatgtttgttaagggggtatttttgttttagtttttttatttttgcgag

SEQ ID NO: 31874 - DNA, 682 bp, Artificial Sequence
  chemically treated genomic DNA (Homo sapiens) CpG-island No: 31874
ctcgcaaaaataaaaaaactaaaacaaaaatacccccttaacaaacatctccctcttcccgtccaaacccgcgatcccgcaaaaataccgaccgaaaacgcctattccccgacgctcacgaacgatatcgcctaaaacacctaaaccgccaacctcaaataaacaaaacgctccgcccgcgcccccgcccgactcccgcaacctcccaacacgcccgcccgtccgaaacaaaaaacaacgacgaccttacgcgaacaacgcgcaaaacgatcaccaaaaaccccaaccccgacccgaccgcccgccgcactcaccgcgctccgcgcgctccgccaacgccaaccgcaaactcaaaaccaaaccgaacgccgtccaaaaaaacatcgcgcgcgaaaaacgaaacgcgctcgacaactcgctcgctcgctcgctcgctcgaaactacaaaacgcgtcaccgcgcgaaccaaaccgaccccgcccccgaaaaacccctccccgaacgaccacacccacgccgaaaccacgcacacgccctccgacgcgaacgaaaaaccacgcgcacaaaccccgaaaaaacgcgcacgaacgaaccccgacacgcaaaaacacgcaacaccaaccgaaatacgaccgaaacacgcacgcgcaaacacgcacacacacacactccaatctccctc

SEQ ID NO: 31875 - DNA, 682 bp, Artificial Sequence
  chemically treated genomic DNA (Homo sapiens) CpG-island No: 31875
ttcgtaagggtagggaaattgaggtaggggtgtttttttgatagatattttttttttttcgtttaggttcgcgatttcgtagagatgtcggtcggggacgtttatttttcggcgtttacggacggtgtcgtttggagtatttgggtcgttagttttaggtgagtaggacgtttcgttcgcgttttcgttcggttttcgtagttttttagtacgttcgttcgttcggagtaggggatagcgacggttttgcgcgggtagcgcgtagagcggttattagaagttttagtttcggttcggtcgttcgtcgtatttatcgcgtttcgcgcgtttcgttagcgttagtcgtaagtttagggttaggtcgagcgtcgtttaggggagtatcgcgcgcgagggacggggcgcgttcggtaattcgttcgttcgttcgttcgttcggggttgtagggcgcgttatcgcgcggattaggtcggtttcgttttcgggaggttttttttcgagcggttatatttacgtcgaggttacgtatacgtttttcggcgcgagcggagggttacgcgtatagatttcggagaggcgcgtacgagcggatttcgatacgtagggatacgtagtattagtcgagatacgatcgaggtacgtacgcgtaggtacgtatatatatatattttagtttttttt

SEQ ID NO: 31876 - DNA, 682 bp, Artificial Sequence
  chemically treated genomic DNA (Homo sapiens) CpG-island No: 31876
aaaaaaaactaaaatatatatatatacgtacctacgcgtacgtacctcgatcgtatctcgactaatactacgtatccctacgtatcgaaatccgctcgtacgcgcctctccgaaatctatacgcgtaaccctccgctcgcgccgaaaaacgtatacgtaacctcgacgtaaatataaccgctcgaaaaaaaacctcccgaaaacgaaaccgacctaatccgcgcgataacgcgccctacaaccccgaacgaacgaacgaacgaacgaattaccgaacgcgccccgtccctcgcgcgcgatactcccctaaacgacgctcgacctaaccctaaacttacgactaacgctaacgaaacgcgcgaaacgcgataaatacgacgaacgaccgaaccgaaactaaaacttctaataaccgctctacgcgctacccgcgcaaaaccgtcgctatcccctactccgaacgaacgaacgtactaaaaaactacgaaaaccgaacgaaaacgcgaacgaaacgtcctactcacctaaaactaacgacccaaatactccaaacgacaccgtccgtaaacgccgaaaaataaacgtccccgaccgacatctctacgaaatcgcgaacctaaacgaaaaaaaaaaaatatctatcaaaaaaacacccctacctcaatttccctacccttacgaa

SEQ ID NO: 31877 - DNA, 610 bp, Artificial Sequence
  chemically treated genomic DNA (Homo sapiens) CpG-island No: 31877
cgtaggtcggatttcgttttatttggtcgtgttgcggggttacgcgtttttggtgcgttttttgttgtagcgaggggtttcggtggcgacggtggatcgggcggggcgtatcgcgttgtacgaggtcgtttggtacggatattcgcgggtggtcgagttgttgttgtagcgcggggtttcggcggcggttcgtttcgggacggttttacgtcgttgtattgggtcgttgttttgggttatacgttgttggtcgcgcgtttgttggaggtttcgggttcgggattcgcggtagcggaggcggaggacgcgcgcggttggacggcggcgtattgggcggcgcgggcgggcggttggcggtgttggagttgttggcggtcggcgtcgcgggtttggacggcgttttgttcgtggttgtcgttgcggggcgcggggcgcgttgcgtttttttttggcgcgcggggcgcgggtggacgttcgggatggcgcgggggttatagcgttgggtttggcggtcgttttaggtcgtttttaggtacgtttcgtttttcgttcggtagtgatgggagggggcgtagggttaggatttttagagacgtgttatcggggtagt

SEQ ID NO: 31878 - DNA, 610 bp, Artificial Sequence
  chemically treated genomic DNA (Homo sapiens) CpG-island No: 31878
actaccccgataacacgtctctaaaaatcctaaccctacgccccctcccatcactaccgaacgaaaaacgaaacgtacctaaaaacgacctaaaacgaccgccaaacccaacgctataacccccgcgccatcccgaacgtccacccgcgccccgcgcgccaaaaaaaaacgcaacgcgccccgcgccccgcaacgacaaccacgaacaaaacgccgtccaaacccgcgacgccgaccgccaacaactccaacaccgccaaccgcccgcccgcgccgcccaatacgccgccgtccaaccgcgcgcgtcctccgcctccgctaccgcgaatcccgaacccgaaacctccaacaaacgcgcgaccaacaacgtataacccaaaacaacgacccaatacaacgacgtaaaaccgtcccgaaacgaaccgccgccgaaaccccgcgctacaacaacaactcgaccacccgcgaatatccgtaccaaacgacctcgtacaacgcgatacgccccgcccgatccaccgtcgccaccgaaacccctcgctacaacaaaaaacgcaccaaaaacgcgtaaccccgcaacacgaccaaataaaacgaaatccgacctacg

SEQ ID NO: 31879 - DNA, 610 bp, Artificial Sequence
  chemically treated genomic DNA (Homo sapiens) CpG-island No: 31879
gttgtttcggtggtacgtttttggggattttggttttgcgtttttttttattattgtcgggcggagggcgggacgtatttgggagcggtttagggcggtcgttagatttagcgttgtggttttcgcgttatttcgggcgtttattcgcgtttcgcgcgttaggaggaagcgtagcgcgtttcgcgtttcgtagcggtagttacgagtagggcgtcgtttaggttcgcgacgtcggtcgttagtagttttagtatcgttagtcgttcgttcgcgtcgtttagtgcgtcgtcgtttagtcgcgcgcgtttttcgttttcgttgtcgcgggtttcgggttcggagtttttagtaggcgcgcggttagtagcgtgtggtttagggtagcggtttagtgtagcggcgtgaggtcgtttcggagcgagtcgtcgtcgaggtttcgcgttgtagtagtagttcggttattcgcgagtgttcgtgttaggcggtttcgtgtagcgcggtgcgtttcgttcggtttatcgtcgttatcggggtttttcgttgtagtaggagacgtattaggggcgcgtggtttcgtagtacggttaggtggagcggggttcggtttgcg

SEQ ID NO: 31880 - DNA, 610 bp, Artificial Sequence
  chemically treated genomic DNA (Homo sapiens) CpG-island No: 31880
cgcaaaccgaaccccgctccacctaaccgtactacgaaaccacgcgcccctaatacgtctcctactacaacgaaaaaccccgataacgacgataaaccgaacgaaacgcaccgcgctacacgaaaccgcctaacacgaacactcgcgaataaccgaactactactacaacgcgaaacctcgacgacgactcgctccgaaacgacctcacgccgctacactaaaccgctaccctaaaccacacgctactaaccgcgcgcctactaaaaactccgaacccgaaacccgcgacaacgaaaacgaaaaacgcgcgcgactaaacgacgacgcactaaacgacgcgaacgaacgactaacgatactaaaactactaacgaccgacgtcgcgaacctaaacgacgccctactcgtaactaccgctacgaaacgcgaaacgcgctacgcttcctcctaacgcgcgaaacgcgaataaacgcccgaaataacgcgaaaaccacaacgctaaatctaacgaccgccctaaaccgctcccaaatacgtcccgccctccgcccgacaataataaaaaaaaacgcaaaaccaaaatccccaaaaacgtaccaccgaaacaac

SEQ ID NO: 31881 - DNA, 561 bp, Artificial Sequence
  chemically treated genomic DNA (Homo sapiens) CpG-island No: 31881
gacggggcgcgtaagggagttgagtttgggtggatcgcgttagggcgcggggagttcgaggcgtagcggttgtagtttcggttttagagttcgcggcgtttaagtggttcgatgcgttgggagggaggcggcgggaggagggaggggagtcgaggtggaggggggaggggggaggagggagcggcgagttcggttcgggttttgtcggtagtttcgggtagcgtttatagtttttgtcgggcggggcgcggcggcggcggtagaggcgttgagtttgagcggggatgtagaggcggcggtagtagaggcggtattggcggtaagagtagacgttcgagtcgagcgagaagagcgtagagttttattttttgaagtcgggtttcgcgttttagttttgtttagttcggtttagtttatgcgcgtcgtttgttgagttcgggcgtcgtacgttgagttattcgttcgcgagtcgcgtttagttcgggggtgattagttgttttttgttgttttttaatttgggttgcggggaggtggaggaggggtaggtgttgtaggttttt

SEQ ID NO: 31882 - DNA, 561 bp, Artificial Sequence
  chemically treated genomic DNA (Homo sapiens) CpG-island No: 31882
aaaaacctacaacacctacccctcctccacctccccgcaacccaaattaaaaaacaacaaaaaacaactaatcacccccgaactaaacgcgactcgcgaacgaataactcaacgtacgacgcccgaactcaacaaacgacgcgcataaactaaaccgaactaaacaaaactaaaacgcgaaacccgacttcaaaaaataaaactctacgctcttctcgctcgactcgaacgtctactcttaccgccaataccgcctctactaccgccgcctctacatccccgctcaaactcaacgcctctaccgccgccgccgcgccccgcccgacaaaaactataaacgctacccgaaactaccgacaaaacccgaaccgaactcgccgctccctcctcccccctcccccctccacctcgactcccctccctcctcccgccgcctccctcccaacgcatcgaaccacttaaacgccgcgaactctaaaaccgaaactacaaccgctacgcctcgaactccccgcgccctaacgcgatccacccaaactcaactcccttacgcgccccgtc

SEQ ID NO: 31883 - DNA, 561 bp, Artificial Sequence
  chemically treated genomic DNA (Homo sapiens) CpG-island No: 31883
gggagtttgtagtatttgttttttttttattttttcgtaatttaaattaaaaaataataaaaagtaattaattattttcgagttgagcgcggttcgcgggcggatggtttagcgtgcggcgttcggatttagtaggcggcgcgtatggattgggtcgggttgggtagggttgggacgcggggttcggttttagaagataaggttttgcgtttttttcgttcggttcgggcgtttgtttttgtcgttagtgtcgtttttgttgtcgtcgtttttatattttcgtttaggtttagcgtttttgtcgtcgtcgtcgcgtttcgttcggtaggagttatgaacgttgttcggggttgtcggtaaaattcggatcggattcgtcgtttttttttttttttttttttttttatttcggttttttttttttttttcgtcgttttttttttagcgtatcgggttatttggacgtcgcgggttttgaggtcggagttgtagtcgttgcgtttcgagtttttcgcgttttgacgcggtttatttaggtttagtttttttgcgcgtttcgtt

SEQ ID NO: 31884 - DNA, 561 bp, Artificial Sequence
  chemically treated genomic DNA (Homo sapiens) CpG-island No: 31884
aacgaaacgcgcaaaaaaactaaacctaaataaaccgcgtcaaaacgcgaaaaactcgaaacgcaacgactacaactccgacctcaaaacccgcgacgtccaaataacccgatacgctaaaaaaaaaacgacgaaaaaaaaaaaaaaaaccgaaataaaaaaaaaaaaaaaaaaaaaaaaacgacgaatccgatccgaattttaccgacaaccccgaacaacgttcataactcctaccgaacgaaacgcgacgacgacgacaaaaacgctaaacctaaacgaaaatataaaaacgacgacaacaaaaacgacactaacgacaaaaacaaacgcccgaaccgaacgaaaaaaacgcaaaaccttatcttctaaaaccgaaccccgcgtcccaaccctacccaacccgacccaatccatacgcgccgcctactaaatccgaacgccgcacgctaaaccatccgcccgcgaaccgcgctcaactcgaaaataattaattactttttattattttttaatttaaattacgaaaaaataaaaaaaaaacaaatactacaaactccc

SEQ ID NO: 31885 - DNA, 766 bp, Artificial Sequence
  chemically treated genomic DNA (Homo sapiens) CpG-island No: 31885
  misc_feature (134)..(134): n is either a, c, g or t
ttttcgattttcgtaggtgatttgtatttattttcgattttagatagggtttttttgttcggcgtttttagtttttttaggttcggcggttgcgtgggggttaataaggtttagttatcgacgttttttggttntaaggaatttcgaggtaggatttgaatttatttcgtggaaataaagattataaatttttcgggagtcgggggttgggcggaggtacggtttttttcgaggataggtagcggtcgaggtcgggtagttttcgtttcgtttcgttttttttcgtttcgggtcgtcgtcggagtttcgggcgcgcggattttttcgtcggtttcgtatttatttggtttcgcggtgttgttttcggcgcggcgggcgcggagtcgaacgtattgcgtttttttttttcggtagggcgtcgggcgtcggcgttttttttttgacgcgttacggcgttggcggttatttttcggagcgcgcgggaggtcgaggatagtcggggaaggcgtcggattttagtagagcggcgcgagcggcgggtcgggggtagttcgtgcggggaggggttgtaggttcgtttcgtttaggttttcgaggaaattcgcgtttttttttttttttcgaggattttcgcgaaaggtcgggttacggtgtatcgtttgttttcgttacgcgttgtgtaaagtttaagaggatatagtgggttttgtttggagttatagattttggtgtttttttttcgttcgttcgtagtggtcgttatttt

SEQ ID NO: 31886 - DNA, 766 bp, Artificial Sequence
  chemically treated genomic DNA (Homo sapiens) CpG-island No: 31886
  misc_feature (633)..(633): n is either a, c, g or t
aaaataacgaccactacgaacgaacgaaaaaaaaacaccaaaatctataactccaaacaaaacccactatatcctcttaaactttacacaacgcgtaacgaaaacaaacgatacaccgtaacccgacctttcgcgaaaatcctcgaaaaaaaaaaaaaaacgcgaatttcctcgaaaacctaaacgaaacgaacctacaacccctccccgcacgaactacccccgacccgccgctcgcgccgctctactaaaatccgacgccttccccgactatcctcgacctcccgcgcgctccgaaaaataaccgccaacgccgtaacgcgtcaaaaaaaaaacgccgacgcccgacgccctaccgaaaaaaaaaaacgcaatacgttcgactccgcgcccgccgcgccgaaaacaacaccgcgaaaccaaataaatacgaaaccgacgaaaaaatccgcgcgcccgaaactccgacgacgacccgaaacgaaaaaaaacgaaacgaaacgaaaactacccgacctcgaccgctacctatcctcgaaaaaaaccgtacctccgcccaacccccgactcccgaaaaatttataatctttatttccacgaaataaattcaaatcctacctcgaaattccttanaaccaaaaaacgtcgataactaaaccttattaacccccacgcaaccgccgaacctaaaaaaactaaaaacgccgaacaaaaaaaccctatctaaaatcgaaaataaatacaaatcacctacgaaaatcgaaaa

SEQ ID NO: 31887 - DNA, 766 bp, Artificial Sequence
  chemically treated genomic DNA (Homo sapiens) CpG-island No: 31887
  misc_feature (633)..(633): n is either a, c, g or t
agggtagcggttattgcgggcggacgagagggaaatattagagtttgtgattttagataggatttattgtgtttttttgaattttgtatagcgcgtgacgggggtagacggtgtatcgtggttcggtttttcgcgggggttttcggggaagagagaggagcgcgggttttttcggaggtttgagcgggacgagtttgtagttttttttcgtacgggttgttttcggttcgtcgttcgcgtcgttttgttgggattcggcgtttttttcggttgttttcggtttttcgcgcgtttcgggaggtagtcgttagcgtcgtgacgcgttaaggaggaaacgtcggcgttcggcgttttgtcggaaggaggaagcgtagtgcgttcggtttcgcgttcgtcgcgtcgggagtagtatcgcggggttaggtaggtgcggggtcggcgggagggttcgcgcgttcgggatttcgacggcggttcggggcgggaggagacggggcggggcgagggttgttcggtttcggtcgttgtttgttttcggaaaaagtcgtattttcgtttagttttcggttttcggagagtttgtggtttttgtttttacgaggtgaatttagattttgtttcgagattttttanaattaaggggcgtcggtggttggattttgttaatttttacgtagtcgtcgagtttggaggaattgggaacgtcgagtagggagattttatttgaggtcgaaagtgggtgtaggttatttgcgagggtcgggga

SEQ ID NO: 31888 - DNA, 766 bp, Artificial Sequence
  chemically treated genomic DNA (Homo sapiens) CpG-island No: 31888
  misc_feature (134)..(134): n is either a, c, g or t
tccccgaccctcgcaaataacctacacccactttcgacctcaaataaaatctccctactcgacgttcccaattcctccaaactcgacgactacgtaaaaattaacaaaatccaaccaccgacgccccttaattntaaaaaatctcgaaacaaaatctaaattcacctcgtaaaaacaaaaaccacaaactctccgaaaaccgaaaactaaacgaaaatacgactttttccgaaaacaaacaacgaccgaaaccgaacaaccctcgccccgccccgtctcctcccgccccgaaccgccgtcgaaatcccgaacgcgcgaaccctcccgccgaccccgcacctacctaaccccgcgatactactcccgacgcgacgaacgcgaaaccgaacgcactacgcttcctccttccgacaaaacgccgaacgccgacgtttcctccttaacgcgtcacgacgctaacgactacctcccgaaacgcgcgaaaaaccgaaaacaaccgaaaaaaacgccgaatcccaacaaaacgacgcgaacgacgaaccgaaaacaacccgtacgaaaaaaaactacaaactcgtcccgctcaaacctccgaaaaaacccgcgctcctctctcttccccgaaaacccccgcgaaaaaccgaaccacgatacaccgtctacccccgtcacgcgctatacaaaattcaaaaaaacacaataaatcctatctaaaatcacaaactctaatatttccctctcgtccgcccgcaataaccgctaccct

SEQ ID NO: 31889 - DNA, 576 bp, Artificial Sequence
  chemically treated genomic DNA (Homo sapiens) CpG-island No: 31889
ttgtcgtcgaggcgaggttgcggagacgtttttttggtgggtcgcgggattatttatttcgttagaaattcggttcgtttattttaagaattttggggtaattggatttttttatcgttcgttttcggattcgtttcggcgtcgttttcggatttatttttcggcgagcgtaggaattcgtttttttagtaggtttcgcgcggtgcgttttcggcgcgtttcgggttttatgatagttcggttcgtatgcgttatttacggttttattcgcggttttattttttggttttcggtttttttttcgattttcgcgagttttagttttagtttttagttttttagtttcgtttttagtcgcgcgcgttttttttttttcgttttcgttttttcgcgtgcggtttttatagttaatgaggtttagggtcgcgtgcgtagatttaaacggcggtttttgagggaggttgggcgcgagattcggcggtgcggataaaattttgtaggagattgcgagttttgtagaattgttagttgcgggggagagggtaggggtcgggcgtttgtgcggagtcgggttgg

SEQ ID NO: 31890 - DNA, 576 bp, Artificial Sequence
  chemically treated genomic DNA (Homo sapiens) CpG-island No: 31890
ccaacccgactccgcacaaacgcccgacccctaccctctcccccgcaactaacaattctacaaaactcgcaatctcctacaaaattttatccgcaccgccgaatctcgcgcccaacctccctcaaaaaccgccgtttaaatctacgcacgcgaccctaaacctcattaactataaaaaccgcacgcgaaaaaacgaaaacgaaaaaaaaaaaacgcgcgcgactaaaaacgaaactaaaaaactaaaaactaaaactaaaactcgcgaaaatcgaaaaaaaaaccgaaaaccaaaaaataaaaccgcgaataaaaccgtaaataacgcatacgaaccgaactatcataaaacccgaaacgcgccgaaaacgcaccgcgcgaaacctactaaaaaaacgaattcctacgctcgccgaaaaataaatccgaaaacgacgccgaaacgaatccgaaaacgaacgataaaaaaatccaattaccccaaaattcttaaaataaacgaaccgaatttctaacgaaataaataatcccgcgacccaccaaaaaaacgtctccgcaacctcgcctcgacgacaa

SEQ ID NO: 31891 - DNA, 576 bp, Artificial Sequence
  chemically treated genomic DNA (Homo sapiens) CpG-island No: 31891
ttagttcggtttcgtataggcgttcgatttttgttttttttttcgtagttagtagttttgtagggttcgtagttttttgtagggttttgttcgtatcgtcgaatttcgcgtttagttttttttaagagtcgtcgtttgaatttgcgtacgcggttttgaattttattggttgtgggggtcgtacgcgaagaagcgagggcggggaggggagagcgcgcgcggttgagggcggggttggggagttggaagttgggattggaattcgcgggagtcggggaaggagtcgggagttagggggtggggtcgcgggtggggtcgtaggtggcgtatgcgagtcgagttgttataggattcggaacgcgtcgagagcgtatcgcgcggggtttgttgggagagcgagtttttgcgttcgtcgaggagtgggttcggaagcggcgtcggagcgggttcggaagcgggcggtggagaagtttagttgttttaaaatttttagggtgagcgaatcgagtttttggcggggtgggtggtttcgcggtttattaagggaacgttttcgtagtttcgtttcggcgatag

SEQ ID NO: 31892 - DNA, 576 bp, Artificial Sequence
  chemically treated genomic DNA (Homo sapiens) CpG-island No: 31892
ctatcgccgaaacgaaactacgaaaacgttcccttaataaaccgcgaaaccacccaccccgccaaaaactcgattcgctcaccctaaaaattttaaaacaactaaacttctccaccgcccgcttccgaacccgctccgacgccgcttccgaacccactcctcgacgaacgcaaaaactcgctctcccaacaaaccccgcgcgatacgctctcgacgcgttccgaatcctataacaactcgactcgcatacgccacctacgaccccacccgcgaccccaccccctaactcccgactccttccccgactcccgcgaattccaatcccaacttccaactccccaaccccgccctcaaccgcgcgcgctctcccctccccgccctcgcttcttcgcgtacgacccccacaaccaataaaattcaaaaccgcgtacgcaaattcaaacgacgactcttaaaaaaaactaaacgcgaaattcgacgatacgaacaaaaccctacaaaaaactacgaaccctacaaaactactaactacgaaaaaaaaaacaaaaatcgaacgcctatacgaaaccgaactaa

SEQ ID NO: 31893 - DNA, 559 bp, Artificial Sequence
  chemically treated genomic DNA (Homo sapiens) CpG-island No: 31893
gggagaagtcggcggagggcgggatcgcgttttttgatatgttgggggtattttggtcgggcgggcggggttaagagcggtttgcgggcggcggttcggggtcgggtcgcggttcgtttcgttgttttttcgttttgttttgtcgaggacgtgcgtttcgtatcggttcgtttttagagggagcgagggaagcgtttagaggatcggggagaaggagtattcgtcggaggttggaggaggttgattcgcgttttcgcgttagtttgtttttatgcggtatttgaaggatggcgaagaggtcgcgtaggtgggggtatcgtttttcgtcgtacgtgtcggggtcgtttcggtttagatttttttttttatttcgttgttttttggtcgtatagaggtttttttggcgagggtagaggtttttgcgtgtcgttcgcgcggtcgtttggtttcgatgatcggagggtagttgcgacgtgtggagagttggggacgtagggtgtttgaggcgcgggacgtaagagatgcgttaggtttttcgcggggattttcgtagagtcga

SEQ ID NO: 31894 - DNA, 559 bp, Artificial Sequence
  chemically treated genomic DNA (Homo sapiens) CpG-island No: 31894
tcgactctacgaaaatccccgcgaaaaacctaacgcatctcttacgtcccgcgcctcaaacaccctacgtccccaactctccacacgtcgcaactaccctccgatcatcgaaaccaaacgaccgcgcgaacgacacgcaaaaacctctaccctcgccaaaaaaacctctatacgaccaaaaaacaacgaaataaaaaaaaaaatctaaaccgaaacgaccccgacacgtacgacgaaaaacgatacccccacctacgcgacctcttcgccatccttcaaataccgcataaaaacaaactaacgcgaaaacgcgaatcaacctcctccaacctccgacgaatactccttctccccgatcctctaaacgcttccctcgctccctctaaaaacgaaccgatacgaaacgcacgtcctcgacaaaacaaaacgaaaaaacaacgaaacgaaccgcgacccgaccccgaaccgccgcccgcaaaccgctcttaaccccgcccgcccgaccaaaatacccccaacatatcaaaaaacgcgatcccgccctccgccgacttctccc

SEQ ID NO: 31895 - DNA, 559 bp, Artificial Sequence
  chemically treated genomic DNA (Homo sapiens) CpG-island No: 31895
tcgattttacgaggattttcgcgagaaatttggcgtattttttacgtttcgcgttttaaatattttgcgtttttaattttttatacgtcgtagttgtttttcggttatcgaggttaagcggtcgcgcgagcgatacgtaaaaatttttgttttcgttagggaggtttttatgcggttagggggtagcgggataggaaagagaatttgagtcgagacggtttcgatacgtgcggcgaaaggcggtgtttttatttgcgcgattttttcgttattttttaagtatcgtataggagtaggttggcgcggggacgcgggttagttttttttagttttcggcgaatgtttttttttttcgattttttaggcgtttttttcgttttttttggaggcgggtcgatgcggaacgtacgttttcgatagggtaggacggagggatagcggggcggatcgcgattcgatttcgagtcgtcgttcgtaggtcgtttttagtttcgttcgttcggttaggatatttttaatatgttaggaggcgcgatttcgtttttcgtcggtttttttt

SEQ ID NO: 31896 - DNA, 559 bp, Artificial Sequence
  chemically treated genomic DNA (Homo sapiens) CpG-island No: 31896
aaaaaaaaccgacgaaaaacgaaatcgcgcctcctaacatattaaaaatatcctaaccgaacgaacgaaactaaaaacgacctacgaacgacgactcgaaatcgaatcgcgatccgccccgctatccctccgtcctaccctatcgaaaacgtacgttccgcatcgacccgcctccaaaaaaaacgaaaaaaacgcctaaaaaatcgaaaaaaaaaaacattcgccgaaaactaaaaaaaactaacccgcgtccccgcgccaacctactcctatacgatacttaaaaaataacgaaaaaatcgcgcaaataaaaacaccgcctttcgccgcacgtatcgaaaccgtctcgactcaaattctctttcctatcccgctaccccctaaccgcataaaaacctccctaacgaaaacaaaaatttttacgtatcgctcgcgcgaccgcttaacctcgataaccgaaaaacaactacgacgtataaaaaattaaaaacgcaaaatatttaaaacgcgaaacgtaaaaaatacgccaaatttctcgcgaaaatcctcgtaaaatcga

SEQ ID NO: 31897 - DNA, 871 bp, Artificial Sequence
  chemically treated genomic DNA (Homo sapiens) CpG-island No: 31897
tgcgggaggcgaggggagttaagagaaaggggttattttatacgcggttatttttattattcgtatgttcgttattatgtcgggatcgagtgtgtggtattcgtggtttttagtaggatcgagtttcgatcgcgatatagcgcgtttcgttcgtttcgggattttattttcggtagtttcgtttattttttttttagtcgtcgttgcgtgggttttttcgtattcgtttcggcgagttaggaggtcgtcgaaggacgattcgtcggataatcgttcgattttcgcgcggaaggttcggattcgggatttacggtttttgtgcggagacgggggcgggtttcggggcgtacggttttgttgatttttgtttttcgcggggtgcgtcgtgtatcggcggcgagcgtttaggggtttggggggcgtttatacgggttttagttttcgtttcgtcggcggtcgtatcgggagtttttcggtttttgttagttttttgtacgtcgttttaaatatatattcgttttgaataaataagggatgttcgttgtatagacgtagtttcgtgatagtttttagcggtttttattatcggattgtcgttttgagtttttgttttagtaagttgtcggagtcgtcgagtttgtcgttttttttttatgggtttagcgttttattttcgaaattgcgtgggggatggcgtagtttgtgtttttcgagtatcgttttcggtagtcggggattttttgtgttgttcggcgttcggcgcgggttgtaacgttttttttcgtggtttggggtagagtacgtaagatggcgttgttggattttttttttttgttttgggggttcggtttattattatttagttttttat

SEQ ID NO: 31898 - DNA, 871 bp, Artificial Sequence
  chemically treated genomic DNA (Homo sapiens) CpG-island No: 31898
ataaaaaactaaataataataaaccgaacccccaaaacaaaaaaaaaaaatccaacaacgccatcttacgtactctaccccaaaccacgaaaaaaaacgttacaacccgcgccgaacgccgaacaacacaaaaaatccccgactaccgaaaacgatactcgaaaaacacaaactacgccatcccccacgcaatttcgaaaataaaacgctaaacccataaaaaaaaaacgacaaactcgacgactccgacaacttactaaaacaaaaactcaaaacgacaatccgataataaaaaccgctaaaaactatcacgaaactacgtctatacaacgaacatcccttatttattcaaaacgaatatatatttaaaacgacgtacaaaaaactaacaaaaaccgaaaaactcccgatacgaccgccgacgaaacgaaaactaaaacccgtataaacgccccccaaacccctaaacgctcgccgccgatacacgacgcaccccgcgaaaaacaaaaatcaacaaaaccgtacgccccgaaacccgcccccgtctccgcacaaaaaccgtaaatcccgaatccgaaccttccgcgcgaaaatcgaacgattatccgacgaatcgtccttcgacgacctcctaactcgccgaaacgaatacgaaaaaacccacgcaacgacgactaaaaaaaaaataaacgaaactaccgaaaataaaatcccgaaacgaacgaaacgcgctatatcgcgatcgaaactcgatcctactaaaaaccacgaataccacacactcgatcccgacataataacgaacatacgaataataaaaataaccgcgtataaaataacccctttctcttaactcccctcgcctcccgca

SEQ ID NO: 31899 - DNA, 871 bp, Artificial Sequence
  chemically treated genomic DNA (Homo sapiens) CpG-island No: 31899
gtaaaggattgaatgatggtagatcgaatttttaaagtaaaagagaaaggtttaatagcgttattttgcgtgttttgttttaagttacggggagaaacgttgtagttcgcgtcgaacgtcgagtagtataaaggattttcgattgtcggggacggtgttcggagggtataggttacgttattttttacgtagtttcggagatggagcgttgggtttatggagggaaggcggtaggttcggcggtttcggtagtttgttggggtaggggtttaaggcggtagttcgatagtggaggtcgttgagaattgttacggagttgcgtttgtatagcgagtattttttatttatttagggcgagtgtgtatttggggcggcgtgtagggggttgataaagatcggagagttttcggtgcggtcgtcggcggagcgaagattggaattcgtatgagcgttttttaggtttttgagcgttcgtcgtcggtgtacggcgtatttcgcgggaggtagggattagtaaagtcgtgcgtttcgaggttcgttttcgttttcgtataaagatcgtgagtttcgggttcgagtttttcgcgcggggatcgggcggttgttcggcgggtcgtttttcgacggttttttggttcgtcggagcgggtgcggggaggtttacgtagcgacggttggaggaggggtgggcggggttgtcgggggtggggtttcggggcgggcggggcgcgttgtgtcgcggtcggagttcggttttgttggaggttacgggtgttatatattcggtttcgatatgatggcgagtatgcgagtggtgaaggtaatcgcgtataggatgattttttttttttggtttttttcgtttttcgta

SEQ ID NO: 31900 - DNA, 871 bp, Artificial Sequence
  chemically treated genomic DNA (Homo sapiens) CpG-island No: 31900
tacgaaaaacgaaaaaaaccaaaaaaaaaaaatcatcctatacgcgattaccttcaccactcgcatactcgccatcatatcgaaaccgaatatataacacccgtaacctccaacaaaaccgaactccgaccgcgacacaacgcgccccgcccgccccgaaaccccacccccgacaaccccgcccacccctcctccaaccgtcgctacgtaaacctccccgcacccgctccgacgaaccaaaaaaccgtcgaaaaacgacccgccgaacaaccgcccgatccccgcgcgaaaaactcgaacccgaaactcacgatctttatacgaaaacgaaaacgaacctcgaaacgcacgactttactaatccctacctcccgcgaaatacgccgtacaccgacgacgaacgctcaaaaacctaaaaaacgctcatacgaattccaatcttcgctccgccgacgaccgcaccgaaaactctccgatctttatcaaccccctacacgccgccccaaatacacactcgccctaaataaataaaaaatactcgctatacaaacgcaactccgtaacaattctcaacgacctccactatcgaactaccgccttaaacccctaccccaacaaactaccgaaaccgccgaacctaccgccttccctccataaacccaacgctccatctccgaaactacgtaaaaaataacgtaacctataccctccgaacaccgtccccgacaatcgaaaatcctttatactactcgacgttcgacgcgaactacaacgtttctccccgtaacttaaaacaaaacacgcaaaataacgctattaaacctttctcttttactttaaaaattcgatctaccatcattcaatcctttac

SEQ ID NO: 31901 - DNA, 1106 bp, Artificial Sequence
  chemically treated genomic DNA (Homo sapiens) CpG-island No: 31901
  misc_feature (6)..(6): n is either a, c, g or t
  misc_feature (66)..(66): n is either a, c, g or t
  misc_feature (97)..(97): n is either a, c, g or t
  misc_feature (187)..(187): n is either a, c, g or t
  misc_feature (337)..(337): n is either a, c, g or t
  misc_feature (563)..(563): n is either a, c, g or t
  misc_feature (730)..(730): n is either a, c, g or t
  misc_feature (837)..(837): n is either a, c, g or t
  misc_feature (910)..(910): n is either a, c, g or t
atttantcgcgttttaattatttttcgtttttttttatcgttcgttcgtataattttcgtttttantttttcgttatttagttatatttttttttanttagttacgtttaattagtcgtacgtttacgcgtatacgtttatttatatacgttcgtttatatacgttttatcgtcgcgcgtatcgttntattatatatcgtacgtatcgtacgttattatattattttattatattattatatttatcgttcgtatttcgtcgttatttttattatcgtttttacggttatttttttttacgttttcgcgcgtatatatttatcgtattcgttcgttntacgttatcgtttaattttatattcgtataatttcgcgtttttatatcgttcgttcgcgcgcgtacgtacgcgttcgcgtatttttcgtcgtttattttcgcgcgttcgttttagcgcgtatcgcgtattattttttttttttttttttatttacgttcgacgtatcgcgcgttatattacgtatcgtattttcgtttttatttttatttcgtttttcgcgttttntatcgtacgtacgtacgttttcgttacgtttaacgtcgcgtattttatcgtatcgcgtattatttcgttttttttacgttaagcgttcgtatatataattttatcgttttttttaatcgtttcgcgtttttacgttataattcgcgtttaaataattttttttttanttaataatttatatatattaaattacgtttttcgtacgtaattacgtcgttatcgtattatcgtttttatttttttagatttttcgcgtaataacgtattattttantttattttaatagtaacgttcggtatattttaatcgttttaatagcgcgcgtaaataattcgtttttaattancgcgtcgtatcgcgtattattatcgtttaaatttatttattttattatttaacgtatttttttttttatttatcgtcgtcgttaaagttttattatcgttaatttttaaagcgacgttttcgatttttatagtatttacggtcgaaattcggtttaattttttcgattaacgtaatttaataaattttaagtaatt

SEQ ID NO: 31902 - DNA, 1106 bp, Artificial Sequence
  chemically treated genomic DNA (Homo sapiens) CpG-island No: 31902
  misc_feature (197)..(197): n is either a, c, g or t
  misc_feature (270)..(270): n is either a, c, g or t
  misc_feature (377)..(377): n is either a, c, g or t
  misc_feature (544)..(544): n is either a, c, g or t
  misc_feature (770)..(770): n is either a, c, g or t
  misc_feature (920)..(920): n is either a, c, g or t
  misc_feature (1010)..(1010): n is either a, c, g or t
  misc_feature (1041)..(1041): n is either a, c, g or t
  misc_feature (1101)..(1101): n is either a, c, g or t
aattacttaaaatttattaaattacgttaatcgaaaaaattaaaccgaatttcgaccgtaaatactataaaaatcgaaaacgtcgctttaaaaattaacgataataaaactttaacgacgacgataaataaaaaaaaaaatacgttaaataataaaataaataaatttaaacgataataatacgcgatacgacgcgntaattaaaaacgaattatttacgcgcgctattaaaacgattaaaatataccgaacgttactattaaaataaantaaaataatacgttattacgcgaaaaatctaaaaaaataaaaacgataatacgataacgacgtaattacgtacgaaaaacgtaatttaatatatataaattattaantaaaaaaaaaattatttaaacgcgaattataacgtaaaaacgcgaaacgattaaaaaaaacgataaaattatatatacgaacgcttaacgtaaaaaaaacgaaataatacgcgatacgataaaatacgcgacgttaaacgtaacgaaaacgtacgtacgtacgatanaaaacgcgaaaaacgaaataaaaataaaaacgaaaatacgatacgtaatataacgcgcgatacgtcgaacgtaaataaaaaaaaaaaaaaaaaataatacgcgatacgcgctaaaacgaacgcgcgaaaataaacgacgaaaaatacgcgaacgcgtacgtacgcgcgcgaacgaacgatataaaaacgcgaaattatacgaatataaaattaaacgataacgtanaacgaacgaatacgataaatatatacgcgcgaaaacgtaaaaaaaaataaccgtaaaaacgataataaaaataacgacgaaatacgaacgataaatataataatataataaaataatataataacgtacgatacgtacgatatataatanaacgatacgcgcgacgataaaacgtatataaacgaacgtatataaataaacgtatacgcgtaaacgtacgactaattaaacgtaactaantaaaaaaaaatataactaaataacgaaaaantaaaaacgaaaattatacgaacgaacgataaaaaaaaacgaaaaataattaaaacgcgantaaat

SEQ ID NO: 31903 - DNA, 1106 bp, Artificial Sequence
  chemically treated genomic DNA (Homo sapiens) CpG-island No: 31903
  misc_feature (197)..(197): n is either a, c, g or t
  misc_feature (270)..(270): n is either a, c, g or t
  misc_feature (377)..(377): n is either a, c, g or t
  misc_feature (544)..(544): n is either a, c, g or t
  misc_feature (770)..(770): n is either a, c, g or t
  misc_feature (920)..(920): n is either a, c, g or t
  misc_feature (1010)..(1010): n is either a, c, g or t
  misc_feature (1041)..(1041): n is either a, c, g or t
  misc_feature (1101)..(1101): n is either a, c, g or t
ggttgtttggggtttgttgagttgcgttggtcggggaggttgggtcgggtttcggtcgtgaatgttgtgaaagtcgggggcgtcgttttgagggttggcgatggtagggttttgacggcgacggtggatggggggaaaaatacgttggatggtggggtggatgggtttgagcggtgatggtgcgcgatgcggcgcgntgattaggagcgggttgtttgcgcgcgttgttggagcggttgggatgtgtcgagcgttgttgttgagatgagntgggatggtgcgttgttgcgcgagagatttggggagatgagagcgatggtgcgatagcggcgtgattgcgtgcggggggcgtgatttggtgtgtgtggattgttgantgagagggggattgtttgggcgcggattgtggcgtgagagcgcgaggcgattggagagagcgatgggattgtgtgtgcgggcgtttggcgtggggggggcgagatgatgcgcgatgcggtgggatgcgcggcgttgggcgtggcgagagcgtgcgtgcgtgcgatgnggggcgcgagggacggggtggagatgggggcgagagtgcgatgcgtggtgtggcgcgcggtgcgtcgagcgtgggtgggagagagaggagagagtgatgcgcgatgcgcgttggggcgggcgcgcgagagtgagcggcgagagatgcgcgggcgcgtgcgtgcgcgcgcggacggacggtgtgggggcgcgggattgtgcgagtgtgagattgggcgatggcgtgnggcgagcggatgcgatgggtgtgtgcgcgcgggagcgtggggagagatggtcgtgggggcgatggtggggatggcggcgagatgcgggcgatgagtgtgatgatgtggtgggatggtgtgatggcgtgcgatgcgtgcgatgtgtgatgnggcgatgcgcgcgacgatggggcgtgtgtgagcgagcgtgtgtgagtgggcgtgtgcgcgtgggcgtgcggttgattgggcgtggttggntgggggagagtgtggttggatggcgggggantgagagcgagagttgtgcgagcgagcgatgggagagagcgaggggtgattggagcgcgantggat

SEQ ID NO: 31904 - DNA, 1106 bp, Artificial Sequence
  chemically treated genomic DNA (Homo sapiens) CpG-island No: 31904
  misc_feature (6)..(6): n is either a, c, g or t
  misc_feature (66)..(66): n is either a, c, g or t
  misc_feature (97)..(97): n is either a, c, g or t
  misc_feature (187)..(187): n is either a, c, g or t
  misc_feature (337)..(337): n is either a, c, g or t
  misc_feature (563)..(563): n is either a, c, g or t
  misc_feature (730)..(730): n is either a, c, g or t
  misc_feature (837)..(837): n is either a, c, g or t
  misc_feature (910)..(910): n is either a, c, g or t
atccantcgcgctccaatcacccctcgctctctcccatcgctcgctcgcacaactctcgctctcantcccccgccatccaaccacactctcccccanccaaccacgcccaatcaaccgcacgcccacgcgcacacgcccactcacacacgctcgctcacacacgccccatcgtcgcgcgcatcgccncatcacacatcgcacgcatcgcacgccatcacaccatcccaccacatcatcacactcatcgcccgcatctcgccgccatccccaccatcgcccccacgaccatctctccccacgctcccgcgcgcacacacccatcgcatccgctcgccncacgccatcgcccaatctcacactcgcacaatcccgcgcccccacaccgtccgtccgcgcgcgcacgcacgcgcccgcgcatctctcgccgctcactctcgcgcgcccgccccaacgcgcatcgcgcatcactctctcctctctctcccacccacgctcgacgcaccgcgcgccacaccacgcatcgcactctcgcccccatctccaccccgtccctcgcgccccncatcgcacgcacgcacgctctcgccacgcccaacgccgcgcatcccaccgcatcgcgcatcatctcgccccccccacgccaaacgcccgcacacacaatcccatcgctctctccaatcgcctcgcgctctcacgccacaatccgcgcccaaacaatccccctctcantcaacaatccacacacaccaaatcacgccccccgcacgcaatcacgccgctatcgcaccatcgctctcatctccccaaatctctcgcgcaacaacgcaccatcccanctcatctcaacaacaacgctcgacacatcccaaccgctccaacaacgcgcgcaaacaacccgctcctaatcancgcgccgcatcgcgcaccatcaccgctcaaacccatccaccccaccatccaacgtatttttccccccatccaccgtcgccgtcaaaaccctaccatcgccaaccctcaaaacgacgcccccgactttcacaacattcacgaccgaaacccgacccaacctccccgaccaacgcaactcaacaaaccccaaacaacc

SEQ ID NO: 31905 - DNA, 528 bp, Artificial Sequence
  chemically treated genomic DNA (Homo sapiens) CpG-island No: 31905
  misc_feature (163)..(163): n is either a, c, g or t
  misc_feature (171)..(171): n is either a, c, g or t
  misc_feature (182)..(182): n is either a, c, g or t
  misc_feature (271)..(271): n is either a, c, g or t
  misc_feature (340)..(341): n is either a, c, g or t
  misc_feature (462)..(462): n is either a, c, g or t
  misc_feature (507)..(507): n is either a, c, g or t
cgcgtagtcgatagtggttttaagtagcgaagcgagtaggattgggcggcggttaaagcggtcggatagtgtttcgagaacgggtgcgtatagaaattgtattaacgtatatagcgttagtagtacgttatagtgattggcgatgttgtcgggatggacgatntttcgtangaggttcggtngtttcggtttaattaagtttatgtttatagtatttagggtgacggggttcgagggtgacgatgatcgtattgtatgatttatattcggngtttgtttgggttattagtttaattgcgcgtaattatcgtataagaggttatcgtcgatagggtggggnnttggggacggggtcgggggttttagcgttttttcgttttaggttcgttcgtttcggtggtgtcgttcggttgtgtcgtcgtcggtacgtcgtttacgtcggcgggaagcgtgtgcgtcgtngtcgcggtcggttgtaggtgtcggggataggttcgcgcgcgtttnggtgagcggaagtagcgcgtt

SEQ ID NO: 31906 - DNA, 528 bp, Artificial Sequence
  chemically treated genomic DNA (Homo sapiens) CpG-island No: 31906
  misc_feature (22)..(22): n is either a, c, g or t
  misc_feature (67)..(67): n is either a, c, g or t
  misc_feature (188)..(189): n is either a, c, g or t
  misc_feature (258)..(258): n is either a, c, g or t
  misc_feature (347)..(347): n is either a, c, g or t
  misc_feature (358)..(358): n is either a, c, g or t
  misc_feature (366)..(366): n is either a, c, g or t
aacgcgctacttccgctcaccnaaacgcgcgcgaacctatccccgacacctacaaccgaccgcgacnacgacgcacacgcttcccgccgacgtaaacgacgtaccgacgacgacacaaccgaacgacaccaccgaaacgaacgaacctaaaacgaaaaaacgctaaaacccccgaccccgtccccaannccccaccctatcgacgataacctcttatacgataattacgcgcaattaaactaataacccaaacaaacnccgaatataaatcatacaatacgatcatcgtcaccctcgaaccccgtcaccctaaatactataaacataaacttaattaaaccgaaacnaccgaacctcntacgaaanatcgtccatcccgacaacatcgccaatcactataacgtactactaacgctatatacgttaatacaatttctatacgcacccgttctcgaaacactatccgaccgctttaaccgccgcccaatcctactcgcttcgctacttaaaaccactatcgactacgcg

SEQ ID NO: 31907 - DNA, 528 bp, Artificial Sequence
  chemically treated genomic DNA (Homo sapiens) CpG-island No: 31907
  misc_feature (22)..(22): n is either a, c, g or t
  misc_feature (67)..(67): n is either a, c, g or t
  misc_feature (188)..(189): n is either a, c, g or t
  misc_feature (258)..(258): n is either a, c, g or t
  misc_feature (347)..(347): n is either a, c, g or t
  misc_feature (358)..(358): n is either a, c, g or t
  misc_feature (366)..(366): n is either a, c, g or t
ggcgcgttgttttcgtttattnaggcgcgcgcgagtttattttcggtatttgtagtcggtcgcgatnacgacgtatacgtttttcgtcggcgtggacggcgtatcggcgacggtatagtcgggcggtattatcggggcgagcggatttggggcgaagggacgttgaggttttcggtttcgtttttagnnttttattttatcggcgataattttttatgcggtagttacgcgtagttaaattggtaatttaggtaggtntcgggtataaattatataatgcggttatcgttattttcgggtttcgttattttggatgttgtaggtataggtttggttaagtcggaatngtcgggttttntgcggganatcgtttatttcgatagtatcgttagttattatggcgtgttgttagcgttatatgcgttgatgtaatttttatgcgtattcgttttcggagtattgttcgatcgttttggtcgtcgtttagttttgttcgtttcgttatttggagttattatcgattacgcg

SEQ ID NO: 31908 - DNA, 528 bp, Artificial Sequence
  chemically treated genomic DNA (Homo sapiens) CpG-island No: 31908
  misc_feature (163)..(163): n is either a, c, g or t
  misc_feature (171)..(171): n is either a, c, g or t
  misc_feature (182)..(182): n is either a, c, g or t
  misc_feature (271)..(271): n is either a, c, g or t
  misc_feature (340)..(341): n is either a, c, g or t
  misc_feature (462)..(462): n is either a, c, g or t
  misc_feature (507)..(507): n is either a, c, g or t
cgcgtaatcgataataactccaaataacgaaacgaacaaaactaaacgacgaccaaaacgatcgaacaatactccgaaaacgaatacgcataaaaattacatcaacgcatataacgctaacaacacgccataataactaacgatactatcgaaataaacgatntcccgcanaaaacccgacnattccgacttaaccaaacctatacctacaacatccaaaataacgaaacccgaaaataacgataaccgcattatataatttatacccganacctacctaaattaccaatttaactacgcgtaactaccgcataaaaaattatcgccgataaaataaaannctaaaaacgaaaccgaaaacctcaacgtcccttcgccccaaatccgctcgccccgataataccgcccgactataccgtcgccgatacgccgtccacgccgacgaaaaacgtatacgtcgtnatcgcgaccgactacaaataccgaaaataaactcgcgcgcgcctnaataaacgaaaacaacgcgcc

SEQ ID NO: 31909 - DNA, 557 bp, Artificial Sequence
  chemically treated genomic DNA (Homo sapiens) CpG-island No: 31909
tgcggttgttgatcgtataatgattcgacgtcggtagcgagggaagagtaaggtttaaaaatcggcgtttattagggtagaatgtagtttacggaggatggcggaagaggcggttgaggtcgtaggacgtgttattttaaggtacggtcgtacgagtgttacgtatgcgcgtgcgttggttcgcgttagatatagtgttagtttttagatggggcggggtcgggcgttcgcgtcggaagagggttggttgggcggggtcgggaagcggtagtggcggttacgcgcgcgggggtgcgcgcgggaacgatcgggaaatatcgcgagggtcggggtgggttaggttgtggggacgacgggttgcgacgatggtcgtagcggcgggcggcggcgggtcggggatagcggtaggcgttacgggttcggggattgcggcggtagtcgtaggtttagttgtttatcgacggaaggatgggggttcggttattaagttttgggagagttcggagacggtgttttagttggattcggtgcgggtttggttgggtaagtattataag

SEQ ID NO: 31910 - DNA, 557 bp, Artificial Sequence
  chemically treated genomic DNA (Homo sapiens) CpG-island No: 31910
cttataatacttacccaaccaaacccgcaccgaatccaactaaaacaccgtctccgaactctcccaaaacttaataaccgaacccccatccttccgtcgataaacaactaaacctacgactaccgccgcaatccccgaacccgtaacgcctaccgctatccccgacccgccgccgcccgccgctacgaccatcgtcgcaacccgtcgtccccacaacctaacccaccccgaccctcgcgatatttcccgatcgttcccgcgcgcacccccgcgcgcgtaaccgccactaccgcttcccgaccccgcccaaccaaccctcttccgacgcgaacgcccgaccccgccccatctaaaaactaacactatatctaacgcgaaccaacgcacgcgcatacgtaacactcgtacgaccgtaccttaaaataacacgtcctacgacctcaaccgcctcttccgccatcctccgtaaactacattctaccctaataaacgccgatttttaaaccttactcttccctcgctaccgacgtcgaatcattatacgatcaacaaccgca

SEQ ID NO: 31911 - DNA, 557 bp, Artificial Sequence
  chemically treated genomic DNA (Homo sapiens) CpG-island No: 31911
tttgtagtgtttgtttagttagattcgtatcgaatttagttgggatatcgttttcgggtttttttaaaatttggtggtcgggtttttattttttcgtcgataaatagttaggtttgcggttgtcgtcgtaattttcgagttcgtggcgtttatcgttgttttcggttcgtcgtcgttcgtcgttgcggttatcgtcgtagttcgtcgtttttatagtttggtttatttcggttttcgcggtgtttttcggtcgttttcgcgcgtattttcgcgcgcgtagtcgttattgtcgtttttcggtttcgtttagttaattttttttcggcgcggacgttcggtttcgttttatttgggaattggtattgtatttgacgcgagttagcgtacgcgtatgcgtagtattcgtgcggtcgtgttttggaatagtacgttttgcggttttagtcgtttttttcgttatttttcgtaggttgtattttgttttagtgagcgtcggtttttgagttttgtttttttttcgttatcgacgtcgaattattatgcggttaataatcgta

SEQ ID NO: 31912 - DNA, 557 bp, Artificial Sequence
  chemically treated genomic DNA (Homo sapiens) CpG-island No: 31912
tacgattattaaccgcataataattcgacgtcgataacgaaaaaaaaacaaaactcaaaaaccgacgctcactaaaacaaaatacaacctacgaaaaataacgaaaaaaacgactaaaaccgcaaaacgtactattccaaaacacgaccgcacgaatactacgcatacgcgtacgctaactcgcgtcaaatacaataccaattcccaaataaaacgaaaccgaacgtccgcgccgaaaaaaaattaactaaacgaaaccgaaaaacgacaataacgactacgcgcgcgaaaatacgcgcgaaaacgaccgaaaaacaccgcgaaaaccgaaataaaccaaactataaaaacgacgaactacgacgataaccgcaacgacgaacgacgacgaaccgaaaacaacgataaacgccacgaactcgaaaattacgacgacaaccgcaaacctaactatttatcgacgaaaaaataaaaacccgaccaccaaattttaaaaaaacccgaaaacgatatcccaactaaattcgatacgaatctaactaaacaaacactacaaa

SEQ ID NO: 31913 - DNA, 992 bp, Artificial Sequence
  chemically treated genomic DNA (Homo sapiens) CpG-island No: 31913
acggcgtatttcgaggcgaaggcgtcgttgcgttaatgaagcggttttttttacggttttcgcggagtttttggttgcgaggttcgtttcggcggatcggtttggttttcgttttcgttcgggttttatggtaacggtaggtcgaggtttggttgtttacggatcggtcgggtcggtttttcgggtaggtttaggatgttcggtttgtttttcgggttcgtcggcgttttcgttttatttttcgttaggttggcggtcggatcgggttttttttttacgacgattattttcggtcgcggtaggttttttaagagggtacgaaaggggagaataaaaagtttaatttatttgttgttatagatgtgaaataagtttttgtgtatcgcgtatgagtcgcggtttttttaattacggtcggattataatttttagtagcggcggcgcggtttttttcgagtttcgtggcggaagtttcgttatcggttcggcgttttttattcggcgttacggagttcgtttgcggcgtacggtttcgttttttcgcgggtttggagttcggttttatttgggattcgtcgtagtcgttcggggtatttagcgttcgggatgttttagtattcggtttaatggggcgcggcggcggtgtaggcgggattttcggcggagtcgcgaaggggacgggttggcgtcggttgttttggggtcgtagagcgagcgggtttgggtggcggggtcgggcgttaagttgttgtttttttcggcgatttagttgtttgtagtgtgaaagcgggaagggttttttcgttttttgcgagttattcgcgttttttgatgcgaataaatagttcgggttatggttgagcggggaacggtttttagttcgggtttcgggattttattcgtttttttcgttatagttcgtagttacgtttttttttttttttattttttttataatttgtttttttagggaggtgagtatttttaattta

SEQ ID NO: 31914 - DNA, 992 bp, Artificial Sequence
  chemically treated genomic DNA (Homo sapiens) CpG-island No: 31914
taaattaaaaatactcacctccctaaaaaaacaaattataaaaaaaataaaaaaaaaaaaaaacgtaactacgaactataacgaaaaaaacgaataaaatcccgaaacccgaactaaaaaccgttccccgctcaaccataacccgaactatttattcgcatcaaaaaacgcgaataactcgcaaaaaacgaaaaaacccttcccgctttcacactacaaacaactaaatcgccgaaaaaaacaacaacttaacgcccgaccccgccacccaaacccgctcgctctacgaccccaaaacaaccgacgccaacccgtccccttcgcgactccgccgaaaatcccgcctacaccgccgccgcgccccattaaaccgaatactaaaacatcccgaacgctaaataccccgaacgactacgacgaatcccaaataaaaccgaactccaaacccgcgaaaaaacgaaaccgtacgccgcaaacgaactccgtaacgccgaataaaaaacgccgaaccgataacgaaacttccgccacgaaactcgaaaaaaaccgcgccgccgctactaaaaattataatccgaccgtaattaaaaaaaccgcgactcatacgcgatacacaaaaacttatttcacatctataacaacaaataaattaaactttttattctcccctttcgtaccctcttaaaaaacctaccgcgaccgaaaataatcgtcgtaaaaaaaaaacccgatccgaccgccaacctaacgaaaaataaaacgaaaacgccgacgaacccgaaaaacaaaccgaacatcctaaacctacccgaaaaaccgacccgaccgatccgtaaacaaccaaacctcgacctaccgttaccataaaacccgaacgaaaacgaaaaccaaaccgatccgccgaaacgaacctcgcaaccaaaaactccgcgaaaaccgtaaaaaaaaccgcttcattaacgcaacgacgccttcgcctcgaaatacgccgt

SEQ ID NO: 31915 - DNA, 992 bp, Artificial Sequence
  chemically treated genomic DNA (Homo sapiens) CpG-island No: 31915
taagttaaaaatgtttatttttttaaaaaaatagattataggggagatggggaagagaagaggcgtggttacgagttgtggcggggaaggcgggtggaatttcggagttcgagttggaaatcgtttttcgtttagttatgattcgggttgtttattcgtattaggaggcgcgggtggttcgtagagggcgagaagatttttttcgtttttatattgtaggtagttaagtcgtcgagaaaggtagtaatttgacgttcgatttcgttatttaaattcgttcgttttgcgattttagagtagtcggcgttaattcgtttttttcgcgatttcgtcggaagtttcgtttgtatcgtcgtcgcgttttattgggtcgggtgttggggtatttcgggcgttgggtgtttcgagcggttacgacgagttttaggtggggtcgggttttaggttcgcgggggagcggagtcgtgcgtcgtaggcgggtttcgtgacgtcgggtggggaacgtcgggtcggtggcgggattttcgttacgggattcggaaggggtcgcgtcgtcgttgttgggagttgtagttcggtcgtggttgggggagtcgcggtttatgcgcggtgtatagaggtttgttttatatttgtaataataggtgaattgggttttttatttttttttttcgtgtttttttgaggagtttgtcgcggtcgggggtggtcgtcgtgaggagggggttcggttcgatcgttagtttggcggagagtggggcggagacgtcggcgggttcgaggagtaggtcgggtattttaggtttgttcgggaagtcggttcggtcgattcgtgggtagttaggtttcggtttgtcgttgttatggagttcgggcgggggcgggggttagatcggttcgtcggggcgggtttcgtagttaggggtttcgcggaggtcgtgggagaggtcgttttattggcgtaacgacgttttcgtttcgggatgcgtcgt

SEQ ID NO: 31916 - DNA, 992 bp, Artificial Sequence
  chemically treated genomic DNA (Homo sapiens) CpG-island No: 31916
acgacgcatcccgaaacgaaaacgtcgttacgccaataaaacgacctctcccacgacctccgcgaaacccctaactacgaaacccgccccgacgaaccgatctaacccccgcccccgcccgaactccataacaacgacaaaccgaaacctaactacccacgaatcgaccgaaccgacttcccgaacaaacctaaaatacccgacctactcctcgaacccgccgacgtctccgccccactctccgccaaactaacgatcgaaccgaaccccctcctcacgacgaccacccccgaccgcgacaaactcctcaaaaaaacacgaaaaaaaaaaataaaaaacccaattcacctattattacaaatataaaacaaacctctatacaccgcgcataaaccgcgactcccccaaccacgaccgaactacaactcccaacaacgacgacgcgaccccttccgaatcccgtaacgaaaatcccgccaccgacccgacgttccccacccgacgtcacgaaacccgcctacgacgcacgactccgctcccccgcgaacctaaaacccgaccccacctaaaactcgtcgtaaccgctcgaaacacccaacgcccgaaataccccaacacccgacccaataaaacgcgacgacgatacaaacgaaacttccgacgaaatcgcgaaaaaaacgaattaacgccgactactctaaaatcgcaaaacgaacgaatttaaataacgaaatcgaacgtcaaattactacctttctcgacgacttaactacctacaatataaaaacgaaaaaaatcttctcgccctctacgaaccacccgcgcctcctaatacgaataaacaacccgaatcataactaaacgaaaaacgatttccaactcgaactccgaaattccacccgccttccccgccacaactcgtaaccacgcctcttctcttccccatctcccctataatctatttttttaaaaaaataaacatttttaactta

SEQ ID NO: 31917 - DNA, 533 bp, Artificial Sequence
  chemically treated genomic DNA (Homo sapiens) CpG-island No: 31917
cgaagaaggcggggggggggagggaacggcgcgagcgacggagattaaggatagacggagaaagcgaacgggaaaacggggagcgggggcggggggcgaggcgaaaaggggaggggcggtatttcgcgtaattcgataaataaaaggggcggaggggaagggggggggggaaataagaggagggggggggaggataacgggtaacggggggcggggacggggggaatattaataacggaaggggggaagaaaggggggggtcggaagcgatagaagggtcgaaacgggggataaagggggggggaaaaggggaaaaaaaagaaatcggaaaaaacggggaaagcgggggcggcgggggcgcggtcgaaaatcgtattataaacggggaaaggagaaaagggtatcgggcgagtttaaaacggaaggaaagacggagggggggaacgacgaaagacggcgggtaatagtaaaatttttttttttttttttcgaggatacgtgtagattagatttagggtggtatttcgtcgttt

SEQ ID NO: 31918 - DNA, 533 bp, Artificial Sequence
  chemically treated genomic DNA (Homo sapiens) CpG-island No: 31918
aaacgacgaaataccaccctaaatctaatctacacgtatcctcgaaaaaaaaaaaaaaaaattttactattacccgccgtctttcgtcgttccccccctccgtctttccttccgttttaaactcgcccgatacccttttctcctttccccgtttataatacgattttcgaccgcgcccccgccgcccccgctttccccgttttttccgatttcttttttttccccttttccccccccctttatcccccgtttcgacccttctatcgcttccgacccccccctttcttccccccttccgttattaatattccccccgtccccgccccccgttacccgttatcctccccccccctcctcttatttcccccccccccttcccctccgccccttttatttatcgaattacgcgaaataccgcccctccccttttcgcctcgccccccgcccccgctccccgttttcccgttcgctttctccgtctatccttaatctccgtcgctcgcgccgttccctccccccccccgccttcttcg

SEQ ID NO: 31919 - DNA, 533 bp, Artificial Sequence
  chemically treated genomic DNA (Homo sapiens) CpG-island No: 31919
gggcggcggagtgttattttgggtttggtttgtacgtgttttcgggggggggggggaaggattttgttgttgttcgtcgtttttcgtcgtttttttttttcgttttttttttcgttttgggttcgttcggtgtttttttttttttttttcgtttgtggtgcggttttcggtcgcgttttcgtcgttttcgtttttttcgtttttttcggttttttttttttttttttttttttttttttttgtttttcgtttcggtttttttgtcgttttcggtttttttttttttttttttttttcgttgttggtgtttttttcgttttcgtttttcgttgttcgttgttttttttttttttttttttgttttttttttttttttttttttcgttttttttgtttgtcgggttgcgcggggtgtcgtttttttttttttcgtttcgtttttcgttttcgtttttcgttttttcgttcgtttttttcgtttgtttttggttttcgtcgttcgcgtcgtttttttttttttttcgtttttttcg

SEQ ID NO: 31920 - DNA, 533 bp, Artificial Sequence
  chemically treated genomic DNA (Homo sapiens) CpG-island No: 31920
cgaaaaaaacgaaaaaaaaaaaaaaacgacgcgaacgacgaaaaccaaaaacaaacgaaaaaaacgaacgaaaaaacgaaaaacgaaaacgaaaaacgaaacgaaaaaaaaaaaaacgacaccccgcgcaacccgacaaacaaaaaaaacgaaaaaaaaaaaaaaaaaaaaaacaaaaaaaaaaaaaaaaaaaacaacgaacaacgaaaaacgaaaacgaaaaaaacaccaacaacgaaaaaaaaaaaaaaaaaaaaaaaccgaaaacgacaaaaaaaccgaaacgaaaaacaaaaaaaaaaaaaaaaaaaaaaaaaaaaaaaaccgaaaaaaacgaaaaaaacgaaaacgacgaaaacgcgaccgaaaaccgcaccacaaacgaaaaaaaaaaaaaaaaacaccgaacgaacccaaaacgaaaaaaaaaacgaaaaaaaaaaacgacgaaaaacgacgaacaacaacaaaatccttcccccccccccccgaaaacacgtacaaaccaaacccaaaataacactccgccgccc

SEQ ID NO: 31921 - DNA, 545 bp, Artificial Sequence
  chemically treated genomic DNA (Homo sapiens) CpG-island No: 31921
tattcgggtttgtgttacgttaagttttataaatagtaaggtcgttgttcgtcgacggatggcgaatttggttattatggaagagaggattttcggtcgttaggttcgatttcggttcgcgtttttagttttgttattttaggagttaagggcgttgcggatcgttcgttttcgtcgatgtttttatcgtttattaagttttcgtcgttttttttaggttcgtcgggggttatttttgattcggtttcggcggtttttttggtgtggtcggggtgggcgtagtttgaagagaagtcgcgcgagcgattttgtcgtttagtagcgcggggatttagcggttgtaggcgcggagagatgtcggcggttagcgttatgagttttttagcggtcgttatcgtgttttcgtcgatttcgaggtttgtgcgcggtagggatcgggcgaagagatacgggagcggtcggttcgagcgtcgcgcgttttttgcgggtcgggcggattcgaagtttaagtttaggcgagggtattagtagattcgttttcgttt

SEQ ID NO: 31922 - DNA, 545 bp, Artificial Sequence
  chemically treated genomic DNA (Homo sapiens) CpG-island No: 31922
aaacgaaaacgaatctactaataccctcgcctaaacttaaacttcgaatccgcccgacccgcaaaaaacgcgcgacgctcgaaccgaccgctcccgtatctcttcgcccgatccctaccgcgcacaaacctcgaaatcgacgaaaacacgataacgaccgctaaaaaactcataacgctaaccgccgacatctctccgcgcctacaaccgctaaatccccgcgctactaaacgacaaaatcgctcgcgcgacttctcttcaaactacgcccaccccgaccacaccaaaaaaaccgccgaaaccgaatcaaaaataacccccgacgaacctaaaaaaaacgacgaaaacttaataaacgataaaaacatcgacgaaaacgaacgatccgcaacgcccttaactcctaaaataacaaaactaaaaacgcgaaccgaaatcgaacctaacgaccgaaaatcctctcttccataataaccaaattcgccatccgtcgacgaacaacgaccttactatttataaaacttaacgtaacacaaacccgaata

SEQ ID NO: 31923 - DNA, 545 bp, Artificial Sequence
  chemically treated genomic DNA (Homo sapiens) CpG-island No: 31923
gagcgaggacgggtttgttgatgttttcgtttaggtttgggtttcgggttcgttcggttcgtagggggcgcgcggcgttcgggtcggtcgttttcgtgttttttcgttcggtttttgtcgcgtataggtttcggggtcggcgggagtacgatggcggtcgttaggagatttatggcgttggtcgtcggtattttttcgcgtttgtagtcgttgggttttcgcgttgttgggcgatagggtcgttcgcgcggtttttttttaagttgcgtttatttcgattatattaaggaagtcgtcgaggtcgagttagggatggttttcggcgggtttggggaaggcgacggaagtttggtgaacggtgagggtatcggcgggggcgggcggttcgtagcgtttttgatttttgggatggtagagttaggggcgcgggtcgaaatcgggtttggcggtcgggggtttttttttttatagtggttaagttcgttattcgtcggcgggtagcggttttgttgtttgtaaagtttagcgtggtataggttcgaatg

SEQ ID NO: 31924 - DNA, 545 bp, Artificial Sequence
  chemically treated genomic DNA (Homo sapiens) CpG-island No: 31924
cattcgaacctataccacgctaaactttacaaacaacaaaaccgctacccgccgacgaataacgaacttaaccactataaaaaaaaaaacccccgaccgccaaacccgatttcgacccgcgcccctaactctaccatcccaaaaatcaaaaacgctacgaaccgcccgcccccgccgataccctcaccgttcaccaaacttccgtcgccttccccaaacccgccgaaaaccatccctaactcgacctcgacgacttccttaatataatcgaaataaacgcaacttaaaaaaaaaccgcgcgaacgaccctatcgcccaacaacgcgaaaacccaacgactacaaacgcgaaaaaataccgacgaccaacgccataaatctcctaacgaccgccatcgtactcccgccgaccccgaaacctatacgcgacaaaaaccgaacgaaaaaacacgaaaacgaccgacccgaacgccgcgcgccccctacgaaccgaacgaacccgaaacccaaacctaaacgaaaacatcaacaaacccgtcctcgctc

SEQ ID NO: 31925 - DNA, 517 bp, Artificial Sequence
  chemically treated genomic DNA (Homo sapiens) CpG-island No: 31925
  misc_feature (67)..(67): n is either a, c, g or t
  misc_feature (181)..(181): n is either a, c, g or t
  misc_feature (229)..(229): n is either a, c, g or t
  misc_feature (354)..(354): n is either a, c, g or t
ttttttttttttttttttgtttgtttcgtttcgttcggtcggtttttttttttttttttttttgttntttcgtgttttttgttttcgttttttcgtttttcgttttcgtgtgttttttttttttcgttttttttttcgtcgtttggttttcgtttttcggtgtcggtggttgtgtcgcggncggttgtcgttttggtttttcgtcgtcgttttgttgttcgttgtcggnttttttttttttttggttttttttcgttttcgcgttcgttcgttcgcgtttgttgttcgcgtttttcgtttcgtttcgttgtttttttttcgttcgttttttttggtttttgttttttttttttncgttttttttgcgtttttgtcgttttttttcgtttttgttttttcgttttgtttttcgtcgttttcgtttttcgttttcgtttttttttcgtagtttttgtttttttgtgttttgtttcgttttttttttgttttttttgtttttttttgtttttttttcgtt

SEQ ID NO: 31926 - DNA, 517 bp, Artificial Sequence
  chemically treated genomic DNA (Homo sapiens) CpG-island No: 31926
  misc_feature (164)..(164): n is either a, c, g or t
  misc_feature (289)..(289): n is either a, c, g or t
  misc_feature (337)..(337): n is either a, c, g or t
  misc_feature (451)..(451): n is either a, c, g or t
aacgaaaaaaaaacaaaaaaaaacaaaaaaaacaaaaaaaaaacgaaacaaaacacaaaaaaacaaaaactacgaaaaaaaaacgaaaacgaaaaacgaaaacgacgaaaaacaaaacgaaaaaacaaaaacgaaaaaaaacgacaaaaacgcaaaaaaaacgnaaaaaaaaaaaacaaaaaccaaaaaaaacgaacgaaaaaaaaacaacgaaacgaaacgaaaaacgcgaacaacaaacgcgaacgaacgaacgcgaaaacgaaaaaaaaccaaaaaaaaaaaaaanccgacaacgaacaacaaaacgacgacgaaaaaccaaaacgacaaccgnccgcgacacaaccaccgacaccgaaaaacgaaaaccaaacgacgaaaaaaaaaacgaaaaaaaaaaaacacacgaaaacgaaaaacgaaaaaacgaaaacaaaaaacacgaaanaacaaaaaaaaaaaaaaaaaaaaaccgaccgaacgaaacgaaacaaacaaaaaaaaaaaaaaaaaa

SEQ ID NO: 31927 - DNA, 517 bp, Artificial Sequence
  chemically treated genomic DNA (Homo sapiens) CpG-island No: 31927
  misc_feature (164)..(164): n is either a, c, g or t
  misc_feature (289)..(289): n is either a, c, g or t
  misc_feature (337)..(337): n is either a, c, g or t
  misc_feature (451)..(451): n is either a, c, g or t
gacgagagagaggtaaaaagaggtaaagaaaataaagggaaaacgagataaaatatagaaagatagggattacggagaagggacgagagcgaggggcgaggacgacgggagataggacggggaaataggagcgaaagaaaacggtaagggcgtagagggaacgnaagagggggaggtagaaattagaggagacggacggaagaggaatagcgaggcggagcgagggacgcgggtagtaagcgcgagcgaacgggcgcgaaagcgaaggaaaattaaagaaagaggagantcggtagcgaatagtaaagcggcggcggggggttaggacgatagtcgntcgcgatataattatcgatatcgaggagcgggaattaggcgacggaggagagaacggagagagaggagtatacgagagcgaaggacgagaaaacgagaataggagatacggggngataggggaaggaaggaagggaggtcgatcgaacgggacgagataggtaaagggggggagagggaa

SEQ ID NO: 31928 - DNA, 517 bp, Artificial Sequence
  chemically treated genomic DNA (Homo sapiens) CpG-island No: 31928
  misc_feature (67)..(67): n is either a, c, g or t
  misc_feature (181)..(181): n is either a, c, g or t
  misc_feature (229)..(229): n is either a, c, g or t
  misc_feature (354)..(354): n is either a, c, g or t
ttccctctccccccctttacctatctcgtcccgttcgatcgacctcccttccttccttcccctatcnccccgtatctcctattctcgttttctcgtccttcgctctcgtatactcctctctctccgttctctcctccgtcgcctaattcccgctcctcgatatcgataattatatcgcgancgactatcgtcctaaccccccgccgccgctttactattcgctaccgantctcctctttctttaattttccttcgctttcgcgcccgttcgctcgcgcttactacccgcgtccctcgctccgcctcgctattcctcttccgtccgtctcctctaatttctacctccccctcttncgttccctctacgcccttaccgttttctttcgctcctatttccccgtcctatctcccgtcgtcctcgcccctcgctctcgtcccttctccgtaatccctatctttctatattttatctcgttttccctttattttctttacctctttttacctctctctcgtc

SEQ ID NO: 31929 - DNA, 621 bp, Artificial Sequence
  chemically treated genomic DNA (Homo sapiens) CpG-island No: 31929
  misc_feature (466)..(466): n is either a, c, g or t
  misc_feature (469)..(469): n is either a, c, g or t
  misc_feature (472)..(472): n is either a, c, g or t
  misc_feature (475)..(475): n is either a, c, g or t
  misc_feature (485)..(485): n is either a, c, g or t
  misc_feature (494)..(494): n is either a, c, g or t
gagttttagcgtttcgaattagggattgtatttttcggtaggcgtcgcggttcgcggttaatgaggggttgaggatttggcggcggcggcgtttcgagagtcggggtgggggggttttgtgcgcggcggcggcgggagaggcggcggcggcggttagtacggaggcggaggtcgagggggttgtgtataggtcgtcgcggagaggcgtgcgaatttcgagtcgagcgtcgaggatcgtgttatttaggtcgggttgttagtcgtaggtttttttttggtagtagcggcggcgcggcgattttcgtttttcggttttttttttttattttatttttcgagttttttttttttcgtagtacgttcggttcggttcggtcgtggttttttttagtgtcggtcgttatggtagaggcgttcggcgcggggaaaatttagttcggggattttatgcggtttagttcggttncgnttnttnttcgcgcggntttagcggntgttcgtattttagttttatttcgggttttcgagtattttttgtgatcgtattgatacgggcgtggggttagaatggaataaattgaaggtaaagtgcgtgtgcgtttgtgtatgtgtgtgtgtgtg

SEQ ID NO: 31930 - DNA, 621 bp, Artificial Sequence
  chemically treated genomic DNA (Homo sapiens) CpG-island No: 31930
  misc_feature (128)..(128): n is either a, c, g or t
  misc_feature (137)..(137): n is either a, c, g or t
  misc_feature (147)..(147): n is either a, c, g or t
  misc_feature (150)..(150): n is either a, c, g or t
  misc_feature (153)..(153): n is either a, c, g or t
  misc_feature (156)..(156): n is either a, c, g or t
cacacacacacacatacacaaacgcacacgcactttaccttcaatttattccattctaaccccacgcccgtatcaatacgatcacaaaaaatactcgaaaacccgaaataaaactaaaatacgaacanccgctaaanccgcgcgaanaanaancgnaaccgaactaaaccgcataaaatccccgaactaaattttccccgcgccgaacgcctctaccataacgaccgacactaaaaaaaaccacgaccgaaccgaaccgaacgtactacgaaaaaaaaaaaactcgaaaaataaaataaaaaaaaaaaaccgaaaaacgaaaatcgccgcgccgccgctactaccaaaaaaaaacctacgactaacaacccgacctaaataacacgatcctcgacgctcgactcgaaattcgcacgcctctccgcgacgacctatacacaaccccctcgacctccgcctccgtactaaccgccgccgccgcctctcccgccgccgccgcgcacaaaacccccccaccccgactctcgaaacgccgccgccgccaaatcctcaacccctcattaaccgcgaaccgcgacgcctaccgaaaaatacaatccctaattcgaaacgctaaaactc

SEQ ID NO: 31931 - DNA, 621 bp, Artificial Sequence
  chemically treated genomic DNA (Homo sapiens) CpG-island No: 31931
  misc_feature (128)..(128): n is either a, c, g or t
  misc_feature (137)..(137): n is either a, c, g or t
  misc_feature (147)..(147): n is either a, c, g or t
  misc_feature (150)..(150): n is either a, c, g or t
  misc_feature (153)..(153): n is either a, c, g or t
  misc_feature (156)..(156): n is either a, c, g or t
tatatatatatatatatataaacgtatacgtattttatttttagtttgttttattttaattttacgttcgtgttagtgcgattataggagatattcggaggttcggagtggggttggggtgcgggtantcgttgggntcgcgcgagnagnagncgnaatcgagttaggtcgtatgaaattttcgggttagatttttttcgcgtcggacgtttttgttatggcggtcggtattgaggagggttacggtcgggtcgggtcgggcgtgttgcgggaagaggaaggttcgggaggtgggatgggaaggggaggtcgagggacgggggtcgtcgcgtcgtcgttgttgttagagaggagtttgcggttggtagttcggtttgggtagtacggttttcggcgttcggttcggaattcgtacgttttttcgcggcgatttgtgtatagttttttcggttttcgttttcgtgttggtcgtcgtcgtcgtttttttcgtcgtcgtcgcgtataaagtttttttatttcgattttcggggcgtcgtcgtcgttaaatttttagttttttattggtcgcgggtcgcggcgtttgtcgggaaatgtagtttttggttcgggacgttggggttt

SEQ ID NO: 31932 - DNA, 621 bp, Artificial Sequence
  chemically treated genomic DNA (Homo sapiens) CpG-island No: 31932
  misc_feature (466)..(466): n is either a, c, g or t
  misc_feature (469)..(469): n is either a, c, g or t
  misc_feature (472)..(472): n is either a, c, g or t
  misc_feature (475)..(475): n is either a, c, g or t
  misc_feature (485)..(485): n is either a, c, g or t
  misc_feature (494)..(494): n is either a, c, g or t
aaaccccaacgtcccgaaccaaaaactacatttcccgacaaacgccgcgacccgcgaccaataaaaaactaaaaatttaacgacgacgacgccccgaaaatcgaaataaaaaaactttatacgcgacgacgacgaaaaaaacgacgacgacgaccaacacgaaaacgaaaaccgaaaaaactatacacaaatcgccgcgaaaaaacgtacgaattccgaaccgaacgccgaaaaccgtactacccaaaccgaactaccaaccgcaaactcctctctaacaacaacgacgacgcgacgacccccgtccctcgacctccccttcccatcccacctcccgaaccttcctcttcccgcaacacgcccgacccgacccgaccgtaaccctcctcaataccgaccgccataacaaaaacgtccgacgcgaaaaaaatctaacccgaaaatttcatacgacctaactcgattncgnctnctnctcgcgcgancccaacgantacccgcaccccaaccccactccgaacctccgaatatctcctataatcgcactaacacgaacgtaaaattaaaataaaacaaactaaaaataaaatacgtatacgtttatatatatatatatatata

SEQ ID NO: 31933 - DNA, 525 bp, Artificial Sequence
  chemically treated genomic DNA (Homo sapiens) CpG-island No: 31933
taggaaatcgcgggtttcgtcgttttcgtttcgggtttgtttttttcgggatttattgaggagtcgtcgtcgtttcgttagttttcgagcgcgagttggaggaaaagttgggcggcgggaagagcggcgggacgagcgtagggagggggcgtaggagacgcggacggagggaagggaggggagatttaaggggcgcggatcgttcgggagggagttaagaggtgaaaagggcgggcggcgagcggagggaagcgtcggttttcgttgggttgcggcgggtaaagcgcgtagttcgggaggttttcggcgttcggggggtcggtttgggaacgtttaaagtttcggttttaagattttcgggggtcgttcgcgggtttttttaatttttcgtttttcgggcgtgggaaaggttttttttttttttcggggaagaaggttttcgtttcgtggggttttttggtggtttaaaattcgggtcggttgtttgtttttcgtcggttttttttttcggggtttttttggggt

SEQ ID NO: 31934 - DNA, 525 bp, Artificial Sequence
  chemically treated genomic DNA (Homo sapiens) CpG-island No: 31934
accccaaaaaaaccccgaaaaaaaaaaccgacgaaaaacaaacaaccgacccgaattttaaaccaccaaaaaaccccacgaaacgaaaaccttcttccccgaaaaaaaaaaaaaacctttcccacgcccgaaaaacgaaaaattaaaaaaacccgcgaacgacccccgaaaatcttaaaaccgaaactttaaacgttcccaaaccgaccccccgaacgccgaaaacctcccgaactacgcgctttacccgccgcaacccaacgaaaaccgacgcttccctccgctcgccgcccgcccttttcacctcttaactccctcccgaacgatccgcgccccttaaatctcccctcccttccctccgtccgcgtctcctacgccccctccctacgctcgtcccgccgctcttcccgccgcccaacttttcctccaactcgcgctcgaaaactaacgaaacgacgacgactcctcaataaatcccgaaaaaaacaaacccgaaacgaaaacgacgaaacccgcgatttccta

SEQ ID NO: 31935 - DNA, 525 bp, Artificial Sequence
  chemically treated genomic DNA (Homo sapiens) CpG-island No: 31935
gttttagaaaaatttcggggggggaaatcggcggggggtaaataatcggttcgggttttgggttattaaaaggttttacggggcgggaattttttttttcggaaggggggggaaattttttttacgttcgaaaggcgaagggttaaagaagttcgcgggcggttttcggggattttggggtcggggttttgggcgtttttaagtcggtttttcgggcgtcggaagtttttcgggttgcgcgttttgttcgtcgtagtttagcgggggtcggcgttttttttcgttcgtcgttcgttttttttattttttggttttttttcgggcgattcgcgttttttgggttttttttttttttttttcgttcgcgttttttgcgttttttttttgcgttcgtttcgtcgtttttttcgtcgtttaattttttttttaattcgcgttcgggagttggcgaggcggcggcggttttttagtgagtttcgggagggataggttcggggcgaaggcggcgaggttcgcggttttttg

SEQ ID NO: 31936 - DNA, 525 bp, Artificial Sequence
  chemically treated genomic DNA (Homo sapiens) CpG-island No: 31936
caaaaaaccgcgaacctcgccgccttcgccccgaacctatccctcccgaaactcactaaaaaaccgccgccgcctcgccaactcccgaacgcgaattaaaaaaaaaattaaacgacgaaaaaaacgacgaaacgaacgcaaaaaaaaaacgcaaaaaacgcgaacgaaaaaaaaaaaaaaaaaacccaaaaaacgcgaatcgcccgaaaaaaaaccaaaaaataaaaaaaacgaacgacgaacgaaaaaaaacgccgacccccgctaaactacgacgaacaaaacgcgcaacccgaaaaacttccgacgcccgaaaaaccgacttaaaaacgcccaaaaccccgaccccaaaatccccgaaaaccgcccgcgaacttctttaacccttcgcctttcgaacgtaaaaaaaatttccccccccttccgaaaaaaaaaattcccgccccgtaaaaccttttaataacccaaaacccgaaccgattatttaccccccgccgatttccccccccgaaatttttctaaaac

SEQ ID NO: 31937 - DNA, 558 bp, Artificial Sequence
  chemically treated genomic DNA (Homo sapiens) CpG-island No: 31937
tgcggggcggcggggcgtggcgtggttgcgtggggtggtggtcggttgggcggcggtggtggcgggtcgtcggggggcgggggggttgtgggttggcgcgggggggggtgggcggttggtgcgggggggggggggcggcgcggtggggtgggggtcgtcgtggcggtgcggggcgggggcgggggggtgtgtgggggggtcgtgttcgggcgtggggcgggggtcggggtggcgttggcgggggcgtcgttttgcgggagcgttcgttcgcgggttcgttttgttcggggtgggggtggcggtgtggttgggcggcgggggggttcgggttttgcggtgttcgttgcggttttggcggggtggggcgtcgtgcggggggtcggcgcgttcgtcgtgttcggggggcgtcggttcggtcgtcgttcggcgggtcgcgcggtcgttcgggtagtttcgcggcgtttttttcgaggtcgggcggttcggggtcggggcgggtcgtcggcgttcggtcgtcggttcgcgcgcgggagtcgttcgcgggcggcggtgcgggcg

SEQ ID NO: 31938 - DNA, 558 bp, Artificial Sequence
  chemically treated genomic DNA (Homo sapiens) CpG-island No: 31938
cgcccgcaccgccgcccgcgaacgactcccgcgcgcgaaccgacgaccgaacgccgacgacccgccccgaccccgaaccgcccgacctcgaaaaaaacgccgcgaaactacccgaacgaccgcgcgacccgccgaacgacgaccgaaccgacgccccccgaacacgacgaacgcgccgaccccccgcacgacgccccaccccgccaaaaccgcaacgaacaccgcaaaacccgaacccccccgccgcccaaccacaccgccacccccaccccgaacaaaacgaacccgcgaacgaacgctcccgcaaaacgacgcccccgccaacgccaccccgacccccgccccacgcccgaacacgacccccccacacacccccccgcccccgccccgcaccgccacgacgacccccaccccaccgcgccgcccccccccccccgcaccaaccgcccacccccccccgcgccaacccacaacccccccgccccccgacgacccgccaccaccgccgcccaaccgaccaccaccccacgcaaccacgccacgccccgccgccccgca

SEQ ID NO: 31939 - DNA, 558 bp, Artificial Sequence
  chemically treated genomic DNA (Homo sapiens) CpG-island No: 31939
cgttcgtatcgtcgttcgcgggcgattttcgcgcgcgggtcggcgatcgggcgtcgacggttcgtttcggtttcgggtcgttcggtttcgagaggggcgtcgcgaaattgttcgaacgatcgcgcggttcgtcgggcggcgatcgagtcggcgtttttcggatacggcgggcgcgtcggtttttcgtacggcgttttatttcgttagagtcgtagcggatatcgtagggttcggattttttcgtcgtttaattatatcgttatttttatttcgagtagggcgggttcgcgggcgggcgttttcgtaaggcggcgttttcgttagcgttatttcgattttcgttttacgttcggatacgatttttttatatattttttcgttttcgtttcgtatcgttacgacgatttttattttatcgcgtcgttttttttttttcgtattagtcgtttattttttttcgcgttaatttataattttttcgtttttcgacgattcgttattatcgtcgtttaatcgattattattttacgtaattacgttacgtttcgtcgtttcgta

SEQ ID NO: 31940 - DNA, 558 bp, Artificial Sequence
  chemically treated genomic DNA (Homo sapiens) CpG-island No: 31940
tacgaaacgacgaaacgtaacgtaattacgtaaaataataatcgattaaacgacgataataacgaatcgtcgaaaaacgaaaaaattataaattaacgcgaaaaaaaataaacgactaatacgaaaaaaaaaaaacgacgcgataaaataaaaatcgtcgtaacgatacgaaacgaaaacgaaaaaatatataaaaaaatcgtatccgaacgtaaaacgaaaatcgaaataacgctaacgaaaacgccgccttacgaaaacgcccgcccgcgaacccgccctactcgaaataaaaataacgatataattaaacgacgaaaaaatccgaaccctacgatatccgctacgactctaacgaaataaaacgccgtacgaaaaaccgacgcgcccgccgtatccgaaaaacgccgactcgatcgccgcccgacgaaccgcgcgatcgttcgaacaatttcgcgacgcccctctcgaaaccgaacgacccgaaaccgaaacgaaccgtcgacgcccgatcgccgacccgcgcgcgaaaatcgcccgcgaacgacgatacgaacg

SEQ ID NO: 31941 - DNA, 698 bp, Artificial Sequence
  chemically treated genomic DNA (Homo sapiens) CpG-island No: 31941
cgcgcgttatttcgagagttagcggcgaggaagttttttcgttattttttcggagttcggaaaatttaaatacgtatttgcgtatttttagttagatacgtatttttacgcgcgttcggttttcgttttttcgagacgagttcgtaatagtcgtggttagatttacgggtgggtgcgggagtcggatgcgttgcgaggagtcgtcgcgttcggattttttttttattattatatatattttttgattttatttttttttgaagtttgggggacggggagattttttaagtttcgatttgttttgcgtcgcgcgcgtgtcgtttcgttttttcggttttgttttggcggtcgatggtttttcgtttttcgtttgcgcgtagtttttttttcgagttttttgcgttttatttttgtttcgtcgagacgattttttggagttagcgagtcgaggcggcgtgcgtttcgagtggggattacggcggtggcggcggcgtcgggagtcgaggagtttgttagttgtcgcggggtcgcggttatttgttgttttcgttttttttcgttttcgtttttcgttttttttttttttagataacgtcgcgttcggaaatttagatttttttttttttttggttttcgacgagtttttttttttatttgttgtgagtttcgttttggtttcgggagattggtagtgatat

SEQ ID NO: 31942 - DNA, 698 bp, Artificial Sequence
  chemically treated genomic DNA (Homo sapiens) CpG-island No: 31942
atatcactaccaatctcccgaaaccaaaacgaaactcacaacaaataaaaaaaaaaactcgtcgaaaaccaaaaaaaaaaaaaaatctaaatttccgaacgcgacgttatctaaaaaaaaaaaaaacgaaaaacgaaaacgaaaaaaaacgaaaacaacaaataaccgcgaccccgcgacaactaacaaactcctcgactcccgacgccgccgccaccgccgtaatccccactcgaaacgcacgccgcctcgactcgctaactccaaaaaatcgtctcgacgaaacaaaaataaaacgcaaaaaactcgaaaaaaaaactacgcgcaaacgaaaaacgaaaaaccatcgaccgccaaaacaaaaccgaaaaaacgaaacgacacgcgcgcgacgcaaaacaaatcgaaacttaaaaaatctccccgtcccccaaacttcaaaaaaaaataaaatcaaaaaatatatataataataaaaaaaaaatccgaacgcgacgactcctcgcaacgcatccgactcccgcacccacccgtaaatctaaccacgactattacgaactcgtctcgaaaaaacgaaaaccgaacgcgcgtaaaaatacgtatctaactaaaaatacgcaaatacgtatttaaattttccgaactccgaaaaaataacgaaaaaacttcctcgccgctaactctcgaaataacgcgcg

SEQ ID NO: 31943 - DNA, 698 bp, Artificial Sequence
  chemically treated genomic DNA (Homo sapiens) CpG-island No: 31943
gtgttattgttagtttttcgggattaaggcggagtttataataggtggggaggggggttcgtcgagggttaaaaagaagaaggaatttaagttttcgagcgcgacgttgtttgaaaaggagggaggcgggaggcgggggcgagggaaggcggaggtagtaaatgatcgcgatttcgcggtaattggtaaatttttcggttttcggcgtcgtcgttatcgtcgtggtttttattcgaagcgtacgtcgtttcggttcgttggttttagggagtcgtttcggcgggataggaatagagcgtagggagttcgggaggaaggttgcgcgtaagcgagggacggagagttatcggtcgttaggatagggtcggagggacgaggcgatacgcgcgcgacgtaggataaatcggagtttgggaaattttttcgttttttaagttttagaggggggtaaaattagaaaatgtgtgtgatggtgggagagagattcgggcgcggcgatttttcgtagcgtattcggttttcgtatttattcgtggatttggttacggttgttgcggattcgtttcgggaaagcggaggtcgagcgcgcgtaggggtgcgtgtttggttgggggtgcgtaggtgcgtgtttgaatttttcgggtttcgagggggtggcgggagagttttttcgtcgttgattttcggggtaacgcgcg

SEQ ID NO: 31944 - DNA, 698 bp, Artificial Sequence
  chemically treated genomic DNA (Homo sapiens) CpG-island No: 31944
cgcgcgttaccccgaaaatcaacgacgaaaaaactctcccgccaccccctcgaaacccgaaaaattcaaacacgcacctacgcacccccaaccaaacacgcacccctacgcgcgctcgacctccgctttcccgaaacgaatccgcaacaaccgtaaccaaatccacgaataaatacgaaaaccgaatacgctacgaaaaatcgccgcgcccgaatctctctcccaccatcacacacattttctaattttacccccctctaaaacttaaaaaacgaaaaaatttcccaaactccgatttatcctacgtcgcgcgcgtatcgcctcgtccctccgaccctatcctaacgaccgataactctccgtccctcgcttacgcgcaaccttcctcccgaactccctacgctctattcctatcccgccgaaacgactccctaaaaccaacgaaccgaaacgacgtacgcttcgaataaaaaccacgacgataacgacgacgccgaaaaccgaaaaatttaccaattaccgcgaaatcgcgatcatttactacctccgccttccctcgcccccgcctcccgcctccctccttttcaaacaacgtcgcgctcgaaaacttaaattccttcttctttttaaccctcgacgaacccccctccccacctattataaactccgccttaatcccgaaaaactaacaataacac

SEQ ID NO: 31945 - DNA, 540 bp, Artificial Sequence
  chemically treated genomic DNA (Homo sapiens) CpG-island No: 31945
ggacgggttcgatatttatgtggttttgtttttttacgggaggtttagatatatttacgattgcgttgattggtcgggttgttgtcgtttttttttattttatacgtcgtcgttttggagacgtttcgattacgatattagaatgtgttgaggggttaattcgaaatagaggtgttcgattatcgttgttcgtcgtatatttttttcgcgtttattatgtttttacgatttattaattcgtcgcgttcggagtttatgacggtacggttcgcgaattgttaatttggggcgtatatcgttgcgcgtatttttttacgttagtatcgcgcgattgttatcggcgtttagcgaagatcggatcgagggggagtagtgcgttaggtgacgttatattgtagtttattcgttaacgtgtatattacgtagattattatagtttattatacgtatttttatttttagtcgttatgcgttattatgcgagattaacgcgattttcgtagattgttttattgtttacgttacgttagtttatattta

SEQ ID NO: 31946 - DNA, 540 bp, Artificial Sequence
  chemically treated genomic DNA (Homo sapiens) CpG-island No: 31946
taaatataaactaacgtaacgtaaacaataaaacaatctacgaaaatcgcgttaatctcgcataataacgcataacgactaaaaataaaaatacgtataataaactataataatctacgtaatatacacgttaacgaataaactacaatataacgtcacctaacgcactactccccctcgatccgatcttcgctaaacgccgataacaatcgcgcgatactaacgtaaaaaaatacgcgcaacgatatacgccccaaattaacaattcgcgaaccgtaccgtcataaactccgaacgcgacgaattaataaatcgtaaaaacataataaacgcgaaaaaaatatacgacgaacaacgataatcgaacacctctatttcgaattaacccctcaacacattctaatatcgtaatcgaaacgtctccaaaacgacgacgtataaaataaaaaaaaacgacaacaacccgaccaatcaacgcaatcgtaaatatatctaaacctcccgtaaaaaaacaaaaccacataaatatcgaacccgtcc

SEQ ID NO: 31947 - DNA, 540 bp, Artificial Sequence
  chemically treated genomic DNA (Homo sapiens) CpG-island No: 31947
tgaatgtagattagcgtggcgtgaatagtaagatagtttacggagatcgcgttggtttcgtatgatagcgtatagcgattggagataagggtgcgtgtagtagattgtagtagtttgcgtagtgtgtacgttagcgggtgagttatagtgtagcgttatttagcgtattgttttttttcggttcggttttcgttaggcgtcgatgataatcgcgcgatgttggcgtggggagatacgcgtagcgatgtgcgttttaagttggtagttcgcgggtcgtgtcgttatgggtttcgagcgcgacgagttgataggtcgtaagggtatgatgaacgcggagggagtgtgcggcgggtagcggtagtcggatatttttgtttcgagttggttttttagtatattttagtgtcgtggtcgaggcgtttttaaggcggcggcgtatagggtgggggggagcgatagtagttcgattaattagcgtagtcgtaagtgtatttgggtttttcgtaaaaaaataaagttatatgggtgtcgagttcgttt

SEQ ID NO: 31948 - DNA, 540 bp, Artificial Sequence
  chemically treated genomic DNA (Homo sapiens) CpG-island No: 31948
aaacgaactcgacacccatataactttatttttttacgaaaaacccaaatacacttacgactacgctaattaatcgaactactatcgctcccccccaccctatacgccgccgccttaaaaacgcctcgaccacgacactaaaatatactaaaaaaccaactcgaaacaaaaatatccgactaccgctacccgccgcacactccctccgcgttcatcatacccttacgacctatcaactcgtcgcgctcgaaacccataacgacacgacccgcgaactaccaacttaaaacgcacatcgctacgcgtatctccccacgccaacatcgcgcgattatcatcgacgcctaacgaaaaccgaaccgaaaaaaaacaatacgctaaataacgctacactataactcacccgctaacgtacacactacgcaaactactacaatctactacacgcacccttatctccaatcgctatacgctatcatacgaaaccaacgcgatctccgtaaactatcttactattcacgccacgctaatctacattca

SEQ ID NO: 31949 - DNA, 677 bp, Artificial Sequence
  chemically treated genomic DNA (Homo sapiens) CpG-island No: 31949
  misc_feature (421)..(421): n is either a, c, g or t
gcgaaattattatcgttcggttagatcgttgcggtagggaacgagatgcggcgtttttgggtttcgtagcggttgtagttttcgggattttcgttgttcgtttcgttttaattttttcgttcggcgttcggcgcgtttagtttcggtcgtagtttttagtttcgggcgttcggtcgagcgttgggattcggttttcgtcgtcggtacgtttttcggtagttattcgttggcgttgtttcggtttgcggtcgtttttcgttttttttttttttcgaattaatagtaaatataattttttatgaaaagaaaataaattttagcgacgtgatttatttttgttgtagtcggcgtttgggaagggcgagtcggggttcgggggttagcgtggtgggcgcgagggagttatatagcgtcgcgtcgnacggatatataatacgttcggtgatatcggggatattaatacgggcgagcggtcgcggttggagtaataaaggagtcgaggatcgagaagttgcggttcgcgaaagggaggtttcggtcggtcgtgttgtggttgtggcggtcgtgaaggtgtgtcgcgtcgggggtttcggggggttttttttgggggggttgggggtttttgggggcgggttgggcgcgtttcgcggggttgatttcgtgggcggggtttaggt

SEQ ID NO: 31950 - DNA, 677 bp, Artificial Sequence
  chemically treated genomic DNA (Homo sapiens) CpG-island No: 31950
  misc_feature (257)..(257): n is either a, c, g or t
acctaaaccccgcccacgaaatcaaccccgcgaaacgcgcccaacccgcccccaaaaacccccaacccccccaaaaaaaaccccccgaaacccccgacgcgacacaccttcacgaccgccacaaccacaacacgaccgaccgaaacctccctttcgcgaaccgcaacttctcgatcctcgactcctttattactccaaccgcgaccgctcgcccgtattaatatccccgatatcaccgaacgtattatatatccgtncgacgcgacgctatataactccctcgcgcccaccacgctaacccccgaaccccgactcgcccttcccaaacgccgactacaacaaaaataaatcacgtcgctaaaatttattttcttttcataaaaaattatatttactattaattcgaaaaaaaaaaaaaacgaaaaacgaccgcaaaccgaaacaacgccaacgaataactaccgaaaaacgtaccgacgacgaaaaccgaatcccaacgctcgaccgaacgcccgaaactaaaaactacgaccgaaactaaacgcgccgaacgccgaacgaaaaaattaaaacgaaacgaacaacgaaaatcccgaaaactacaaccgctacgaaacccaaaaacgccgcatctcgttccctaccgcaacgatctaaccgaacgataataatttcgc

SEQ ID NO: 31951 - DNA, 677 bp, Artificial Sequence
  chemically treated genomic DNA (Homo sapiens) CpG-island No: 31951
  misc_feature (257)..(257): n is either a, c, g or t
atttgagtttcgtttacggggttaatttcgcggggcgcgtttaattcgtttttaggggtttttaatttttttagaaaagatttttcggggttttcggcgcggtatatttttacggtcgttatagttataatacggtcggtcggggtttttttttcgcgggtcgtaatttttcggttttcggtttttttgttgttttagtcgcggtcgttcgttcgtgttggtgttttcggtgttatcgagcgtgttgtgtgttcgtncggcgcggcgttgtgtggttttttcgcgtttattacgttggttttcgggtttcggttcgttttttttaggcgtcggttgtagtagaggtgagttacgtcgttgaagtttgttttttttttataaaaagttgtgtttattgttggttcggggagaggagggggcgggaggcggtcgtaggtcgaggtagcgttagcgagtggttgtcgggggacgtgtcggcggcgggagtcgggttttagcgttcggtcgggcgttcggggttgggagttgcggtcgaggttgggcgcgtcgggcgtcgggcgaagaagttggggcgaggcgggtagcgggggtttcgggggttgtagtcgttacggggtttaggggcgtcgtatttcgttttttgtcgtagcggtttggtcgggcgatggtggtttcgt

SEQ ID NO: 31952 - DNA, 677 bp, Artificial Sequence
  chemically treated genomic DNA (Homo sapiens) CpG-island No: 31952
  misc_feature (421)..(421): n is either a, c, g or t
acgaaaccaccatcgcccgaccaaaccgctacgacaaaaaacgaaatacgacgcccctaaaccccgtaacgactacaacccccgaaacccccgctacccgcctcgccccaacttcttcgcccgacgcccgacgcgcccaacctcgaccgcaactcccaaccccgaacgcccgaccgaacgctaaaacccgactcccgccgccgacacgtcccccgacaaccactcgctaacgctacctcgacctacgaccgcctcccgccccctcctctccccgaaccaacaataaacacaactttttataaaaaaaaaacaaacttcaacgacgtaactcacctctactacaaccgacgcctaaaaaaaacgaaccgaaacccgaaaaccaacgtaataaacgcgaaaaaaccacacaacgccgcgccgnacgaacacacaacacgctcgataacaccgaaaacaccaacacgaacgaacgaccgcgactaaaacaacaaaaaaaccgaaaaccgaaaaattacgacccgcgaaaaaaaaaccccgaccgaccgtattataactataacgaccgtaaaaatataccgcgccgaaaaccccgaaaaatcttttctaaaaaaattaaaaacccctaaaaacgaattaaacgcgccccgcgaaattaaccccgtaaacgaaactcaaat

SEQ ID NO: 31953 - DNA, 531 bp, Artificial Sequence
  chemically treated genomic DNA (Homo sapiens) CpG-island No: 31953
tcgttatttaggcggtcgtataggtttcgtcggtttcgttttcgtcgttatcgttagttgaattaatatatgtaattcgttttttcggttagggtcgttcgagcgttcgatcgttagtagcgttttcgcgagataatgagtttttatcgcgagatttcggtcgtcgttgggcggatgtcgcgagaagtcggaagacgggggcggagaaaaattgcggagcgtgcgttttgtttttcggtggggggcgtggttaagaggtcgagaggcgggtcgtcggtaggcggtgttcgttattcgttggagaggatgaattttcgagatgggcgtgtcgaagggaacgtgatttgtagacgtagagagcgtatttgagttataaatgattttttattaatgagttcgaggattatcgtttcggtgtttgcggtgtattttggagttttgattaatttttagttattgtataaattattttcgtgcggggagattgtagtcggatagagcgtttggtcgtattttaatattatgtattga

SEQ ID NO: 31954 - DNA, 531 bp, Artificial Sequence
  chemically treated genomic DNA (Homo sapiens) CpG-island No: 31954
tcaatacataatattaaaatacgaccaaacgctctatccgactacaatctccccgcacgaaaataatttatacaataactaaaaattaatcaaaactccaaaatacaccgcaaacaccgaaacgataatcctcgaactcattaataaaaaatcatttataactcaaatacgctctctacgtctacaaatcacgttcccttcgacacgcccatctcgaaaattcatcctctccaacgaataacgaacaccgcctaccgacgacccgcctctcgacctcttaaccacgccccccaccgaaaaacaaaacgcacgctccgcaatttttctccgcccccgtcttccgacttctcgcgacatccgcccaacgacgaccgaaatctcgcgataaaaactcattatctcgcgaaaacgctactaacgatcgaacgctcgaacgaccctaaccgaaaaaacgaattacatatattaattcaactaacgataacgacgaaaacgaaaccgacgaaacctatacgaccgcctaaataacga

SEQ ID NO: 31955 - DNA, 531 bp, Artificial Sequence
  chemically treated genomic DNA (Homo sapiens) CpG-island No: 31955
ttagtgtatggtgttaaaatgcgattaaacgttttattcggttgtaattttttcgtacgggagtgatttatgtagtagttggaggttagttaggattttaggatgtatcgtagatatcgaggcgatgattttcggatttattaatagggagttatttgtgatttaggtgcgttttttgcgtttgtaagttacgtttttttcggtacgtttatttcgaggatttattttttttaacgggtgacgagtatcgtttgtcggcggttcgtttttcggttttttggttacgttttttatcggagggtaaggcgtacgtttcgtaattttttttcgttttcgtttttcggtttttcgcgatattcgtttagcggcggtcggaatttcgcgataaaggtttattgtttcgcgggagcgttgttggcggtcgggcgttcgggcggttttggtcggggagacgagttgtatgtgttggtttagttggcgatagcggcgggagcggagtcggcggggtttgtgcgatcgtttgggtaacga

SEQ ID NO: 31956 - DNA, 531 bp, Artificial Sequence
  chemically treated genomic DNA (Homo sapiens) CpG-island No: 31956
tcgttacccaaacgatcgcacaaaccccgccgactccgctcccgccgctatcgccaactaaaccaacacatacaactcgtctccccgaccaaaaccgcccgaacgcccgaccgccaacaacgctcccgcgaaacaataaacctttatcgcgaaattccgaccgccgctaaacgaatatcgcgaaaaaccgaaaaacgaaaacgaaaaaaaattacgaaacgtacgccttaccctccgataaaaaacgtaaccaaaaaaccgaaaaacgaaccgccgacaaacgatactcgtcacccgttaaaaaaaataaatcctcgaaataaacgtaccgaaaaaaacgtaacttacaaacgcaaaaaacgcacctaaatcacaaataactccctattaataaatccgaaaatcatcgcctcgatatctacgatacatcctaaaatcctaactaacctccaactactacataaatcactcccgtacgaaaaaattacaaccgaataaaacgtttaatcgcattttaacaccatacactaa

SEQ ID NO: 31957 - DNA, 545 bp, Artificial Sequence
  chemically treated genomic DNA (Homo sapiens) CpG-island No: 31957
  misc_feature (78)..(78): n is either a, c, g or t
  misc_feature (269)..(269): n is either a, c, g or t
  misc_feature (311)..(311): n is either a, c, g or t
  misc_feature (346)..(346): n is either a, c, g or t
  misc_feature (394)..(394): n is either a, c, g or t
  misc_feature (400)..(400): n is either a, c, g or t
  misc_feature (480)..(480): n is either a, c, g or t
  misc_feature (519)..(519): n is either a, c, g or t
gggcgtcgtttcggttttttttttcgtttttcgcgcgcgcgcggggcgttcgcgttttcggcgcgttcgttcgtcgtngtttttgtttttttttgtcgcgttcggcgttgtttttttcgttcggttttttcggcgtttcgcgtttttcgcgtcgtgcgtttttttgttttttttgtttcgttttttttttttttttcgtttttttcgttcgcgtttcgttgttcggcggtggtttcgttgggcgtgtgcgcgggttcgcgtttcgtttntcgttcggtttcggtcgttgtcgttagcggttcgtttgtgtncgcgttttttttttttttcgtcgcgttcgcgtcgngtttttttgtgtgttttcggaattcgcgtcgttttcgcggtgtttcgncgtcgntgttttcgtcgggtgcggcgtggtttttttttttcgtttcgtttcgcgttttcgtcgcgtcgcgcgcggtattcgcgcgntcgcgttttcgggttcgcgcggttgtgttgcgtatgttntcgtatatttttcgtcggtagtatgt

SEQ ID NO: 31958 - DNA, 545 bp, Artificial Sequence
  chemically treated genomic DNA (Homo sapiens) CpG-island No: 31958
  misc_feature (27)..(27): n is either a, c, g or t
  misc_feature (66)..(66): n is either a, c, g or t
  misc_feature (146)..(146): n is either a, c, g or t
  misc_feature (152)..(152): n is either a, c, g or t
  misc_feature (200)..(200): n is either a, c, g or t
  misc_feature (235)..(235): n is either a, c, g or t
  misc_feature (277)..(277): n is either a, c, g or t
  misc_feature (468)..(468): n is either a, c, g or t
acatactaccgacgaaaaatatacganaacatacgcaacacaaccgcgcgaacccgaaaacgcgancgcgcgaataccgcgcgcgacgcgacgaaaacgcgaaacgaaacgaaaaaaaaaaaccacgccgcacccgacgaaaacancgacgncgaaacaccgcgaaaacgacgcgaattccgaaaacacacaaaaaaacncgacgcgaacgcgacgaaaaaaaaaaaaaacgcgnacacaaacgaaccgctaacgacaacgaccgaaaccgaacganaaacgaaacgcgaacccgcgcacacgcccaacgaaaccaccgccgaacaacgaaacgcgaacgaaaaaaacgaaaaaaaaaaaaaaaacgaaacaaaaaaaacaaaaaaacgcacgacgcgaaaaacgcgaaacgccgaaaaaaccgaacgaaaaaaacaacgccgaacgcgacaaaaaaaaacaaaaacnacgacgaacgaacgcgccgaaaacgcgaacgccccgcgcgcgcgcgaaaaacgaaaaaaaaaaccgaaacgacgccc

SEQ ID NO: 31959 - DNA, 545 bp, Artificial Sequence
  chemically treated genomic DNA (Homo sapiens) CpG-island No: 31959
  misc_feature (27)..(27): n is either a, c, g or t
  misc_feature (66)..(66): n is either a, c, g or t
  misc_feature (146)..(146): n is either a, c, g or t
  misc_feature (152)..(152): n is either a, c, g or t
  misc_feature (200)..(200): n is either a, c, g or t
  misc_feature (235)..(235): n is either a, c, g or t
  misc_feature (277)..(277): n is either a, c, g or t
  misc_feature (468)..(468): n is either a, c, g or t
atatattgtcgacggagaatgtgcgangatatacgtaatatagtcgcgcgaattcgggggcgcggncgcgcgggtatcgcgcgcggcgcggcgggagcgcggaacgaggcggggaaggagggttacgtcgtattcggcggaggtancggcgncggagtatcgcggggacggcgcgggtttcgggagtatataaagagatncgacgcgagcgcggcgggggggagaggagacgcgnatatagacgggtcgttggcggtagcggtcggaatcgggcggngagcggggcgcgggttcgcgtatacgtttagcgaggttatcgtcggataacggggcgcgggcgggaaaggcggaagggagaggagaggcggggtagagagggtagagagacgtacggcgcggggagcgcggagcgtcgggaaaatcgggcggagggggtaacgtcgaacgcggtaggggaaaatagagatnacggcgggcgggcgcgtcgggggcgcgggcgtttcgcgcgcgcgcgggaggcggagggaggagtcggggcggcgttt

SEQ ID NO: 31960 - DNA, 545 bp, Artificial Sequence
  chemically treated genomic DNA (Homo sapiens) CpG-island No: 31960
  misc_feature (78)..(78): n is either a, c, g or t
  misc_feature (269)..(269): n is either a, c, g or t
  misc_feature (311)..(311): n is either a, c, g or t
  misc_feature (346)..(346): n is either a, c, g or t
  misc_feature (394)..(394): n is either a, c, g or t
  misc_feature (400)..(400): n is either a, c, g or t
  misc_feature (480)..(480): n is either a, c, g or t
  misc_feature (519)..(519): n is either a, c, g or t
aaacgccgccccgactcctccctccgcctcccgcgcgcgcgcgaaacgcccgcgcccccgacgcgcccgcccgccgtnatctctattttcccctaccgcgttcgacgttaccccctccgcccgattttcccgacgctccgcgctccccgcgccgtacgtctctctaccctctctaccccgcctctcctctcccttccgcctttcccgcccgcgccccgttatccgacgataacctcgctaaacgtatacgcgaacccgcgccccgctcnccgcccgattccgaccgctaccgccaacgacccgtctatatncgcgtctcctctcccccccgccgcgctcgcgtcgnatctctttatatactcccgaaacccgcgccgtccccgcgatactccgncgccgntacctccgccgaatacgacgtaaccctccttccccgcctcgttccgcgctcccgccgcgccgcgcgcgatacccgcgcgnccgcgcccccgaattcgcgcgactatattacgtatatcntcgcacattctccgtcgacaatatat

SEQ ID NO: 31961 - DNA, 507 bp, Artificial Sequence
  chemically treated genomic DNA (Homo sapiens) CpG-island No: 31961
tcgtaggcgatgttttcggcgtcggcgaagaggcggatgaggtagtttacggagtagacgtagtagtatatggagaggaagatgatggggcgttcggggtagcggaagcgggtcgggtcgatgaggaaggtgagtacggtgaaggcgttggagaagaagtatagtatcgtttagatggttagttagattattgcgaagcgtttgttttcgcggttttagtatacgtttacgtcgggcgtgtagagcggcgcgtacgacgcgtttttttttacgtggtggaatttgttcgggttgtcgtagtcgtcgcgttcggggttttcgttttttagcgggtgtttttgcgcgttgtggggtcgttgcggtcggaatagcggcgggaataggttcgagtttcgggtgggttcgttcgagtcgttgttgggcgtttttatgtataggtagttggggtcgtttttgttggggagttttcggtagtttagggagtcgggttatttgaagttgaattgt

SEQ ID NO: 31962 - DNA, 507 bp, Artificial Sequence
  chemically treated genomic DNA (Homo sapiens) CpG-island No: 31962
acaattcaacttcaaataacccgactccctaaactaccgaaaactccccaacaaaaacgaccccaactacctatacataaaaacgcccaacaacgactcgaacgaacccacccgaaactcgaacctattcccgccgctattccgaccgcaacgaccccacaacgcgcaaaaacacccgctaaaaaacgaaaaccccgaacgcgacgactacgacaacccgaacaaattccaccacgtaaaaaaaaacgcgtcgtacgcgccgctctacacgcccgacgtaaacgtatactaaaaccgcgaaaacaaacgcttcgcaataatctaactaaccatctaaacgatactatacttcttctccaacgccttcaccgtactcaccttcctcatcgacccgacccgcttccgctaccccgaacgccccatcatcttcctctccatatactactacgtctactccgtaaactacctcatccgcctcttcgccgacgccgaaaacatcgcctacga

SEQ ID NO: 31963 - DNA, 507 bp, Artificial Sequence
  chemically treated genomic DNA (Homo sapiens) CpG-island No: 31963
gtagtttaattttaagtggttcgattttttggattgtcggaaattttttaataagaacgattttaattatttgtgtatggaggcgtttaataacggttcggacgagtttattcggggttcgggtttgttttcgtcgttgtttcggtcgtagcggttttatagcgcgtaggagtattcgttgaaggacgggggtttcgggcgcggcggttgcgataattcgggtaagttttattacgtggagaagagcgcgtcgtgcgcgtcgttttgtacgttcggcgtggacgtgtattggagtcgcgaggataagcgtttcgtagtggtttggttggttatttgggcggtgttgtgttttttttttagcgtttttatcgtgtttattttttttatcgattcggttcgttttcgttatttcgagcgttttattatttttttttttatgtgttattgcgtttatttcgtgggttattttattcgttttttcgtcggcgtcgagagtatcgtttgcga

SEQ ID NO: 31964 - DNA, 507 bp, Artificial Sequence
  chemically treated genomic DNA (Homo sapiens) CpG-island No: 31964
tcgcaaacgatactctcgacgccgacgaaaaaacgaataaaataacccacgaaataaacgcaataacacataaaaaaaaaaataataaaacgctcgaaataacgaaaacgaaccgaatcgataaaaaaaataaacacgataaaaacgctaaaaaaaaaacacaacaccgcccaaataaccaaccaaaccactacgaaacgcttatcctcgcgactccaatacacgtccacgccgaacgtacaaaacgacgcgcacgacgcgctcttctccacgtaataaaacttacccgaattatcgcaaccgccgcgcccgaaacccccgtccttcaacgaatactcctacgcgctataaaaccgctacgaccgaaacaacgacgaaaacaaacccgaaccccgaataaactcgtccgaaccgttattaaacgcctccatacacaaataattaaaatcgttcttattaaaaaatttccgacaatccaaaaaatcgaaccacttaaaattaaactac

SEQ ID NO: 31965 - DNA, 836 bp, Artificial Sequence
  chemically treated genomic DNA (Homo sapiens) CpG-island No: 31965
agtcgggtttgttcgtatatgattcggtaggcggggatgggggtagagatttgttcggtgtatatcggcgcgtatagcgagtataggaagaagcggaggtggtcgtggtagtcgtattttattagcggcgcgaattcgtgtaattggatggttgtttcgcgttggttttcgtggtttattaggttgggtatacgagttatgttgtagtcgatgtttttgtatatcgggatttcgatgggttggtatttgtcgtcgttcgggcgttttatgtttatggagttgatggcggcgtacgagtttattatttgtaggattagttataggcgggggttcgggcgttgtatgttggcgttggacgtgttttcgcggggagtttcgcgttttttagcgtcgtcgttttcgggtacgggttgttgttggtttcggttttttatttttgttcgggttttcgtttatgttcgttcggtttggttcgagcgttgcgtatagcgttttcggttcggtttttcgcgttcggcgttcgtcgagttgggggtcgcggcggagagtagtaaagtttgtaaataatatcgggaagcgagggaagttttcggagttttcggcgtagcggttcggcgcgagttttaatttacggtcgcggtaaatttcggtttttttttggagcgtttaggtggcgcgtttggagcgggttggcggcgcgggtatatcgaggtcggtttagttcgcggcgtttttatagttcgggcggtttttttttttttgcgtcggtttcggtcgggattagtcggtagttgtttcgaggtttgcgtttcgggatgagaagattcgtaaaaagg

SEQ ID NO: 31966 - DNA, 836 bp, Artificial Sequence
  chemically treated genomic DNA (Homo sapiens) CpG-island No: 31966
cctttttacgaatcttctcatcccgaaacgcaaacctcgaaacaactaccgactaatcccgaccgaaaccgacgcaaaaaaaaaaaaaccgcccgaactataaaaacgccgcgaactaaaccgacctcgatatacccgcgccgccaacccgctccaaacgcgccacctaaacgctccaaaaaaaaaccgaaatttaccgcgaccgtaaattaaaactcgcgccgaaccgctacgccgaaaactccgaaaacttccctcgcttcccgatattatttacaaactttactactctccgccgcgacccccaactcgacgaacgccgaacgcgaaaaaccgaaccgaaaacgctatacgcaacgctcgaaccaaaccgaacgaacataaacgaaaacccgaacaaaaataaaaaaccgaaaccaacaacaacccgtacccgaaaacgacgacgctaaaaaacgcgaaactccccgcgaaaacacgtccaacgccaacatacaacgcccgaacccccgcctataactaatcctacaaataataaactcgtacgccgccatcaactccataaacataaaacgcccgaacgacgacaaataccaacccatcgaaatcccgatatacaaaaacatcgactacaacataactcgtatacccaacctaataaaccacgaaaaccaacgcgaaacaaccatccaattacacgaattcgcgccgctaataaaatacgactaccacgaccacctccgcttcttcctatactcgctatacgcgccgatatacaccgaacaaatctctacccccatccccgcctaccgaatcatatacgaacaaacccgact

SEQ ID NO: 31967 - DNA, 836 bp, Artificial Sequence
  chemically treated genomic DNA (Homo sapiens) CpG-island No: 31967
tttttttgcgagtttttttatttcgggacgtaaatttcgaaatagttgtcggttggtttcggtcgaggtcggcgtagggagggaggagtcgttcgggttgtgggggcgtcgcgagttgggtcggtttcggtgtgttcgcgtcgttagttcgttttagacgcgttatttgggcgttttaagaagaggtcgaagtttgtcgcggtcgtgagttggagttcgcgtcgggtcgttgcgtcgggagtttcgggggtttttttcgtttttcggtattgtttgtaaattttgttgtttttcgtcgcggtttttaattcggcggacgtcgggcgcggagagtcgagtcgggggcgttgtgcgtagcgttcgggttaggtcgggcgggtatgggcgggggttcgagtaggggtggagagtcggggttagtagtagttcgtgttcgggagcggcggcgttgaggggcgcggagtttttcgcgaggatacgtttaacgttagtatgtagcgttcgggttttcgtttgtggttggttttgtaggtgatgggttcgtgcgtcgttattagttttatggatatggagcgttcgggcgacggtaaatgttagtttatcgagatttcgatgtgtaaggatatcggttataatatgattcgtatgtttaatttgatgggttacgagaattagcgcgaggtagttatttagttgtacgagttcgcgtcgttggtggagtacggttgttacggttattttcgtttttttttgtgttcgttgtacgcgtcgatgtgtatcgagtaggtttttatttttattttcgtttgtcgggttatgtgcgagtaggttcggtt

SEQ ID NO: 31968 - DNA, 836 bp, Artificial Sequence
  chemically treated genomic DNA (Homo sapiens) CpG-island No: 31968
aaccgaacctactcgcacataacccgacaaacgaaaataaaaataaaaacctactcgatacacatcgacgcgtacaacgaacacaaaaaaaaacgaaaataaccgtaacaaccgtactccaccaacgacgcgaactcgtacaactaaataactacctcgcgctaattctcgtaacccatcaaattaaacatacgaatcatattataaccgatatccttacacatcgaaatctcgataaactaacatttaccgtcgcccgaacgctccatatccataaaactaataacgacgcacgaacccatcacctacaaaaccaaccacaaacgaaaacccgaacgctacatactaacgttaaacgtatcctcgcgaaaaactccgcgcccctcaacgccgccgctcccgaacacgaactactactaaccccgactctccacccctactcgaacccccgcccatacccgcccgacctaacccgaacgctacgcacaacgcccccgactcgactctccgcgcccgacgtccgccgaattaaaaaccgcgacgaaaaacaacaaaatttacaaacaataccgaaaaacgaaaaaaacccccgaaactcccgacgcaacgacccgacgcgaactccaactcacgaccgcgacaaacttcgacctcttcttaaaacgcccaaataacgcgtctaaaacgaactaacgacgcgaacacaccgaaaccgacccaactcgcgacgcccccacaacccgaacgactcctccctccctacgccgacctcgaccgaaaccaaccgacaactatttcgaaatttacgtcccgaaataaaaaaactcgcaaaaaaa

SEQ ID NO: 31969 - DNA, 560 bp, Artificial Sequence
  chemically treated genomic DNA (Homo sapiens) CpG-island No: 31969
  misc_feature (273)..(273): n is either a, c, g or t
  misc_feature (347)..(347): n is either a, c, g or t
  misc_feature (463)..(463): n is either a, c, g or t
cgggacgcgcggtagggattttgtaaattttgtaaaagtttcgagtagatcgtagaggttcgcggtcgcgggtaggtttttttagatttttcgtagattttagtagattcggcgtgtattttttattcgcggagtatttcggtgtgtagcgatttttcgagagttggcgtagggttatttggttgtagagaacgtgtgtatttttagttcgggaaattcgttttagtcgagtagtcgcgtattttgggaagtttggcgagttacggcgtcggnggcggttaaggggaggcgggatgagtttgcgagtcggttgagcgcgtcgaggagtcggtcggggtatcgtcggngatatggtaggattcgcgggaaggacgcgcgagcggagggtggggcgattattaggataggtggttgtagttaaacgcgtagcggttagggcgcgcgtagtttgcgcggttttttngaggtcggagtgtttttcgaagttgtatggggcggcgtcggtttttatttttgattagagttggggcgatcggttttttgtcgtttttagtggggcg

SEQ ID NO: 31970 - DNA, 560 bp, Artificial Sequence
  chemically treated genomic DNA (Homo sapiens) CpG-island No: 31970
  misc_feature (98)..(98): n is either a, c, g or t
  misc_feature (214)..(214): n is either a, c, g or t
  misc_feature (288)..(288): n is either a, c, g or t
cgccccactaaaaacgacaaaaaaccgatcgccccaactctaatcaaaaataaaaaccgacgccgccccatacaacttcgaaaaacactccgacctcnaaaaaaccgcgcaaactacgcgcgccctaaccgctacgcgtttaactacaaccacctatcctaataatcgccccaccctccgctcgcgcgtccttcccgcgaatcctaccatatcnccgacgataccccgaccgactcctcgacgcgctcaaccgactcgcaaactcatcccgcctccccttaaccgccnccgacgccgtaactcgccaaacttcccaaaatacgcgactactcgactaaaacgaatttcccgaactaaaaatacacacgttctctacaaccaaataaccctacgccaactctcgaaaaatcgctacacaccgaaatactccgcgaataaaaaatacacgccgaatctactaaaatctacgaaaaatctaaaaaaacctacccgcgaccgcgaacctctacgatctactcgaaacttttacaaaatttacaaaatccctaccgcgcgtcccg

SEQ ID NO: 31971 - DNA, 560 bp, Artificial Sequence
  chemically treated genomic DNA (Homo sapiens) CpG-island No: 31971
  misc_feature (98)..(98): n is either a, c, g or t
  misc_feature (214)..(214): n is either a, c, g or t
  misc_feature (288)..(288): n is either a, c, g or t
cgttttattaagagcggtagaaaatcgatcgttttagttttggttagaaatgaaagtcggcgtcgttttatgtaatttcggggaatatttcggttttngggaggtcgcgtaggttgcgcgcgttttggtcgttgcgcgtttgattgtagttatttgttttggtgatcgttttatttttcgttcgcgcgtttttttcgcgagttttattatgttntcggcggtgtttcggtcggtttttcggcgcgtttagtcggttcgtagatttatttcgtttttttttggtcgttntcggcgtcgtggttcgttaggttttttaggatgcgcggttattcggttggggcgggtttttcggattgaaggtgtatacgttttttgtagttaagtggttttgcgttaattttcgggagatcgttgtatatcgggatatttcgcgggtggggaatatacgtcggatttattgagatttacgggggatttgagggagtttattcgcggtcgcgagtttttgcggtttattcgggatttttgtagagtttgtaaagtttttgtcgcgcgtttcg

SEQ ID NO: 31972 - DNA, 560 bp, Artificial Sequence
  chemically treated genomic DNA (Homo sapiens) CpG-island No: 31972
  misc_feature (273)..(273): n is either a, c, g or t
  misc_feature (347)..(347): n is either a, c, g or t
  misc_feature (463)..(463): n is either a, c, g or t
cgaaacgcgcgacaaaaactttacaaactctacaaaaatcccgaataaaccgcaaaaactcgcgaccgcgaataaactccctcaaatcccccgtaaatctcaataaatccgacgtatattccccacccgcgaaatatcccgatatacaacgatctcccgaaaattaacgcaaaaccacttaactacaaaaaacgtatacaccttcaatccgaaaaacccgccccaaccgaataaccgcgcatcctaaaaaacctaacgaaccacgacgccganaacgaccaaaaaaaaacgaaataaatctacgaaccgactaaacgcgccgaaaaaccgaccgaaacaccgccganaacataataaaactcgcgaaaaaaacgcgcgaacgaaaaataaaacgatcaccaaaacaaataactacaatcaaacgcgcaacgaccaaaacgcgcgcaacctacgcgacctcccnaaaaccgaaatattccccgaaattacataaaacgacgccgactttcatttctaaccaaaactaaaacgatcgattttctaccgctcttaataaaacg

SEQ ID NO: 31973 - DNA, 537 bp, Artificial Sequence
  chemically treated genomic DNA (Homo sapiens) CpG-island No: 31973
tcgcggtggttataaagggggttaagagtgtcggatttagtcgcgcggagtttattattgcggttcgagggggattcgacgggggttcgacggtgtggcgtggcgtaaggagcgcgtttgttttttttcgtcgtcgggaacgggttgtattaatggttaggtgaggaggcggcggtggtcgttcgggaggagggggtggtgtcgatttcgtgtgttaggagtgcgtttcggggacgttgtttttttcgcggtcgagttggttgtcgtcggttgcgttgcggagggttgggggcggagaggaggtagtggttgttcgggtcgaggaggggcgcgttgattgtttatcgcgagttaggaggggtcggcgggtttacggagggagatagggtgggcgggggtaaaggttaggcgttagggcggcggcgttagcgtagagcggcggtttggaggaaagatgagacggtgagtgggtttcggggatatagagtttttttgtttttttataggttgtagggataaaagttcgggttggggtcg

SEQ ID NO: 31974 - DNA, 537 bp, Artificial Sequence
  chemically treated genomic DNA (Homo sapiens) CpG-island No: 31974
cgaccccaacccgaacttttatccctacaacctataaaaaaacaaaaaaactctatatccccgaaacccactcaccgtctcatctttcctccaaaccgccgctctacgctaacgccgccgccctaacgcctaacctttacccccgcccaccctatctccctccgtaaacccgccgacccctcctaactcgcgataaacaatcaacgcgcccctcctcgacccgaacaaccactacctcctctccgcccccaaccctccgcaacgcaaccgacgacaaccaactcgaccgcgaaaaaaacaacgtccccgaaacgcactcctaacacacgaaatcgacaccaccccctcctcccgaacgaccaccgccgcctcctcacctaaccattaatacaacccgttcccgacgacgaaaaaaaacaaacgcgctccttacgccacgccacaccgtcgaacccccgtcgaatccccctcgaaccgcaataataaactccgcgcgactaaatccgacactcttaaccccctttataaccaccgcga

SEQ ID NO: 31975 - DNA, 537 bp, Artificial Sequence
  chemically treated genomic DNA (Homo sapiens) CpG-island No: 31975
cgattttagttcgggtttttgtttttatagtttgtaaagaagtaaagaaattttgtgttttcggagtttatttatcgttttattttttttttaaatcgtcgttttacgttggcgtcgtcgttttagcgtttagtttttgttttcgtttattttgttttttttcgtgagttcgtcggttttttttgattcgcggtgagtagttagcgcgttttttttcggttcgggtagttattgtttttttttcgtttttaatttttcgtagcgtaatcggcggtaattaattcggtcgcgggggaggtagcgttttcgggacgtatttttggtatacggagtcggtattatttttttttttcgggcgattatcgtcgtttttttatttggttattggtgtagttcgttttcggcggcgagagaaggtaggcgcgttttttgcgttacgttatatcgtcgggttttcgtcgggtttttttcgggtcgtaatggtgggtttcgcgcggttgggttcggtatttttgattttttttgtaattatcgcgg

SEQ ID NO: 31976 - DNA, 537 bp, Artificial Sequence
  chemically treated genomic DNA (Homo sapiens) CpG-island No: 31976
ccgcgataattacaaaaaaaatcaaaaataccgaacccaaccgcgcgaaacccaccattacgacccgaaaaaaacccgacgaaaacccgacgatataacgtaacgcaaaaaacgcgcctaccttctctcgccgccgaaaacgaactacaccaataaccaaataaaaaaacgacgataatcgcccgaaaaaaaaaaataataccgactccgtataccaaaaatacgtcccgaaaacgctacctcccccgcgaccgaattaattaccgccgattacgctacgaaaaattaaaaacgaaaaaaaaacaataactacccgaaccgaaaaaaaacgcgctaactactcaccgcgaatcaaaaaaaaccgacgaactcacgaaaaaaaacaaaataaacgaaaacaaaaactaaacgctaaaacgacgacgccaacgtaaaacgacgatttaaaaaaaaaataaaacgataaataaactccgaaaacacaaaatttctttacttctttacaaactataaaaacaaaaacccgaactaaaatcg

SEQ ID NO: 31977 - DNA, 992 bp, Artificial Sequence
  chemically treated genomic DNA (Homo sapiens) CpG-island No: 31977
tttcgattttcgttttcgggatcggttgcgatttttcgagcgtttgcgggagtcgacgtgagttatggcgtcgcgggttggcgacgaagaagacgcgtttgagtcgaagtttttaaggtcggtcgcgggcgggttttaagggtggttttagcggggtcggggtttggcgacgtttagtattcgttatcgtttcgggaaaatgagcgatttttatttatttttagcgttggggatttcggtttttttcgtcgattttagttttcgtagcggtgtttgttaagggttcgtttcgtgttcggaggttttacgtttgcgtattcggttttaaatttttgggaattggtcgtcgttcgtcgcgagtggcgtttggggcgttttttcgcgtttttttattttttagtttcgcgtttttcgcggtttcgtcgttttaagggggttttcggggttgtttcgtttttatttcgatcgttttgcgggtcggatagttcgtttcgcgttttttcgagaggaagcggcggcgaggaggttttcggtcggggcgttgcgcgggaggttggtcggttgggaagcgcggcgtcgttgtttttcgttttgacgttttaggtttcgtttcgggcgcgtttatttttcgtagaggtaagtaggggcgtcggttttcgagtttcgtagttttttacgtttgtgtttgtcgaagttgcgtttatttttaaggttgttttttcggcgtacgttcgtagtatttacgttttcggtgttttgggaagaaggcgattttcgcgcgcgtcgttttttttttcggttggttttgttttttttatacgattgcgagttttagattgaggcgttttggttttttcgacgcgtttatttagtgatttagaggtcgtaaattcgtgttcgtaggggttagaaagattttggtagtgagcgcgggtatggattttaggtttattcggaaggaagttaggattttgttttagttgatacgtgta

SEQ ID NO: 31978 - DNA, 992 bp, Artificial Sequence
  chemically treated genomic DNA (Homo sapiens) CpG-island No: 31978
tacacgtatcaactaaaacaaaatcctaacttccttccgaataaacctaaaatccatacccgcgctcactaccaaaatctttctaacccctacgaacacgaatttacgacctctaaatcactaaataaacgcgtcgaaaaaaccaaaacgcctcaatctaaaactcgcaatcgtataaaaaaaacaaaaccaaccgaaaaaaaaaacgacgcgcgcgaaaatcgccttcttcccaaaacaccgaaaacgtaaatactacgaacgtacgccgaaaaaacaaccttaaaaataaacgcaacttcgacaaacacaaacgtaaaaaactacgaaactcgaaaaccgacgcccctacttacctctacgaaaaataaacgcgcccgaaacgaaacctaaaacgtcaaaacgaaaaacaacgacgccgcgcttcccaaccgaccaacctcccgcgcaacgccccgaccgaaaacctcctcgccgccgcttcctctcgaaaaaacgcgaaacgaactatccgacccgcaaaacgatcgaaataaaaacgaaacaaccccgaaaacccccttaaaacgacgaaaccgcgaaaaacgcgaaactaaaaaataaaaaaacgcgaaaaaacgccccaaacgccactcgcgacgaacgacgaccaattcccaaaaatttaaaaccgaatacgcaaacgtaaaacctccgaacacgaaacgaacccttaacaaacaccgctacgaaaactaaaatcgacgaaaaaaaccgaaatccccaacgctaaaaataaataaaaatcgctcattttcccgaaacgataacgaatactaaacgtcgccaaaccccgaccccgctaaaaccacccttaaaacccgcccgcgaccgaccttaaaaacttcgactcaaacgcgtcttcttcgtcgccaacccgcgacgccataactcacgtcgactcccgcaaacgctcgaaaaatcgcaaccgatcccgaaaacgaaaatcgaaa

SEQ ID NO: 31979 - DNA, 992 bp, Artificial Sequence
  chemically treated genomic DNA (Homo sapiens) CpG-island No: 31979
tgtacgtattagttggagtagaattttggttttttttcggatgggtttggggtttatgttcgcgtttattgttaagatttttttggtttttacggatacgagtttgcgatttttgagttattgggtgggcgcgtcggaaagattagggcgttttagtttggagttcgtagtcgtatggagagggtaggattagtcggggaggagggcggcgcgcgcgagggtcgttttttttttagggtatcgggggcgtgggtgttgcgggcgtgcgtcgagagggtagttttggaagtgggcgtagtttcggtagatataggcgtgaggggttgcggagttcgagggtcggcgtttttgtttgtttttgcgggaggtgggcgcgttcgggacggaatttggggcgttagaacgaaaggtagcggcgtcgcgttttttagtcggttagtttttcgcgtagcgtttcggtcggaagttttttcgtcgtcgttttttttcgagaaggcgcggggcgggttgttcggttcgtagggcggtcgaggtgggaacggagtagtttcgggggtttttttgaggcggcgaggtcgcgaagggcgcggggttggagggtaggagagcgcgggaaagcgttttagacgttattcgcggcggacggcggttagtttttaggggtttggagtcgggtgcgtaggcgtggggttttcgggtacggggcgggtttttaataggtatcgttgcggggattggagtcggcggagaaaatcggggtttttagcgttgggggtgggtgagggtcgtttattttttcgggacggtgacgggtattgggcgtcgttaggtttcggtttcgttagagttatttttggagttcgttcgcggtcggttttgggggtttcggtttaagcgcgtttttttcgtcgttagttcgcggcgttatggtttacgtcggttttcgtaagcgttcgaggagtcgtagtcggtttcggggacgggggtcggaa

SEQ ID NO: 31980 - DNA, 992 bp, Artificial Sequence
  chemically treated genomic DNA (Homo sapiens) CpG-island No: 31980
ttccgacccccgtccccgaaaccgactacgactcctcgaacgcttacgaaaaccgacgtaaaccataacgccgcgaactaacgacgaaaaaaacgcgcttaaaccgaaacccccaaaaccgaccgcgaacgaactccaaaaataactctaacgaaaccgaaacctaacgacgcccaatacccgtcaccgtcccgaaaaaataaacgaccctcacccacccccaacgctaaaaaccccgattttctccgccgactccaatccccgcaacgatacctattaaaaacccgccccgtacccgaaaaccccacgcctacgcacccgactccaaacccctaaaaactaaccgccgtccgccgcgaataacgtctaaaacgctttcccgcgctctcctaccctccaaccccgcgcccttcgcgacctcgccgcctcaaaaaaacccccgaaactactccgttcccacctcgaccgccctacgaaccgaacaacccgccccgcgccttctcgaaaaaaaacgacgacgaaaaaacttccgaccgaaacgctacgcgaaaaactaaccgactaaaaaacgcgacgccgctacctttcgttctaacgccccaaattccgtcccgaacgcgcccacctcccgcaaaaacaaacaaaaacgccgaccctcgaactccgcaacccctcacgcctatatctaccgaaactacgcccacttccaaaactaccctctcgacgcacgcccgcaacacccacgcccccgataccctaaaaaaaaaacgaccctcgcgcgcgccgccctcctccccgactaatcctaccctctccatacgactacgaactccaaactaaaacgccctaatctttccgacgcgcccacccaataactcaaaaatcgcaaactcgtatccgtaaaaaccaaaaaaatcttaacaataaacgcgaacataaaccccaaacccatccgaaaaaaaaccaaaattctactccaactaatacgtaca

SEQ ID NO: 31981 - DNA, 755 bp, Artificial Sequence
  chemically treated genomic DNA (Homo sapiens) CpG-island No: 31981
attatacgtttagcgaaggcgtagagatttatttttttgcggatagtcgtttgacgttttttgttcgggagttgttggaaagtcgttatttgcgtattaagtttattgacgagtagggtcgtttgtttgttgacgatgaatagtagtagtcgtagttcgtttatgggttgattagtagcgatgaatattcgtaggcgtgttgcgaattgtgtcgttagtcggtggtaaaaaagtcggatacgttgatttatttgtcggcggaaaaaatggtcgttaaaagcgattcgcgtttgggttttcgcgcggttttcgatagtattattgcgttggtagtgtggttgtaaattgaattggcggaatcgtggtagtcgtggttggcggatattcgttcgcgttttggtaatattatgcgcgttcgatgtcgtttgggggaattcgttgggttgttaggcgattgtcgggttttttgacgaagatttgtatcggtttttttattagtcgttgcgttatttcgatacgattatttggtgtcggaagttagttacgggcgcgatgttgcgttgtttaatttgttacgtattaaagtgcgggaaatcgaaatcgtagcggcgtaggtttttattattcgtagttttgaagtattacgttcggatattttgtaggcgttgaatcgtttttcgagtacggtttacgtgatgatgattttgagcgtaacgaagtagtcgttaacggtgaagtagatttaataacgattg

SEQ ID NO: 31982 - DNA, 755 bp, Artificial Sequence
  chemically treated genomic DNA (Homo sapiens) CpG-island No: 31982
caatcgttattaaatctacttcaccgttaacgactacttcgttacgctcaaaatcatcatcacgtaaaccgtactcgaaaaacgattcaacgcctacaaaatatccgaacgtaatacttcaaaactacgaataataaaaacctacgccgctacgatttcgatttcccgcactttaatacgtaacaaattaaacaacgcaacatcgcgcccgtaactaacttccgacaccaaataatcgtatcgaaataacgcaacgactaataaaaaaaccgatacaaatcttcgtcaaaaaacccgacaatcgcctaacaacccaacgaattcccccaaacgacatcgaacgcgcataatattaccaaaacgcgaacgaatatccgccaaccacgactaccacgattccgccaattcaatttacaaccacactaccaacgcaataatactatcgaaaaccgcgcgaaaacccaaacgcgaatcgcttttaacgaccattttttccgccgacaaataaatcaacgtatccgacttttttaccaccgactaacgacacaattcgcaacacgcctacgaatattcatcgctactaatcaacccataaacgaactacgactactactattcatcgtcaacaaacaaacgaccctactcgtcaataaacttaatacgcaaataacgactttccaacaactcccgaacaaaaaacgtcaaacgactatccgcaaaaaaataaatctctacgccttcgctaaacgtataat

SEQ ID NO: 31983 - DNA, 755 bp, Artificial Sequence
  chemically treated genomic DNA (Homo sapiens) CpG-island No: 31983
tagtcgttgttggatttgttttatcgttagcggttgtttcgttacgtttaggattattattacgtagatcgtgttcgaaaggcggtttagcgtttgtaaaatgttcgggcgtaatattttaaagttgcgggtgataaagatttgcgtcgttacggtttcggtttttcgtattttggtgcgtagtagattgagtaacgtagtatcgcgttcgtggttggttttcggtattagatgatcgtgtcgagatagcgtagcggttgatgagaaagtcgatgtagattttcgttagaaagttcgataatcgtttggtagtttagcgggtttttttaggcggtatcgggcgcgtataatgttgttaagacgcgaacggatattcgttagttacggttgttacggtttcgttagtttaatttgtagttatattgttagcgtaatggtgttgtcgagaatcgcgcgaaaatttagacgcggatcgtttttggcgattatttttttcgtcgataggtgagttagcgtattcggtttttttgttatcggttggcgatatagttcgtagtacgtttgcggatgtttatcgttattggttagtttatgaacgggttgcggttgttgttgtttatcgttaataaataggcggttttgttcgttaataaatttgatgcgtagatggcggttttttagtaattttcgggtagagggcgttaggcgattgttcgtagggagatggatttttgcgttttcgttgagcgtatggt

SEQ ID NO: 31984 - DNA, 755 bp, Artificial Sequence
  chemically treated genomic DNA (Homo sapiens) CpG-island No: 31984
accatacgctcaacgaaaacgcaaaaatccatctccctacgaacaatcgcctaacgccctctacccgaaaattactaaaaaaccgccatctacgcatcaaatttattaacgaacaaaaccgcctatttattaacgataaacaacaacaaccgcaacccgttcataaactaaccaataacgataaacatccgcaaacgtactacgaactatatcgccaaccgataacaaaaaaaccgaatacgctaactcacctatcgacgaaaaaaataatcgccaaaaacgatccgcgtctaaattttcgcgcgattctcgacaacaccattacgctaacaatataactacaaattaaactaacgaaaccgtaacaaccgtaactaacgaatatccgttcgcgtcttaacaacattatacgcgcccgataccgcctaaaaaaacccgctaaactaccaaacgattatcgaactttctaacgaaaatctacatcgactttctcatcaaccgctacgctatctcgacacgatcatctaataccgaaaaccaaccacgaacgcgatactacgttactcaatctactacgcaccaaaatacgaaaaaccgaaaccgtaacgacgcaaatctttatcacccgcaactttaaaatattacgcccgaacattttacaaacgctaaaccgcctttcgaacacgatctacgtaataataatcctaaacgtaacgaaacaaccgctaacgataaaacaaatccaacaacgacta

SEQ ID NO: 31985 - DNA, 649 bp, Artificial Sequence
  chemically treated genomic DNA (Homo sapiens) CpG-island No: 31985
gggcgggaagcgggcggcgggtttagtcgagggtcgcgaagacgcgcgtttttaaacgaggcgacgtttatttattacggttcggcggggtagcgcgtcggaggttcgcgatagggttcggcgcggttttcgcgatcggttcgggcgggcgttttcggagtttttagagtcgttgtcgttcgagattacgatgtaattttttattggttgcgggtttcgatcgaagatttaggtagtggcggcggcggcgacgatttcggtttttgtttttgaggtggcgcggcgggggcggcggtagcggcggcggttataattcgggttatcgttacgtcggtttcgtttcgagtttcgtttcgtcgggttcgtaagttttagttatcggcggcgggcggttggggttagggtcgggtcgttgtgtttcgtggcggcgcgggtttttcgttttttaggaggaaaaaaaaaaagaaaaatggagtcgtagtcggtttcggtaggtgttggggttaggcgtgcgagacgtcgaggtcgcggggatttttttatttgtttttaatcgacgaaagcgtgaagtgaggcgcgtttagttttattttgtttaggtgtgaagcgtttttcggattgagagggttttgattgaggggtagggaga

SEQ ID NO: 31986 - DNA, 649 bp, Artificial Sequence
  chemically treated genomic DNA (Homo sapiens) CpG-island No: 31986
tctccctacccctcaatcaaaaccctctcaatccgaaaaacgcttcacacctaaacaaaataaaactaaacgcgcctcacttcacgctttcgtcgattaaaaacaaataaaaaaatccccgcgacctcgacgtctcgcacgcctaaccccaacacctaccgaaaccgactacgactccatttttctttttttttttcctcctaaaaaacgaaaaacccgcgccgccacgaaacacaacgacccgaccctaaccccaaccgcccgccgccgataactaaaacttacgaacccgacgaaacgaaactcgaaacgaaaccgacgtaacgataacccgaattataaccgccgccgctaccgccgcccccgccgcgccacctcaaaaacaaaaaccgaaatcgtcgccgccgccgccactacctaaatcttcgatcgaaacccgcaaccaataaaaaattacatcgtaatctcgaacgacaacgactctaaaaactccgaaaacgcccgcccgaaccgatcgcgaaaaccgcgccgaaccctatcgcgaacctccgacgcgctaccccgccgaaccgtaataaataaacgtcgcctcgtttaaaaacgcgcgtcttcgcgaccctcgactaaacccgccgcccgcttcccgccc

SEQ ID NO: 31987 - DNA, 649 bp, Artificial Sequence
  chemically treated genomic DNA (Homo sapiens) CpG-island No: 31987
tttttttgttttttagttaaggtttttttagttcgggaggcgttttatatttgggtagggtgggattgggcgcgttttattttacgttttcgtcggttggaagtaggtggggaagttttcgcggtttcggcgtttcgtacgtttggttttaatatttgtcgaagtcggttgcgattttatttttttttttttttttttttttgggaaacggaggattcgcgtcgttacgaagtatagcgattcggttttgattttagtcgttcgtcgtcggtggttggggtttgcgggttcggcggggcggggttcggggcggggtcggcgtggcggtggttcgggttgtagtcgtcgtcgttgtcgtcgttttcgtcgcgttattttagaagtaggaatcgaagtcgtcgtcgtcgtcgttattgtttgggttttcggtcggggttcgtagttaatggaggattatatcgtgatttcggacgatagcggttttgagagtttcgggggcgttcgttcgggtcggtcgcggaggtcgcgtcgggttttgtcgcgaattttcggcgcgttgtttcgtcggatcgtggtgagtgagcgtcgtttcgtttgggggcgcgcgttttcgcgattttcggttgggttcgtcgttcgtttttcgttt

SEQ ID NO: 31988 - DNA, 649 bp, Artificial Sequence
  chemically treated genomic DNA (Homo sapiens) CpG-island No: 31988
aaacgaaaaacgaacgacgaacccaaccgaaaatcgcgaaaacgcgcgcccccaaacgaaacgacgctcactcaccacgatccgacgaaacaacgcgccgaaaattcgcgacaaaacccgacgcgacctccgcgaccgacccgaacgaacgcccccgaaactctcaaaaccgctatcgtccgaaatcacgatataatcctccattaactacgaaccccgaccgaaaacccaaacaataacgacgacgacgacgacttcgattcctacttctaaaataacgcgacgaaaacgacgacaacgacgacgactacaacccgaaccaccgccacgccgaccccgccccgaaccccgccccgccgaacccgcaaaccccaaccaccgacgacgaacgactaaaatcaaaaccgaatcgctatacttcgtaacgacgcgaatcctccgtttcccaaaaaaaaaaaaaaaaaaaaaaataaaatcgcaaccgacttcgacaaatattaaaaccaaacgtacgaaacgccgaaaccgcgaaaacttccccacctacttccaaccgacgaaaacgtaaaataaaacgcgcccaatcccaccctacccaaatataaaacgcctcccgaactaaaaaaaccttaactaaaaaacaaaaaaa

SEQ ID NO: 31989 - DNA, 688 bp, Artificial Sequence
  chemically treated genomic DNA (Homo sapiens) CpG-island No: 31989
cgttttttcggttcgcgcgtaggcggtttgtgtatttcggataacgcgtattttttgcgttttcggaagtggcggtaacgttcggttttgtttttagtagaggcggaagcggtgtcgttttgaggggtcgttagtcgtcgtaggcgttttagtttagcggcgggttttggtttttggttgtttatttttatcgttttagtttcgggcggttttgggtttgttgcgggcgcggcgttgttcgatatagagttttttgtggaacgttttttagaggtgcgggttggtatcgtttcggtatttttcgtttttcgcgtagtcgtttcggatttttgtttcgattttcgcggttaatttcgttttttgtcggttgtttcgcggtttttttcgttatttgtcgtgtttttagcggtttttttcgttttttgtttcgatcgtcgtcgtttttttcgatttttgttttagtcgacgcggtcgttttcgttttttggcgggtttttcgcggtttttttcgttcgttgttcggttttttggggtcgttttttgttttttgttcggtttttgttttgtgcgtcggttttttttaagatgtagagtgcgttattgtagattcgaggtcgcggttatcggtttttgggttaggttttttttttcgttttaagagtcgttaggtggagggtttttagggtgt

SEQ ID NO: 31990 - DNA, 688 bp, Artificial Sequence
  chemically treated genomic DNA (Homo sapiens) CpG-island No: 31990
acaccctaaaaaccctccacctaacgactcttaaaacgaaaaaaaaaacctaacccaaaaaccgataaccgcgacctcgaatctacaataacgcactctacatcttaaaaaaaaccgacgcacaaaacaaaaaccgaacaaaaaacaaaaaacgaccccaaaaaaccgaacaacgaacgaaaaaaaccgcgaaaaacccgccaaaaaacgaaaacgaccgcgtcgactaaaacaaaaatcgaaaaaaacgacgacgatcgaaacaaaaaacgaaaaaaaccgctaaaaacacgacaaataacgaaaaaaaccgcgaaacaaccgacaaaaaacgaaattaaccgcgaaaatcgaaacaaaaatccgaaacgactacgcgaaaaacgaaaaataccgaaacgataccaacccgcacctctaaaaaacgttccacaaaaaactctatatcgaacaacgccgcgcccgcaacaaacccaaaaccgcccgaaactaaaacgataaaaataaacaaccaaaaaccaaaacccgccgctaaactaaaacgcctacgacgactaacgacccctcaaaacgacaccgcttccgcctctactaaaaacaaaaccgaacgttaccgccacttccgaaaacgcaaaaaatacgcgttatccgaaatacacaaaccgcctacgcgcgaaccgaaaaaacg

SEQ ID NO: 31991 - DNA, 688 bp, Artificial Sequence
  chemically treated genomic DNA (Homo sapiens) CpG-island No: 31991
gtattttggagattttttatttggcggtttttgaggcgagaaaaagggtttagtttaggagtcggtggtcgcgatttcgggtttgtagtggcgtattttgtattttgggaagggtcgacgtataggatagggatcgggtaggaggtagggggcggttttaggagatcgggtagcggacgggggagatcgcgggggattcgttaggggacgggggcggtcgcgtcggttggggtaggggtcgggggaggcggcggcggtcggggtaggggacgggggaggtcgttggggatacggtaggtgacgggggaggtcgcggggtaatcggtagggaacggggttggtcgcgggggtcgggataggggttcggggcggttgcgcgggaggcgggagatgtcggggcggtgttagttcgtatttttggaagacgttttataggaagttttgtgtcgggtagcgtcgcgttcgtagtaggtttagggtcgttcggggttggggcggtaggagtaggtagttaagggttaaggttcgtcgttgggttgaagcgtttgcggcgattggcgattttttagagcgatatcgttttcgtttttgttgggggtagggtcgggcgttatcgttattttcgggggcgtaggaaatgcgcgttgttcgggatgtataggtcgtttgcgcgcgggtcgggaaggcg

SEQ ID NO: 31992 - DNA, 688 bp, Artificial Sequence
  chemically treated genomic DNA (Homo sapiens) CpG-island No: 31992
cgccttcccgacccgcgcgcaaacgacctatacatcccgaacaacgcgcatttcctacgcccccgaaaataacgataacgcccgaccctacccccaacaaaaacgaaaacgatatcgctctaaaaaatcgccaatcgccgcaaacgcttcaacccaacgacgaaccttaacccttaactacctactcctaccgccccaaccccgaacgaccctaaacctactacgaacgcgacgctacccgacacaaaacttcctataaaacgtcttccaaaaatacgaactaacaccgccccgacatctcccgcctcccgcgcaaccgccccgaacccctatcccgacccccgcgaccaaccccgttccctaccgattaccccgcgacctcccccgtcacctaccgtatccccaacgacctcccccgtcccctaccccgaccgccgccgcctcccccgacccctaccccaaccgacgcgaccgcccccgtcccctaacgaatcccccgcgatctcccccgtccgctacccgatctcctaaaaccgccccctacctcctacccgatccctatcctatacgtcgacccttcccaaaatacaaaatacgccactacaaacccgaaatcgcgaccaccgactcctaaactaaaccctttttctcgcctcaaaaaccgccaaataaaaaatctccaaaatac

SEQ ID NO: 31993 - DNA, 636 bp, Artificial Sequence
  chemically treated genomic DNA (Homo sapiens) CpG-island No: 31993
atcgacgttaatttaggttaacgttaaagcgacggcgggtaaagtgtattttgattttcggttacgattttaaagatttttataatttgttggaatagatcgaaggtacgggcgttaatgtttatatttacggcgaaatgttgtttgcgtatgttattcggagttgcgtaaatttaagtatttggtcggtaattacggtagcggttggtagaattagtaagtggagttcgttcgtttttttggttttatcgtgatgatttcgaattgtattatcgatttaatcgtaggcgtttatgacgatcgtatttggattcgtagtattgttggttggtttggcgtgcgttatttggacggtgatgatttttttgcggttattatttaggcgtaatagatggtaggtttttcgtatagcgaaatttcgtattttattatcgtgggttttggtcgttagacgttgtttggcgttgttgatacgttgattgatttggtgagtcgtgaaaaattgcgtttatatttttttggtttggtggttgtgacggcgtacgcggcgagcgttattattttatcgatttcgttattagcgtgtttcgaatgaattgttttattttgtaatttcgattgttgtaaatatttttt

SEQ ID NO: 31994 - DNA, 636 bp, Artificial Sequence
  chemically treated genomic DNA (Homo sapiens) CpG-island No: 31994
aaaaaatatttacaacaatcgaaattacaaaataaaacaattcattcgaaacacgctaataacgaaatcgataaaataataacgctcgccgcgtacgccgtcacaaccaccaaaccaaaaaaatataaacgcaatttttcacgactcaccaaatcaatcaacgtatcaacaacgccaaacaacgtctaacgaccaaaacccacgataataaaatacgaaatttcgctatacgaaaaacctaccatctattacgcctaaataataaccgcaaaaaaatcatcaccgtccaaataacgcacgccaaaccaaccaacaatactacgaatccaaatacgatcgtcataaacgcctacgattaaatcgataatacaattcgaaatcatcacgataaaaccaaaaaaacgaacgaactccacttactaattctaccaaccgctaccgtaattaccgaccaaatacttaaatttacgcaactccgaataacatacgcaaacaacatttcgccgtaaatataaacattaacgcccgtaccttcgatctattccaacaaattataaaaatctttaaaatcgtaaccgaaaatcaaaatacactttacccgccgtcgctttaacgttaacctaaattaacgtcgat

SEQ ID NO: 31995 - DNA, 636 bp, Artificial Sequence
  chemically treated genomic DNA (Homo sapiens) CpG-island No: 31995
aaggaatatttataatagtcgaggttatagaataaggtaatttattcgggatacgttggtggcgaaatcggtgaagtagtggcgttcgtcgcgtgcgtcgttatagttattaagttaggaagatatggacgtagttttttacggtttattagattaattagcgtattagtagcgttaagtagcgtttggcgattaaaatttacggtgataaggtgcggaatttcgttgtacgggaagtttgttatttgttgcgtttgggtgataatcgtagagaaattattatcgtttagatgacgtacgttaggttagttaataatgttgcgggtttagatacgatcgttataagcgtttacggttgggtcgatgatgtagttcgaggttattacgatggggttagggaaacgagcgaattttatttgttgattttgttagtcgttgtcgtagttatcgattagatgtttgaatttacgtagtttcgggtagtatgcgtaggtagtatttcgtcgtgggtgtagatattaacgttcgtgttttcggtttgttttagtaggttgtagagatttttgagatcgtgatcggaaattagaatgtattttattcgtcgtcgttttgacgttgatttgggttggcgtcggt

SEQ ID NO: 31996 - DNA, 636 bp, Artificial Sequence
  chemically treated genomic DNA (Homo sapiens) CpG-island No: 31996
accgacgccaacccaaatcaacgtcaaaacgacgacgaataaaatacattctaatttccgatcacgatctcaaaaatctctacaacctactaaaacaaaccgaaaacacgaacgttaatatctacacccacgacgaaatactacctacgcatactacccgaaactacgtaaattcaaacatctaatcgataactacgacaacgactaacaaaatcaacaaataaaattcgctcgtttccctaaccccatcgtaataacctcgaactacatcatcgacccaaccgtaaacgcttataacgatcgtatctaaacccgcaacattattaactaacctaacgtacgtcatctaaacgataataatttctctacgattatcacccaaacgcaacaaataacaaacttcccgtacaacgaaattccgcaccttatcaccgtaaattttaatcgccaaacgctacttaacgctactaatacgctaattaatctaataaaccgtaaaaaactacgtccatatcttcctaacttaataactataacgacgcacgcgacgaacgccactacttcaccgatttcgccaccaacgtatcccgaataaattaccttattctataacctcgactattataaatattcctt

SEQ ID NO: 31997 - DNA, 576 bp, Artificial Sequence
  chemically treated genomic DNA (Homo sapiens) CpG-island No: 31997
atttcgcgtttaatttgcgtatcgtgtatttggtgcgcgattcgcgggtcgtgttgcgttttcgggaggcggcgggttcgatattggtacgcgataacggtatcgtgttgggtattaacggtaagtgggtggaggtcgatttttatttgcgtttgattcgcgaggtgtgtcgtagttacgtgcgtatcgtcgaggtcgttatatttaagtcgttattttttttgcgcggtcgttatcgtttggtgcgtttcgaggatttggcgcgggagtcgttggtagagattcgcgtattttacgtttttatcggtttgatttttacgttatagttcgaggtttggatttataatattatttacgggtcggggatcggtaagttaatcgaggttttttatatttcgtttaggaatgcgcgtaacgttttttaggtttggcgttacgcgttgttttttattaagattttgcgcgtgtaggaggtgtgcgtcggcgcgttgtagttgttgggttatcggtttgtgtattttgcggattagtagcgtgattttattttggatttggtgttgttacgaggtttagatt

SEQ ID NO: 31998 - DNA, 576 bp, Artificial Sequence
  chemically treated genomic DNA (Homo sapiens) CpG-island No: 31998
aatctaaacctcgtaacaacaccaaatccaaaataaaatcacgctactaatccgcaaaatacacaaaccgataacccaacaactacaacgcgccgacgcacacctcctacacgcgcaaaatcttaataaaaaacaacgcgtaacgccaaacctaaaaaacgttacgcgcattcctaaacgaaatataaaaaacctcgattaacttaccgatccccgacccgtaaataatattataaatccaaacctcgaactataacgtaaaaatcaaaccgataaaaacgtaaaatacgcgaatctctaccaacgactcccgcgccaaatcctcgaaacgcaccaaacgataacgaccgcgcaaaaaaaataacgacttaaatataacgacctcgacgatacgcacgtaactacgacacacctcgcgaatcaaacgcaaataaaaatcgacctccacccacttaccgttaatacccaacacgataccgttatcgcgtaccaatatcgaacccgccgcctcccgaaaacgcaacacgacccgcgaatcgcgcaccaaatacacgatacgcaaattaaacgcgaaat

SEQ ID NO: 31999 - DNA, 576 bp, Artificial Sequence
  chemically treated genomic DNA (Homo sapiens) CpG-island No: 31999
ggtttgggtttcgtggtagtattagatttagggtgaggttacgttgttggttcgtagagtatataggtcggtagtttagtagttgtagcgcgtcggcgtatattttttgtacgcgtaggattttagtgaagggtaacgcgtggcgttaggtttgggagacgttgcgcgtatttttagacgaagtatggaaggtttcgattggtttgtcgattttcgattcgtgggtgatgttgtggatttaggtttcgagttgtggcgtgagggttaggtcggtgaaggcgtagagtgcgcggatttttgttagcggttttcgcgttaggttttcgaagcgtattaggcggtagcggtcgcgtaggaagggtggcggtttgagtgtggcggtttcggcgatgcgtacgtggttgcggtatatttcgcgaattaggcgtaggtgagggtcggtttttatttatttgtcgttggtgtttagtacgatgtcgttgtcgcgtgttagtatcgggttcgtcgtttttcgggagcgtagtacggttcgcgggtcgcgtattaggtgtacgatgcgtaggttgagcgcggggt

SEQ ID NO: 32000 - DNA, 576 bp, Artificial Sequence
  chemically treated genomic DNA (Homo sapiens) CpG-island No: 32000
accccgcgctcaacctacgcatcgtacacctaatacgcgacccgcgaaccgtactacgctcccgaaaaacgacgaacccgatactaacacgcgacaacgacatcgtactaaacaccaacgacaaataaataaaaaccgaccctcacctacgcctaattcgcgaaatataccgcaaccacgtacgcatcgccgaaaccgccacactcaaaccgccacccttcctacgcgaccgctaccgcctaatacgcttcgaaaacctaacgcgaaaaccgctaacaaaaatccgcgcactctacgccttcaccgacctaaccctcacgccacaactcgaaacctaaatccacaacatcacccacgaatcgaaaatcgacaaaccaatcgaaaccttccatacttcgtctaaaaatacgcgcaacgtctcccaaacctaacgccacgcgttacccttcactaaaatcctacgcgtacaaaaaatatacgccgacgcgctacaactactaaactaccgacctatatactctacgaaccaacaacgtaacctcaccctaaatctaatactaccacgaaacccaaacc

SEQ ID NO: 32001 - DNA, 685 bp, Artificial Sequence
  chemically treated genomic DNA (Homo sapiens) CpG-island No: 32001
gggtttttagcgagggttttagggacgttagttcggaggtatcggtcggaagtgtcgtagggtaattacgtagtattttttgcgtatgtgtaaagcgttgtcgggggtcgttttagttgtcgtcgtcgtcgtcggggttttatggtttttttttagagttttgtcgttggaggcggttgttgcggttttgtgagtttgattagcgtcgagcggtagtaatatggaggaattcgatttcgaagatttttttacgtcggaggaggacgaggattacgtgtcgtcgggtgagcgatttcgtttgaggcgagaagcgaattgtttcgttttacgttttacgtgaggcgcgttttgttttcgcgggcgtttgttttgtggtttaggtggtttaggggggtttttgttttcgagcgttcgtttttttaggttttttattttcggtcgtttcggttcgaggcgtgtgcgcgtggcggttttgtgtttttttttcgttgggtagtttcggtcgtcgtttttttttgtagcgcgggaatcggtatatggatacggttttttgtcgttagggacgttcgtcggttagtttcgaacgatatcgttgttttagaagtcggggcggtagttcgagttttggaggttttttttagttttggttcgagagagttgttggttattatttcgtttaagatag

SEQ ID NO: 32002 - DNA, 685 bp, Artificial Sequence
  chemically treated genomic DNA (Homo sapiens) CpG-island No: 32002
ctatcttaaacgaaataataaccaacaactctctcgaaccaaaactaaaaaaaacctccaaaactcgaactaccgccccgacttctaaaacaacgatatcgttcgaaactaaccgacgaacgtccctaacgacaaaaaaccgtatccatataccgattcccgcgctacaaaaaaaaacgacgaccgaaactacccaacgaaaaaaaaacacaaaaccgccacgcgcacacgcctcgaaccgaaacgaccgaaaataaaaaacctaaaaaaacgaacgctcgaaaacaaaaacccccctaaaccacctaaaccacaaaacaaacgcccgcgaaaacaaaacgcgcctcacgtaaaacgtaaaacgaaacaattcgcttctcgcctcaaacgaaatcgctcacccgacgacacgtaatcctcgtcctcctccgacgtaaaaaaatcttcgaaatcgaattcctccatattactaccgctcgacgctaatcaaactcacaaaaccgcaacaaccgcctccaacgacaaaactctaaaaaaaaaccataaaaccccgacgacgacgacgacaactaaaacgacccccgacaacgctttacacatacgcaaaaaatactacgtaattaccctacgacacttccgaccgatacctccgaactaacgtccctaaaaccctcgctaaaaaccc

SEQ ID NO: 32003 - DNA, 685 bp, Artificial Sequence
  chemically treated genomic DNA (Homo sapiens) CpG-island No: 32003
ttattttggacggggtggtggttagtagttttttcgggttagggttgaaaaaaatttttaaggttcggattgtcgtttcgatttttgaagtagcggtgtcgttcggggttgatcgacgagcgtttttagcgataaggggtcgtgtttatgtgtcggttttcgcgttgtaagagggggcggcggtcggagttgtttaacgggaggggagtatagaatcgttacgcgtatacgtttcgggtcggagcggtcgaggatgaggggtttgagggagcggacgttcgagaataggagtttttttggattatttgggttatagggtagacgttcgcgggggtagagcgcgttttacgtgaggcgtggggcggggtaattcgtttttcgttttaggcggaatcgtttattcgacggtacgtagttttcgttttttttcgacgtagagaagttttcggagtcgaatttttttatgttgttgtcgttcgacgttggttaaatttataagatcgtagtagtcgtttttaacggtaaagttttagggagagattatagagtttcggcggcggcgacggtagttagggcggttttcgatagcgttttgtatatgcgtagagagtattacgtggttgttttacgatattttcggtcgatgttttcgggttggcgtttttgaagttttcgttgggagttt

SEQ ID NO: 32004 - DNA, 685 bp, Artificial Sequence
  chemically treated genomic DNA (Homo sapiens) CpG-island No: 32004
aaactcccaacgaaaacttcaaaaacgccaacccgaaaacatcgaccgaaaatatcgtaaaacaaccacgtaatactctctacgcatatacaaaacgctatcgaaaaccgccctaactaccgtcgccgccgccgaaactctataatctctccctaaaactttaccgttaaaaacgactactacgatcttataaatttaaccaacgtcgaacgacaacaacataaaaaaattcgactccgaaaacttctctacgtcgaaaaaaaacgaaaactacgtaccgtcgaataaacgattccgcctaaaacgaaaaacgaattaccccgccccacgcctcacgtaaaacgcgctctacccccgcgaacgtctaccctataacccaaataatccaaaaaaactcctattctcgaacgtccgctccctcaaacccctcatcctcgaccgctccgacccgaaacgtatacgcgtaacgattctatactcccctcccgttaaacaactccgaccgccgccccctcttacaacgcgaaaaccgacacataaacacgaccccttatcgctaaaaacgctcgtcgatcaaccccgaacgacaccgctacttcaaaaatcgaaacgacaatccgaaccttaaaaatttttttcaaccctaacccgaaaaaactactaaccaccaccccgtccaaaataa

SEQ ID NO: 32005 - DNA, 785 bp, Artificial Sequence
  chemically treated genomic DNA (Homo sapiens) CpG-island No: 32005
ttggaaagttatcgatttgtttttgaaagatatttaggtgttggtttttgaattgtcgatggttgaagcgatttttgaattgttggcgttggttggcgaagaaggtgtcgtagaatcgtatcgttatttgatgaaaaatttgcgttttcgtttgatggcgatataggtatggttggaagcgcgtttgaaaggcgaagaattgttaaaattagaaggtttgttgatataaaacgaagaattgtgggaatcgttttacgtttgttattagttattttaggcgtgtggtatgggtattatcgttaacggcgatttgttcgatattttgcgtcgcgtgaaatgtttcggcgtatcgttggttcgtattgatattcgttaggagagtacgcgttatatcgaagcgttgggcgagttgattcgttatttcggtatcggcgattacgaaagttggttagaggtcgataaataggcgtttttgattcgcgaattgaattttaaacgttcgtttttgtcgcgtaattggtaattaagcgtcgaaacgcgcgaagtgttcgatatttgttaggtgattgtcgaagtatcgtaaggttttattgtcgtttacgtgatttcgatggcgaaaacgtcgttcgacgtattggttgtttatttgttgttgaaagaagcgggtatcgggtttgcgatgtcggttgtttcgttgtttgaaattttcgatgatttgaataacgttacgatgttatgatttagttgtttaatattgattggtatcgtggtttgatttagggtaa

SEQ ID NO: 32006 - DNA, 785 bp, Artificial Sequence
  chemically treated genomic DNA (Homo sapiens) CpG-island No: 32006
ttaccctaaatcaaaccacgataccaatcaatattaaacaactaaatcataacatcgtaacgttattcaaatcatcgaaaatttcaaacaacgaaacaaccgacatcgcaaacccgatacccgcttctttcaacaacaaataaacaaccaatacgtcgaacgacgttttcgccatcgaaatcacgtaaacgacaataaaaccttacgatacttcgacaatcacctaacaaatatcgaacacttcgcgcgtttcgacgcttaattaccaattacgcgacaaaaacgaacgtttaaaattcaattcgcgaatcaaaaacgcctatttatcgacctctaaccaactttcgtaatcgccgataccgaaataacgaatcaactcgcccaacgcttcgatataacgcgtactctcctaacgaatatcaatacgaaccaacgatacgccgaaacatttcacgcgacgcaaaatatcgaacaaatcgccgttaacgataatacccataccacacgcctaaaataactaataacaaacgtaaaacgattcccacaattcttcgttttatatcaacaaaccttctaattttaacaattcttcgcctttcaaacgcgcttccaaccatacctatatcgccatcaaacgaaaacgcaaatttttcatcaaataacgatacgattctacgacaccttcttcgccaaccaacgccaacaattcaaaaatcgcttcaaccatcgacaattcaaaaaccaacacctaaatatctttcaaaaacaaatcgataactttccaa

SEQ ID NO: 32007 - DNA, 785 bp, Artificial Sequence
  chemically treated genomic DNA (Homo sapiens) CpG-island No: 32007
ttgttttgaattaggttacgatattagttaatattgagtagttgggttatgatatcgtggcgttgtttagattatcgagggttttaaatagcggagtaatcggtatcgtaaattcgatattcgttttttttagtagtaggtggatagttagtacgtcggacggcgttttcgttatcgagattacgtaggcggtaatggagttttgcggtgtttcggtaattatttggtaggtatcgagtatttcgcgcgtttcggcgtttggttgttagttgcgcggtagaagcggacgtttggagtttagttcgcggattaggaacgtttgtttgtcggtttttgattagttttcgtagtcgtcgatatcgaggtagcgggttagttcgtttagcgtttcggtatgacgcgtgtttttttgacggatattaatacggattagcggtacgtcgaaatattttacgcggcgtagggtgtcgagtagatcgtcgttggcgataatatttatgttatacgtttgaagtgattggtagtaagcgtagagcggtttttatagtttttcgttttgtgttagtaggttttttggttttggtagtttttcgttttttaggcgcgtttttagttatgtttgtgtcgttattaggcgagaacgtaggttttttattagatagcgatacggttttgcggtatttttttcgttaattagcgttagtagtttaggggtcgttttaattatcgatagtttagaaattagtatttgaatattttttaggaataaatcggtggttttttag

SEQ ID NO: 32008 - DNA, 785 bp, Artificial Sequence
  chemically treated genomic DNA (Homo sapiens) CpG-island No: 32008
ctaaaaaaccaccgatttattcctaaaaaatattcaaatactaatttctaaactatcgataattaaaacgacccctaaactactaacgctaattaacgaaaaaaataccgcaaaaccgtatcgctatctaataaaaaacctacgttctcgcctaataacgacacaaacataactaaaaacgcgcctaaaaaacgaaaaactaccaaaaccaaaaaacctactaacacaaaacgaaaaactataaaaaccgctctacgcttactaccaatcacttcaaacgtataacataaatattatcgccaacgacgatctactcgacaccctacgccgcgtaaaatatttcgacgtaccgctaatccgtattaatatccgtcaaaaaaacacgcgtcataccgaaacgctaaacgaactaacccgctacctcgatatcgacgactacgaaaactaatcaaaaaccgacaaacaaacgttcctaatccgcgaactaaactccaaacgtccgcttctaccgcgcaactaacaaccaaacgccgaaacgcgcgaaatactcgatacctaccaaataattaccgaaacaccgcaaaactccattaccgcctacgtaatctcgataacgaaaacgccgtccgacgtactaactatccacctactactaaaaaaaacgaatatcgaatttacgataccgattactccgctatttaaaaccctcgataatctaaacaacgccacgatatcataacccaactactcaatattaactaatatcgtaacctaattcaaaacaa

SEQ ID NO: 32009 - DNA, 657 bp, Artificial Sequence
  chemically treated genomic DNA (Homo sapiens) CpG-island No: 32009
ggagttgcgttatttatatcgattttcgagatcgatttcgtttcgaacgggtcgatttatcgtcgttcggtattagtatagcgcggaaattacgcggaatgttattaattttcggtgcgtcgtaattgcgtaaattacgcgttaacgggtgattttcggcgttataaatgattttttcgtttatattgtggtcgatagtacgtagggtggtatcgtagatttgttttaacgttaattttggattgatcggtgtatcgtagtttagtaaggcgtagaatttatttaggcggattttattcgtacgcgtgttgacggtaattttagcgaagtttgcgttatacgggaaggcgaaattaggcgtgatataattgttagtttttattagtgaattaaagtcggtgtcggtttcgtttttatgggtaatattttcgaaattaatttcgttttttttgtcgcgtacgacgttcggcgttgttagttgaatatttgttattggtttatttaatatttgcgcgtcgtggaatagaattttttttcgtagatttttcgttgttaaacgcgtcgcgttattcgagaagtaagtatcggacgaggtatatgcgtttttattaaataacgtatgatcggtatttatcgggaaggaattttattagtttg

SEQ ID NO: 32010 - DNA, 657 bp, Artificial Sequence
  chemically treated genomic DNA (Homo sapiens) CpG-island No: 32010
caaactaataaaattccttcccgataaataccgatcatacgttatttaataaaaacgcatatacctcgtccgatacttacttctcgaataacgcgacgcgtttaacaacgaaaaatctacgaaaaaaaattctattccacgacgcgcaaatattaaataaaccaataacaaatattcaactaacaacgccgaacgtcgtacgcgacaaaaaaaacgaaattaatttcgaaaatattacccataaaaacgaaaccgacaccgactttaattcactaataaaaactaacaattatatcacgcctaatttcgccttcccgtataacgcaaacttcgctaaaattaccgtcaacacgcgtacgaataaaatccgcctaaataaattctacgccttactaaactacgatacaccgatcaatccaaaattaacgttaaaacaaatctacgataccaccctacgtactatcgaccacaatataaacgaaaaaatcatttataacgccgaaaatcacccgttaacgcgtaatttacgcaattacgacgcaccgaaaattaataacattccgcgtaatttccgcgctatactaataccgaacgacgataaatcgacccgttcgaaacgaaatcgatctcgaaaatcgatataaataacgcaactcc

SEQ ID NO: 32011 - DNA, 657 bp, Artificial Sequence
  chemically treated genomic DNA (Homo sapiens) CpG-island No: 32011
taaattggtaaaattttttttcggtagatatcgattatgcgttgtttgataaaggcgtatatgtttcgttcggtatttgtttttcgggtaacgcggcgcgtttggtagcggaaaatttacgggagaaaattttgttttacggcgcgtaaatgttgggtgagttagtggtagatgtttaattggtaacgtcgggcgtcgtgcgcggtaagaaaggcgaagttagtttcggggatattgtttataaaggcgaaatcggtatcggttttggtttattggtgggaattggtagttatattacgtttgatttcgttttttcgtatggcgtaaatttcgttgaagttgtcgttaatacgcgtacgggtgaaattcgtttggataaattttacgttttgttggattgcggtatatcggttaatttagagttagcgttgggataaatttacggtgttattttgcgtgttatcggttatagtatgagcgaagagattatttatgacgtcgaaggttattcgttaacgcgtgatttacgtagttacggcgtatcgaaaattggtgatatttcgcgtgattttcgcgttgtgttggtgtcgagcgacgataagtcggttcgttcggggcgaaatcgatttcggaaatcggtgtaaatggcgtagtttt

SEQ ID NO: 32012 - DNA, 657 bp, Artificial Sequence
  chemically treated genomic DNA (Homo sapiens) CpG-island No: 32012
aaaactacgccatttacaccgatttccgaaatcgatttcgccccgaacgaaccgacttatcgtcgctcgacaccaacacaacgcgaaaatcacgcgaaatatcaccaattttcgatacgccgtaactacgtaaatcacgcgttaacgaataaccttcgacgtcataaataatctcttcgctcatactataaccgataacacgcaaaataacaccgtaaatttatcccaacgctaactctaaattaaccgatataccgcaatccaacaaaacgtaaaatttatccaaacgaatttcacccgtacgcgtattaacgacaacttcaacgaaatttacgccatacgaaaaaacgaaatcaaacgtaatataactaccaattcccaccaataaaccaaaaccgataccgatttcgcctttataaacaatatccccgaaactaacttcgcctttcttaccgcgcacgacgcccgacgttaccaattaaacatctaccactaactcacccaacatttacgcgccgtaaaacaaaattttctcccgtaaattttccgctaccaaacgcgccgcgttacccgaaaaacaaataccgaacgaaacatatacgcctttatcaaacaacgcataatcgatatctaccgaaaaaaaattttaccaattta

SEQ ID NO: 32013 - DNA, 650 bp, Artificial Sequence
  chemically treated genomic DNA (Homo sapiens) CpG-island No: 32013
atacgttcgttatattgtcgtagttttttgaagttcgcgtttcgtatgtgttgggaatattttttcgcgaataggttagcgaatttttttttggtttgttgattggcgtagaggtcgttagtatgcgcgattatgtggtttattaatacgttattatttttgtcgtcggaatatcgttgatcgcgcgttattagtaagttttttaggcgatgggttgcgacgtgacggcggtggcgggcgatacggtattttaggttggtataaggagtatcgtttatgtagtggtaaattaaattttcgttgatcgttattttgcgcggtattacgttcgacgaggcgttggcgtatgttggcgcggtgattgacgtcgggttcgacgcggttgaaatttcgttgaattttttataatgggagtaaagtattttcgttatcgttgatgcgtacggcgataaggcgttgattggcgtaggtacggtattgaaatttgaataggtcgatgcgttcgttaggatgggttgttagtttatcgttacgtttaatatttatagtgaagtgattcgtcgtgcggtgggttacggtatgatcgtttgtttcggttgcgcgacggcgatcgaagtttttatcgcgttcgaagcgggcgcgtaggcgtt

SEQ ID NO: 32014 - DNA, 650 bp, Artificial Sequence
  chemically treated genomic DNA (Homo sapiens) CpG-island No: 32014
aacgcctacgcgcccgcttcgaacgcgataaaaacttcgatcgccgtcgcgcaaccgaaacaaacgatcataccgtaacccaccgcacgacgaatcacttcactataaatattaaacgtaacgataaactaacaacccatcctaacgaacgcatcgacctattcaaatttcaataccgtacctacgccaatcaacgccttatcgccgtacgcatcaacgataacgaaaatactttactcccattataaaaaattcaacgaaatttcaaccgcgtcgaacccgacgtcaatcaccgcgccaacatacgccaacgcctcgtcgaacgtaataccgcgcaaaataacgatcaacgaaaatttaatttaccactacataaacgatactccttataccaacctaaaataccgtatcgcccgccaccgccgtcacgtcgcaacccatcgcctaaaaaacttactaataacgcgcgatcaacgatattccgacgacaaaaataataacgtattaataaaccacataatcgcgcatactaacgacctctacgccaatcaacaaaccaaaaaaaaattcgctaacctattcgcgaaaaaatattcccaacacatacgaaacgcgaacttcaaaaaactacgacaatataacgaacgtat

SEQ ID NO: 32015 - DNA, 650 bp, Artificial Sequence
  chemically treated genomic DNA (Homo sapiens) CpG-island No: 32015
agcgtttgcgcgttcgtttcgagcgcggtaaaggtttcggtcgtcgtcgcgtagtcggggtagacggttatgtcgtagtttatcgtacggcggattattttattatggatattgggcgtaacgatgagttgatagtttattttggcgagcgtatcgatttgtttaggttttagtatcgtatttgcgttaattaacgttttgtcgtcgtacgtattaacgatggcgggaatgttttgtttttattgtggggaatttagcgggattttaatcgcgtcgaattcggcgttaattatcgcgttaatatgcgttagcgtttcgtcgggcgtaatatcgcgtaaaatggcgattagcgggagtttagtttgttattgtatgagcgatgttttttatattagtttgaaatgtcgtgtcgttcgttatcgtcgttacgtcgtaatttatcgtttgaaaggtttgttggtagcgcgcggttagcgatgtttcggcgataagggtgatggcgtgttgatgggttatatagtcgcgtatattggcgatttttgcgttaattaataaattagagagaaattcgttgatttgttcgcggggaagtgtttttagtatatgcgaggcgcgaattttaaaaagttgcggtaatatggcgggcgtat

SEQ ID NO: 32016 - DNA, 650 bp, Artificial Sequence
  chemically treated genomic DNA (Homo sapiens) CpG-island No: 32016
atacgcccgccatattaccgcaactttttaaaattcgcgcctcgcatatactaaaaacacttccccgcgaacaaatcaacgaatttctctctaatttattaattaacgcaaaaatcgccaatatacgcgactatataacccatcaacacgccatcacccttatcgccgaaacatcgctaaccgcgcgctaccaacaaacctttcaaacgataaattacgacgtaacgacgataacgaacgacacgacatttcaaactaatataaaaaacatcgctcatacaataacaaactaaactcccgctaatcgccattttacgcgatattacgcccgacgaaacgctaacgcatattaacgcgataattaacgccgaattcgacgcgattaaaatcccgctaaattccccacaataaaaacaaaacattcccgccatcgttaatacgtacgacgacaaaacgttaattaacgcaaatacgatactaaaacctaaacaaatcgatacgctcgccaaaataaactatcaactcatcgttacgcccaatatccataataaaataatccgccgtacgataaactacgacataaccgtctaccccgactacgcgacgacgaccgaaacctttaccgcgctcgaaacgaacgcgcaaacgct

SEQ ID NO: 32017 - DNA, 555 bp, Artificial Sequence
  chemically treated genomic DNA (Homo sapiens) CpG-island No: 32017
tagttttcgttggttaggcgtaggttaagtagttttagtaatttcggatcgttatcgattaataataaatgcgtaggtttatggtttattaggagtgattttatgggtggatggcgcgggttttttattttcgtgcggcgtattcggcgagaaatttttagtcggtttgcgggtcgagagttggcgtttaatatcggttaggttttttagttttgcgggtggtgagttttagttgttgttgtagaacgtgatgttgttggcgtaatgtatttagttcgttgtcgttggattgttggagtttattgtaacgttggcgttttttcgttagttgtagttgtagcgtttgattatcgcgttagagttgatatagtgggcgaatttgtgtcgggatttcggtatttaacgttttaatacgcgcgattagttggcggcgtttatacggcgtaattttggcgtcggcgagtaaaattttttgtttaaaggtattttgttagttgtcgtcgttatattggcgagtttgttgacgcgattgcgtaggtattaaacgattagtat

SEQ ID NO: 32018 - DNA, 555 bp, Artificial Sequence
  chemically treated genomic DNA (Homo sapiens) CpG-island No: 32018
atactaatcgtttaatacctacgcaatcgcgtcaacaaactcgccaatataacgacgacaactaacaaaatacctttaaacaaaaaattttactcgccgacgccaaaattacgccgtataaacgccgccaactaatcgcgcgtattaaaacgttaaataccgaaatcccgacacaaattcgcccactatatcaactctaacgcgataatcaaacgctacaactacaactaacgaaaaaacgccaacgttacaataaactccaacaatccaacgacaacgaactaaatacattacgccaacaacatcacgttctacaacaacaactaaaactcaccacccgcaaaactaaaaaacctaaccgatattaaacgccaactctcgacccgcaaaccgactaaaaatttctcgccgaatacgccgcacgaaaataaaaaacccgcgccatccacccataaaatcactcctaataaaccataaacctacgcatttattattaatcgataacgatccgaaattactaaaactacttaacctacgcctaaccaacgaaaacta

SEQ ID NO: 32019 - DNA, 555 bp, Artificial Sequence
  chemically treated genomic DNA (Homo sapiens) CpG-island No: 32019
gtgttgatcgtttaatgtttgcgtagtcgcgttagtaagttcgttaatatgacgacggtagttggtaaaatatttttaaataagggattttgttcgtcgacgttaaaattacgtcgtatgagcgtcgttagttggtcgcgcgtattgaagcgttaagtatcgagatttcggtataggttcgtttattgtattaattttggcgcgatggttaggcgttgtaattgtaattggcggaagagcgttaacgttatagtaaattttagtagtttagcgatagcgagttggatatattgcgttagtaatattacgttttatagtagtaattggaatttattattcgtaaggttggaaaatttgatcgatattgaacgttagttttcgattcgtaaatcggttggaaatttttcgtcggatacgtcgtacgagagtgaaaagttcgcgttatttatttatgaggttatttttgatgagttataaatttgcgtatttattattggtcgatgacgattcgggattgttgaaattgtttggtttgcgtttgattagcgaaggtta

SEQ ID NO: 32020 - DNA, 555 bp, Artificial Sequence
  chemically treated genomic DNA (Homo sapiens) CpG-island No: 32020
taaccttcgctaatcaaacgcaaaccaaacaatttcaacaatcccgaatcgtcatcgaccaataataaatacgcaaatttataactcatcaaaaataacctcataaataaataacgcgaacttttcactctcgtacgacgtatccgacgaaaaatttccaaccgatttacgaatcgaaaactaacgttcaatatcgatcaaattttccaaccttacgaataataaattccaattactactataaaacgtaatattactaacgcaatatatccaactcgctatcgctaaactactaaaatttactataacgttaacgctcttccgccaattacaattacaacgcctaaccatcgcgccaaaattaatacaataaacgaacctataccgaaatctcgatacttaacgcttcaatacgcgcgaccaactaacgacgctcatacgacgtaattttaacgtcgacgaacaaaatcccttatttaaaaatattttaccaactaccgtcgtcatattaacgaacttactaacgcgactacgcaaacattaaacgatcaacac

SEQ ID NO: 32021 - DNA, 701 bp, Artificial Sequence
  chemically treated genomic DNA (Homo sapiens) CpG-island No: 32021
tacgcgttcggttattagatatatttttcggcggaaggggtagtaatagtgttatcgataaggaggaggagtcgttaagaaatatagttaaatttagaacgtacggtatcgttaggtcgcgatagtaggaaaagcgtacgtttcgagtttggggagttcgttgtagggattaggtttcggatacgtagggtaggtagtcgggggtataggttttagattcgggagtacgcgcggtttggagtaaagcggcggaagatagtatttattttgcgtggatatcggatttcgtagttttcggtttggtttttaggaggtttgtatttttagttgggttcggttttcgcggttttcgtttggagttttagtttagttttttgagtgcgacggggcggggcggtttcgggaaggcgacgtaggatgtttttcgtttttttgttcggcggtttcgtttcgggagttcgggatgcgtggggagggaggtttcgtttcgtggattcgttatgcgtttggtatttggagattggtttatttaataacgtagtttgtgatgcggattacgtgttgtgtgggttgcgtatcgtcggttgattataggttatcgttttttcggttgttattttgtgattattagaataaggtaacgacggtgggtgtatttcgtaaatatgttttttcgaagattttttttgaaattataaagt

SEQ ID NO: 32022 - DNA, 701 bp, Artificial Sequence
  chemically treated genomic DNA (Homo sapiens) CpG-island No: 32022
actttataatttcaaaaaaaatcttcgaaaaaacatatttacgaaatacacccaccgtcgttaccttattctaataatcacaaaataacaaccgaaaaaacgataacctataatcaaccgacgatacgcaacccacacaacacgtaatccgcatcacaaactacgttattaaataaaccaatctccaaataccaaacgcataacgaatccacgaaacgaaacctccctccccacgcatcccgaactcccgaaacgaaaccgccgaacaaaaaaacgaaaaacatcctacgtcgccttcccgaaaccgccccgccccgtcgcactcaaaaaactaaactaaaactccaaacgaaaaccgcgaaaaccgaacccaactaaaaatacaaacctcctaaaaaccaaaccgaaaactacgaaatccgatatccacgcaaaataaatactatcttccgccgctttactccaaaccgcgcgtactcccgaatctaaaacctatacccccgactacctaccctacgtatccgaaacctaatccctacaacgaactccccaaactcgaaacgtacgcttttcctactatcgcgacctaacgataccgtacgttctaaatttaactatatttcttaacgactcctcctccttatcgataacactattactaccccttccgccgaaaaatatatctaataaccgaacgcgta

SEQ ID NO: 32023 - DNA, 701 bp, Artificial Sequence
  chemically treated genomic DNA (Homo sapiens) CpG-island No: 32023
attttatagttttaaaagaggttttcgggggagtatatttgcgaagtgtatttatcgtcgttgttttattttggtagttatagggtgatagtcgagggagcggtaatttgtaattagtcggcggtgcgtagtttatatagtacgtggttcgtattataggttgcgttattgagtgagttagtttttagatgttaggcgtatgacgagtttacggagcgggatttttttttttacgtatttcgggttttcggggcggggtcgtcgggtaggggggcggggagtattttgcgtcgttttttcgggatcgtttcgtttcgtcgtatttagagagttgggttggagttttaagcggaaatcgcgggagtcgagtttagttaggaatgtagattttttgaaaattaagtcgaggattgcggggttcggtgtttacgtagagtgagtattgtttttcgtcgttttgttttaggtcgcgcgtgttttcgggtttagggtttgtgttttcggttatttgttttgcgtgttcggggtttggtttttgtagcggattttttaggttcgggacgtgcgttttttttattatcgcgatttggcgatatcgtgcgttttgagtttaattgtgttttttggcgattttttttttttgtcggtaatattgttattgtttttttcgtcgggaaatgtatttggtgatcggacgcgta

SEQ ID NO: 32024 - DNA, 701 bp, Artificial Sequence
  chemically treated genomic DNA (Homo sapiens) CpG-island No: 32024
tacgcgtccgatcaccaaatacatttcccgacgaaaaaaacaataacaatattaccgacaaaaaaaaaaaatcgccaaaaaacacaattaaactcaaaacgcacgatatcgccaaatcgcgataataaaaaaaacgcacgtcccgaacctaaaaaatccgctacaaaaaccaaaccccgaacacgcaaaacaaataaccgaaaacacaaaccctaaacccgaaaacacgcgcgacctaaaacaaaacgacgaaaaacaatactcactctacgtaaacaccgaaccccgcaatcctcgacttaattttcaaaaaatctacattcctaactaaactcgactcccgcgatttccgcttaaaactccaacccaactctctaaatacgacgaaacgaaacgatcccgaaaaaacgacgcaaaatactccccgcccccctacccgacgaccccgccccgaaaacccgaaatacgtaaaaaaaaaaatcccgctccgtaaactcgtcatacgcctaacatctaaaaactaactcactcaataacgcaacctataatacgaaccacgtactatataaactacgcaccgccgactaattacaaattaccgctccctcgactatcaccctataactaccaaaataaaacaacgacgataaatacacttcgcaaatatactcccccgaaaacctcttttaaaactataaaat

SEQ ID NO: 32025 - DNA, 545 bp, Artificial Sequence
  chemically treated genomic DNA (Homo sapiens) CpG-island No: 32025
gcgaacggtttagtttaggttttgcgttagagtatcgtattcgggggcggacggttttgtagttttttagttttttttcgtattaattagttgacgttcgggcgtattggtttttttcgttttcgttcgtacgaaagttttgttcgacgtttgtagttagtatcgttcgtattgtttagggagggtttgcgtcgagatttagtggtcgagtgagttatagagtcgttggttttggggacgttgttttttatcgttttttatcgttttttttttttttgtattttatttcggtatttcgtattttttttttcgttcggtttcgcgtattttgtttagattttataagtattttttcggggtatttaggattcgacgtttttttcgcgtcgttagcggcgttcgttatttttggtacgtcggagggatcgttttcggttttttgcgcggcgttttttaggggatttttagtttattttttatttagttgttcgggtttcgacgttttatttttgtcgaattgggggatatcgaggttgagttcgatt

SEQ ID NO: 32026 - DNA, 545 bp, Artificial Sequence
  chemically treated genomic DNA (Homo sapiens) CpG-island No: 32026
aatcgaactcaacctcgatatcccccaattcgacaaaaataaaacgtcgaaacccgaacaactaaataaaaaataaactaaaaatcccctaaaaaacgccgcgcaaaaaaccgaaaacgatccctccgacgtaccaaaaataacgaacgccgctaacgacgcgaaaaaaacgtcgaatcctaaataccccgaaaaaatacttataaaatctaaacaaaatacgcgaaaccgaacgaaaaaaaaaatacgaaataccgaaataaaatacaaaaaaaaaaaaaacgataaaaaacgataaaaaacaacgtccccaaaaccaacgactctataactcactcgaccactaaatctcgacgcaaaccctccctaaacaatacgaacgatactaactacaaacgtcgaacaaaactttcgtacgaacgaaaacgaaaaaaaccaatacgcccgaacgtcaactaattaatacgaaaaaaaactaaaaaactacaaaaccgtccgcccccgaatacgatactctaacgcaaaacctaaactaaaccgttcgc

SEQ ID NO: 32027 - DNA, 545 bp, Artificial Sequence
  chemically treated genomic DNA (Homo sapiens) CpG-island No: 32027
ggtcgggtttagtttcggtgttttttagttcggtaaaggtaaggcgtcgggattcggatagttgggtgagggatgggttgggagttttttgagaaacgtcgcgtagggggtcggaggcggttttttcggcgtgttaagggtggcgagcgtcgttggcggcgcggaggaggcgtcgagttttgggtgtttcgagaaagtgtttgtaaagtttgagtagagtgcgcggggtcgagcggggagaagggtgcggggtatcggggtgagatataggaaagaggaggacggtggggagcggtagaagatagcgtttttaggattagcgattttgtggtttattcggttattgggtttcggcgtaaattttttttaggtagtgcgggcgatgttgattgtagacgtcgggtagggttttcgtgcgggcgggagcgggggaagttagtgcgttcgggcgttagttagttgatgcgggaagaggttggggagttgtagggtcgttcgttttcgggtgcggtgttttggcgtagggtttgggttgagtcgttcgt

SEQ ID NO: 32028 - DNA, 545 bp, Artificial Sequence
  chemically treated genomic DNA (Homo sapiens) CpG-island No: 32028
acgaacgactcaacccaaaccctacgccaaaacaccgcacccgaaaacgaacgaccctacaactccccaacctcttcccgcatcaactaactaacgcccgaacgcactaacttcccccgctcccgcccgcacgaaaaccctacccgacgtctacaatcaacatcgcccgcactacctaaaaaaaatttacgccgaaacccaataaccgaataaaccacaaaatcgctaatcctaaaaacgctatcttctaccgctccccaccgtcctcctctttcctatatctcaccccgataccccgcacccttctccccgctcgaccccgcgcactctactcaaactttacaaacactttctcgaaacacccaaaactcgacgcctcctccgcgccgccaacgacgctcgccacccttaacacgccgaaaaaaccgcctccgaccccctacgcgacgtttctcaaaaaactcccaacccatccctcacccaactatccgaatcccgacgccttacctttaccgaactaaaaaacaccgaaactaaacccgacc

SEQ ID NO: 32029 - DNA, 872 bp, Artificial Sequence
  chemically treated genomic DNA (Homo sapiens) CpG-island No: 32029
gttattatcggggaatcggtatcggtgattcgtgaattcggcggcgattttgttttcgttatcggcggtacgcgtattttttttgattggttggtgattgagtgtagcgttaatttcggcgagatatttttggatcggatgatcgcgatggtggaaggcgtatagcgacgtataacgtcgaacgaaattgttttgattattttgttgattgttttgattatcgtttttttattggtaatcgttacgttgtggtcgtttttcgcgtggggcggtaatgtagttagcgtaacggtattggtggcgttgttggtttgtttgattttaattattattggcggtttgttgttagcgatcggcgtcgtcgggatgagtcggatgttaggcgcgaatgtgattgttattagcggacgtgtagttgaagcggtaggtgacgttgacgttttgttattggataaaatcggtattattatattcggtaatcgttaggcgtcggagtttattttcgcgtagggcgtggataaaaaacgttggttgacgtcgtataattggtttcgttggttgatgaaacgtcggaaggtcgtagtattgtgattttcgttaagtagcgttttaatttgcgcgagcgcgatgtgtagtcgttttatgttatttttgtatcgtttattgcgtaaagtcggatgagcgggattaatatcgataatcgtatgattcgtaaaggttttgtcgatgttattcgtcgttatgttgaggttaacggtggttatttttttatcgatgttggattataaagtcgattaggttgcgcgttaggagttacgtcgttagtggtggtggaagggtttcgtgttgttgagcgttattgcgtttaaaga

SEQ ID NO: 32030 - DNA, 872 bp, Artificial Sequence
  chemically treated genomic DNA (Homo sapiens) CpG-island No: 32030
tctttaaacgcaataacgctcaacaacacgaaacccttccaccaccactaacgacgtaactcctaacgcgcaacctaatcgactttataatccaacatcgataaaaaaataaccaccgttaacctcaacataacgacgaataacatcgacaaaacctttacgaatcatacgattatcgatattaatcccgctcatccgactttacgcaataaacgatacaaaaataacataaaacgactacacatcgcgctcgcgcaaattaaaacgctacttaacgaaaatcacaatactacgaccttccgacgtttcatcaaccaacgaaaccaattatacgacgtcaaccaacgttttttatccacgccctacgcgaaaataaactccgacgcctaacgattaccgaatataataataccgattttatccaataacaaaacgtcaacgtcacctaccgcttcaactacacgtccgctaataacaatcacattcgcgcctaacatccgactcatcccgacgacgccgatcgctaacaacaaaccgccaataataattaaaatcaaacaaaccaacaacgccaccaataccgttacgctaactacattaccgccccacgcgaaaaacgaccacaacgtaacgattaccaataaaaaaacgataatcaaaacaatcaacaaaataatcaaaacaatttcgttcgacgttatacgtcgctatacgccttccaccatcgcgatcatccgatccaaaaatatctcgccgaaattaacgctacactcaatcaccaaccaatcaaaaaaaatacgcgtaccgccgataacgaaaacaaaatcgccgccgaattcacgaatcaccgataccgattccccgataataac

SEQ ID NO: 32031 - DNA, 872 bp, Artificial Sequence
  chemically treated genomic DNA (Homo sapiens) CpG-island No: 32031
tttttaagcgtaataacgtttagtaatacgagatttttttattattattagcggcgtggtttttgacgcgtaatttgatcgattttgtgatttaatatcggtagggaagtgattatcgttagttttaatatggcgacgaatggtatcgatagaatttttacggattatgcggttgtcgatgttgatttcgtttattcggttttgcgtagtaaacggtataaaggtggtatggagcgattgtatatcgcgttcgcgtaggttaaaacgttgtttggcgaggattataatattgcggtttttcggcgttttattagttagcgaagttagttgtgcggcgttagttagcgttttttatttacgttttgcgcggggataaatttcgacgtttgacggttatcgagtgtgatggtgtcggttttatttagtagtagaacgttaacgttatttgtcgttttaattgtacgttcgttggtggtaattatattcgcgtttagtattcggtttatttcggcgacgtcgatcgttgataataggtcgttaatagtggttgggattagatagattagtagcgttattagtatcgttacgttgattgtattatcgttttacgcggaaaacggttatagcgtggcggttgttagtaaaaagacgatagttagggtaattagtagaatggttagggtaatttcgttcggcgttgtgcgtcgttgtgcgttttttattatcgcgattattcgatttagaaatgtttcgtcggggttaacgttatatttaattattagttagttagaaagaatacgcgtgtcgtcggtgacggaggtaaaatcgtcgtcggatttacggattatcggtgtcgatttttcggtgatggt

SEQ ID NO: 32032 - DNA, 872 bp, Artificial Sequence
  chemically treated genomic DNA (Homo sapiens) CpG-island No: 32032
accatcaccgaaaaatcgacaccgataatccgtaaatccgacgacgattttacctccgtcaccgacgacacgcgtattctttctaactaactaataattaaatataacgttaaccccgacgaaacatttctaaatcgaataatcgcgataataaaaaacgcacaacgacgcacaacgccgaacgaaattaccctaaccattctactaattaccctaactatcgtctttttactaacaaccgccacgctataaccgttttccgcgtaaaacgataatacaatcaacgtaacgatactaataacgctactaatctatctaatcccaaccactattaacgacctattatcaacgatcgacgtcgccgaaataaaccgaatactaaacgcgaatataattaccaccaacgaacgtacaattaaaacgacaaataacgttaacgttctactactaaataaaaccgacaccatcacactcgataaccgtcaaacgtcgaaatttatccccgcgcaaaacgtaaataaaaaacgctaactaacgccgcacaactaacttcgctaactaataaaacgccgaaaaaccgcaatattataatcctcgccaaacaacgttttaacctacgcgaacgcgatatacaatcgctccataccacctttataccgtttactacgcaaaaccgaataaacgaaatcaacatcgacaaccgcataatccgtaaaaattctatcgataccattcgtcgccatattaaaactaacgataatcacttccctaccgatattaaatcacaaaatcgatcaaattacgcgtcaaaaaccacgccgctaataataataaaaaaatctcgtattactaaacgttattacgcttaaaaa

SEQ ID NO: 32033 - DNA, 555 bp, Artificial Sequence
  chemically treated genomic DNA (Homo sapiens) CpG-island No: 32033
gggtttatcgggcgggaatttttttttagtcgtttggtggaggtatcgttgttgacggtaataattaagcggttatttagtttgcgggtatttgttagataagagacgtgttcggcgtgtaggatgttaaagatatcgttggttattattatttttttattacgtttacgcgttgtcgttacggttagttttagttttttttcggttattacgttaaagtttgtatttgtacgtttacgtatagtattttttagttcgatcggcgaaatcgtggaggtttttagtttgtcgattattacgttagtcgtcgtattggtaaagaagtaggttttttttagcgaattattcgttgttagcgttgtcgttaggacgttaattatcgtgtcgttcgtatcggtacgttatatattttttgcgtttgggttggtatatgtagcggcgttttattcggttgtagtagcgatatattttgttcggaacgggttattaatagagtcgagagttcgtaatcggtaattagttttatgtcgcgtttaataatttttttttcggttt

SEQ ID NO: 32034 - DNA, 555 bp, Artificial Sequence
  chemically treated genomic DNA (Homo sapiens) CpG-island No: 32034
aaaccgaaaaaaaaattattaaacgcgacataaaactaattaccgattacgaactctcgactctattaataacccgttccgaacaaaatatatcgctactacaaccgaataaaacgccgctacatataccaacccaaacgcaaaaaatatataacgtaccgatacgaacgacacgataattaacgtcctaacgacaacgctaacaacgaataattcgctaaaaaaaacctacttctttaccaatacgacgactaacgtaataatcgacaaactaaaaacctccacgatttcgccgatcgaactaaaaaatactatacgtaaacgtacaaatacaaactttaacgtaataaccgaaaaaaaactaaaactaaccgtaacgacaacgcgtaaacgtaataaaaaaataataataaccaacgatatctttaacatcctacacgccgaacacgtctcttatctaacaaatacccgcaaactaaataaccgcttaattattaccgtcaacaacgatacctccaccaaacgactaaaaaaaaattcccgcccgataaaccc

SEQ ID NO: 32035 - DNA, 555 bp, Artificial Sequence
  chemically treated genomic DNA (Homo sapiens) CpG-island No: 32035
agatcgaagaagagattgttgagcgcggtatgaaattgattgtcgattacgaattttcggttttgttagtgattcgtttcgaatagggtatgtcgttgttgtaatcgggtaaagcgtcgttgtatatgttaatttaagcgtaggaagtgtatgacgtatcggtgcgggcgatacggtgattggcgttttggcggtaacgttggtagcgggtaattcgttggaagaagtttgtttttttgttaatgcggcggttggcgtggtggtcggtaaattgggaatttttacggtttcgtcgatcgagttggaaaatgttgtacgtggacgtgtagatataggttttggcgtgatgatcgaagaggaattgaagttggtcgtagcggtagcgcgtaaacgtggtgaaaaagtggtgatgattaacggtgtttttgatattttgtacgtcgggtacgttttttatttggtaaatgttcgtaagttgggtgatcgtttgattgttgtcgttaatagcgatgtttttattaaacggttgaaaggggattttcgttcggtaaattt

SEQ ID NO: 32036 - DNA, 555 bp, Artificial Sequence
  chemically treated genomic DNA (Homo sapiens) CpG-island No: 32036
aaatttaccgaacgaaaatcccctttcaaccgtttaataaaaacatcgctattaacgacaacaatcaaacgatcacccaacttacgaacatttaccaaataaaaaacgtacccgacgtacaaaatatcaaaaacaccgttaatcatcaccactttttcaccacgtttacgcgctaccgctacgaccaacttcaattcctcttcgatcatcacgccaaaacctatatctacacgtccacgtacaacattttccaactcgatcgacgaaaccgtaaaaattcccaatttaccgaccaccacgccaaccgccgcattaacaaaaaaacaaacttcttccaacgaattacccgctaccaacgttaccgccaaaacgccaatcaccgtatcgcccgcaccgatacgtcatacacttcctacgcttaaattaacatatacaacgacgctttacccgattacaacaacgacataccctattcgaaacgaatcactaacaaaaccgaaaattcgtaatcgacaatcaatttcataccgcgctcaacaatctcttcttcgatct

SEQ ID NO: 32037 - DNA, 1283 bp, Artificial Sequence
  chemically treated genomic DNA (Homo sapiens) CpG-island No: 32037
gtttttatcgtaattcgagggcggggggcgtagtagcgcggtttcgggatcgtcgggcgggtttcgaggtttcggggttgagacgggcgtcgggggttcggggatttttttcggtcgttgaggtggttgcggtcgcgcgtttagttcgggggtcgggaatttttggcggcgcggatttcgtcgttttcgtcgttttagttatcgggcgtgtgtgtagttcgggtttttttttttttgtttcgtcgcgagtcgggcgcgatttcgaggcggttcggttatttattatattatagatggaggcgatgtttcggatagttattagtttaaaggttgtagcgattttttatcgttatttttataaggggaaatcgggattgtttatggtggcgcgttggcggggaggtcgggcggtagcgcggcggtttggggttcggtttttagtttggttgggagagggaggtcgggaggaggaggcggcggcgcggggagggcggggagggagcgcggaggggcggggagtggcggagcgagggagtttgggtcgcggtcggcggcgcggggaggaggggcggttcgggcgcgtcgcgtgagttcgagtcggtcgtttagagcgttttaggttgggttttcgggtttcgtcgcgtcgttttttttttagttcgttcgtttaggtttggttttttgtttttttatttgattttttgtttttttttattcggattggaatgtcgggttaggtttcggggcgcgtcgttgcggtagtcgtatttcgtaggtttttcggtcgatttcgacgcggaagcggcggtttttttcgtcgtcggggagttagggagtcggggacggtacggtgcgcggggtggggaagcgggcggtttaggtcggggcgaattcggggtcgtttttcgttttcgtttttttttcgtcgttttttttttggcgggtttcggtagttttcggtgtttattttttggcgaggggtaggggtggcgacgtttaatttttagtttttttcgagggttttaattagatggtatcggcggggatttaagaagtaaaatggggcgaggatatcggagcggttagagagttttcgttagttgcgggtcgggcgttcgagaaagggcgtcgggaagggggaggaattcgggtttgggcggaggttagtagcggcgcgttcgggcggtttgtgatattagcgggtttaaaggagacgtttcggtttcgcgtaagtattagggattgtttaaggagtggaaagaacgaaaataaaatttttttat

SEQ ID NO: 32038 - DNA, 1283 bp, Artificial Sequence
  chemically treated genomic DNA (Homo sapiens) CpG-island No: 32038
ataaaaaaattttattttcgttctttccactccttaaacaatccctaatacttacgcgaaaccgaaacgtctcctttaaacccgctaatatcacaaaccgcccgaacgcgccgctactaacctccgcccaaacccgaattcctcccccttcccgacgccctttctcgaacgcccgacccgcaactaacgaaaactctctaaccgctccgatatcctcgccccattttacttcttaaatccccgccgataccatctaattaaaaccctcgaaaaaaactaaaaattaaacgtcgccacccctacccctcgccaaaaaataaacaccgaaaactaccgaaacccgccaaaaaaaaaacgacgaaaaaaaaacgaaaacgaaaaacgaccccgaattcgccccgacctaaaccgcccgcttccccaccccgcgcaccgtaccgtccccgactccctaactccccgacgacgaaaaaaaccgccgcttccgcgtcgaaatcgaccgaaaaacctacgaaatacgactaccgcaacgacgcgccccgaaacctaacccgacattccaatccgaataaaaaaaaacaaaaaatcaaataaaaaaacaaaaaaccaaacctaaacgaacgaactaaaaaaaaaacgacgcgacgaaacccgaaaacccaacctaaaacgctctaaacgaccgactcgaactcacgcgacgcgcccgaaccgcccctcctccccgcgccgccgaccgcgacccaaactccctcgctccgccactccccgcccctccgcgctccctccccgccctccccgcgccgccgcctcctcctcccgacctccctctcccaaccaaactaaaaaccgaaccccaaaccgccgcgctaccgcccgacctccccgccaacgcgccaccataaacaatcccgatttccccttataaaaataacgataaaaaatcgctacaacctttaaactaataactatccgaaacatcgcctccatctataatataataaataaccgaaccgcctcgaaatcgcgcccgactcgcgacgaaacaaaaaaaaaaaaacccgaactacacacacgcccgataactaaaacgacgaaaacgacgaaatccgcgccgccaaaaattcccgacccccgaactaaacgcgcgaccgcaaccacctcaacgaccgaaaaaaatccccgaacccccgacgcccgtctcaaccccgaaacctcgaaacccgcccgacgatcccgaaaccgcgctactacgccccccgccctcgaattacgataaaaac

SEQ ID NO: 32039 - DNA, 1283 bp, Artificial Sequence
  chemically treated genomic DNA (Homo sapiens) CpG-island No: 32039
atggaaaagttttgttttcgttttttttattttttggatagtttttagtgtttgcgcggaatcgggacgttttttttggattcgttaatgttataagtcgttcgagcgcgtcgttgttggttttcgtttagattcggattttttttttttttcggcgttttttttcgggcgttcggttcgtagttggcgagggttttttgatcgtttcggtgttttcgttttattttattttttgggttttcgtcggtgttatttggttggaattttcgggaggaattaaaagttggacgtcgttatttttatttttcgttaaaaaataaatatcgggggttgtcgaggttcgttaggaggaaggcgacgaggaaaaagcgaggacggaaggcggtttcgggttcgtttcggtttgggtcgttcgtttttttatttcgcgtatcgtatcgttttcggttttttggtttttcgacggcgaggagggtcgtcgttttcgcgtcggggtcggtcgggggatttgcgaggtgcggttgtcgtagcggcgcgtttcggagtttggttcggtattttagttcgaatagaaagaggtagggaattaaatggaaaagtaggaggttaggtttgggcgggcgagttgggaaggaggcggcgcggcggggttcgggaatttagtttggagcgttttgagcggtcggttcggatttacgcggcgcgttcgggtcgtttttttttttcgcgtcgtcggtcgcggtttaggttttttcgtttcgttatttttcgttttttcgcgtttttttttcgtttttttcgcgtcgtcgtttttttttttcggttttttttttttagttaaattgaaagtcggattttaggtcgtcgcgttgtcgttcggttttttcgttagcgcgttattatgggtagtttcggtttttttttgtaaagatggcggtgagggatcgttgtaatttttagattaatgattgttcgaaatatcgtttttatttgtaatatggtgagtggtcgagtcgtttcggggtcgcgttcgattcgcggcgaggtaaagaaagggaagttcgagttgtatatacgttcggtggttggggcggcgggggcggcggggttcgcgtcgttagaagttttcggttttcgagttgggcgcgcggtcgtagttattttagcggtcggggagggttttcgagttttcggcgttcgttttagtttcgggatttcggaattcgttcggcgatttcggggtcgcgttgttgcgtttttcgttttcgggttgcggtggaagt

SEQ ID NO: 32040 - DNA, 1283 bp, Artificial Sequence
  chemically treated genomic DNA (Homo sapiens) CpG-island No: 32040
acttccaccgcaacccgaaaacgaaaaacgcaacaacgcgaccccgaaatcgccgaacgaattccgaaatcccgaaactaaaacgaacgccgaaaactcgaaaaccctccccgaccgctaaaataactacgaccgcgcgcccaactcgaaaaccgaaaacttctaacgacgcgaaccccgccgcccccgccgccccaaccaccgaacgtatatacaactcgaacttccctttctttacctcgccgcgaatcgaacgcgaccccgaaacgactcgaccactcaccatattacaaataaaaacgatatttcgaacaatcattaatctaaaaattacaacgatccctcaccgccatctttacaaaaaaaaaccgaaactacccataataacgcgctaacgaaaaaaccgaacgacaacgcgacgacctaaaatccgactttcaatttaactaaaaaaaaaaaaccgaaaaaaaaaaacgacgacgcgaaaaaaacgaaaaaaaaacgcgaaaaaacgaaaaataacgaaacgaaaaaacctaaaccgcgaccgacgacgcgaaaaaaaaaaacgacccgaacgcgccgcgtaaatccgaaccgaccgctcaaaacgctccaaactaaattcccgaaccccgccgcgccgcctccttcccaactcgcccgcccaaacctaacctcctacttttccatttaattccctacctctttctattcgaactaaaataccgaaccaaactccgaaacgcgccgctacgacaaccgcacctcgcaaatcccccgaccgaccccgacgcgaaaacgacgaccctcctcgccgtcgaaaaaccaaaaaaccgaaaacgatacgatacgcgaaataaaaaaacgaacgacccaaaccgaaacgaacccgaaaccgccttccgtcctcgctttttcctcgtcgccttcctcctaacgaacctcgacaacccccgatatttattttttaacgaaaaataaaaataacgacgtccaacttttaattcctcccgaaaattccaaccaaataacaccgacgaaaacccaaaaaataaaataaaacgaaaacaccgaaacgatcaaaaaaccctcgccaactacgaaccgaacgcccgaaaaaaaacgccgaaaaaaaaaaaaaatccgaatctaaacgaaaaccaacaacgacgcgctcgaacgacttataacattaacgaatccaaaaaaaacgtcccgattccgcgcaaacactaaaaactatccaaaaaataaaaaaaacgaaaacaaaacttttccat

SEQ ID NO: 32041 - DNA, 876 bp, Artificial Sequence
  chemically treated genomic DNA (Homo sapiens) CpG-island No: 32041
gagaagaacgagttttacgtcgttttttttttttcgggttaattgtagttcgcgggcggtaggaaggtagtcgcgcggggtgggtttttggggattgggcgtagggtttcgcggcgcggttgggttgcggttgttcgatcggcgagggtcgggtttcgggaagtttttagggtttcgttcgcgtagttaggaaagtatgtagtttatcgacgggcggaggaatcgttcgggtaaagttacgtcggtggttgatcgcgcggtagggaggtgggtattttgtttatatttattaggaggttgatagttggcgagcgttaggcggtcgggacgggataagggtcgtagcgcgtcggagggggtcgttttgagaaagtcgcgttgggcgttgttcgtcgttaacgattttttttcgttcggattagcggcggttggatatttacgtagggttggtagaatttggagagtcgcggtttttcgtggttgttgaagattaggatcgttttgattatggttgtgtcgggtcgatcgggtgggtattgggggttagggcgggggcgggcgcgcgagtttcgtttcgtaatttcgtttgcgatttttttttattcgttttttttcgtacgcgatcgcgcgcgttttcgagtcgtcgggcggggtttaaggggcggggtttgggcggggtaggtattaaggaaagcggaaatatttttaggttcgagttagcggtttaattggagtgtgcgtattcgatcgagtatagatacgtggtttatcgtttttttttcgaggtttgtagtcgcggagaaatatatgttgcgttattaacgtttagaggtttgcgatagtttcgatttgaatgattagtcgggaatattaagt

SEQ ID NO: 32042 - DNA, 876 bp, Artificial Sequence
  chemically treated genomic DNA (Homo sapiens) CpG-island No: 32042
acttaatattcccgactaatcattcaaatcgaaactatcgcaaacctctaaacgttaataacgcaacatatatttctccgcgactacaaacctcgaaaaaaaaacgataaaccacgtatctatactcgatcgaatacgcacactccaattaaaccgctaactcgaacctaaaaatatttccgctttccttaatacctaccccgcccaaaccccgccccttaaaccccgcccgacgactcgaaaacgcgcgcgatcgcgtacgaaaaaaaacgaataaaaaaaaatcgcaaacgaaattacgaaacgaaactcgcgcgcccgcccccgccctaacccccaatacccacccgatcgacccgacacaaccataatcaaaacgatcctaatcttcaacaaccacgaaaaaccgcgactctccaaattctaccaaccctacgtaaatatccaaccgccgctaatccgaacgaaaaaaaatcgttaacgacgaacaacgcccaacgcgactttctcaaaacgaccccctccgacgcgctacgacccttatcccgtcccgaccgcctaacgctcgccaactatcaacctcctaataaatataaacaaaatacccacctccctaccgcgcgatcaaccaccgacgtaactttacccgaacgattcctccgcccgtcgataaactacatactttcctaactacgcgaacgaaaccctaaaaacttcccgaaacccgaccctcgccgatcgaacaaccgcaacccaaccgcgccgcgaaaccctacgcccaatccccaaaaacccaccccgcgcgactaccttcctaccgcccgcgaactacaattaacccgaaaaaaaaaaaacgacgtaaaactcgttcttctc

SEQ ID NO: 32043 - DNA, 876 bp, Artificial Sequence
  chemically treated genomic DNA (Homo sapiens) CpG-island No: 32043
atttggtgttttcggttagttatttaaatcgaagttgtcgtagatttttgaacgttagtaacgtaatatgtgttttttcgcgattatagatttcgggagaggagcggtgggttacgtgtttgtgttcggtcgaatgcgtatattttagttaggtcgttggttcggatttagaaatgttttcgttttttttagtgtttgtttcgtttaggtttcgttttttgggtttcgttcgacggttcgggagcgcgcgcggtcgcgtgcgggagggggcgggtggggaaggatcgtaggcgagattacgaggcgaggttcgcgcgttcgttttcgttttggtttttagtgtttattcggtcggttcggtatagttatgattaaggcgattttaatttttaataattacgggaagtcgcggttttttaagttttattagttttacgtgagtatttagtcgtcgttgattcgggcgagggggagtcgttggcgacgggtagcgtttagcgcggtttttttagagcgatttttttcggcgcgttgcggtttttgtttcgtttcggtcgtttggcgttcgttagttgttagttttttggtgggtgtggatagggtgtttatttttttgtcgcgcggttagttatcgacgtggttttgttcgggcggttttttcgttcgtcggtgggttgtatgtttttttggttgcgcgggcgaggttttggagatttttcggggttcggttttcgtcgatcgggtagtcgtagtttagtcgcgtcgcggagttttgcgtttagtttttaagagtttatttcgcgcggttgtttttttgtcgttcgcgggttgtagttagttcgggaggaggaagacggcgtggaattcgtttttttt

SEQ ID NO: 32044 - DNA, 876 bp, Artificial Sequence
  chemically treated genomic DNA (Homo sapiens) CpG-island No: 32044
aaaaaaaacgaattccacgccgtcttcctcctcccgaactaactacaacccgcgaacgacaaaaaaacaaccgcgcgaaataaactcttaaaaactaaacgcaaaactccgcgacgcgactaaactacgactacccgatcgacgaaaaccgaaccccgaaaaatctccaaaacctcgcccgcgcaaccaaaaaaacatacaacccaccgacgaacgaaaaaaccgcccgaacaaaaccacgtcgataactaaccgcgcgacaaaaaaataaacaccctatccacacccaccaaaaaactaacaactaacgaacgccaaacgaccgaaacgaaacaaaaaccgcaacgcgccgaaaaaaatcgctctaaaaaaaccgcgctaaacgctacccgtcgccaacgactccccctcgcccgaatcaacgacgactaaatactcacgtaaaactaataaaacttaaaaaaccgcgacttcccgtaattattaaaaattaaaatcgccttaatcataactataccgaaccgaccgaataaacactaaaaaccaaaacgaaaacgaacgcgcgaacctcgcctcgtaatctcgcctacgatccttccccacccgccccctcccgcacgcgaccgcgcgcgctcccgaaccgtcgaacgaaacccaaaaaacgaaacctaaacgaaacaaacactaaaaaaaacgaaaacatttctaaatccgaaccaacgacctaactaaaatatacgcattcgaccgaacacaaacacgtaacccaccgctcctctcccgaaatctataatcgcgaaaaaacacatattacgttactaacgttcaaaaatctacgacaacttcgatttaaataactaaccgaaaacaccaaat

SEQ ID NO: 32045 - DNA, 890 bp, Artificial Sequence
  chemically treated genomic DNA (Homo sapiens) CpG-island No: 32045
  misc_feature (724)..(724): n is either a, c, g or t
ttgcgcgattatttggatttttatttggtgacggagtacgtatattaatgtcgtaatagattgaattacgtaatatcgcgttataggtcgcgtagtcgttggtatacggtgtatcgttaattttgtaacgcgggcgcgtgttggcgttagtcggcggtagcggtagcgggaaattattaatttgcgtcgtaacgttgggtattttgttcgttggcgttcgttagacggcgggcggaaattttagtcgatggtaaatcggtttcgttttgcgttttgcgcggtattaaaattgttattattatgtagaattcgcgtagcgtttttaatttattgtatattatgtatatttacgcgcgggaaatttgtttggcgttagggaaattcgtcgatgacgttacgtttatcgttgttatagaagcggtggggttggaaaacgtcgcgcgcgtgttgaagttgtattcgttcgagatgagcggcggtatgttgtagcgtatgatgattgcgatggcggtgttgtgtgaattatcgtttattatcgtcgataatcgattatcgattttgacgtggtagtataggcgcgtattttttgatttgttggaaagtattatgtaaataataagcgtcgggaatgttgttggtgatttatgatatgggcgttgtgtgcgcgtttggcggatgacgtggcggttatgtttgacggtaagattgtcgaatagggcggatntgaaacgttgtttaacgtttttaaatatatagtgacgcgtagtttggttttcgtttatttcgttttttatcggtatggagttggtattatgattttatttaatatttttcggttttttatttattatgcgtacggtggattaacggaaatattatattaggcggtg

SEQ ID NO: 32046 - DNA, 890 bp, Artificial Sequence
  chemically treated genomic DNA (Homo sapiens) CpG-island No: 32046
  misc_feature (167)..(167): n is either a, c, g or t
caccgcctaatataatatttccgttaatccaccgtacgcataataaataaaaaaccgaaaaatattaaataaaatcataataccaactccataccgataaaaaacgaaataaacgaaaaccaaactacgcgtcactatatatttaaaaacgttaaacaacgtttcanatccgccctattcgacaatcttaccgtcaaacataaccgccacgtcatccgccaaacgcgcacacaacgcccatatcataaatcaccaacaacattcccgacgcttattatttacataatactttccaacaaatcaaaaaatacgcgcctatactaccacgtcaaaatcgataatcgattatcgacgataataaacgataattcacacaacaccgccatcgcaatcatcatacgctacaacataccgccgctcatctcgaacgaatacaacttcaacacgcgcgcgacgttttccaaccccaccgcttctataacaacgataaacgtaacgtcatcgacgaatttccctaacgccaaacaaatttcccgcgcgtaaatatacataatatacaataaattaaaaacgctacgcgaattctacataataataacaattttaataccgcgcaaaacgcaaaacgaaaccgatttaccatcgactaaaatttccgcccgccgtctaacgaacgccaacgaacaaaatacccaacgttacgacgcaaattaataatttcccgctaccgctaccgccgactaacgccaacacgcgcccgcgttacaaaattaacgatacaccgtataccaacgactacgcgacctataacgcgatattacgtaattcaatctattacgacattaatatacgtactccgtcaccaaataaaaatccaaataatcgcgcaa

SEQ ID NO: 32047 - DNA, 890 bp, Artificial Sequence
  chemically treated genomic DNA (Homo sapiens) CpG-island No: 32047
  misc_feature (167)..(167): n is either a, c, g or t
tatcgtttgatgtgatgttttcgttaatttatcgtgcgtatagtggatgggaagtcggaagatgttaagtaaagttatgatgttagttttatatcggtagagggcgagatgagcggaaattaggttgcgcgttattgtatgtttgggggcgttaaatagcgttttanattcgttttgttcgataattttatcgttagatataatcgttacgttattcgttagacgcgtatataacgtttatattatgggttattagtagtattttcggcgtttgttatttgtataatgttttttagtagattagaggatgcgcgtttgtgttattacgttaaggtcggtggtcggttatcggcgatgataaacggtgatttatatagtatcgttatcgtaattattatgcgttgtaatatgtcgtcgtttatttcgaacgggtatagttttagtacgcgcgcggcgttttttagttttatcgtttttatggtagcggtaagcgtagcgttatcggcgggtttttttaacgttaggtaggtttttcgcgcgtgggtgtgtatggtgtgtagtggattaaaggcgttgcgcgggttttgtatgatggtggtaattttgatgtcgcgtagggcgtaaggcgaaatcggtttgttatcggttaaaattttcgttcgtcgtttggcgaacgttagcgggtaaaatgtttagcgttgcggcgtaggttaatgatttttcgttgtcgttatcgtcgattaacgttagtacgcgttcgcgttgtagggttaacgatatatcgtgtattagcggttgcgcggtttgtagcgcgatattacgtagtttaatttgttgcggtattagtgtgcgtgtttcgttattagatgagggtttagatgatcgcgtag

SEQ ID NO: 32048 - DNA, 890 bp, Artificial Sequence
  chemically treated genomic DNA (Homo sapiens) CpG-island No: 32048
  misc_feature (724)..(724): n is either a, c, g or t
ctacgcgatcatctaaaccctcatctaataacgaaacacgcacactaataccgcaacaaattaaactacgtaatatcgcgctacaaaccgcgcaaccgctaatacacgatatatcgttaaccctacaacgcgaacgcgtactaacgttaatcgacgataacgacaacgaaaaatcattaacctacgccgcaacgctaaacattttacccgctaacgttcgccaaacgacgaacgaaaattttaaccgataacaaaccgatttcgccttacgccctacgcgacatcaaaattaccaccatcatacaaaacccgcgcaacgcctttaatccactacacaccatacacacccacgcgcgaaaaacctacctaacgttaaaaaaacccgccgataacgctacgcttaccgctaccataaaaacgataaaactaaaaaacgccgcgcgcgtactaaaactatacccgttcgaaataaacgacgacatattacaacgcataataattacgataacgatactatataaatcaccgtttatcatcgccgataaccgaccaccgaccttaacgtaataacacaaacgcgcatcctctaatctactaaaaaacattatacaaataacaaacgccgaaaatactactaataacccataatataaacgttatatacgcgtctaacgaataacgtaacgattatatctaacgataaaattatcgaacaaaacgaatntaaaacgctatttaacgcccccaaacatacaataacgcgcaacctaatttccgctcatctcgccctctaccgatataaaactaacatcataactttacttaacatcttccgacttcccatccactatacgcacgataaattaacgaaaacatcacatcaaacgata

SEQ ID NO: 32049 - DNA, 532 bp, Artificial Sequence
  chemically treated genomic DNA (Homo sapiens) CpG-island No: 32049
tcgttacgcgggtcgcggtcggaatgcggttcggtggcgttcgggttattcggcgtcggtagttgtttaggtttagcggggttgcgggaggggcggagttggcgagtcgtcggaggggcggagtcggcgggtcgcggggggcggggttatcggttgttcgcgcgcgtcgtcgaggtttcgtacgtcgtcgcgcgggtcgggcgtttttgtgaattttgggtcgtcgatgggggaggtggagtcggggttcgcgggttcgttggagttttcggagtcgttcgaagcgttcgcgagtcgtcggtcgggagggattcgggttttgaaggtgaggaggcggatggattagcgagcgagcgagcgggcgagcgggtaagcggattagggagggaacgagggaggttagaggtcgttgtcgttttcgtttcgcgtagtggttgaggtagtcggcggttttcgttcggcgttagttagtcggtcgttttatattcggttggggacgtcgaggttttcgcgtcgcgttcgcgtttaggtt

SEQ ID NO: 32050 - DNA, 532 bp, Artificial Sequence
  chemically treated genomic DNA (Homo sapiens) CpG-island No: 32050
aacctaaacgcgaacgcgacgcgaaaacctcgacgtccccaaccgaatataaaacgaccgactaactaacgccgaacgaaaaccgccgactacctcaaccactacgcgaaacgaaaacgacaacgacctctaacctccctcgttccctccctaatccgcttacccgctcgcccgctcgctcgctcgctaatccatccgcctcctcaccttcaaaacccgaatccctcccgaccgacgactcgcgaacgcttcgaacgactccgaaaactccaacgaacccgcgaaccccgactccacctcccccatcgacgacccaaaattcacaaaaacgcccgacccgcgcgacgacgtacgaaacctcgacgacgcgcgcgaacaaccgataaccccgccccccgcgacccgccgactccgcccctccgacgactcgccaactccgcccctcccgcaaccccgctaaacctaaacaactaccgacgccgaataacccgaacgccaccgaaccgcattccgaccgcgacccgcgtaacga

SEQ ID NO: 32051 - DNA, 532 bp, Artificial Sequence
  chemically treated genomic DNA (Homo sapiens) CpG-island No: 32051
ggtttggacgcgggcgcggcgcggaggtttcggcgtttttagtcgggtgtggggcggtcgattgattgacgtcgggcgggggtcgtcgattgttttagttattgcgcggggcgggggcggtagcggtttttagtttttttcgttttttttttagttcgtttgttcgttcgttcgttcgttcgttcgttggtttattcgtttttttatttttaggattcggatttttttcggtcggcggttcgcgggcgtttcgggcggtttcgggggttttagcgggttcgcgggtttcggttttattttttttatcggcgatttaggatttatagagacgttcggttcgcgcgacggcgtgcggagtttcggcggcgcgcgcgagtaatcggtggtttcgtttttcgcggttcgtcggtttcgttttttcggcggttcgttagtttcgtttttttcgtagtttcgttggatttaagtagttgtcggcgtcgagtggttcgggcgttatcgagtcgtatttcggtcgcggttcgcgtggcgg

SEQ ID NO: 32052 - DNA, 532 bp, Artificial Sequence
  chemically treated genomic DNA (Homo sapiens) CpG-island No: 32052
ccgccacgcgaaccgcgaccgaaatacgactcgataacgcccgaaccactcgacgccgacaactacttaaatccaacgaaactacgaaaaaaacgaaactaacgaaccgccgaaaaaacgaaaccgacgaaccgcgaaaaacgaaaccaccgattactcgcgcgcgccgccgaaactccgcacgccgtcgcgcgaaccgaacgtctctataaatcctaaatcgccgataaaaaaaataaaaccgaaacccgcgaacccgctaaaacccccgaaaccgcccgaaacgcccgcgaaccgccgaccgaaaaaaatccgaatcctaaaaataaaaaaacgaataaaccaacgaacgaacgaacgaacgaacgaacaaacgaactaaaaaaaaaacgaaaaaaactaaaaaccgctaccgcccccgccccgcgcaataactaaaacaatcgacgacccccgcccgacgtcaatcaatcgaccgccccacacccgactaaaaacgccgaaacctccgcgccgcgcccgcgtccaaacc

SEQ ID NO: 32053 - DNA, 668 bp, Artificial Sequence
  chemically treated genomic DNA (Homo sapiens) CpG-island No: 32053
gtgatgatttttttatgattgtcgtgtaagggtcgaatgcgtaggtaaaagttgttatattgtttaatgacgtttagcgttaggcggtggaagggatgaaatcgttttttggcgtgtaggcgggcgatttgtttattgttattattggttatatcggtgaagcgggttatgaaattgcgttgtttaatgaaaaagcggtcgatttttggcgtgcgttggtggaagcgggtgttaagttatgtggtttgggcgcgcgtgatacgttgcgtttggaagcgggtatgaatttttatggttaggagatggacgaaattattttttttttagtcgttaatatgggttggattatcgtttgggaatcggtagatcgtgattttatcggtcgtgaagttttggaagtgtagcgtgagtatggtatagaaaaattggttggtttggtgatgatcgaaaaaggcgtgttgcgtaatgaattgtcggtacgttttatcgatgcgtaggggtaattagtatgaaggtattattattagcggtatttttttttcgaacgttggttatagtattgcgttggcgcgcgtgtcggaaggtattggcgaaacggcgattgtgtaaattcgtaatcgtgaaatgtcggttaaagtgataaaatttgtttttgtgcgtaacggtaa

SEQ ID NO: 32054 - DNA, 668 bp, Artificial Sequence
  chemically treated genomic DNA (Homo sapiens) CpG-island No: 32054
ttaccgttacgcacaaaaacaaattttatcactttaaccgacatttcacgattacgaatttacacaatcgccgtttcgccaataccttccgacacgcgcgccaacgcaatactataaccaacgttcgaaaaaaaaataccgctaataataataccttcatactaattacccctacgcatcgataaaacgtaccgacaattcattacgcaacacgcctttttcgatcatcaccaaaccaaccaatttttctataccatactcacgctacacttccaaaacttcacgaccgataaaatcacgatctaccgattcccaaacgataatccaacccatattaacgactaaaaaaaaaataatttcgtccatctcctaaccataaaaattcatacccgcttccaaacgcaacgtatcacgcgcgcccaaaccacataacttaacacccgcttccaccaacgcacgccaaaaatcgaccgctttttcattaaacaacgcaatttcataacccgcttcaccgatataaccaataataacaataaacaaatcgcccgcctacacgccaaaaaacgatttcatcccttccaccgcctaacgctaaacgtcattaaacaatataacaacttttacctacgcattcgacccttacacgacaatcataaaaaaatcatcac

SEQ ID NO: 32055 - DNA, 668 bp, Artificial Sequence
  chemically treated genomic DNA (Homo sapiens) CpG-island No: 32055
ttgtcgttacgtataaaaataggttttgttattttaatcggtattttacggttgcgaatttgtataatcgtcgtttcgttaatatttttcggtacgcgcgttagcgtaatgttgtaattagcgttcggggagaaagtatcgttggtgataatgtttttatgttggttgtttttgcgtatcggtaaagcgtatcggtagtttattacgtagtacgtttttttcggttattattagattaattagtttttttgtattatgtttacgttgtatttttagggttttacgatcgataaagttacgatttgtcggtttttaggcgatggtttagtttatgttggcggttaaaggagagatggtttcgtttattttttgattataaagatttatgttcgtttttagacgtagcgtgttacgcgcgtttaagttatatggtttaatattcgtttttattagcgtacgttagaaatcggtcgtttttttattgggtagcgtaattttatagttcgttttatcggtataattagtggtggtaataaatagatcgttcgtttgtacgttaaagaacggttttattttttttatcgtttgacgttgggcgttattaaatagtgtggtagtttttgtttgcgtattcggtttttgtacggtaattatggaaaggttattat

SEQ ID NO: 32056 - DNA, 668 bp, Artificial Sequence
  chemically treated genomic DNA (Homo sapiens) CpG-island No: 32056
ataataacctttccataattaccgtacaaaaaccgaatacgcaaacaaaaactaccacactatttaataacgcccaacgtcaaacgataaaaaaaataaaaccgttctttaacgtacaaacgaacgatctatttattaccaccactaattataccgataaaacgaactataaaattacgctacccaataaaaaaacgaccgatttctaacgtacgctaataaaaacgaatattaaaccatataacttaaacgcgcgtaacacgctacgtctaaaaacgaacataaatctttataatcaaaaaataaacgaaaccatctctcctttaaccgccaacataaactaaaccatcgcctaaaaaccgacaaatcgtaactttatcgatcgtaaaaccctaaaaatacaacgtaaacataatacaaaaaaactaattaatctaataataaccgaaaaaaacgtactacgtaataaactaccgatacgctttaccgatacgcaaaaacaaccaacataaaaacattatcaccaacgatactttctccccgaacgctaattacaacattacgctaacgcgcgtaccgaaaaatattaacgaaacgacgattatacaaattcgcaaccgtaaaataccgattaaaataacaaaacctatttttatacgtaacgacaa

SEQ ID NO: 32057 - DNA, 510 bp, Artificial Sequence
  chemically treated genomic DNA (Homo sapiens) CpG-island No: 32057
gcgtaagcgtattgcgtaagcgtatataattgatttggatatttcgcgttttttggtttaaagataaagtttttttttttttttttcgtcgttcgtttatcgttttttttttttgtcggtcgtatgcgcgttggttttttgtgacgtagttttcgcgcgttcgcgtcgtttggagttgcgacgttaaatatggcgtgtttttagaagtcgttttcggtattagtaggcggcggcgtggggtttggtagcgtggggagagggattaatcgacgttatttcgtgttgggaagtgggagcgggagggtcgggtaattttcgatcgaattaaacggtgaggtttcggttcgagagttatcgagcgcgcgggagtggaagggagtgggttgggtattcgagtttcgagaggcgagggaggaaagtggggttattaggagatgagggataacggtagcgaggtaagggcggtttgtagatttggttgtttgcgtaattttaggaattcggggaatt

SEQ ID NO: 32058 - DNA, 510 bp, Artificial Sequence
  chemically treated genomic DNA (Homo sapiens) CpG-island No: 32058
aattccccgaattcctaaaattacgcaaacaaccaaatctacaaaccgcccttacctcgctaccgttatccctcatctcctaataaccccactttcctccctcgcctctcgaaactcgaatacccaacccactcccttccactcccgcgcgctcgataactctcgaaccgaaacctcaccgtttaattcgatcgaaaattacccgaccctcccgctcccacttcccaacacgaaataacgtcgattaatccctctccccacgctaccaaaccccacgccgccgcctactaataccgaaaacgacttctaaaaacacgccatatttaacgtcgcaactccaaacgacgcgaacgcgcgaaaactacgtcacaaaaaaccaacgcgcatacgaccgacaaaaaaaaaaaacgataaacgaacgacgaaaaaaaaaaaaaaaaactttatctttaaaccaaaaaacgcgaaatatccaaatcaattatatacgcttacgcaatacgcttacgc

SEQ ID NO: 32059 - DNA, 510 bp, Artificial Sequence
  chemically treated genomic DNA (Homo sapiens) CpG-island No: 32059
agtttttcgggtttttaaggttgcgtaaatagttaagtttgtaggtcgtttttgtttcgttatcgttattttttattttttggtagttttatttttttttttcgtttttcgggattcgggtgtttaatttatttttttttattttcgcgcgttcggtggttttcgggtcggggttttatcgtttggttcggtcgggaattgttcggttttttcgtttttattttttaatacgaagtggcgtcggttggtttttttttttacgttgttagattttacgtcgtcgtttattgatgtcgaaagcggtttttaggaatacgttatgtttggcgtcgtagttttaaacgacgcggacgcgcgaaaattacgttataggagattagcgcgtatgcgatcggtagagagagaaggcgataggcgaacggcgggaaggggaaggaggggttttgtttttgaattaaaaggcgcggggtatttaaattagttgtgtgcgtttgcgtagtgcgtttgcgt

SEQ ID NO: 32060 - DNA, 510 bp, Artificial Sequence
  chemically treated genomic DNA (Homo sapiens) CpG-island No: 32060
acgcaaacgcactacgcaaacgcacacaactaatttaaataccccgcgccttttaattcaaaaacaaaacccctccttccccttcccgccgttcgcctatcgccttctctctctaccgatcgcatacgcgctaatctcctataacgtaattttcgcgcgtccgcgtcgtttaaaactacgacgccaaacataacgtattcctaaaaaccgctttcgacatcaataaacgacgacgtaaaatctaacaacgtaaaaaaaaaaaccaaccgacgccacttcgtattaaaaaataaaaacgaaaaaaccgaacaattcccgaccgaaccaaacgataaaaccccgacccgaaaaccaccgaacgcgcgaaaataaaaaaaaataaattaaacacccgaatcccgaaaaacgaaaaaaaaaaataaaactaccaaaaaataaaaaataacgataacgaaacaaaaacgacctacaaacttaactatttacgcaaccttaaaaacccgaaaaact

SEQ ID NO: 32061 - DNA, 866 bp, Artificial Sequence
  chemically treated genomic DNA (Homo sapiens) CpG-island No: 32061
tgcggaatcgaaagatattgtgggttatgtgcgtgaagttacgtcgcgtgaagtagaataggcgttggaaagtgcggttaatacgcgttaatttggtttgttacgttttcggttgaacgcgtagcgattttgtatcgcgttgtcgtgttgatggaaagttagatgtagtaattgattggtattttggtgcgtgaggtcggaaaaatttttagtaacgttattgtcgaagtgcgcgaagcggtcgattttttttattattacgtcggataggtgcgggatgatttcgttaacgaaatttatcgtttattagggtttgtggtgtgtattagttcgtggaatttttcgttggttatttttatcgggtagatcgtcgtcgtattggcggtaggtaatagcgtgttggtaaaatcggtagaataaacgtcgttgattgtcgcgtaagggatcgttattttgttggaagcgggtgtatcgttaggcgtggtgtaattgttgttaggtcggggtgaaatcgtgggcgcgtaattgacgggtgatgatcgcgtgcgcggggtgatgtttatcggtttaatcgaagtcgttacgttattgtagcgtaatatcgttagtcgtttggacgtttagggtcgttttatttcgtttatcgttgaaatcggcggtatgaacgcgatgattgtcgattttttagtattggatcgaataggtcgtcgtggatggtattggtttcggcgtttcgatagtgcgggtttagcgttgttcggcgttgcgcgtgttgtgtttgtaagatgagattggcggattataacgttgaaaattgttgggcggagtaattggcgaatgcggatgggaattcgggtcgttgaata

SEQ ID NO: 32062 - DNA, 866 bp, Artificial Sequence
  chemically treated genomic DNA (Homo sapiens) CpG-island No: 32062
tattcaacgacccgaattcccatccgcattcgccaattactccgcccaacaattttcaacgttataatccgccaatctcatcttacaaacacaacacgcgcaacgccgaacaacgctaaacccgcactatcgaaacgccgaaaccaataccatccacgacgacctattcgatccaatactaaaaaatcgacaatcatcgcgttcataccgccgatttcaacgataaacgaaataaaacgaccctaaacgtccaaacgactaacgatattacgctacaataacgtaacgacttcgattaaaccgataaacatcaccccgcgcacgcgatcatcacccgtcaattacgcgcccacgatttcaccccgacctaacaacaattacaccacgcctaacgatacacccgcttccaacaaaataacgatcccttacgcgacaatcaacgacgtttattctaccgattttaccaacacgctattacctaccgccaatacgacgacgatctacccgataaaaataaccaacgaaaaattccacgaactaatacacaccacaaaccctaataaacgataaatttcgttaacgaaatcatcccgcacctatccgacgtaataataaaaaaaatcgaccgcttcgcgcacttcgacaataacgttactaaaaatttttccgacctcacgcaccaaaataccaatcaattactacatctaactttccatcaacacgacaacgcgatacaaaatcgctacgcgttcaaccgaaaacgtaacaaaccaaattaacgcgtattaaccgcactttccaacgcctattctacttcacgcgacgtaacttcacgcacataacccacaatatctttcgattccgca

SEQ ID NO: 32063 - DNA, 866 bp, Artificial Sequence
  chemically treated genomic DNA (Homo sapiens) CpG-island No: 32063
tgtttagcgattcggatttttattcgtattcgttaattgtttcgtttagtaatttttaacgttgtggttcgttaattttattttgtaggtatagtacgcgtagcgtcgaataacgttggattcgtattgtcgaaacgtcgaggttagtattatttacgacgatttgttcggtttagtgttgaagaatcgataattatcgcgtttatgtcgtcggttttagcgatgagcggaatagggcgattttgagcgtttaggcggttggcgatattgcgttgtagtaacgtagcgatttcggttgaatcggtaaatattatttcgcgtacgcgattattattcgttagttgcgcgtttacggttttatttcgatttggtagtaattgtattacgtttggcggtatattcgtttttagtaaaatggcgattttttgcgcggtaattagcggcgtttgttttgtcggttttgttagtacgttgttatttgtcgttagtgcggcggcgatttgttcggtgaaaatagttagcgggaagttttacggattgatatatattataggttttaatggacggtgggtttcgttagcgaaattatttcgtatttgttcggcgtagtagtggagaaaatcgatcgtttcgcgtatttcggtaatggcgttattgaaggttttttcggttttacgtattagaatattaattagttgttgtatttggttttttattagtacggtagcgcggtgtaaaatcgttgcgcgtttagtcggaggcgtggtaaattagattggcgcgtattaatcgtattttttagcgtttgttttattttacgcggcgtggttttacgtatatagtttataatatttttcggtttcgta

SEQ ID NO: 32064 - DNA, 866 bp, Artificial Sequence
  chemically treated genomic DNA (Homo sapiens) CpG-island No: 32064
tacgaaaccgaaaaatattataaactatatacgtaaaaccacgccgcgtaaaataaaacaaacgctaaaaaatacgattaatacgcgccaatctaatttaccacgcctccgactaaacgcgcaacgattttacaccgcgctaccgtactaataaaaaaccaaatacaacaactaattaatattctaatacgtaaaaccgaaaaaaccttcaataacgccattaccgaaatacgcgaaacgatcgattttctccactactacgccgaacaaatacgaaataatttcgctaacgaaacccaccgtccattaaaacctataatatatatcaatccgtaaaacttcccgctaactattttcaccgaacaaatcgccgccgcactaacgacaaataacaacgtactaacaaaaccgacaaaacaaacgccgctaattaccgcgcaaaaaatcgccattttactaaaaacgaatataccgccaaacgtaatacaattactaccaaatcgaaataaaaccgtaaacgcgcaactaacgaataataatcgcgtacgcgaaataatatttaccgattcaaccgaaatcgctacgttactacaacgcaatatcgccaaccgcctaaacgctcaaaatcgccctattccgctcatcgctaaaaccgacgacataaacgcgataattatcgattcttcaacactaaaccgaacaaatcgtcgtaaataatactaacctcgacgtttcgacaatacgaatccaacgttattcgacgctacgcgtactatacctacaaaataaaattaacgaaccacaacgttaaaaattactaaacgaaacaattaacgaatacgaataaaaatccgaatcgctaaaca

SEQ ID NO: 32065 - DNA, 546 bp, Artificial Sequence
  chemically treated genomic DNA (Homo sapiens) CpG-island No: 32065
  misc_feature (419)..(419): n is either a, c, g or t
aaagagtggttggatcgggtattaagtcgtggttttgttagcgggtcgggaggaaattaattggcgggaaagtattggcgtagcgtgattattatcggcgagtcggaaagtgtttatcgttatgacgcgttgaatcgttattcgatgagcgatgtgttgcgtttttttgaattggcggcgggtatgtgtcggatgtattggttaagttttattattatttattgggcgagacggtaaagcgtataggagttggcgagttacgttagagtttacggtgattggttggtaaattcgttgtttttaggaggtcgttgatggaaggtttcgattttttattcgtaggagtgttgttttttttcgcggcggtggttgcggtgtcgttggtatcgcggttgggtatggcgttgtgttgggatatntgttggtagggattgtaattggttcgtgggggttggggtttattagcgacgtcgatgagattttttatttttcggaattcggcgtggtatttttggatgtttattatcggttttgagttgaattttt

SEQ ID NO: 32066 - DNA, 546 bp, Artificial Sequence
  chemically treated genomic DNA (Homo sapiens) CpG-island No: 32066
  misc_feature (128)..(128): n is either a, c, g or t
aaaaattcaactcaaaaccgataataaacatccaaaaataccacgccgaattccgaaaaataaaaaatctcatcgacgtcgctaataaaccccaacccccacgaaccaattacaatccctaccaacanatatcccaacacaacgccatacccaaccgcgataccaacgacaccgcaaccaccgccgcgaaaaaaaacaacactcctacgaataaaaaatcgaaaccttccatcaacgacctcctaaaaacaacgaatttaccaaccaatcaccgtaaactctaacgtaactcgccaactcctatacgctttaccgtctcgcccaataaataataataaaacttaaccaatacatccgacacatacccgccgccaattcaaaaaaacgcaacacatcgctcatcgaataacgattcaacgcgtcataacgataaacactttccgactcgccgataataatcacgctacgccaatactttcccgccaattaatttcctcccgacccgctaacaaaaccacgacttaatacccgatccaaccactcttt

SEQ ID NO: 32067 - DNA, 546 bp, Artificial Sequence
  chemically treated genomic DNA (Homo sapiens) CpG-island No: 32067
  misc_feature (128)..(128): n is either a, c, g or t
agggatttaatttaaggtcgatgataaatatttaggaatattacgtcgagtttcgaaaagtggaggattttatcgacgtcgttaataaattttagtttttacgggttaattgtaatttttgttagtanatattttaatatagcgttatatttagtcgcgatgttagcggtatcgtagttatcgtcgcgaagagaaatagtatttttgcgagtaaaaaatcggaattttttattagcggttttttggagatagcggatttgttagttagttatcgtaggttttggcgtggttcgttagtttttgtgcgttttgtcgtttcgtttagtaaataatgatgggatttaattaatgtattcggtatatgttcgtcgttagtttaaaggggcgtagtatatcgtttatcgggtagcgatttagcgcgttataacggtaagtatttttcggttcgtcggtggtaattacgttacgttagtattttttcgttagttggttttttttcggttcgttggtaaaattacgatttaatattcggtttagttatttttt

SEQ ID NO: 32068 - DNA, 546 bp, Artificial Sequence
  chemically treated genomic DNA (Homo sapiens) CpG-island No: 32068
  misc_feature (419)..(419): n is either a, c, g or t
aaaaaataactaaaccgaatattaaatcgtaattttaccaacgaaccgaaaaaaaaccaactaacgaaaaaatactaacgtaacgtaattaccaccgacgaaccgaaaaatacttaccgttataacgcgctaaatcgctacccgataaacgatatactacgcccctttaaactaacgacgaacatataccgaatacattaattaaatcccatcattatttactaaacgaaacgacaaaacgcacaaaaactaacgaaccacgccaaaacctacgataactaactaacaaatccgctatctccaaaaaaccgctaataaaaaattccgattttttactcgcaaaaatactatttctcttcgcgacgataactacgataccgctaacatcgcgactaaatataacgctatattaaaatatntactaacaaaaattacaattaacccgtaaaaactaaaatttattaacgacgtcgataaaatcctccacttttcgaaactcgacgtaatattcctaaatatttatcatcgaccttaaattaaatccct

SEQ ID NO: 32069 - DNA, 666 bp, Artificial Sequence
  chemically treated genomic DNA (Homo sapiens) CpG-island No: 32069
tcgcgatcgagtatttcggttattttgtgtttgcgggcgtggtaacgtattcgtgagggtacgatttttattacgaaatgatcgattttaacgttatcgataaagtatttttggtgtatggttagatgaacgagtcgtcgggaaatcgtttgcgcgttgttttgatcggtttgattatggttgagaaatttcgtgacgaaggtcgtgacgttttgttgttcgttgataatatttatcgttatattttggtcggtacggaagtattcgtattgttgggtcgtatgtttttagcggtaggttattagtcgattttggcggaagagatgggcgttttgtaggaacgtattatttttattaaaattggttttattattttcgtataggtagtatacgtatttgcggatgatttgattgattcgttttcggtaattatttttgcgtattttgacgtaatcgtggtattgagtcgttagatcgcgtttttgggtatttattcggtcgttgattcgttggattttattagtcgttagttggattcgttggtggttggttaggaatattacgatatcgcgcgtggcgtttagtttattttgtaacgttattaggaattgaaagatattatcgttattttgggtatggatgaattgtttgaagaagataaattgg

SEQ ID NO: 32070 - DNA, 666 bp, Artificial Sequence
  chemically treated genomic DNA (Homo sapiens) CpG-island No: 32070
ccaatttatcttcttcaaacaattcatccatacccaaaataacgataatatctttcaattcctaataacgttacaaaataaactaaacgccacgcgcgatatcgtaatattcctaaccaaccaccaacgaatccaactaacgactaataaaatccaacgaatcaacgaccgaataaatacccaaaaacgcgatctaacgactcaataccacgattacgtcaaaatacgcaaaaataattaccgaaaacgaatcaatcaaatcatccgcaaatacgtatactacctatacgaaaataataaaaccaattttaataaaaataatacgttcctacaaaacgcccatctcttccgccaaaatcgactaataacctaccgctaaaaacatacgacccaacaatacgaatacttccgtaccgaccaaaatataacgataaatattatcaacgaacaacaaaacgtcacgaccttcgtcacgaaatttctcaaccataatcaaaccgatcaaaacaacgcgcaaacgatttcccgacgactcgttcatctaaccatacaccaaaaatactttatcgataacgttaaaatcgatcatttcgtaataaaaatcgtaccctcacgaatacgttaccacgcccgcaaacacaaaataaccgaaatactcgatcgcga

SEQ ID NO: 32071 - DNA, 666 bp, Artificial Sequence
  chemically treated genomic DNA (Homo sapiens) CpG-island No: 32071
ttagtttgttttttttagatagtttatttatatttaggatggcgatgatgttttttagtttttgataacgttgtaggatggattgaacgttacgcgcggtgtcgtagtgtttttgattaattattagcgggtttagttgacggttggtggagtttagcgggttaacggtcgggtagatatttagagacgcgatttgacggtttagtattacggttgcgttaaggtgcgtaaaggtggttgtcggagacgggttagttaagttattcgtaggtacgtatattgtttgtacggaggtgatagaattagttttggtggaggtgatacgtttttgtagaacgtttatttttttcgttagggtcggttgataatttatcgttgaaggtatacggtttagtagtgcggatattttcgtatcggttagggtgtaacgatagatgttgttaacgaatagtagaacgttacgattttcgttacggaattttttagttatggttagatcggttagagtaacgcgtagacggtttttcggcggttcgtttatttggttatatattagggatattttgtcgataacgttggagtcggttatttcgtggtagaagtcgtatttttacgagtacgttattacgttcgtaaatatagagtaatcggagtgttcgatcgcga

SEQ ID NO: 32072 - DNA, 666 bp, Artificial Sequence
  chemically treated genomic DNA (Homo sapiens) CpG-island No: 32072
tcgcgatcgaacactccgattactctatatttacgaacgtaataacgtactcgtaaaaatacgacttctaccacgaaataaccgactccaacgttatcgacaaaatatccctaatatataaccaaataaacgaaccgccgaaaaaccgtctacgcgttactctaaccgatctaaccataactaaaaaattccgtaacgaaaatcgtaacgttctactattcgttaacaacatctatcgttacaccctaaccgatacgaaaatatccgcactactaaaccgtataccttcaacgataaattatcaaccgaccctaacgaaaaaaataaacgttctacaaaaacgtatcacctccaccaaaactaattctatcacctccgtacaaacaatatacgtacctacgaataacttaactaacccgtctccgacaaccacctttacgcaccttaacgcaaccgtaatactaaaccgtcaaatcgcgtctctaaatatctacccgaccgttaacccgctaaactccaccaaccgtcaactaaacccgctaataattaatcaaaaacactacgacaccgcgcgtaacgttcaatccatcctacaacgttatcaaaaactaaaaaacatcatcgccatcctaaatataaataaactatctaaaaaaaacaaactaa

SEQ ID NO: 32073 - DNA, 1039 bp, Artificial Sequence
  chemically treated genomic DNA (Homo sapiens) CpG-island No: 32073
gttgatgtttgttagttagtcgcgttcgttatattgttatcgttttgcggtttcgttatttacggtgcggtgcgtgaggcggtttgtttcgttatagtgttagtgggtgattagttttttattttcgttgcggataagtttgtcggttaggtcgtggtgatacgttgtgtgcggtcgttaaagtcggttttttgtattagtcggtcgagtatatcgtaacggaaggtggtgtggttgtcgtttttattggttaggcggatgattcgttcggtagtatcgtattttatattgcgcgttagttcgttttgcgtggtgttgatcgtttttttttacgtatcgtattgtgtttcgtttttgttgtcgttcggggtaatgacggtagttaggtcgtttgcggcgttgtatttatatcgcgttttacggttttgtgcgttttttatcgaggttaatcggttacggttgttatagcggcggtaaaggttgatgtttttttcgcggtggatcgtcgttatttggtcgaagcggtcgtatttataacgggtttggtagttcgagtagtcggtgaacgttagtaattgatcgtagcggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacgggggttttaggttgtcggtgaatggtgattcgggt

SEQ ID NO: 32074 - DNA, 1039 bp, Artificial Sequence
  chemically treated genomic DNA (Homo sapiens) CpG-island No: 32074
acccgaatcaccattcaccgacaacctaaaacccccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgctacgatcaattactaacgttcaccgactactcgaactaccaaacccgttataaatacgaccgcttcgaccaaataacgacgatccaccgcgaaaaaaacatcaacctttaccgccgctataacaaccgtaaccgattaacctcgataaaaaacgcacaaaaccgtaaaacgcgatataaatacaacgccgcaaacgacctaactaccgtcattaccccgaacgacaacaaaaacgaaacacaatacgatacgtaaaaaaaaacgatcaacaccacgcaaaacgaactaacgcgcaatataaaatacgatactaccgaacgaatcatccgcctaaccaataaaaacgacaaccacaccaccttccgttacgatatactcgaccgactaatacaaaaaaccgactttaacgaccgcacacaacgtatcaccacgacctaaccgacaaacttatccgcaacgaaaataaaaaactaatcacccactaacactataacgaaacaaaccgcctcacgcaccgcaccgtaaataacgaaaccgcaaaacgataacaatataacgaacgcgactaactaacaaacatcaac

SEQ ID NO: 32075 - DNA, 1039 bp, Artificial Sequence
  chemically treated genomic DNA (Homo sapiens) CpG-island No: 32075
gttcgaattattatttatcgatagtttgggattttcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttggcgtttatcgattgttcgggttattagattcgttatgaatacgatcgtttcggttagatgacggcggtttatcgcgaggaaggtattagtttttatcgtcgttatgatagtcgtggtcggttaatttcggtgaaagacgtatagggtcgtgaaacgcggtatgaatataacgtcgtaggcgatttgattgtcgttattgtttcggacggtagtagaaacgggatatagtacgatgcgtggggaaaggcggttagtattacgtagggcgggttgacgcgtagtatggaatacgatgttgtcggacgggttattcgtttgattagtgaaaacggtagttatattatttttcgttacgatgtattcgatcggttgatataggaaatcggttttgacggtcgtatatagcgtattattacgatttgatcggtaaatttattcgtagcgaggatgaggggttggttatttattggtattatgacgaagtagatcgttttacgtatcgtatcgtgaatggcgaaatcgtagagcggtggtagtatgacgaacgcggttggttgatagatattagt

SEQ ID NO: 32076 - DNA, 1039 bp, Artificial Sequence
  chemically treated genomic DNA (Homo sapiens) CpG-island No: 32076
actaatatctatcaaccaaccgcgttcgtcatactaccaccgctctacgatttcgccattcacgatacgatacgtaaaacgatctacttcgtcataataccaataaataaccaacccctcatcctcgctacgaataaatttaccgatcaaatcgtaataatacgctatatacgaccgtcaaaaccgatttcctatatcaaccgatcgaatacatcgtaacgaaaaataatataactaccgttttcactaatcaaacgaataacccgtccgacaacatcgtattccatactacgcgtcaacccgccctacgtaatactaaccgcctttccccacgcatcgtactatatcccgtttctactaccgtccgaaacaataacgacaatcaaatcgcctacgacgttatattcataccgcgtttcacgaccctatacgtctttcaccgaaattaaccgaccacgactatcataacgacgataaaaactaataccttcctcgcgataaaccgccgtcatctaaccgaaacgatcgtattcataacgaatctaataacccgaacaatcgataaacgccaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgaaaatcccaaactatcgataaataataattcgaac

SEQ ID NO: 32077 - DNA, 517 bp, Artificial Sequence
  chemically treated genomic DNA (Homo sapiens) CpG-island No: 32077
  misc_feature (271)..(271): n is either a, c, g or t
gtcgggaatgtttatcgacgcgttgaattaggaaattttttaggttagtagttagttgttggataaaagtcgttaggtttagtaagagtaggagcgcgttcgcgagattgtcgattcgttgaattaattgtcgtaatagtaaatcgacgttcgtcgttagttaaatgagatcgagcgtcgtttgggaacgtttatcggtaatatttcgtttaattaggtataaaatttcgcgttgtagtttgattttgtacgttttaaggcgttcgttgantaattggagttggcgtagttgtttgttaataatcgttaggaattagcgcgtttacgtttagagttggcggaaaaagagagttagtaattggatgcgtatttgtaggttttgcgtaattattaaatagttacgttagtttgaggcggagcgggcgttggaaagtatcgaattgttggtagaaaatagcgtcgatttgtcgaaagatatcgtcgcgtaatttaaaattaatcgcgaattatttggcgg

SEQ ID NO: 32078 - DNA, 517 bp, Artificial Sequence
  chemically treated genomic DNA (Homo sapiens) CpG-island No: 32078
  misc_feature (247)..(247): n is either a, c, g or t
ccgccaaataattcgcgattaattttaaattacgcgacgatatctttcgacaaatcgacgctattttctaccaacaattcgatactttccaacgcccgctccgcctcaaactaacgtaactatttaataattacgcaaaacctacaaatacgcatccaattactaactctctttttccgccaactctaaacgtaaacgcgctaattcctaacgattattaacaaacaactacgccaactccaattantcaacgaacgccttaaaacgtacaaaatcaaactacaacgcgaaattttatacctaattaaacgaaatattaccgataaacgttcccaaacgacgctcgatctcatttaactaacgacgaacgtcgatttactattacgacaattaattcaacgaatcgacaatctcgcgaacgcgctcctactcttactaaacctaacgacttttatccaacaactaactactaacctaaaaaatttcctaattcaacgcgtcgataaacattcccgac

SEQ ID NO: 32079 - DNA, 517 bp, Artificial Sequence
  chemically treated genomic DNA (Homo sapiens) CpG-island No: 32079
  misc_feature (247)..(247): n is either a, c, g or t
tcgttagatagttcgcggttaattttgaattgcgcgacgatatttttcggtaaatcggcgttgttttttgttagtaattcggtattttttagcgttcgtttcgttttaagttgacgtggttgtttaatgattacgtaaggtttgtaaatacgtatttagttgttggtttttttttttcgttagttttgagcgtaagcgcgttaatttttggcggttattggtagatagttgcgttagttttagttanttaacgagcgttttaagacgtgtagagttagattgtaacgcgaaattttgtgtttgattgagcggagtattgtcggtaagcgtttttaggcggcgttcgattttatttaattgacggcgggcgtcggtttgttgttgcggtagttgatttagcgaatcggtaatttcgcgggcgcgtttttgtttttgttgggtttgacggtttttatttagtaattggttgttgatttggagaattttttgatttagcgcgtcggtagatattttcggt

SEQ ID NO: 32080 - DNA, 517 bp, Artificial Sequence
  chemically treated genomic DNA (Homo sapiens) CpG-island No: 32080
  misc_feature (271)..(271): n is either a, c, g or t
accgaaaatatctaccgacgcgctaaatcaaaaaattctccaaatcaacaaccaattactaaataaaaaccgtcaaacccaacaaaaacaaaaacgcgcccgcgaaattaccgattcgctaaatcaactaccgcaacaacaaaccgacgcccgccgtcaattaaataaaatcgaacgccgcctaaaaacgcttaccgacaatactccgctcaatcaaacacaaaatttcgcgttacaatctaactctacacgtcttaaaacgctcgttaantaactaaaactaacgcaactatctaccaataaccgccaaaaattaacgcgcttacgctcaaaactaacgaaaaaaaaaaaccaacaactaaatacgtatttacaaaccttacgtaatcattaaacaaccacgtcaacttaaaacgaaacgaacgctaaaaaataccgaattactaacaaaaaacaacgccgatttaccgaaaaatatcgtcgcgcaattcaaaattaaccgcgaactatctaacga

SEQ ID NO: 32081 - DNA, 732 bp, Artificial Sequence
  chemically treated genomic DNA (Homo sapiens) CpG-island No: 32081
gcgcgttgttgttgtttttggcgtatcgcgcgtttttttgcggcgatgttagtttgaatagatttgagttggttacgtttattcgcgtgggcggaaaaggcgtataataatacgttagcgttaagaacgttggcgtagatgatgggtttgattgtaaatttgcgcggttttacggttcgtgttatggtattaatcgtttttttttttatggggagggattattttacgatgaatagcggtttattagttattttttgcgggatttttatatttattagcgataatatggtcggcgcgatgttagaaagtttgtcgtttttaatcgtttttacgtttttattattaacgtaaattagcggaattggtaggttggtgtgtgtcgtgtgtgtttgattcgttgtcggatcgcgtatttgtttagcgttatcgtggttagcggtgattagtagttgtttatttacggatttaatcgttttcgcgattttttttacgtagtgatttagcgttttaatcgtttaatcgtcgtttttattatttcggtgtgatttatatatgtcgtcgttcggatagttatagatgatggtgtcgtatttgtcgtttttgatggtcgtaattagtttttcggttagttttgcggagtttattttcggttgtagatcgtaggtagttattttcggtgagttgattagaatgcgattttcgtttttgaacgatttttttacgttatcgttg

SEQ ID NO: 32082 - DNA, 732 bp, Artificial Sequence
  chemically treated genomic DNA (Homo sapiens) CpG-island No: 32082
caacgataacgtaaaaaaatcgttcaaaaacgaaaatcgcattctaatcaactcaccgaaaataactacctacgatctacaaccgaaaataaactccgcaaaactaaccgaaaaactaattacgaccatcaaaaacgacaaatacgacaccatcatctataactatccgaacgacgacatatataaatcacaccgaaataataaaaacgacgattaaacgattaaaacgctaaatcactacgtaaaaaaaatcgcgaaaacgattaaatccgtaaataaacaactactaatcaccgctaaccacgataacgctaaacaaatacgcgatccgacaacgaatcaaacacacacgacacacaccaacctaccaattccgctaatttacgttaataataaaaacgtaaaaacgattaaaaacgacaaactttctaacatcgcgccgaccatattatcgctaataaatataaaaatcccgcaaaaaataactaataaaccgctattcatcgtaaaataatccctccccataaaaaaaaaaacgattaataccataacacgaaccgtaaaaccgcgcaaatttacaatcaaacccatcatctacgccaacgttcttaacgctaacgtattattatacgccttttccgcccacgcgaataaacgtaaccaactcaaatctattcaaactaacatcgccgcaaaaaaacgcgcgatacgccaaaaacaacaacaacgcgc

SEQ ID NO: 32083 - DNA, 732 bp, Artificial Sequence
  chemically treated genomic DNA (Homo sapiens) CpG-island No: 32083
taacggtggcgtagaagagtcgtttaaaggcgaagatcgtattttgattaatttatcgaaagtggttatttacgatttgtaatcggaaatgagtttcgtagagttgatcgaaaaattggttgcggttattaagagcggtaaatacgatattattatttgtaattattcgaacggcgatatgtgtaggttatatcggggtgatggaagcggcggttaagcggttgaagcgttggattattgcgtggaagaagtcgcgaaagcggttgagttcgtgggtggataattgttgattatcgttgattacggtaacgttgagtagatgcgcgattcggtaacgggttaggtatatacggtatatattaatttgttagtttcgttgatttacgttggtgataagaacgtgaaagcggttgaaggcggtaaattttttgatatcgcgtcgattatgttgtcgttgatgggtatggaaatttcgtaagagatgattggtaagtcgttgtttatcgtggaataatttttttttatgaggggaaaggcgattaatattatgatacgggtcgtgaaatcgcgtaggtttgtaattaggtttattatttacgttagcgtttttagcgttggcgtattgttgtgcgtttttttcgtttacgcggatgagcgtgattaatttaaatttatttaggttgatatcgtcgtaaaagagcgcgcggtacgttaaaagtaataataacgcgt

SEQ ID NO: 32084 - DNA, 732 bp, Artificial Sequence
  chemically treated genomic DNA (Homo sapiens) CpG-island No: 32084
acgcgttattattacttttaacgtaccgcgcgctcttttacgacgatatcaacctaaataaatttaaattaatcacgctcatccgcgtaaacgaaaaaaacgcacaacaatacgccaacgctaaaaacgctaacgtaaataataaacctaattacaaacctacgcgatttcacgacccgtatcataatattaatcgcctttcccctcataaaaaaaaattattccacgataaacaacgacttaccaatcatctcttacgaaatttccatacccatcaacgacaacataatcgacgcgatatcaaaaaatttaccgccttcaaccgctttcacgttcttatcaccaacgtaaatcaacgaaactaacaaattaatatataccgtatatacctaacccgttaccgaatcgcgcatctactcaacgttaccgtaatcaacgataatcaacaattatccacccacgaactcaaccgctttcgcgacttcttccacgcaataatccaacgcttcaaccgcttaaccgccgcttccatcaccccgatataacctacacatatcgccgttcgaataattacaaataataatatcgtatttaccgctcttaataaccgcaaccaatttttcgatcaactctacgaaactcatttccgattacaaatcgtaaataaccactttcgataaattaatcaaaatacgatcttcgcctttaaacgactcttctacgccaccgtta

SEQ ID NO: 32085 - DNA, 574 bp, Artificial Sequence
  chemically treated genomic DNA (Homo sapiens) CpG-island No: 32085
cgtggtttattttatattcgataaagtgtacggtagtttgaattggattggaatgaaaagacgtgtttgggacgggtttacggggacgcgttgcgggatttgttcggtttggtttttaagtcgttaattaatcgttggatgttttgtagttcgttggtggtcgttttttttttcgcgtagagtttgggcgataaggatatggagttggaggagagcgtggaggagcggttgttgagtttagagttcgagtttattgttatcgaggtcgggttggcggttagggcggcgattttgtcgtttaggggtttcgcggtcgtcgttatggagggtagggcggtggtgagtagattgttgtcgttcgggatcggtatcgggatggagtaggggttgtagcgtagtcgcgggcgtatggtgtttagattgaggaaggggtggcggtgtatcgagttggaggttgtcgtagaggaggcggtcgtcgttgcggttatgtacgtgtaggggtaagggaataggttttcgaaaggggatatggttaggttttggggtgagaaaagagatatatagcgagttagtt

SEQ ID NO: 32086 - DNA, 574 bp, Artificial Sequence
  chemically treated genomic DNA (Homo sapiens) CpG-island No: 32086
aactaactcgctatatatctcttttctcaccccaaaacctaaccatatcccctttcgaaaacctattcccttacccctacacgtacataaccgcaacgacgaccgcctcctctacgacaacctccaactcgatacaccgccaccccttcctcaatctaaacaccatacgcccgcgactacgctacaacccctactccatcccgataccgatcccgaacgacaacaatctactcaccaccgccctaccctccataacgacgaccgcgaaacccctaaacgacaaaatcgccgccctaaccgccaacccgacctcgataacaataaactcgaactctaaactcaacaaccgctcctccacgctctcctccaactccatatccttatcgcccaaactctacgcgaaaaaaaaaacgaccaccaacgaactacaaaacatccaacgattaattaacgacttaaaaaccaaaccgaacaaatcccgcaacgcgtccccgtaaacccgtcccaaacacgtcttttcattccaatccaattcaaactaccgtacactttatcgaatataaaataaaccacg

SEQ ID NO: 32087 - DNA, 574 bp, Artificial Sequence
  chemically treated genomic DNA (Homo sapiens) CpG-island No: 32087
ggttgattcgttgtgtgtttttttttttattttagggtttggttatgttttttttcggaagtttgtttttttatttttatacgtatatggtcgtagcggcggtcgttttttttgcggtagtttttagttcggtgtatcgttattttttttttaatttgaatattatgcgttcgcggttgcgttatagtttttattttatttcggtgtcggtttcggacggtagtagtttgtttattatcgttttgttttttatggcggcggtcgcggggtttttggacggtaaagtcgtcgttttggtcgttagttcggtttcggtggtagtggattcgggttttgaatttaatagtcgtttttttacgtttttttttagttttatgtttttgtcgtttaaattttgcgcggagaaagaggcggttattagcgaattgtagagtatttagcggttggttagcggtttggaagttaagtcggataggtttcgtagcgcgttttcgtagattcgttttagatacgtttttttattttagtttagtttaggttgtcgtgtattttgtcggatataaaataaattacg

SEQ ID NO: 32088 - DNA, 574 bp, Artificial Sequence
  chemically treated genomic DNA (Homo sapiens) CpG-island No: 32088
cgtaatttattttatatccgacaaaatacacgacaacctaaactaaactaaaataaaaaaacgtatctaaaacgaatctacgaaaacgcgctacgaaacctatccgacttaacttccaaaccgctaaccaaccgctaaatactctacaattcgctaataaccgcctctttctccgcgcaaaatttaaacgacaaaaacataaaactaaaaaaaaacgtaaaaaaacgactattaaattcaaaacccgaatccactaccaccgaaaccgaactaacgaccaaaacgacgactttaccgtccaaaaaccccgcgaccgccgccataaaaaacaaaacgataataaacaaactactaccgtccgaaaccgacaccgaaataaaataaaaactataacgcaaccgcgaacgcataatattcaaattaaaaaaaaaataacgatacaccgaactaaaaactaccgcaaaaaaaacgaccgccgctacgaccatatacgtataaaaataaaaaaacaaacttccgaaaaaaaacataaccaaaccctaaaataaaaaaaaaaacacacaacgaatcaacc

SEQ ID NO: 32089 - DNA, 687 bp, Artificial Sequence
  chemically treated genomic DNA (Homo sapiens) CpG-island No: 32089
  misc_feature (472)..(472): n is either a, c, g or t
  misc_feature (587)..(587): n is either a, c, g or t
ggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgnttcggcgagtatatggaaacggttggtatggattgtaggcgtcgatttatattttgtttgttttttcgcgttgcgtcgcggtgtatggagttcggtttattcgatttgaatggangtcggcgggttttcgttaacggatttttttatttttagaaattggaatttaattaattttttgcggagaattgtgaatgtcgtaaatttattttttggta

SEQ ID NO: 32090 - DNA, 687 bp, Artificial Sequence
  chemically treated genomic DNA (Homo sapiens) CpG-island No: 32090
  misc_feature (101)..(101): n is either a, c, g or t
  misc_feature (216)..(216): n is either a, c, g or t
taccaaaaaataaatttacgacattcacaattctccgcaaaaaattaattaaattccaatttctaaaaataaaaaaatccgttaacgaaaacccgccgacntccattcaaatcgaataaaccgaactccatacaccgcgacgcaacgcgaaaaaacaaacaaaatataaatcgacgcctacaatccataccaaccgtttccatatactcgccgaancgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccacc

SEQ ID NO: 32091 - DNA, 687 bp, Artificial Sequence
  chemically treated genomic DNA (Homo sapiens) CpG-island No: 32091
  misc_feature (101)..(101): n is either a, c, g or t
  misc_feature (216)..(216): n is either a, c, g or t
tgttaaggggtgggtttgcggtatttatagtttttcgtaaagaattgattgggttttaatttttgggagtggggaaattcgttagcgagggttcgtcggtntttatttaggtcgagtgggtcgggttttatgtatcgcgacgtaacgcggggaggtagataaggtataggtcggcgtttataatttatgttaatcgtttttatgtgttcgtcgagncggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatt

SEQ ID NO: 32092 - DNA, 687 bp, Artificial Sequence
  chemically treated genomic DNA (Homo sapiens) CpG-island No: 32092
  misc_feature (472)..(472): n is either a, c, g or t
  misc_feature (587)..(587): n is either a, c, g or t
aataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgnctcgacgaacacataaaaacgattaacataaattataaacgccgacctataccttatctacctccccgcgttacgtcgcgatacataaaacccgacccactcgacctaaataaanaccgacgaaccctcgctaacgaatttccccactcccaaaaattaaaacccaatcaattctttacgaaaaactataaataccgcaaacccaccccttaaca

SEQ ID NO: 32093 - DNA, 543 bp, Artificial Sequence
  chemically treated genomic DNA (Homo sapiens) CpG-island No: 32093
taagcgcggggttcgtcgtttgttggggattcgagtcggtttgtggttttcggggaatcgaagacgcgtttttagcgattttgaagagttagttaagttttttgcgggttaaggagacggtgaaggaatcgggattaattggggtaggggttagaaggtagttcgcgagtgggttacgaggggagttgggttcggtagttggggatttcgagggggtaagcgggcggggagtaggagaggggcggagtttcggggtcggggtcggggtcgtagcggtcgtttagagggtttgcgggggttgttgtggtcggattcgaaggcgggcgtcgggagcgtagcgagttagacgcgtttttttaagatcgtgattttggtatagggagcggggttgcgcgtagttttgagattagattagagtttattttcgtggagatttacggtcgaggggtcggagttgtttttgtgcgagggagttttggtcgcggcgtaggtaggatcggggaatttaaggagggcgggaggaaagcgtttttggtgggggag

SEQ ID NO: 32094 - DNA, 543 bp, Artificial Sequence
  chemically treated genomic DNA (Homo sapiens) CpG-island No: 32094
ctcccccaccaaaaacgctttcctcccgccctccttaaattccccgatcctacctacgccgcgaccaaaactccctcgcacaaaaacaactccgacccctcgaccgtaaatctccacgaaaataaactctaatctaatctcaaaactacgcgcaaccccgctccctataccaaaatcacgatcttaaaaaaacgcgtctaactcgctacgctcccgacgcccgccttcgaatccgaccacaacaacccccgcaaaccctctaaacgaccgctacgaccccgaccccgaccccgaaactccgcccctctcctactccccgcccgcttaccccctcgaaatccccaactaccgaacccaactcccctcgtaacccactcgcgaactaccttctaacccctaccccaattaatcccgattccttcaccgtctccttaacccgcaaaaaacttaactaactcttcaaaatcgctaaaaacgcgtcttcgattccccgaaaaccacaaaccgactcgaatccccaacaaacgacgaaccccgcgctta

SEQ ID NO: 32095 - DNA, 543 bp, Artificial Sequence
  chemically treated genomic DNA (Homo sapiens) CpG-island No: 32095
tttttttattaggggcgtttttttttcgttttttttgggtttttcggttttatttgcgtcgcggttagggttttttcgtatagaggtagtttcggtttttcggtcgtgggtttttacgaggatgagttttggtttgattttaggattgcgcgtagtttcgttttttatgttaaggttacggttttggagaggcgcgtttggttcgttgcgttttcggcgttcgttttcgggttcggttatagtagttttcgtagattttttgggcggtcgttgcggtttcggtttcggtttcggagtttcgttttttttttgtttttcgttcgtttgttttttcggggtttttaattgtcgagtttagtttttttcgtagtttattcgcgggttgttttttaatttttattttagttagtttcggtttttttatcgtttttttagttcgtagagagtttagttgattttttagggtcgttgagggcgcgttttcggtttttcgagggttataggtcggttcgggtttttagtagacggcgagtttcgcgttta

SEQ ID NO: 32096 - DNA, 543 bp, Artificial Sequence
  chemically treated genomic DNA (Homo sapiens) CpG-island No: 32096
taaacgcgaaactcgccgtctactaaaaacccgaaccgacctataaccctcgaaaaaccgaaaacgcgccctcaacgaccctaaaaaatcaactaaactctctacgaactaaaaaaacgataaaaaaaccgaaactaactaaaataaaaattaaaaaacaacccgcgaataaactacgaaaaaaactaaactcgacaattaaaaaccccgaaaaaacaaacgaacgaaaaacaaaaaaaaaacgaaactccgaaaccgaaaccgaaaccgcaacgaccgcccaaaaaatctacgaaaactactataaccgaacccgaaaacgaacgccgaaaacgcaacgaaccaaacgcgcctctccaaaaccgtaaccttaacataaaaaacgaaactacgcgcaatcctaaaatcaaaccaaaactcatcctcgtaaaaacccacgaccgaaaaaccgaaactacctctatacgaaaaaaccctaaccgcgacgcaaataaaaccgaaaaacccaaaaaaaacgaaaaaaaaacgcccctaataaaaaaa

SEQ ID NO: 32097 - DNA, 893 bp, Artificial Sequence
  chemically treated genomic DNA (Homo sapiens) CpG-island No: 32097
  misc_feature (305)..(306): n is either a, c, g or t
  misc_feature (309)..(309): n is either a, c, g or t
  misc_feature (315)..(315): n is either a, c, g or t
  misc_feature (352)..(352): n is either a, c, g or t
  misc_feature (364)..(364): n is either a, c, g or t
  misc_feature (728)..(728): n is either a, c, g or t
ttcggtttggattttaattttttttgtttttcgtattcgttaagcgtcgatggttttacgtttttttatgtcgacgatagtattcgttagttttggattgattattgtaaagttagtcgtcgcgtttcggtttattttggcgagtaattcggtatattatcggtgatgaatatttggatttcgggtggtttgaaagaattatcgttgatcgtttcgtttcgcgttagcgttcgtaggtagtattggatgaggggattagcgataagttaaattttgcgtattagacgatcgtcgtgagagtaaanngtngggtangggcgtagagagttatacggttggttttaatgagttntatatggggtangttattagtcgttagattgcgttgcgtttggacgtcgggtatttttattcgattgaagtgattttcgataagattttcgtcgttatgttgtatgggtcgtagttgttgttgtacgttagtcgttcggttcgttgggatagcgattacgtagtgttgttggatgatgaaatttaggtaattgttagtgagattgtgcgttacgatttgtttgatcgggtgtatatcggttttgattttttcgatgtttttattaatcgtattgtcgcgtgggttattggtatattttttacgaaaaaagttttgttgcgtgcgttgttggaatttatcgtttatttgcgtaagttggaagcggcgggaaattatntagcgcgtttggtattgttggaagagtagaaatcgttgtcgtggtagacggtttgggaaatgtattgttaacgttacgatacgttagtaggtagcgaatggttggagagcgtgcgggttattaggattttttttgagtcgtcgcgggtaaatattgtcggatgcg

SEQ ID NO: 32098 - DNA, 893 bp, Artificial Sequence
  chemically treated genomic DNA (Homo sapiens) CpG-island No: 32098
  misc_feature (166)..(166): n is either a, c, g or t
  misc_feature (530)..(530): n is either a, c, g or t
  misc_feature (542)..(542): n is either a, c, g or t
  misc_feature (579)..(579): n is either a, c, g or t
  misc_feature (585)..(585): n is either a, c, g or t
  misc_feature (588)..(589): n is either a, c, g or t
cgcatccgacaatatttacccgcgacgactcaaaaaaaatcctaataacccgcacgctctccaaccattcgctacctactaacgtatcgtaacgttaacaatacatttcccaaaccgtctaccacgacaacgatttctactcttccaacaataccaaacgcgctanataatttcccgccgcttccaacttacgcaaataaacgataaattccaacaacgcacgcaacaaaacttttttcgtaaaaaatataccaataacccacgcgacaatacgattaataaaaacatcgaaaaaatcaaaaccgatatacacccgatcaaacaaatcgtaacgcacaatctcactaacaattacctaaatttcatcatccaacaacactacgtaatcgctatcccaacgaaccgaacgactaacgtacaacaacaactacgacccatacaacataacgacgaaaatcttatcgaaaatcacttcaatcgaataaaaatacccgacgtccaaacgcaacgcaatctaacgactaataacntaccccatatanaactcattaaaaccaaccgtataactctctacgcccntacccnacnntttactctcacgacgatcgtctaatacgcaaaatttaacttatcgctaatcccctcatccaatactacctacgaacgctaacgcgaaacgaaacgatcaacgataattctttcaaaccacccgaaatccaaatattcatcaccgataatataccgaattactcgccaaaataaaccgaaacgcgacgactaactttacaataatcaatccaaaactaacgaatactatcgtcgacataaaaaaacgtaaaaccatcgacgcttaacgaatacgaaaaacaaaaaaaattaaaatccaaaccgaa

SEQ ID NO: 32099 - DNA, 893 bp, Artificial Sequence
  chemically treated genomic DNA (Homo sapiens) CpG-island No: 32099
  misc_feature (166)..(166): n is either a, c, g or t
  misc_feature (530)..(530): n is either a, c, g or t
  misc_feature (542)..(542): n is either a, c, g or t
  misc_feature (579)..(579): n is either a, c, g or t
  misc_feature (585)..(585): n is either a, c, g or t
  misc_feature (588)..(589): n is either a, c, g or t
cgtattcggtagtgtttattcgcggcgatttaaaaggggttttgatagttcgtacgttttttagttattcgttatttgttggcgtatcgtgacgttggtaatatattttttagatcgtttgttacggtaacgatttttgtttttttagtagtgttagacgcgttgngtaatttttcgtcgtttttagtttgcgtaggtgggcggtaggttttagtaacgtacgtagtagggtttttttcgtagggggtgtattaatgatttacgcggtagtgcggttgatagaggtatcgaagaagttaaggtcgatatgtattcggttaaatagatcgtgacgtataattttattggtaattgtttgggttttattatttagtagtattacgtgatcgttgttttagcgaatcggacggttgacgtgtagtagtaattgcggtttatatagtatggcggcggaaattttgtcggaaattattttagtcgggtggaagtgttcggcgtttaggcgtagcgtagtttggcggttggtggtntattttatgtgngatttattggagttaatcgtgtagttttttgcgtttntgtttnatnntttgtttttacggcggtcgtttggtgcgtagggtttagtttgtcgttggtttttttatttagtgttgtttgcggacgttggcgcggggcgagacggttaacggtgatttttttaaattattcgggatttagatgtttattatcgatggtgtgtcgagttgttcgttaaaataggtcgaaacgcgacggttggttttgtagtgattaatttagaattggcgaatgttgtcgtcggtatgggaaagcgtaaagttatcggcgtttagcggatgcgaaaagtaggaggggttaaaatttagatcgag

SEQ ID NO: 32100 - DNA, 893 bp, Artificial Sequence
  chemically treated genomic DNA (Homo sapiens) CpG-island No: 32100
  misc_feature (305)..(306): n is either a, c, g or t
  misc_feature (309)..(309): n is either a, c, g or t
  misc_feature (315)..(315): n is either a, c, g or t
  misc_feature (352)..(352): n is either a, c, g or t
  misc_feature (364)..(364): n is either a, c, g or t
  misc_feature (728)..(728): n is either a, c, g or t
ctcgatctaaattttaacccctcctacttttcgcatccgctaaacgccgataactttacgctttcccataccgacgacaacattcgccaattctaaattaatcactacaaaaccaaccgtcgcgtttcgacctattttaacgaacaactcgacacaccatcgataataaacatctaaatcccgaataatttaaaaaaatcaccgttaaccgtctcgccccgcgccaacgtccgcaaacaacactaaataaaaaaaccaacgacaaactaaaccctacgcaccaaacgaccgccgtaaaaacaaannatnaaacanaaacgcaaaaaactacacgattaactccaataaatcncacataaaatanaccaccaaccgccaaactacgctacgcctaaacgccgaacacttccacccgactaaaataatttccgacaaaatttccgccgccatactatataaaccgcaattactactacacgtcaaccgtccgattcgctaaaacaacgatcacgtaatactactaaataataaaacccaaacaattaccaataaaattatacgtcacgatctatttaaccgaatacatatcgaccttaacttcttcgatacctctatcaaccgcactaccgcgtaaatcattaatacaccccctacgaaaaaaaccctactacgtacgttactaaaacctaccgcccacctacgcaaactaaaaacgacgaaaaattacncaacgcgtctaacactactaaaaaaacaaaaatcgttaccgtaacaaacgatctaaaaaatatattaccaacgtcacgatacgccaacaaataacgaataactaaaaaacgtacgaactatcaaaaccccttttaaatcgccgcgaataaacactaccgaatacg

SEQ ID NO: 32101 - DNA, 648 bp, Artificial Sequence
  chemically treated genomic DNA (Homo sapiens) CpG-island No: 32101
  misc_feature (15)..(15): n is either a, c, g or t
  misc_feature (41)..(42): n is either a, c, g or t
  misc_feature (78)..(78): n is either a, c, g or t
  misc_feature (90)..(90): n is either a, c, g or t
  misc_feature (218)..(218): n is either a, c, g or t
  misc_feature (275)..(275): n is either a, c, g or t
  misc_feature (279)..(279): n is either a, c, g or t
  misc_feature (332)..(332): n is either a, c, g or t
  misc_feature (339)..(339): n is either a, c, g or t
  misc_feature (392)..(392): n is either a, c, g or t
  misc_feature (473)..(473): n is either a, c, g or t
  misc_feature (510)..(510): n is either a, c, g or t
  misc_feature (521)..(521): n is either a, c, g or t
  misc_feature (541)..(541): n is either a, c, g or t
  misc_feature (543)..(546): n is either a, c, g or t
gggcgtgtgggggtncggcggcgttcgcggggcgcggcganntttttttttttcgtttttcgttttcgttttcgtttngggcgcgttttnttcggcgggggcgcgcgtttttttttttcgcgggggcgttcgcgtcgggggggggggggtttcgtcgggcggtcgtcggcggggtcgcgggggggggggggggtcgcgtcggtcggggttcgtcgcgnggggggcggtttcgcgtcgcgttttcgtttcgcgttttcgggcgtcgcgcggtcgtngggnggttcggggcggcgtcgtttcggcgttcgcgtttttcgtcgcgcgtttcgcgngcgtttngggcgtttcgtttcgtcgcggcggggcgggggggtcgtcgttcgttcgcgcgngcggcgttcgttcgcgcgtcgcgcgttcggttttttttttttcgggcgttcgttttttttcgtcgttttttcgcgcggcgngggttttttcgtcggtcgttcgtcggtcgttcgtttncgcgcgcggtngcgtcgcgggcgtttttttngnnnnggtcgtcgggggcggcgtttcgtcgtttttttcgcgggcgcggcgttttcggcgtttcgtcgtcgcggttcgcgttcgtcgtttttcgtcggggcgcggtcg

SEQ ID NO: 32102 - DNA, 648 bp, Artificial Sequence
  chemically treated genomic DNA (Homo sapiens) CpG-island No: 32102
  misc_feature (103)..(106): n is either a, c, g or t
  misc_feature (108)..(108): n is either a, c, g or t
  misc_feature (128)..(128): n is either a, c, g or t
  misc_feature (139)..(139): n is either a, c, g or t
  misc_feature (176)..(176): n is either a, c, g or t
  misc_feature (257)..(257): n is either a, c, g or t
  misc_feature (310)..(310): n is either a, c, g or t
  misc_feature (317)..(317): n is either a, c, g or t
  misc_feature (370)..(370): n is either a, c, g or t
  misc_feature (374)..(374): n is either a, c, g or t
  misc_feature (431)..(431): n is either a, c, g or t
  misc_feature (559)..(559): n is either a, c, g or t
  misc_feature (571)..(571): n is either a, c, g or t
  misc_feature (607)..(608): n is either a, c, g or t
  misc_feature (634)..(634): n is either a, c, g or t
cgaccgcgccccgacgaaaaacgacgaacgcgaaccgcgacgacgaaacgccgaaaacgccgcgcccgcgaaaaaaacgacgaaacgccgcccccgacgaccnnnncnaaaaaaacgcccgcgacgcnaccgcgcgcgnaaacgaacgaccgacgaacgaccgacgaaaaaacccncgccgcgcgaaaaaacgacgaaaaaaaacgaacgcccgaaaaaaaaaaaaccgaacgcgcgacgcgcgaacgaacgccgcncgcgcgaacgaacgacgacccccccgccccgccgcgacgaaacgaaacgcccnaaacgcncgcgaaacgcgcgacgaaaaacgcgaacgccgaaacgacgccgccccgaaccncccnacgaccgcgcgacgcccgaaaacgcgaaacgaaaacgcgacgcgaaaccgccccccncgcgacgaaccccgaccgacgcgacccccccccccccccgcgaccccgccgacgaccgcccgacgaaacccccccccccccgacgcgaacgcccccgcgaaaaaaaaaaacgcgcgcccccgccgaanaaaacgcgcccnaaacgaaaacgaaaacgaaaaacgaaaaaaaaaaanntcgccgcgccccgcgaacgccgccgnacccccacacgccc

SEQ ID NO: 32103 - DNA, 648 bp, Artificial Sequence
  chemically treated genomic DNA (Homo sapiens) CpG-island No: 32103
  misc_feature (103)..(106): n is either a, c, g or t
  misc_feature (108)..(108): n is either a, c, g or t
  misc_feature (128)..(128): n is either a, c, g or t
  misc_feature (139)..(139): n is either a, c, g or t
  misc_feature (176)..(176): n is either a, c, g or t
  misc_feature (257)..(257): n is either a, c, g or t
  misc_feature (310)..(310): n is either a, c, g or t
  misc_feature (317)..(317): n is either a, c, g or t
  misc_feature (370)..(370): n is either a, c, g or t
  misc_feature (374)..(374): n is either a, c, g or t
  misc_feature (431)..(431): n is either a, c, g or t
  misc_feature (559)..(559): n is either a, c, g or t
  misc_feature (571)..(571): n is either a, c, g or t
  misc_feature (607)..(608): n is either a, c, g or t
  misc_feature (634)..(634): n is either a, c, g or t
cggtcgcgtttcggcggggggcggcgggcgcgggtcgcggcggcggggcgtcgggggcgtcgcgttcgcggggggggcggcggggcgtcgttttcggcggttnnnntngggggggcgttcgcggcgtngtcgcgcgcgngggcgggcggtcggcgggcggtcggcgggggggtttncgtcgcgcgggggggcggcgggggggggcgggcgttcgggggggggggggtcgggcgcgcggcgcgcgggcgggcgtcgtncgcgcgggcgggcggcggttttttcgtttcgtcgcggcggggcggggcgtttngggcgtncgcggggcgcgcggcggggggcgcgggcgtcggggcggcgtcgtttcgggttntttngcggtcgcgcggcgttcgggggcgcggggcgggggcgcggcgcggggtcgttttttncgcggcgggtttcggtcggcgcggttttttttttttttcgcggtttcgtcggcggtcgttcggcggggttttttttttttcggcgcgggcgttttcgcggggggggggggcgcgcgttttcgtcgggnggggcgcgtttngggcgggggcgggggcggggggcggggggggggggnntcgtcgcgtttcgcgggcgtcgtcgngtttttatacgttt

SEQ ID NO: 32104 - DNA, 648 bp, Artificial Sequence
  chemically treated genomic DNA (Homo sapiens) CpG-island No: 32104
  misc_feature (15)..(15): n is either a, c, g or t
  misc_feature (41)..(42): n is either a, c, g or t
  misc_feature (78)..(78): n is either a, c, g or t
  misc_feature (90)..(90): n is either a, c, g or t
  misc_feature (218)..(218): n is either a, c, g or t
  misc_feature (275)..(275): n is either a, c, g or t
  misc_feature (279)..(279): n is either a, c, g or t
  misc_feature (332)..(332): n is either a, c, g or t
  misc_feature (339)..(339): n is either a, c, g or t
  misc_feature (392)..(392): n is either a, c, g or t
  misc_feature (473)..(473): n is either a, c, g or t
  misc_feature (510)..(510): n is either a, c, g or t
  misc_feature (521)..(521): n is either a, c, g or t
  misc_feature (541)..(541): n is either a, c, g or t
  misc_feature (543)..(546): n is either a, c, g or t
aaacgtataaaaacncgacgacgcccgcgaaacgcgacgannccccccccccccgccccccgcccccgcccccgcccnaaacgcgccccncccgacgaaaacgcgcgccccccccccccgcgaaaacgcccgcgccgaaaaaaaaaaaaccccgccgaacgaccgccgacgaaaccgcgaaaaaaaaaaaaaaccgcgccgaccgaaacccgccgcgnaaaaaacgaccccgcgccgcgcccccgccccgcgcccccgaacgccgcgcgaccgcnaaanaacccgaaacgacgccgccccgacgcccgcgccccccgccgcgcgccccgcgnacgcccnaaacgccccgccccgccgcgacgaaacgaaaaaaccgccgcccgcccgcgcgnacgacgcccgcccgcgcgccgcgcgcccgacccccccccccccgaacgcccgcccccccccgccgcccccccgcgcgacgnaaacccccccgccgaccgcccgccgaccgcccgcccncgcgcgcgacnacgccgcgaacgcccccccnannnnaaccgccgaaaacgacgccccgccgccccccccgcgaacgcgacgcccccgacgccccgccgccgcgacccgcgcccgccgccccccgccgaaacgcgaccg

SEQ ID NO: 32105 - DNA, 840 bp, Artificial Sequence
  chemically treated genomic DNA (Homo sapiens) CpG-island No: 32105
ttttttcgcgcggggtcgcggttgtttttgggaagtgtggtggtttgagttttacgtttttcgttttttcgttagttgtgcgtttggtcgcgagatattttggtagttataggaatataaaggtttgtgtattttttcgcggggggtcgcggtatttttgggaaatgtagttgtttaggattcgggttttttgtttttcggttttgggcgtgggagtatagtttttatgttttggcgtatcgggtcgcgatggttttgggaattgtagttgtcgtaggttttcgttttttgttttttggcgttttgggtacggtagcgaggcgttttgggagttttagtaggaacgaaaagtttttgcgcgtagggtcgtattggtttttgggaattgtagttttttgaggtcggcggtttggttggggtgacgtcggcgaggtttttgaagacgtaatttttgcgacgttcgcggaggggtttggggggcggcgtcgagcgtttggtttgtgttggttgtaggtaacgaaaggagttttttcggtttgcgtcggatggtttcgggcggtgattcggttcggagttttggaacgttacgtttatttggcggaaagtattacggaaacgtatttttttgtggttattgttaggtgagggggttttggggaggcgcgtcgtggtaggaagagaaagtcggcgttagtggtttaagcgcgattttttagggcgttttgttttttacgtgggaggcgcggagcgggggttacgggaatttttagtgcgggaatttagtgatttgggcgcggtttagttggtttgttcgtttagggtttttttttttttttgtta

SEQ ID NO: 32106 - DNA, 840 bp, Artificial Sequence
  chemically treated genomic DNA (Homo sapiens) CpG-island No: 32106
taacaaaaaaaaaaaaaaaccctaaacgaacaaaccaactaaaccgcgcccaaatcactaaattcccgcactaaaaattcccgtaacccccgctccgcgcctcccacgtaaaaaacaaaacgccctaaaaaatcgcgcttaaaccactaacgccgactttctcttcctaccacgacgcgcctccccaaaaccccctcacctaacaataaccacaaaaaaatacgtttccgtaatactttccgccaaataaacgtaacgttccaaaactccgaaccgaatcaccgcccgaaaccatccgacgcaaaccgaaaaaactcctttcgttacctacaaccaacacaaaccaaacgctcgacgccgccccccaaacccctccgcgaacgtcgcaaaaattacgtcttcaaaaacctcgccgacgtcaccccaaccaaaccgccgacctcaaaaaactacaattcccaaaaaccaatacgaccctacgcgcaaaaacttttcgttcctactaaaactcccaaaacgcctcgctaccgtacccaaaacgccaaaaaacaaaaaacgaaaacctacgacaactacaattcccaaaaccatcgcgacccgatacgccaaaacataaaaactatactcccacgcccaaaaccgaaaaacaaaaaacccgaatcctaaacaactacatttcccaaaaataccgcgaccccccgcgaaaaaatacacaaacctttatattcctataactaccaaaatatctcgcgaccaaacgcacaactaacgaaaaaacgaaaaacgtaaaactcaaaccaccacacttcccaaaaacaaccgcgaccccgcgcgaaaaaa

SEQ ID NO: 32107 - DNA, 840 bp, Artificial Sequence
  chemically treated genomic DNA (Homo sapiens) CpG-island No: 32107
tggtagagagagaaaggagttttgagcgaataggttagttaggtcgcgtttaagttattagattttcgtattggggattttcgtggttttcgtttcgcgttttttacgtagagagtagggcgttttgagagatcgcgtttggattattggcgtcggttttttttttttgttacggcgcgtttttttagaatttttttatttaatagtggttatagaaggatgcgttttcgtggtgtttttcgttaggtgggcgtagcgttttagggtttcggatcgagttatcgttcggggttattcggcgtagatcgggagggtttttttcgttgtttatagttaatataggttagacgttcggcgtcgttttttaggttttttcgcgggcgtcgtaggaattgcgtttttagaagtttcgtcgacgttattttaattaggtcgtcggttttaagaaattataatttttagaaattaatgcggttttgcgcgtaagggtttttcgtttttattggaatttttagagcgtttcgttgtcgtgtttagaacgttaggagataaagaacgagggtttgcgataattataatttttagagttatcgcggttcggtgcgttagagtataggggttatatttttacgtttagagtcgagaaataaagaattcgggttttaggtaattatattttttagaaatatcgcggtttttcgcggaagagtatatagatttttgtgtttttataattgttagagtgtttcgcggttaagcgtataattagcggagaaacgaagaacgtggaatttaggttattatattttttagaaataatcgcgatttcgcgcgagagag

SEQ ID NO: 32108 - DNA, 840 bp, Artificial Sequence
  chemically treated genomic DNA (Homo sapiens) CpG-island No: 32108
ctctctcgcgcgaaatcgcgattatttctaaaaaatataataacctaaattccacgttcttcgtttctccgctaattatacgcttaaccgcgaaacactctaacaattataaaaacacaaaaatctatatactcttccgcgaaaaaccgcgatatttctaaaaaatataattacctaaaacccgaattctttatttctcgactctaaacgtaaaaatataacccctatactctaacgcaccgaaccgcgataactctaaaaattataattatcgcaaaccctcgttctttatctcctaacgttctaaacacgacaacgaaacgctctaaaaattccaataaaaacgaaaaacccttacgcgcaaaaccgcattaatttctaaaaattataatttcttaaaaccgacgacctaattaaaataacgtcgacgaaacttctaaaaacgcaattcctacgacgcccgcgaaaaaacctaaaaaacgacgccgaacgtctaacctatattaactataaacaacgaaaaaaaccctcccgatctacgccgaataaccccgaacgataactcgatccgaaaccctaaaacgctacgcccacctaacgaaaaacaccacgaaaacgcatccttctataaccactattaaataaaaaaattctaaaaaaacgcgccgtaacaaaaaaaaaaaaccgacgccaataatccaaacgcgatctctcaaaacgccctactctctacgtaaaaaacgcgaaacgaaaaccacgaaaatccccaatacgaaaatctaataacttaaacgcgacctaactaacctattcgctcaaaactcctttctctctctacca

SEQ ID NO: 32109 - DNA, 507 bp, Artificial Sequence
  chemically treated genomic DNA (Homo sapiens) CpG-island No: 32109
tagcggagcgcgaagagcggcgttagaggtgagtttgaggtcggttcggtacggcggcgttattttttcgtggtttgacgttacgtacgcgtacgcgtttcgtttttattggttttacgttcgtttttgttgcgaacgtacgtatacgtatttataatatatatcgttacgtacgcgttttagtttggcgtttaggttacgtttcgtttttagttcgttagtcgcgcgtttcgggattttagagtcggcgattcgtcgtcggcgtcgtagtcgttattttgtgtcggattttgcgggttttcggtttagagcgcgttcgtgacgtatagattaggtttttttgcggggcggcgtaggagtttttgggaaacgtagttcggtttcgcgtttttttcgggcgggatcgcggacgtttggaggtaggtattgaggacgggtgagtatgcgggtttgtggttcgtttattcgggataagtttttcgtgggattagtttggttcgttgagtt

SEQ ID NO: 32110 - DNA, 507 bp, Artificial Sequence
  chemically treated genomic DNA (Homo sapiens) CpG-island No: 32110
aactcaacgaaccaaactaatcccacgaaaaacttatcccgaataaacgaaccacaaacccgcatactcacccgtcctcaatacctacctccaaacgtccgcgatcccgcccgaaaaaaacgcgaaaccgaactacgtttcccaaaaactcctacgccgccccgcaaaaaaacctaatctatacgtcacgaacgcgctctaaaccgaaaacccgcaaaatccgacacaaaataacgactacgacgccgacgacgaatcgccgactctaaaatcccgaaacgcgcgactaacgaactaaaaacgaaacgtaacctaaacgccaaactaaaacgcgtacgtaacgatatatattataaatacgtatacgtacgttcgcaacaaaaacgaacgtaaaaccaataaaaacgaaacgcgtacgcgtacgtaacgtcaaaccacgaaaaaataacgccgccgtaccgaaccgacctcaaactcacctctaacgccgctcttcgcgctccgcta

SEQ ID NO: 32111 - DNA, 507 bp, Artificial Sequence
  chemically treated genomic DNA (Homo sapiens) CpG-island No: 32111
aatttagcgggttaggttgattttacgagggatttgtttcgggtgaacgagttataggttcgtatgtttattcgtttttagtgtttgtttttaggcgttcgcggtttcgttcgagggggacgcgaggtcgaattacgttttttaggagtttttgcgtcgtttcgtagaggggtttggtttgtgcgttacggacgcgttttgggtcgaaggttcgtagggttcggtatagagtggcggttgcggcgtcggcgacgaatcgtcggttttagggtttcggggcgcgcggttgacgggttgggggcggagcgtggtttgaacgttaggttggggcgcgtgcgtaacggtgtgtgttgtgggtgcgtgtgcgtgcgttcgtagtaggggcgggcgtaggattaatgggggcggggcgcgtgcgcgtgcgtgacgttaggttacggggaggtggcgtcgtcgtgtcgagtcggttttagatttatttttgacgtcgtttttcgcgtttcgttg

SEQ ID NO: 32112 - DNA, 507 bp, Artificial Sequence
  chemically treated genomic DNA (Homo sapiens) CpG-island No: 32112
caacgaaacgcgaaaaacgacgtcaaaaataaatctaaaaccgactcgacacgacgacgccacctccccgtaacctaacgtcacgcacgcgcacgcgccccgcccccattaatcctacgcccgcccctactacgaacgcacgcacacgcacccacaacacacaccgttacgcacgcgccccaacctaacgttcaaaccacgctccgcccccaacccgtcaaccgcgcgccccgaaaccctaaaaccgacgattcgtcgccgacgccgcaaccgccactctataccgaaccctacgaaccttcgacccaaaacgcgtccgtaacgcacaaaccaaacccctctacgaaacgacgcaaaaactcctaaaaaacgtaattcgacctcgcgtccccctcgaacgaaaccgcgaacgcctaaaaacaaacactaaaaacgaataaacatacgaacctataactcgttcacccgaaacaaatccctcgtaaaatcaacctaacccgctaaatt

SEQ ID NO: 32113 - DNA, 582 bp, Artificial Sequence
  chemically treated genomic DNA (Homo sapiens) CpG-island No: 32113
  misc_feature (111)..(111): n is either a, c, g or t
tttggcgggtcgtgacgtggttgcgcgttttattatgatcgaaattcgtgaaggtcgcggttgtgatggttcgtgggggttatacgcgaaattgaaattcgattatttggngtaagaagttttcgaatttcgtttgtcgggtattttggagttttttcgtattttcgtttacgtcgattcggtgaaagagtcgatttcggttattttaatttgttattatatgatgggcggtatttcgattaaagttatcggttaggtattgattgtgaatgagaaaggcgaagatgtggttgtttcgggattgtttgtcgttggtgaaatcgtttgtgtatcggtatacggcgttaatcgtttgggcggtaattcgttgttggatttggtggtttttggtcgcgcggtaggtttgtatttgtaagagtttatcgtcgagtagggcgtattgcgcgatgttagcgagtttgatgttgaagcgttttggatcgtttgaatcgttggaataataatcgtaacggtgaagattcggtggcgattcgtaaagcgttgtaagaatgtatgtagtataatttttcggtttttcgtgaa

SEQ ID NO: 32114 - DNA, 582 bp, Artificial Sequence
  chemically treated genomic DNA (Homo sapiens) CpG-island No: 32114
  misc_feature (472)..(472): n is either a, c, g or t
ttcacgaaaaaccgaaaaattatactacatacattcttacaacgctttacgaatcgccaccgaatcttcaccgttacgattattattccaacgattcaaacgatccaaaacgcttcaacatcaaactcgctaacatcgcgcaatacgccctactcgacgataaactcttacaaatacaaacctaccgcgcgaccaaaaaccaccaaatccaacaacgaattaccgcccaaacgattaacgccgtataccgatacacaaacgatttcaccaacgacaaacaatcccgaaacaaccacatcttcgcctttctcattcacaatcaatacctaaccgataactttaatcgaaataccgcccatcatataataacaaattaaaataaccgaaatcgactctttcaccgaatcgacgtaaacgaaaatacgaaaaaactccaaaatacccgacaaacgaaattcgaaaacttcttacnccaaataatcgaatttcaatttcgcgtataacccccacgaaccatcacaaccgcgaccttcacgaatttcgatcataataaaacgcgcaaccacgtcacgacccgccaaa

SEQ ID NO: 32115 - DNA, 582 bp, Artificial Sequence
  chemically treated genomic DNA (Homo sapiens) CpG-island No: 32115
  misc_feature (472)..(472): n is either a, c, g or t
tttacggaagatcgagaagttatgttgtatatatttttgtagcgttttacggatcgttatcggatttttatcgttacgattattgttttagcggtttaggcgatttagaacgttttaatattagattcgttggtatcgcgtagtgcgttttgttcggcgatagatttttgtagatgtagatttgtcgcgcgattaaagattattaggtttagtagcgagttgtcgtttagacggttagcgtcgtgtatcgatatataagcgattttattaacggtaaatagtttcggaataattatattttcgttttttttatttatagttagtgtttgatcggtaattttggtcggaatatcgtttattatgtagtgataggttgggataatcggaatcggtttttttatcggatcgacgtgagcgaaggtacgggaaagttttaggatattcggtagacgggattcgagaattttttatnttaggtgatcgagttttagtttcgcgtgtggtttttacggattattatagtcgcgatttttacggatttcgattatgatggaacgcgtaattacgttacggttcgttagg

SEQ ID NO: 32116 - DNA, 582 bp, Artificial Sequence
  chemically treated genomic DNA (Homo sapiens) CpG-island No: 32116
  misc_feature (111)..(111): n is either a, c, g or t
cctaacgaaccgtaacgtaattacgcgttccatcataatcgaaatccgtaaaaatcgcgactataataatccgtaaaaaccacacgcgaaactaaaactcgatcacctaanataaaaaattctcgaatcccgtctaccgaatatcctaaaactttcccgtaccttcgctcacgtcgatccgataaaaaaaccgattccgattatcccaacctatcactacataataaacgatattccgaccaaaattaccgatcaaacactaactataaataaaaaaaacgaaaatataattattccgaaactatttaccgttaataaaatcgcttatatatcgatacacgacgctaaccgtctaaacgacaactcgctactaaacctaataatctttaatcgcgcgacaaatctacatctacaaaaatctatcgccgaacaaaacgcactacgcgataccaacgaatctaatattaaaacgttctaaatcgcctaaaccgctaaaacaataatcgtaacgataaaaatccgataacgatccgtaaaacgctacaaaaatatatacaacataacttctcgatcttccgtaaa

SEQ ID NO: 32117 - DNA, 535 bp, Artificial Sequence
  chemically treated genomic DNA (Homo sapiens) CpG-island No: 32117
attcggtaacggtgtcgattgtttgatgcgacgtttgcgcgttttattaggtttataaattttcgtatttttcgtaggtcggataaggcgtttacgtcgtattcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtaggtcggattaaggcgtttacgtcgtattcggtaatggtgtcgattgtttgatgcgacgtttgcgcgttttattaggtttttaaattttcgtattttttcgtatgtcggatataggcgtttacgtcgtattcggtaatcgtgtataatgtttgatgcgacgtttcgcgttttattaggtttacgaaagttaattattacgcgttggtatgtcgtaatttatttggcgtagtgcgtttaatgtggttttggttttattttt

SEQ ID NO: 32118 - DNA, 535 bp, Artificial Sequence
  chemically treated genomic DNA (Homo sapiens) CpG-island No: 32118
aaaaataaaaccaaaaccacattaaacgcactacgccaaataaattacgacataccaacgcgtaataattaactttcgtaaacctaataaaacgcgaaacgtcgcatcaaacattatacacgattaccgaatacgacgtaaacgcctatatccgacatacgaaaaaatacgaaaatttaaaaacctaataaaacgcgcaaacgtcgcatcaaacaatcgacaccattaccgaatacgacgtaaacgccttaatccgacctacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaatacgacgtaaacgccttatccgacctacgaaaaatacgaaaatttataaacctaataaaacgcgcaaacgtcgcatcaaacaatcgacaccgttaccgaat

SEQ ID NO: 32119 - DNA, 535 bp, Artificial Sequence
  chemically treated genomic DNA (Homo sapiens) CpG-island No: 32119
gaagatgaagttaaagttatattagacgtattgcgttaaatggattacgatatattagcgcgtgatgattagttttcgtaggtttgataagacgcggagcgtcgtattaggtattgtgtacgattgtcggatgcggcgtaaacgtttatattcggtatacggaagggtgcgggaatttgaaggtttgataagacgcgtaagcgtcgtattaggtagtcggtattattgtcggatgcggcgtaaacgttttaattcggtttacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggatgcggcgtaaacgttttattcggtttacggagggtgcgggaatttgtaggtttgataagacgcgtaagcgtcgtattaggtagtcggtatcgttgtcggat

SEQ ID NO: 32120 - DNA, 535 bp, Artificial Sequence
  chemically treated genomic DNA (Homo sapiens) CpG-island No: 32120
atccgacaacgataccgactacctaatacgacgcttacgcgtcttatcaaacctacaaattcccgcaccctccgtaaaccgaataaaacgtttacgccgcatccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtaaaccgaattaaaacgtttacgccgcatccgacaataataccgactacctaatacgacgcttacgcgtcttatcaaaccttcaaattcccgcacccttccgtataccgaatataaacgtttacgccgcatccgacaatcgtacacaatacctaatacgacgctccgcgtcttatcaaacctacgaaaactaatcatcacgcgctaatatatcgtaatccatttaacgcaatacgtctaatataactttaacttcatcttc

SEQ ID NO: 32121 - DNA, 615 bp, Artificial Sequence
  chemically treated genomic DNA (Homo sapiens) CpG-island No: 32121
ggcgtcgtcgggtttaggtattagtagtagtagtgcgagtagtttgtatttttaacggttcgcgacggtcgtttagcgttgcgcggatttcggtcgcggtatttcgagaaggcggcggcggttttaatcgagttgcgagacgtagggttaggtttgcgcggatttatcgcgcgcggtaggttttagcgtaggttatttcgtaaagatatatagtagagtaggtttacgtttgtgggagattcgggattagagcgatttttcggttttttgtgaggggcgtagacgggcggatttggggaggtaaaagagaagcggaaaaggtttgagagggtcggaagtggggattagtttttcggggggtgaaggggcggagtttgagatatcggttttcgtgattcggatgcgttttttttcgggaatacgcgttggagtgcgtacgtggaagttcgcgaggcgttggttttgttttcgttgtagtttgggacgaggggcggggttagagtcgtgggcggagaggggcgagattaggaaacggggcgtggcggtcgtcgtggttataggcggttggcgagggtaattacgttttaattattggttttttttgttgtttttttt

SEQ ID NO: 32122 - DNA, 615 bp, Artificial Sequence
  chemically treated genomic DNA (Homo sapiens) CpG-island No: 32122
aaaaaaaacaacaaaaaaaaccaataattaaaacgtaattaccctcgccaaccgcctataaccacgacgaccgccacgccccgtttcctaatctcgcccctctccgcccacgactctaaccccgcccctcgtcccaaactacaacgaaaacaaaaccaacgcctcgcgaacttccacgtacgcactccaacgcgtattcccgaaaaaaaacgcatccgaatcacgaaaaccgatatctcaaactccgccccttcaccccccgaaaaactaatccccacttccgaccctctcaaaccttttccgcttctcttttacctccccaaatccgcccgtctacgcccctcacaaaaaaccgaaaaatcgctctaatcccgaatctcccacaaacgtaaacctactctactatatatctttacgaaataacctacgctaaaacctaccgcgcgcgataaatccgcgcaaacctaaccctacgtctcgcaactcgattaaaaccgccgccgccttctcgaaataccgcgaccgaaatccgcgcaacgctaaacgaccgtcgcgaaccgttaaaaatacaaactactcgcactactactactaatacctaaacccgacgacgcc

SEQ ID NO: 32123 - DNA, 615 bp, Artificial Sequence
  chemically treated genomic DNA (Homo sapiens) CpG-island No: 32123
aaaaaaaataataaaaaaagttagtgattggagcgtaattattttcgttaatcgtttgtaattacggcggtcgttacgtttcgttttttggtttcgttttttttcgtttacgattttggtttcgtttttcgttttaggttgtaacggaggtagagttaacgtttcgcgggtttttacgtacgtattttaacgcgtgttttcggagaagaacgtattcgggttacgggagtcggtgttttaggtttcgtttttttatttttcgaaaggttaatttttattttcgatttttttaggtttttttcgttttttttttatttttttaggttcgttcgtttgcgttttttataggaagtcggagggtcgttttgatttcgaattttttataggcgtgaatttgttttgttgtgtatttttgcggggtggtttgcgttgaggtttgtcgcgcgcggtgagttcgcgtagatttgattttgcgtttcgtagttcggttgaggtcgtcgtcgttttttcgggatgtcgcggtcggggttcgcgtagcgttgggcggtcgtcgcgggtcgttgggggtgtaggttgttcgtattgttgttattggtgtttggattcggcggcgtt

SEQ ID NO: 32124 - DNA, 615 bp, Artificial Sequence
  chemically treated genomic DNA (Homo sapiens) CpG-island No: 32124
aacgccgccgaatccaaacaccaataacaacaatacgaacaacctacacccccaacgacccgcgacgaccgcccaacgctacgcgaaccccgaccgcgacatcccgaaaaaacgacgacgacctcaaccgaactacgaaacgcaaaatcaaatctacgcgaactcaccgcgcgcgacaaacctcaacgcaaaccaccccgcaaaaatacacaacaaaacaaattcacgcctataaaaaattcgaaatcaaaacgaccctccgacttcctataaaaaacgcaaacgaacgaacctaaaaaaataaaaaaaaaacgaaaaaaacctaaaaaaatcgaaaataaaaattaacctttcgaaaaataaaaaaacgaaacctaaaacaccgactcccgtaacccgaatacgttcttctccgaaaacacgcgttaaaatacgtacgtaaaaacccgcgaaacgttaactctacctccgttacaacctaaaacgaaaaacgaaaccaaaatcgtaaacgaaaaaaaacgaaaccaaaaaacgaaacgtaacgaccgccgtaattacaaacgattaacgaaaataattacgctccaatcactaactttttttattatttttttt

SEQ ID NO: 32125 - DNA, 542 bp, Artificial Sequence
  chemically treated genomic DNA (Homo sapiens) CpG-island No: 32125
ttttttttttttttttttttttttttttcgttttttttttttttttttttttttttttgttttttttttgttttttacgtttttttttttttattttttttcgtttttttttcggtcgttttttttcgtttgttgtattttcgttcgtttcgtcgtttcgttcgtcgattcgtttttttttttttttttttttcgtttttttttttttttttcgttttgttttcgtcgttacgtcgtttcgttttcgttcgttttcgtttttgtgttttcgtcgtgttgcgttttttttgcgtttttttatttttttgtttttgttttttttttattgtttttgcgttcgtttcgtttttgttttttttttttttttcgtttatcgtttttttgtttcgtttatcgtttttttttgttttattcgtttcgttgtcgattgtttttggtcgtcgtgtttcgtgtttcgttgtcgtgttgtgtgtttttatgtgtttgtattgtgtgtgttttttttgacgttttatgtgtttttatgttgtgtatgttttgtt

SEQ ID NO: 32126 - DNA, 542 bp, Artificial Sequence
  chemically treated genomic DNA (Homo sapiens) CpG-island No: 32126
aacaaaacatacacaacataaaaacacataaaacgtcaaaaaaaacacacacaatacaaacacataaaaacacacaacacgacaacgaaacacgaaacacgacgaccaaaaacaatcgacaacgaaacgaataaaacaaaaaaaaacgataaacgaaacaaaaaaacgataaacgaaaaaaaaaaaaaaaacaaaaacgaaacgaacgcaaaaacaataaaaaaaaaacaaaaacaaaaaaataaaaaaacgcaaaaaaaacgcaacacgacgaaaacacaaaaacgaaaacgaacgaaaacgaaacgacgtaacgacgaaaacaaaacgaaaaaaaaaaaaaaaaacgaaaaaaaaaaaaaaaaaaaaacgaatcgacgaacgaaacgacgaaacgaacgaaaatacaacaaacgaaaaaaaacgaccgaaaaaaaaacgaaaaaaaataaaaaaaaaaaaacgtaaaaaacaaaaaaaaaacaaaaaaaaaaaaaaaaaaaaaaaaaaaacgaaaaaaaaaaaaaaaaaaaaaaaaaaaa

SEQ ID NO: 32127 - DNA, 542 bp, Artificial Sequence
  chemically treated genomic DNA (Homo sapiens) CpG-island No: 32127
agtagagtatgtatagtatagagatatatggagcgttagaagaaatatatataatatagatatatagaagtatatagtacgatagcggagtacgagatacgacgattaggagtagtcgatagcgagacggatgaggtaggaaaagacgatagacgaagtagagagacgataagcgagaggaagagaagagataggagcgaggcggacgtagaagtaataagaggagagtagagatagagaaataagagggcgtagagagagcgtagtacggcggagatataaagacgaaagcgggcgaagacggaacgacgtggcggcgagagtagaacggaggagagagagagggacgggagagaagaaggaggaggagcgagtcgacgggcgagacgacgggacgagcgagagtataataggcggagggaagcgatcggaggaggagcgggagagaataagagaggaggagcgtaaaagataggagagggataagagaagaagaaaggaagagggaggagcgagaaagggagagaagggaggggaggggg

SEQ ID NO: 32128 - DNA, 542 bp, Artificial Sequence
  chemically treated genomic DNA (Homo sapiens) CpG-island No: 32128
ccccctcccctcccttctctccctttctcgctcctccctcttcctttcttcttctcttatccctctcctatcttttacgctcctcctctcttattctctcccgctcctcctccgatcgcttccctccgcctattatactctcgctcgtcccgtcgtctcgcccgtcgactcgctcctcctccttcttctctcccgtccctctctctctcctccgttctactctcgccgccacgtcgttccgtcttcgcccgctttcgtctttatatctccgccgtactacgctctctctacgccctcttatttctctatctctactctcctcttattacttctacgtccgcctcgctcctatctcttctcttcctctcgcttatcgtctctctacttcgtctatcgtcttttcctacctcatccgtctcgctatcgactactcctaatcgtcgtatctcgtactccgctatcgtactatatacttctatatatctatattatatatatttcttctaacgctccatatatctctatactatacatactctact

SEQ ID NO: 32129 - DNA, 838 bp, Artificial Sequence
  chemically treated genomic DNA (Homo sapiens) CpG-island No: 32129
agttggagcgttgcgtttttaattttggggcgggcggggggcggcgggaatttttgtttcggttttttttgtatcgcgggggtagttgttatttgtaaggcgagcgcggcgcgggggatggaagtaggcgtttattggatagaatataaaggtagaaatttatttcgaaggtcggggttcggcggggcgttgggggtgggcgtttttcgcggttttcggcgtttttcgtttcgagacgtttcggtttagcggtattggcgcgatcgaggtttagtttcggggatacgttcggttggtcgcggggaaggtattaggtgagcgcggtcgcgtttttcggaatttcgttttcgcgcgtttcgcggcgacgcggcgtttattcgtttcgggagttaggaatttagggttttattatggcgttggtcgtcgtcgtcgtcgttgcggttgtcggggtgagttaggcggcggtgttgggttttttgtaggagtacggcgggaaggtgcgtaatttcgagttgttgagtcgttttaagtcgttgttcgatgtcggcgattcgcggggtcgcgtcgttcgtagggatcgttttaagtagttcgttaataacgtggcggtggtgaaggagttcgacggcgttaagttcgtggtgttgaggaagaagtttcggttttcggagttcgagttcgtatttttcggtttttcgggggtagcggtttagtcgtcgaaatttatttcgacggttttgtcgcggagcgtttttgtttcgggagtttcgtttttggtttcggtgtcgcggttagtggagtcgttaggggatttgggtttgttaatagagttatagga

SEQ ID NO: 32130 - DNA, 838 bp, Artificial Sequence
  chemically treated genomic DNA (Homo sapiens) CpG-island No: 32130
tcctataactctattaacaaacccaaatcccctaacgactccactaaccgcgacaccgaaaccaaaaacgaaactcccgaaacaaaaacgctccgcgacaaaaccgtcgaaataaatttcgacgactaaaccgctacccccgaaaaaccgaaaaatacgaactcgaactccgaaaaccgaaacttcttcctcaacaccacgaacttaacgccgtcgaactccttcaccaccgccacgttattaacgaactacttaaaacgatccctacgaacgacgcgaccccgcgaatcgccgacatcgaacaacgacttaaaacgactcaacaactcgaaattacgcaccttcccgccgtactcctacaaaaaacccaacaccgccgcctaactcaccccgacaaccgcaacgacgacgacgacgaccaacgccataataaaaccctaaattcctaactcccgaaacgaataaacgccgcgtcgccgcgaaacgcgcgaaaacgaaattccgaaaaacgcgaccgcgctcacctaataccttccccgcgaccaaccgaacgtatccccgaaactaaacctcgatcgcgccaataccgctaaaccgaaacgtctcgaaacgaaaaacgccgaaaaccgcgaaaaacgcccacccccaacgccccgccgaaccccgaccttcgaaataaatttctacctttatattctatccaataaacgcctacttccatcccccgcgccgcgctcgccttacaaataacaactacccccgcgatacaaaaaaaaccgaaacaaaaattcccgccgccccccgcccgccccaaaattaaaaacgcaacgctccaact

SEQ ID NO: 32131 - DNA, 838 bp, Artificial Sequence
  chemically treated genomic DNA (Homo sapiens) CpG-island No: 32131
ttttgtggttttgttggtagatttaggttttttggcggttttattggtcgcggtatcgggattaagggcggagttttcggggtagaggcgtttcgcggtaagatcgtcgaagtgggtttcgacggttgggtcgttgttttcggggggtcgaagggtgcgggttcgggtttcgggggtcggggttttttttttagtattacgaatttgacgtcgtcgagtttttttattatcgttacgttgttgacgaattgtttgaagcggtttttgcgggcggcgcggtttcgcgggtcgtcggtatcgagtagcggtttgaagcggtttagtagttcggagttgcgtattttttcgtcgtgtttttgtaggaagtttagtatcgtcgtttggtttatttcggtagtcgtagcggcggcggcggcggttagcgttatggtggggttttgggtttttggttttcggggcgggtgggcgtcgcgtcgtcgcgggacgcgcgggagcggggtttcgggaggcgcggtcgcgtttatttggtgtttttttcgcggttagtcgggcgtgttttcgaagttggatttcggtcgcgttagtgtcgttgggtcggggcgtttcggggcgaagggcgtcgggggtcgcggggagcgtttatttttagcgtttcgtcgggtttcggttttcggggtaggtttttgtttttgtattttgtttaatgggcgtttgtttttatttttcgcgtcgcgttcgttttataggtgatagttgttttcgcgatgtagagggaatcggagtagaaattttcgtcgtttttcgttcgttttagaattaaaggcgtagcgttttagtt

SEQ ID NO: 32132 - DNA, 838 bp, Artificial Sequence
  chemically treated genomic DNA (Homo sapiens) CpG-island No: 32132
aactaaaacgctacgcctttaattctaaaacgaacgaaaaacgacgaaaatttctactccgattccctctacatcgcgaaaacaactatcacctataaaacgaacgcgacgcgaaaaataaaaacaaacgcccattaaacaaaatacaaaaacaaaaacctaccccgaaaaccgaaacccgacgaaacgctaaaaataaacgctccccgcgacccccgacgcccttcgccccgaaacgccccgacccaacgacactaacgcgaccgaaatccaacttcgaaaacacgcccgactaaccgcgaaaaaaacaccaaataaacgcgaccgcgcctcccgaaaccccgctcccgcgcgtcccgcgacgacgcgacgcccacccgccccgaaaaccaaaaacccaaaaccccaccataacgctaaccgccgccgccgccgctacgactaccgaaataaaccaaacgacgatactaaacttcctacaaaaacacgacgaaaaaatacgcaactccgaactactaaaccgcttcaaaccgctactcgataccgacgacccgcgaaaccgcgccgcccgcaaaaaccgcttcaaacaattcgtcaacaacgtaacgataataaaaaaactcgacgacgtcaaattcgtaatactaaaaaaaaaaccccgacccccgaaacccgaacccgcacccttcgaccccccgaaaacaacgacccaaccgtcgaaacccacttcgacgatcttaccgcgaaacgcctctaccccgaaaactccgcccttaatcccgataccgcgaccaataaaaccgccaaaaaacctaaatctaccaacaaaaccacaaaa

SEQ ID NO: 32133 - DNA, 947 bp, Artificial Sequence
  chemically treated genomic DNA (Homo sapiens) CpG-island No: 32133
ggttcgtcgatttatcgtttttagtttttgagttagtttaggttatcgagagatttttcgtagacgcggttttatcgtttagggttttttttgaggcggtatcgttttgttttgattcgttagacgcggagttcgggttcggggtagcgaaagggtcgtcgtagtagaagttttgtatgttgtcggtgcgttgcgtttcggttttcgttacgtttcgttttcgggcggaggagttcggtttgcgtcggtagttgtcggaggagtcgagttcgcggagtttttttttgttgttgaggcggttttcggtggaagagttcggtttgggtttcggtttgggttcgggtcgtttttcgtatttgaggcgtttgtcgcgcgtcggttcgcgtttgttgagttttgacgtcgaggagttgttcgtcgcgtcgtcgtcgttcgcggtgtttttggagtcgttcgagtacgagtggttcgtgcggattgtcgggggtcgttggatttattagttgtacgggttgttgttgcgcgatcgcggtttggcggttaagcgcgattttatgtttggttttacggttttgtattgggtcgttaagagcggcgacggcgagatggcgttgtagttggtggaggtcgcgcggcgtagtggcgtattagtcgacgtgaacgtacgtttttacggcggttatacgtcgttgtatttggttgtattgtacggttacgaggacgttgtcgtgttgttggtggtgcgtttgggtgtttaggtgtacgtgcgtgattatagcgggcgtcgcgtttattagtatttgcggttcggtttttcgtacgcgttgcgtcgtttttttggcgatttaggtttgcgaggtattacggagttagatgcgatcggtggtggaagtggtagttttgttgttaggcgtttcgtataggtggtcgttattatttttagtttt

SEQ ID NO: 32134 - DNA, 947 bp, Artificial Sequence
  chemically treated genomic DNA (Homo sapiens) CpG-island No: 32134
aaaactaaaaataataacgaccacctatacgaaacgcctaacaacaaaactaccacttccaccaccgatcgcatctaactccgtaatacctcgcaaacctaaatcgccaaaaaaacgacgcaacgcgtacgaaaaaccgaaccgcaaatactaataaacgcgacgcccgctataatcacgcacgtacacctaaacacccaaacgcaccaccaacaacacgacaacgtcctcgtaaccgtacaatacaaccaaatacaacgacgtataaccgccgtaaaaacgtacgttcacgtcgactaatacgccactacgccgcgcgacctccaccaactacaacgccatctcgccgtcgccgctcttaacgacccaatacaaaaccgtaaaaccaaacataaaatcgcgcttaaccgccaaaccgcgatcgcgcaacaacaacccgtacaactaataaatccaacgacccccgacaatccgcacgaaccactcgtactcgaacgactccaaaaacaccgcgaacgacgacgacgcgacgaacaactcctcgacgtcaaaactcaacaaacgcgaaccgacgcgcgacaaacgcctcaaatacgaaaaacgacccgaacccaaaccgaaacccaaaccgaactcttccaccgaaaaccgcctcaacaacaaaaaaaaactccgcgaactcgactcctccgacaactaccgacgcaaaccgaactcctccgcccgaaaacgaaacgtaacgaaaaccgaaacgcaacgcaccgacaacatacaaaacttctactacgacgaccctttcgctaccccgaacccgaactccgcgtctaacgaatcaaaacaaaacgataccgcctcaaaaaaaaccctaaacgataaaaccgcgtctacgaaaaatctctcgataacctaaactaactcaaaaactaaaaacgataaatcgacgaacc

SEQ ID NO: 32135 - DNA, 947 bp, Artificial Sequence
  chemically treated genomic DNA (Homo sapiens) CpG-island No: 32135
ggaattgaggatggtggcggttatttgtacggggcgtttggtagtaagattgttatttttattatcggtcgtatttggtttcgtggtgtttcgtaggtttggatcgttaagaaggcggcgtagcgcgtacgaggagtcgggtcgtaggtattggtaggcgcgacgttcgttgtgattacgtacgtgtatttgggtatttagacgtattattagtagtacggtagcgttttcgtggtcgtgtagtgtagttaggtgtagcggcgtgtagtcgtcgtgggagcgtgcgtttacgtcgattggtgcgttattgcgtcgcgcgatttttattagttgtagcgttatttcgtcgtcgtcgtttttggcggtttaatgtagggtcgtgaagttagatatgaagtcgcgtttggtcgttaagtcgcggtcgcgtagtagtagttcgtgtagttggtgggtttagcggttttcggtagttcgtacgagttattcgtgttcggacggttttaggggtatcgcggacggcggcggcgcggcgggtaatttttcggcgttagggtttagtagacgcgggtcggcgcgcgataggcgttttaggtgcggggagcggttcgggtttaggtcgaggtttagatcggatttttttatcgagagtcgttttagtagtagaggggagtttcgcgggttcggttttttcgatagttgtcggcgtaggtcgggttttttcgttcggaggcggagcgtggcgggggtcgggacgtagcgtatcggtagtatatagggtttttgttgcggcggttttttcgttgtttcgggttcgggtttcgcgtttggcggattagagtagggcgatgtcgttttagaaggggttttaggcggtggggtcgcgtttgcggagggtttttcggtggtttgggttagtttaagggttggaagcggtgggtcggcggatt

SEQ ID NO: 32136 - DNA, 947 bp, Artificial Sequence
  chemically treated genomic DNA (Homo sapiens) CpG-island No: 32136
aatccgccgacccaccgcttccaacccttaaactaacccaaaccaccgaaaaaccctccgcaaacgcgaccccaccgcctaaaaccccttctaaaacgacatcgccctactctaatccgccaaacgcgaaacccgaacccgaaacaacgaaaaaaccgccgcaacaaaaaccctatatactaccgatacgctacgtcccgacccccgccacgctccgcctccgaacgaaaaaacccgacctacgccgacaactatcgaaaaaaccgaacccgcgaaactcccctctactactaaaacgactctcgataaaaaaatccgatctaaacctcgacctaaacccgaaccgctccccgcacctaaaacgcctatcgcgcgccgacccgcgtctactaaaccctaacgccgaaaaattacccgccgcgccgccgccgtccgcgatacccctaaaaccgtccgaacacgaataactcgtacgaactaccgaaaaccgctaaacccaccaactacacgaactactactacgcgaccgcgacttaacgaccaaacgcgacttcatatctaacttcacgaccctacattaaaccgccaaaaacgacgacgacgaaataacgctacaactaataaaaatcgcgcgacgcaataacgcaccaatcgacgtaaacgcacgctcccacgacgactacacgccgctacacctaactacactacacgaccacgaaaacgctaccgtactactaataatacgtctaaatacccaaatacacgtacgtaatcacaacgaacgtcgcgcctaccaatacctacgacccgactcctcgtacgcgctacgccgccttcttaacgatccaaacctacgaaacaccacgaaaccaaatacgaccgataataaaaataacaatcttactaccaaacgccccgtacaaataaccgccaccatcctcaattcc

SEQ ID NO: 32137 - DNA, 740 bp, Artificial Sequence
  chemically treated genomic DNA (Homo sapiens) CpG-island No: 32137
tttcgggtcgggtaacgtttttgttatcgaagcgaaacgttaggtgagttagcgtttggacggtgcggcgatcgatatgttcgtagagttcgtcggaagtgttggatgattgttgatagcggcgttacgtcggatttcgtggtttttgattatgtttttttaggttgaatacggttcggatttataggtgattttattgatagttcgttgttgatatggtagcgtcgtagttgtcgaggtacgtcgaacgttaattggtagaattgtcgcgtgtcgaaatcgtatcgttaggtattgaatagttaggtcgtttgatcgtgatataaagatttagcgtagtgcgtggagatttttaattagtacggttcggagtatttgattatttagattcgtaacgttcgtgaattggtcgatagtattattagcgtcggttcggtattttttggtgattggttatcggaatcggtaggtgattacgttttcggtattaattacgattttatcgatttacggttatatcgttatttgttttagtttacgggttggaagatttttagaagcgtatgatcgtataggaaattgtcgatagatgggtttttcgcgttggttttaattatagaaatattgttcgtcgtcgagcgtttgatcgtttataaaaatgtcgttattttgcgtgttaacgtttttaaggagtaagtatgagtatcgtgattattatcgatttagcgttgtgaaaacgt

SEQ ID NO: 32138 - DNA, 740 bp, Artificial Sequence
  chemically treated genomic DNA (Homo sapiens) CpG-island No: 32138
acgttttcacaacgctaaatcgataataatcacgatactcatacttactccttaaaaacgttaacacgcaaaataacgacatttttataaacgatcaaacgctcgacgacgaacaatatttctataattaaaaccaacgcgaaaaacccatctatcgacaatttcctatacgatcatacgcttctaaaaatcttccaacccgtaaactaaaacaaataacgatataaccgtaaatcgataaaatcgtaattaataccgaaaacgtaatcacctaccgattccgataaccaatcaccaaaaaataccgaaccgacgctaataatactatcgaccaattcacgaacgttacgaatctaaataatcaaatactccgaaccgtactaattaaaaatctccacgcactacgctaaatctttatatcacgatcaaacgacctaactattcaatacctaacgatacgatttcgacacgcgacaattctaccaattaacgttcgacgtacctcgacaactacgacgctaccatatcaacaacgaactatcaataaaatcacctataaatccgaaccgtattcaacctaaaaaaacataatcaaaaaccacgaaatccgacgtaacgccgctatcaacaatcatccaacacttccgacgaactctacgaacatatcgatcgccgcaccgtccaaacgctaactcacctaacgtttcgcttcgataacaaaaacgttacccgacccgaaa

SEQ ID NO: 32139 - DNA, 740 bp, Artificial Sequence
  chemically treated genomic DNA (Homo sapiens) CpG-island No: 32139
acgtttttatagcgttaaatcggtaatagttacggtgtttatgtttgttttttaagggcgttaatacgtaaagtaacggtatttttgtgggcggttaggcgttcggcggcggatagtgtttttatggttgaagttagcgcggagaatttatttgtcgatagttttttgtacggttatgcgtttttggaaattttttagttcgtaggttggaataggtgacggtgtaatcgtaagtcggtagaatcgtggttggtgtcggaggcgtaattatttgtcgatttcggtgattagttattaagaaatatcgaatcggcgttggtgatgttatcgattagtttacgggcgttgcgggtttgaatgattaggtgtttcgggtcgtattggttggagatttttacgtattgcgttaaatttttatgttacgattaggcggtttggttgtttagtgtttggcggtgcggtttcggtacgcggtagttttgttagttggcgttcgacgtgtttcggtaattgcgacgttgttatattagtagcgggttgttagtaaaattatttgtgagttcgggtcgtgtttagtttgagagagtataattagaagttacgaaattcggcgtagcgtcgttgttagtaattatttagtattttcgacgggttttgcgggtatatcgatcgtcgtatcgtttagacgttggtttatttgacgtttcgtttcggtgataaaggcgttattcggttcgaag

SEQ ID NO: 32140 - DNA, 740 bp, Artificial Sequence
  chemically treated genomic DNA (Homo sapiens) CpG-island No: 32140
cttcgaaccgaataacgcctttatcaccgaaacgaaacgtcaaataaaccaacgtctaaacgatacgacgatcgatatacccgcaaaacccgtcgaaaatactaaataattactaacaacgacgctacgccgaatttcgtaacttctaattatactctctcaaactaaacacgacccgaactcacaaataattttactaacaacccgctactaatataacaacgtcgcaattaccgaaacacgtcgaacgccaactaacaaaactaccgcgtaccgaaaccgcaccgccaaacactaaacaaccaaaccgcctaatcgtaacataaaaatttaacgcaatacgtaaaaatctccaaccaatacgacccgaaacacctaatcattcaaacccgcaacgcccgtaaactaatcgataacatcaccaacgccgattcgatatttcttaataactaatcaccgaaatcgacaaataattacgcctccgacaccaaccacgattctaccgacttacgattacaccgtcacctattccaacctacgaactaaaaaatttccaaaaacgcataaccgtacaaaaaactatcgacaaataaattctccgcgctaacttcaaccataaaaacactatccgccgccgaacgcctaaccgcccacaaaaataccgttactttacgtattaacgcccttaaaaaacaaacataaacaccgtaactattaccgatttaacgctataaaaacgt

SEQ ID NO: 32141 - DNA, 650 bp, Artificial Sequence
  chemically treated genomic DNA (Homo sapiens) CpG-island No: 32141
  misc_feature (423)..(423): n is either a, c, g or t
gtcgtattagtcggcgcgtcgtttgggcggtaacggcgatgtttggttgaacgttaacgaatattttattgtcgtggagttttagtttatttagtaaacgtttaatcgttattcggaatgttagtcgaaagcggtgattgaaaattacgcgtaatatgtaggcgtaaaatcggagtaggtgttggttagtcgtggcgcggacgaaggtattgaattgttgattcgcgttttttgcgaatcgggtaaagacgttattttttattgttcgttaacgtacggtatgtatagcgttagcgtcgaaacgattggcgtcgagtgtcgtatagtgtcgacgttggataattggtaattggatttatagggtattttcgataagttggacggcgtaaaagtggtttatgttgtagttttatattcgatcgngtattgattatcgtaggatttcgtattttgttgggagttattcgcggtaggcgattgtggttgtcgatgaatttatatcgagtttttgttcgtaggtatcgttggttgggttgggttgggcggaatattcgtatttggttattttacgtatattgtcgaaagttttttgttttggcgggtttcgttgcggatttacgttggtaaacgaagaagttattaatttgttg

SEQ ID NO: 32142 - DNA, 650 bp, Artificial Sequence
  chemically treated genomic DNA (Homo sapiens) CpG-island No: 32142
  misc_feature (228)..(228): n is either a, c, g or t
caacaaattaataacttcttcgtttaccaacgtaaatccgcaacgaaacccgccaaaacaaaaaactttcgacaatatacgtaaaataaccaaatacgaatattccgcccaacccaacccaaccaacgatacctacgaacaaaaactcgatataaattcatcgacaaccacaatcgcctaccgcgaataactcccaacaaaatacgaaatcctacgataatcaatacncgatcgaatataaaactacaacataaaccacttttacgccgtccaacttatcgaaaataccctataaatccaattaccaattatccaacgtcgacactatacgacactcgacgccaatcgtttcgacgctaacgctatacataccgtacgttaacgaacaataaaaaataacgtctttacccgattcgcaaaaaacgcgaatcaacaattcaataccttcgtccgcgccacgactaaccaacacctactccgattttacgcctacatattacgcgtaattttcaatcaccgctttcgactaacattccgaataacgattaaacgtttactaaataaactaaaactccacgacaataaaatattcgttaacgttcaaccaaacatcgccgttaccgcccaaacgacgcgccgactaatacgac

SEQ ID NO: 32143 - DNA, 650 bp, Artificial Sequence
  chemically treated genomic DNA (Homo sapiens) CpG-island No: 32143
  misc_feature (228)..(228): n is either a, c, g or t
tagtaggttgatgattttttcgtttgttagcgtaaattcgtaacgaagttcgttagagtaaaaagttttcgatagtgtgcgtaaaatagttaggtgcggatatttcgtttagtttagtttagttagcgatgtttgcgggtaaaaattcgatataggtttatcggtaattataatcgtttatcgcgggtaatttttagtagggtgcgaaattttgcgatgattagtgtncggtcgggtatggggttgtaatataaattatttttacgtcgtttagtttgtcggaaatgttttgtaagtttagttgttagttgtttagcgtcggtattgtgcggtattcgacgttaatcgtttcggcgttgacgttgtatatgtcgtacgttggcgggtagtagaggatggcgtttttattcggttcgtaaaaagcgcgaattagtagtttaatattttcgttcgcgttacggttgattagtatttgtttcggttttacgtttgtatattgcgcgtaatttttaattatcgttttcggttggtatttcgggtagcggttgagcgtttgttgagtaagttgaaattttacggtagtggggtattcgttggcgtttagttagatatcgtcgttatcgtttagacgacgcgtcgattgatacggt

SEQ ID NO: 32144 - DNA, 650 bp, Artificial Sequence
  chemically treated genomic DNA (Homo sapiens) CpG-island No: 32144
  misc_feature (423)..(423): n is either a, c, g or t
accgtatcaatcgacgcgtcgtctaaacgataacgacgatatctaactaaacgccaacgaataccccactaccgtaaaatttcaacttactcaacaaacgctcaaccgctacccgaaataccaaccgaaaacgataattaaaaattacgcgcaatatacaaacgtaaaaccgaaacaaatactaatcaaccgtaacgcgaacgaaaatattaaactactaattcgcgctttttacgaaccgaataaaaacgccatcctctactacccgccaacgtacgacatatacaacgtcaacgccgaaacgattaacgtcgaataccgcacaataccgacgctaaacaactaacaactaaacttacaaaacatttccgacaaactaaacgacgtaaaaataatttatattacaaccccatacccgaccgnacactaatcatcgcaaaatttcgcaccctactaaaaattacccgcgataaacgattataattaccgataaacctatatcgaatttttacccgcaaacatcgctaactaaactaaactaaacgaaatatccgcacctaactattttacgcacactatcgaaaactttttactctaacgaacttcgttacgaatttacgctaacaaacgaaaaaatcatcaacctacta

SEQ ID NO: 32145 - DNA, 644 bp, Artificial Sequence
  chemically treated genomic DNA (Homo sapiens) CpG-island No: 32145
attacgtcgtttgttttggcgattatggtttggttttcgtggcgaatatgtagttttttttttagtattatgtcgatttcgtcgtagtttagggtttacgggaagaatgcgtttttttattgtataaaatcggcggttatgttgttgtcgtcgttttcggttataagattagttaagtttacgtaatgcggttttgcgtcgtcgaaacgattaaatttgacgttattgttattaattattttgatgtcgtttttgtcggttatcgatttgaagttcggttgtattgcgttttgttttagcgattgttttttttttattattttttttattagtatgtgcgattaggttttcggtaaattggtttttcggtagttgggtaatgatggtttcgcggatgcgttggttttcggttttgtcggattggtacgttggcgggatacggacgtcgttatcgggatcgatttattatattcggtgatggtaaaatttagtagattcgttattttacgggtatttcggggttataatgttggcgcgtagaattacggatattgtttgttacgtcgacgcgcgtgtgttttacgaatattattcgattgtgatgagtttatttatcgtgtttttttttgttttggtgagagatg

SEQ ID NO: 32146 - DNA, 644 bp, Artificial Sequence
  chemically treated genomic DNA (Homo sapiens) CpG-island No: 32146
catctctcaccaaaacaaaaaaaaacacgataaataaactcatcacaatcgaataatattcgtaaaacacacgcgcgtcgacgtaacaaacaatatccgtaattctacgcgccaacattataaccccgaaatacccgtaaaataacgaatctactaaattttaccatcaccgaatataataaatcgatcccgataacgacgtccgtatcccgccaacgtaccaatccgacaaaaccgaaaaccaacgcatccgcgaaaccatcattacccaactaccgaaaaaccaatttaccgaaaacctaatcgcacatactaataaaaaaaataataaaaaaaaaacaatcgctaaaacaaaacgcaatacaaccgaacttcaaatcgataaccgacaaaaacgacatcaaaataattaataacaataacgtcaaatttaatcgtttcgacgacgcaaaaccgcattacgtaaacttaactaatcttataaccgaaaacgacgacaacaacataaccgccgattttatacaataaaaaaacgcattcttcccgtaaaccctaaactacgacgaaatcgacataatactaaaaaaaaaactacatattcgccacgaaaaccaaaccataatcgccaaaacaaacgacgtaat

SEQ ID NO: 32147 - DNA, 644 bp, Artificial Sequence
  chemically treated genomic DNA (Homo sapiens) CpG-island No: 32147
tattttttattaagataggaggaagtacggtgaataaatttattatagtcgaatgatattcgtgaagtatacgcgcgtcggcgtaataggtaatgttcgtggttttgcgcgttagtattatgatttcggaatgttcgtgaagtggcggatttattgggttttattattatcgaatgtgatgaatcgatttcggtaacggcgttcgtgtttcgttagcgtgttagttcgataaaatcgaaagttagcgtattcgcgaaattattattgtttagttgtcggaaggttagtttatcgaaagtttggtcgtatatgttgatggaaaaagtgatgaaggaaaaatagtcgttggagtagggcgtaatgtagtcgagttttaaatcggtgatcggtaaaggcggtattaaagtgattgatggtagtagcgttaagtttggtcgtttcgacggcgtagagtcgtattgcgtgggtttgattgattttgtgatcggagacgacggtagtagtatggtcgtcggttttatgtagtgggagaacgtatttttttcgtggattttgaattacgacgaaatcgatatggtgttggaaggggagttgtatgttcgttacgaaggttaaattatgatcgttaaagtaggcgacgtgat

SEQ ID NO: 32148 - DNA, 644 bp, Artificial Sequence
  chemically treated genomic DNA (Homo sapiens) CpG-island No: 32148
atcacgtcgcctactttaacgatcataatttaaccttcgtaacgaacatacaactccccttccaacaccatatcgatttcgtcgtaattcaaaatccacgaaaaaaatacgttctcccactacataaaaccgacgaccatactactaccgtcgtctccgatcacaaaatcaatcaaacccacgcaatacgactctacgccgtcgaaacgaccaaacttaacgctactaccatcaatcactttaataccgcctttaccgatcaccgatttaaaactcgactacattacgccctactccaacgactatttttccttcatcactttttccatcaacatatacgaccaaactttcgataaactaaccttccgacaactaaacaataataatttcgcgaatacgctaactttcgattttatcgaactaacacgctaacgaaacacgaacgccgttaccgaaatcgattcatcacattcgataataataaaacccaataaatccgccacttcacgaacattccgaaatcataatactaacgcgcaaaaccacgaacattacctattacgccgacgcgcgtatacttcacgaatatcattcgactataataaatttattcaccgtacttcctcctatcttaataaaaaata

SEQ ID NO: 32149 - DNA, 526 bp, Artificial Sequence
  chemically treated genomic DNA (Homo sapiens) CpG-island No: 32149
cgcgagtggcgttcgtaggcgagttcgtagatcggatcggttttttttcgattatacgtagtttttttatcgttttattttcgtggacgagtttcgcggttgtagtattcgtattggcgtgtcgttttcgttgtggcgatttgttcgcgcgttttacgtcgtagtttttttggcgttgtggttttatgaggcgtggtcgacgacgattcgcgttgtgttcgtagtatagatattagtgtttcgtagtttgcgtgcgtagttcgcgcgtcggtgtcggtatcgttttcgtttcgatgttcgtcgacggacgttcggcgtgggtcggtcggcgttagatttgttagtcggttcggcgttcgtgttggaggtagtgatattgttgttagaataagtagttagatacgatagcgtatatatcgtttcggcgttaggcgtcgaggagaacgttagcgtaacgacgagcgagttttgtttagcgcggtagtagacgaggagtcgggacgattgtgagggtacgaggagagtt

SEQ ID NO: 32150 - DNA, 526 bp, Artificial Sequence
  chemically treated genomic DNA (Homo sapiens) CpG-island No: 32150
aactctcctcgtaccctcacaatcgtcccgactcctcgtctactaccgcgctaaacaaaactcgctcgtcgttacgctaacgttctcctcgacgcctaacgccgaaacgatatatacgctatcgtatctaactacttattctaacaacaatatcactacctccaacacgaacgccgaaccgactaacaaatctaacgccgaccgacccacgccgaacgtccgtcgacgaacatcgaaacgaaaacgataccgacaccgacgcgcgaactacgcacgcaaactacgaaacactaatatctatactacgaacacaacgcgaatcgtcgtcgaccacgcctcataaaaccacaacgccaaaaaaactacgacgtaaaacgcgcgaacaaatcgccacaacgaaaacgacacgccaatacgaatactacaaccgcgaaactcgtccacgaaaataaaacgataaaaaaactacgtataatcgaaaaaaaaccgatccgatctacgaactcgcctacgaacgccactcgcg

SEQ ID NO: 32151 - DNA, 526 bp, Artificial Sequence
  chemically treated genomic DNA (Homo sapiens) CpG-island No: 32151
agtttttttcgtgtttttataatcgtttcggtttttcgtttattgtcgcgttgggtagagttcgttcgtcgttgcgttgacgtttttttcgacgtttggcgtcgagacgatatatacgttgtcgtgtttgattgtttgttttggtagtaatattattgtttttagtacgagcgtcggatcgattggtagatttgacgtcgatcggtttacgtcgggcgttcgtcggcgagtatcggaacggaggcggtatcggtatcgacgcgcgggttacgtacgtagattgcgaggtattgatgtttgtattgcgagtatagcgcgaatcgtcgtcgattacgttttatggggttatagcgttaggagggttacggcgtgaggcgcgcggatagatcgttatagcggggacgatacgttagtgcgagtgttgtagtcgcgaggttcgtttacgagagtagaacggtagggggattacgtgtgatcgaagaggaatcgattcggtttacgggttcgtttgcgagcgttattcgcg

SEQ ID NO: 32152 - DNA, 526 bp, Artificial Sequence
  chemically treated genomic DNA (Homo sapiens) CpG-island No: 32152
cgcgaataacgctcgcaaacgaacccgtaaaccgaatcgattcctcttcgatcacacgtaatccccctaccgttctactctcgtaaacgaacctcgcgactacaacactcgcactaacgtatcgtccccgctataacgatctatccgcgcgcctcacgccgtaaccctcctaacgctataaccccataaaacgtaatcgacgacgattcgcgctatactcgcaatacaaacatcaatacctcgcaatctacgtacgtaacccgcgcgtcgataccgataccgcctccgttccgatactcgccgacgaacgcccgacgtaaaccgatcgacgtcaaatctaccaatcgatccgacgctcgtactaaaaacaataatattactaccaaaacaaacaatcaaacacgacaacgtatatatcgtctcgacgccaaacgtcgaaaaaaacgtcaacgcaacgacgaacgaactctacccaacgcgacaataaacgaaaaaccgaaacgattataaaaacacgaaaaaaact

SEQ ID NO: 32153 - DNA, 1011 bp, Artificial Sequence
  chemically treated genomic DNA (Homo sapiens) CpG-island No: 32153
agtcgcgtttggaaattttgttaagttcggtcgggattcgtcgggtcgtacgaggtggttagcgtcgtcgtcgcgttttcgtcgttttcgtttttttcgttgtcgtgtgttttcggtttcgttttagatacggcgggcgcgggatttagaggattttagtttcggcgtcgtttttcgcggagggattcgaggaagttacgcgcgaatttttggaaggtgatggcgtcgttacggtcggcgtttagtcgttggaatattgtttcggcgtcggtcggtcgtattcgtagtttcgtgtatagtgttcggaatttttcgcgttttaggcgtttcgagcggttcgcgtcgtaggcggcgaagattgagcgtagtcgggttagttttttttcgtttttattcgtttttatttcgtttggcgggggcggtcgagagggtttcggagcgtcgcggggcgtagggttttttttggaaggacggggttatttgttgtcgtcgggaggttcggcgagtttggttcgttcggttggttcggttatttgagggaacgtcgggcggggcgaggaacgtcgggggtggtcgagcggtttttttcgacgacggttcgggttagtttttaataggtttcgggagcggtggggtgcgttcgggttttaggtatcgttaaggagcgttttttgcgattgagcgtttaagcgtcgaggtggttttcgttattttttcggcgggtgtagtttcgtttagttagggaggaggagcgcgcgttatcgtttttttagtttttacgtttcggagtttatcgttgtttgtcgcgtaggtgggggagatttggttggtcggaattgggattcggggggagtattgtttttcggcgtaagcgttgtttaggtagagtttagcgtttcgtttttttatagaacgtgttggcgcgcgcgttagaagttaatcgtatagaggtaaggtaggtaggggtaggatttcgaatgggttaagtgtattttattattttattttcga

SEQ ID NO: 32154 - DNA, 1011 bp, Artificial Sequence
  chemically treated genomic DNA (Homo sapiens) CpG-island No: 32154
tcgaaaataaaataataaaatacacttaacccattcgaaatcctacccctacctaccttacctctatacgattaacttctaacgcgcgcgccaacacgttctataaaaaaacgaaacgctaaactctacctaaacaacgcttacgccgaaaaacaatactccccccgaatcccaattccgaccaaccaaatctcccccacctacgcgacaaacaacgataaactccgaaacgtaaaaactaaaaaaacgataacgcgcgctcctcctccctaactaaacgaaactacacccgccgaaaaaataacgaaaaccacctcgacgcttaaacgctcaatcgcaaaaaacgctccttaacgatacctaaaacccgaacgcaccccaccgctcccgaaacctattaaaaactaacccgaaccgtcgtcgaaaaaaaccgctcgaccacccccgacgttcctcgccccgcccgacgttccctcaaataaccgaaccaaccgaacgaaccaaactcgccgaacctcccgacgacaacaaataaccccgtccttccaaaaaaaaccctacgccccgcgacgctccgaaaccctctcgaccgcccccgccaaacgaaataaaaacgaataaaaacgaaaaaaaactaacccgactacgctcaatcttcgccgcctacgacgcgaaccgctcgaaacgcctaaaacgcgaaaaattccgaacactatacacgaaactacgaatacgaccgaccgacgccgaaacaatattccaacgactaaacgccgaccgtaacgacgccatcaccttccaaaaattcgcgcgtaacttcctcgaatccctccgcgaaaaacgacgccgaaactaaaatcctctaaatcccgcgcccgccgtatctaaaacgaaaccgaaaacacacgacaacgaaaaaaacgaaaacgacgaaaacgcgacgacgacgctaaccacctcgtacgacccgacgaatcccgaccgaacttaacaaaatttccaaacgcgact

SEQ ID NO: 32155 - DNA, 1011 bp, Artificial Sequence
  chemically treated genomic DNA (Homo sapiens) CpG-island No: 32155
tcgggagtaagataataaaatgtatttaatttattcggaattttatttttatttattttatttttgtgcggttagtttttgacgcgcgcgttagtacgttttgtggagaagcggagcgttgggttttatttgagtagcgtttacgtcgaagggtaatgtttttttcgaattttagtttcggttagttaggttttttttatttgcgcggtaagtagcggtggatttcggggcgtgggaattggagaagcggtggcgcgcgttttttttttttggttgggcggagttgtattcgtcgggaaagtggcgagagttatttcggcgtttgggcgtttagtcgtaggaggcgttttttggcggtgtttggagttcgggcgtattttatcgttttcgggatttgttgggggttggttcgaatcgtcgtcgaagggagtcgttcggttattttcgacgtttttcgtttcgttcgacgtttttttaagtggtcgaattagtcggacgagttaaattcgtcgggtttttcggcggtagtaggtggtttcgtttttttagggagggttttgcgtttcgcggcgtttcggagttttttcggtcgttttcgttaggcgggatggaggcggatggggacggagaggagttggttcggttgcgtttagttttcgtcgtttgcgacgcgaatcgttcggggcgtttggagcgcgaggagtttcgggtattgtgtacggagttgcgggtgcggtcggtcgacgtcgaggtagtattttagcggttggacgtcgatcgtgacggcgttattattttttaggagttcgcgcgtggttttttcgggttttttcgcggggggcggcgtcgggattggggttttttggatttcgcgttcgtcgtgtttgaggcggggtcggagatatacgatagcgaggaggacgaaggcgacgaggacgcggcggcggcgttggttatttcgtgcggttcggcgagtttcggtcgggtttggtaggatttttaggcgcgatt

SEQ ID NO: 32156 - DNA, 1011 bp, Artificial Sequence
  chemically treated genomic DNA (Homo sapiens) CpG-island No: 32156
aatcgcgcctaaaaatcctaccaaacccgaccgaaactcgccgaaccgcacgaaataaccaacgccgccgccgcgtcctcgtcgccttcgtcctcctcgctatcgtatatctccgaccccgcctcaaacacgacgaacgcgaaatccaaaaaaccccaatcccgacgccgccccccgcgaaaaaacccgaaaaaaccacgcgcgaactcctaaaaaataataacgccgtcacgatcgacgtccaaccgctaaaatactacctcgacgtcgaccgaccgcacccgcaactccgtacacaatacccgaaactcctcgcgctccaaacgccccgaacgattcgcgtcgcaaacgacgaaaactaaacgcaaccgaaccaactcctctccgtccccatccgcctccatcccgcctaacgaaaacgaccgaaaaaactccgaaacgccgcgaaacgcaaaaccctccctaaaaaaacgaaaccacctactaccgccgaaaaacccgacgaatttaactcgtccgactaattcgaccacttaaaaaaacgtcgaacgaaacgaaaaacgtcgaaaataaccgaacgactcccttcgacgacgattcgaaccaacccccaacaaatcccgaaaacgataaaatacgcccgaactccaaacaccgccaaaaaacgcctcctacgactaaacgcccaaacgccgaaataactctcgccactttcccgacgaatacaactccgcccaaccaaaaaaaaaaaacgcgcgccaccgcttctccaattcccacgccccgaaatccaccgctacttaccgcgcaaataaaaaaaacctaactaaccgaaactaaaattcgaaaaaaacattacccttcgacgtaaacgctactcaaataaaacccaacgctccgcttctccacaaaacgtactaacgcgcgcgtcaaaaactaaccgcacaaaaataaaataaataaaaataaaattccgaataaattaaatacattttattatcttactcccga

SEQ ID NO: 32157 - DNA, 528 bp, Artificial Sequence
  chemically treated genomic DNA (Homo sapiens) CpG-island No: 32157
ttttggcgcgcgaatggaggagtcgagaagagagcgtagttttgattggagaacgcgcgtgtttatatttttatttttttcgggaagtggacgaatttagatcgttttttttttttcgttgtttaaggtagttggttgtttttttgttcgttagaggtgtagtattagaggtggcgtgttgtcgatttcgcgtttgttttgttggatgatttcgtttgtttgtcggttgcgtgagtgtttagagtttttcggtggaagatgtcggatagtaatttcgtagagcgtagcgaggagtaggtgtttggtgttaaagttatcgtttaggttttgaaaacgtaagtacgatggatttttttggaatgaaaggtttttacggaagttggcggggatcgcgatgttgttttggagacgagtagaaatgggcgatgggggtcggggggttttttttttagcgttcgggagggagggaaggatgtggcgatatggtggggttttgggagtttatttttttgtttttcgttttttagg

SEQ ID NO: 32158 - DNA, 528 bp, Artificial Sequence
  chemically treated genomic DNA (Homo sapiens) CpG-island No: 32158
cctaaaaaacgaaaaacaaaaaaataaactcccaaaaccccaccatatcgccacatccttccctccctcccgaacgctaaaaaaaaaaccccccgacccccatcgcccatttctactcgtctccaaaacaacatcgcgatccccgccaacttccgtaaaaacctttcattccaaaaaaatccatcgtacttacgttttcaaaacctaaacgataactttaacaccaaacacctactcctcgctacgctctacgaaattactatccgacatcttccaccgaaaaactctaaacactcacgcaaccgacaaacaaacgaaatcatccaacaaaacaaacgcgaaatcgacaacacgccacctctaatactacacctctaacgaacaaaaaaacaaccaactaccttaaacaacgaaaaaaaaaaaacgatctaaattcgtccacttcccgaaaaaaataaaaatataaacacgcgcgttctccaatcaaaactacgctctcttctcgactcctccattcgcgcgccaaaa

SEQ ID NO: 32159 - DNA, 528 bp, Artificial Sequence
  chemically treated genomic DNA (Homo sapiens) CpG-island No: 32159
tttgaggaacgaagaataggggagtaaatttttaaggttttattatatcgttatatttttttttttttttcgggcgttaaaaggaaaatttttcgatttttatcgtttatttttattcgtttttaagataatatcgcggttttcgttagttttcgtaggagttttttattttaggaaggtttatcgtatttgcgtttttagggtttgagcgatgattttagtattagatatttgtttttcgttgcgttttgcgaagttattgttcggtattttttatcgaaaagttttaagtatttacgtagtcggtaaataagcggaattatttagtaaggtaaacgcgaaatcggtagtacgttatttttggtattgtatttttgacggataggagggtaattaattgttttaaataacgggaaggaagaggcggtttaaattcgtttatttttcgggagaggtgagaatgtaaatacgcgcgttttttaattagaattgcgtttttttttcggtttttttattcgcgcgttagaa

SEQ ID NO: 32160 - DNA, 528 bp, Artificial Sequence
  chemically treated genomic DNA (Homo sapiens) CpG-island No: 32160
ttctaacgcgcgaataaaaaaaccgaaaaaaaaacgcaattctaattaaaaaacgcgcgtatttacattctcacctctcccgaaaaataaacgaatttaaaccgcctcttccttcccgttatttaaaacaattaattaccctcctatccgtcaaaaatacaataccaaaaataacgtactaccgatttcgcgtttaccttactaaataattccgcttatttaccgactacgtaaatacttaaaacttttcgataaaaaataccgaacaataacttcgcaaaacgcaacgaaaaacaaatatctaatactaaaatcatcgctcaaaccctaaaaacgcaaatacgataaaccttcctaaaataaaaaactcctacgaaaactaacgaaaaccgcgatattatcttaaaaacgaataaaaataaacgataaaaatcgaaaaattttccttttaacgcccgaaaaaaaaaaaaaaatataacgatataataaaaccttaaaaatttactcccctattcttcgttcctcaaa

SEQ ID NO: 32161 - DNA, 711 bp, Artificial Sequence
  chemically treated genomic DNA (Homo sapiens) CpG-island No: 32161
gttttcgtttcggtcgcggtcgtcgttagggtattcggggttagcgtcgtttgtaggtcgcgttcgtttatcggtatgttgcggcggtgtagcggcggggcggggttttagggtgtgttgtttcgacggcgttcgcgtttttggtttttatcgcggttttcgttcgtttcgttgtcgtcgtcgtttagggttatcgcgttcgggatcgtttaggggattaggaattcgagtggtcgtgtaagtcgcgagggaggcgggattcggggcgtatttgtttaattcggagttaggcgggatgtttcggtcgaggtttcgtcgtagtttttttttagtttttaggtcgcggcgtttttattcgggattttttcggatttggcgtatttatttgtagtcgtttcgatttcgtttcgttaggatatttatttattcgtatatagatacgtttaggattaggattcggattaggaggttacgtattcgtagttcggattcggattttagggttttcgtcgtcgttgttgttgtagttatcgtttttttagttcgtattgggttttggttttagagtcgtttatttaagtttttattcgttttcgttttcgttttcggtttacgttgttgcgggggttgacgtgtttgtttatttttattaggggaattttttattttttttttcggattttatattttcgatatttcgttttattcgtt

SEQ ID NO: 32162 - DNA, 711 bp, Artificial Sequence
  chemically treated genomic DNA (Homo sapiens) CpG-island No: 32162
aacgaataaaacgaaatatcgaaaatataaaatccgaaaaaaaaaataaaaaattcccctaataaaaataaacaaacacgtcaacccccgcaacaacgtaaaccgaaaacgaaaacgaaaacgaataaaaacttaaataaacgactctaaaaccaaaacccaatacgaactaaaaaaacgataactacaacaacaacgacgacgaaaaccctaaaatccgaatccgaactacgaatacgtaacctcctaatccgaatcctaatcctaaacgtatctatatacgaataaataaatatcctaacgaaacgaaatcgaaacgactacaaataaatacgccaaatccgaaaaaatcccgaataaaaacgccgcgacctaaaaactaaaaaaaaactacgacgaaacctcgaccgaaacatcccgcctaactccgaattaaacaaatacgccccgaatcccgcctccctcgcgacttacacgaccactcgaattcctaatcccctaaacgatcccgaacgcgataaccctaaacgacgacgacaacgaaacgaacgaaaaccgcgataaaaaccaaaaacgcgaacgccgtcgaaacaacacaccctaaaaccccgccccgccgctacaccgccgcaacataccgataaacgaacgcgacctacaaacgacgctaaccccgaataccctaacgacgaccgcgaccgaaacgaaaac

SEQ ID NO: 32163 - DNA, 711 bp, Artificial Sequence
  chemically treated genomic DNA (Homo sapiens) CpG-island No: 32163
ggcgggtagggcggggtgtcggggatgtaaggttcgaggaagagggtgggggatttttttggtgggggtggatagatacgttagttttcgtagtagcgtggatcgggggcgggagcgggggcgggtggaggtttaaataggcggttttggagttagagtttagtgcgggttgagaaggcggtggttgtagtagtagcggcggcggaaattttaaagttcgagttcggattacgagtgcgtggttttttaattcggattttagttttgagcgtgtttgtgtgcgagtgggtgagtgttttggcggagcggggtcggggcggttgtagatggatgcgttaggttcggaggggtttcgggtgagggcgtcgcgatttgggggttgggggagggttgcggcgggatttcggtcggagtatttcgtttgatttcgggttgggtaggtgcgtttcgggtttcgtttttttcgcggtttatacggttattcgggtttttgattttttagacggtttcggacgcgatgattttgaacggcggcggtagcggagcgggcgggagtcgcggtgggggttaggagcgcgagcgtcgtcggggtagtatattttggggtttcgtttcgtcgttgtatcgtcgtagtatgtcggtggacgagcgcgatttgtaggcggcgttgatttcgggtgttttgacggcggtcgcggtcgggacggggat

SEQ ID NO: 32164 - DNA, 711 bp, Artificial Sequence
  chemically treated genomic DNA (Homo sapiens) CpG-island No: 32164
atccccgtcccgaccgcgaccgccgtcaaaacacccgaaatcaacgccgcctacaaatcgcgctcgtccaccgacatactacgacgatacaacgacgaaacgaaaccccaaaatatactaccccgacgacgctcgcgctcctaacccccaccgcgactcccgcccgctccgctaccgccgccgttcaaaatcatcgcgtccgaaaccgtctaaaaaatcaaaaacccgaataaccgtataaaccgcgaaaaaaacgaaacccgaaacgcacctacccaacccgaaatcaaacgaaatactccgaccgaaatcccgccgcaaccctcccccaacccccaaatcgcgacgccctcacccgaaacccctccgaacctaacgcatccatctacaaccgccccgaccccgctccgccaaaacactcacccactcgcacacaaacacgctcaaaactaaaatccgaattaaaaaaccacgcactcgtaatccgaactcgaactttaaaatttccgccgccgctactactacaaccaccgccttctcaacccgcactaaactctaactccaaaaccgcctatttaaacctccacccgcccccgctcccgcccccgatccacgctactacgaaaactaacgtatctatccacccccaccaaaaaaatcccccaccctcttcctcgaaccttacatccccgacaccccgccctacccgcc

SEQ ID NO: 32165 - DNA, 509 bp, Artificial Sequence
  chemically treated genomic DNA (Homo sapiens) CpG-island No: 32165
attcgttcgcgtttagtagcggcggatatcgaagatttcgcgtgcgtcgatgttgtcgggaatttgttcgtttttttcgtttgtcgttataggtcgttttttagagcgttggtagatgagggggttggtattttttaggaggtcgtcgtcgatttcgtcgtcgtttattatcgcggaattattatcgttgattttagtaggcgtgcgttttcgttttaattcgcgtattttcggagaacgggaagggggcgtggcgtggcgacggagtcgcgcgagggatacgtcgcgttgtgggttttcggtttgaggtgcgagagaagcggtgatcgcggttttggttgttcggattcgggaatatgatggtcgttggagtagaaggcgttgagaagggattacggcggcgttgggtcgtgcgagttagtagcgggttgaaacgtagaggttagaattaggttttagggggtattaaaggcggtcggaggtaatttttatatcgtttttttttggaa

SEQ ID NO: 32166 - DNA, 509 bp, Artificial Sequence
  chemically treated genomic DNA (Homo sapiens) CpG-island No: 32166
ttccaaaaaaaaacgatataaaaattacctccgaccgcctttaataccccctaaaacctaattctaacctctacgtttcaacccgctactaactcgcacgacccaacgccgccgtaatcccttctcaacgccttctactccaacgaccatcatattcccgaatccgaacaaccaaaaccgcgatcaccgcttctctcgcacctcaaaccgaaaacccacaacgcgacgtatccctcgcgcgactccgtcgccacgccacgcccccttcccgttctccgaaaatacgcgaattaaaacgaaaacgcacgcctactaaaatcaacgataataattccgcgataataaacgacgacgaaatcgacgacgacctcctaaaaaataccaaccccctcatctaccaacgctctaaaaaacgacctataacgacaaacgaaaaaaacgaacaaattcccgacaacatcgacgcacgcgaaatcttcgatatccgccgctactaaacgcgaacgaat

SEQ ID NO: 32167 - DNA, 509 bp, Artificial Sequence
  chemically treated genomic DNA (Homo sapiens) CpG-island No: 32167
ttttaggaggaagcggtgtggggattattttcgatcgtttttagtgttttttgagatttggttttggtttttacgttttagttcgttattggttcgtacgatttagcgtcgtcgtggtttttttttagcgttttttgttttagcgattattatgttttcgggttcgagtagttagggtcgcggttatcgtttttttcgtattttaggtcgagaatttataacgcggcgtgtttttcgcgcgatttcgtcgttacgttacgtttttttttcgtttttcggaagtgcgcgggttggagcggaagcgtacgtttgttaggattagcggtggtggtttcgcgatggtaggcggcggcggggtcggcggcggttttttggagaatgttaatttttttatttattagcgttttggggagcggtttgtgacggtaggcgaggaggacgagtaggttttcgatagtatcgacgtacgcgagattttcgatattcgtcgttgttgggcgcgggcgggt

SEQ ID NO: 32168 - DNA, 509 bp, Artificial Sequence
  chemically treated genomic DNA (Homo sapiens) CpG-island No: 32168
acccgcccgcgcccaacaacgacgaatatcgaaaatctcgcgtacgtcgatactatcgaaaacctactcgtcctcctcgcctaccgtcacaaaccgctccccaaaacgctaataaataaaaaaattaacattctccaaaaaaccgccgccgaccccgccgccgcctaccatcgcgaaaccaccaccgctaatcctaacaaacgtacgcttccgctccaacccgcgcacttccgaaaaacgaaaaaaaaacgtaacgtaacgacgaaatcgcgcgaaaaacacgccgcgttataaattctcgacctaaaatacgaaaaaaacgataaccgcgaccctaactactcgaacccgaaaacataataatcgctaaaacaaaaaacgctaaaaaaaaaccacgacgacgctaaatcgtacgaaccaataacgaactaaaacgtaaaaaccaaaaccaaatctcaaaaaacactaaaaacgatcgaaaataatccccacaccgcttcctcctaaaa

SEQ ID NO: 32169 - DNA, 503 bp, Artificial Sequence
  chemically treated genomic DNA (Homo sapiens) CpG-island No: 32169
acgtgcgtaaatattttgttcggtgtagatatttagatatatgtttgcgtttttaagtgttttttttttttacgtatcggtcgagaaggtagttcggttatttttgcggggaaatttttttcgggggatattgcgtttttgttacgcggagtttcgttttttcgaggttttcgtttatttgtcgtgcgcgtttttcgtagatattcgcgtatagcgtttcgcggcgttcgtttttcgttgttttgggttatttttacgcgttgcgtacgttcggggcgagtgagtgagagtttgggtttgggtttgagcgggttgggtaattaggggtttcgcggaggaggcggtaggatatagtcgttaggtcgtttgttggcggcggggttattcggggcgtagcgcggattttgcgtttggcgcgggggattaaggtttgggttaagttcgggggtcgggatgggaagaggggtttcgtttagtttggagtgtgggagtttttcggtttg

SEQ ID NO: 32170 - DNA, 503 bp, Artificial Sequence
  chemically treated genomic DNA (Homo sapiens) CpG-island No: 32170
caaaccgaaaaactcccacactccaaactaaacgaaacccctcttcccatcccgacccccgaacttaacccaaaccttaatcccccgcgccaaacgcaaaatccgcgctacgccccgaataaccccgccgccaacaaacgacctaacgactatatcctaccgcctcctccgcgaaacccctaattacccaacccgctcaaacccaaacccaaactctcactcactcgccccgaacgtacgcaacgcgtaaaaataacccaaaacaacgaaaaacgaacgccgcgaaacgctatacgcgaatatctacgaaaaacgcgcacgacaaataaacgaaaacctcgaaaaaacgaaactccgcgtaacaaaaacgcaatatcccccgaaaaaaatttccccgcaaaaataaccgaactaccttctcgaccgatacgtaaaaaaaaaaaacacttaaaaacgcaaacatatatctaaatatctacaccgaacaaaatatttacgcacgt

SEQ ID NO: 32171 - DNA, 503 bp, Artificial Sequence
  chemically treated genomic DNA (Homo sapiens) CpG-island No: 32171
tagatcggaaagtttttatattttaggttgggcgggatttttttttttatttcggttttcgaatttggtttaagttttggtttttcgcgttagacgtaaagttcgcgttgcgtttcgggtggtttcgtcgttagtaagcgatttggcggttgtgttttgtcgtttttttcgcgaagtttttgattgtttagttcgtttagatttaggtttagatttttatttattcgtttcgggcgtgcgtagcgcgtgggggtggtttagggtagcggggggcgggcgtcgcggagcgttgtgcgcgggtgtttgcggggagcgcgtacggtaagtgagcggggatttcgggggagcggggtttcgcgtggtaagggcgtagtgtttttcggagagaattttttcgtagaagtggtcgagttgttttttcggtcggtacgtgagggaagggggtatttgggggcgtaagtatgtgtttgggtgtttatatcgagtagggtgtttgcgtacgt

SEQ ID NO: 32172 - DNA, 503 bp, Artificial Sequence
  chemically treated genomic DNA (Homo sapiens) CpG-island No: 32172
acgtacgcaaacaccctactcgatataaacacccaaacacatacttacgcccccaaatacccccttccctcacgtaccgaccgaaaaaacaactcgaccacttctacgaaaaaattctctccgaaaaacactacgcccttaccacgcgaaaccccgctcccccgaaatccccgctcacttaccgtacgcgctccccgcaaacacccgcgcacaacgctccgcgacgcccgccccccgctaccctaaaccacccccacgcgctacgcacgcccgaaacgaataaataaaaatctaaacctaaatctaaacgaactaaacaatcaaaaacttcgcgaaaaaaacgacaaaacacaaccgccaaatcgcttactaacgacgaaaccacccgaaacgcaacgcgaactttacgtctaacgcgaaaaaccaaaacttaaaccaaattcgaaaaccgaaataaaaaaaaaaatcccgcccaacctaaaatataaaaactttccgatcta

SEQ ID NO: 32173 - DNA, 578 bp, Artificial Sequence
  chemically treated genomic DNA (Homo sapiens) CpG-island No: 32173
ttttacgattttttttattgtttgatagttagttaatagcgtgttaggattttaggacgcgcgatggcgtaagttttaacgttcgcgtgatgacgtaagaggcgttatcgtttttaaggagtggttcggggtatcggttttaaagtcgtagggcgggtcgagtggattttcgttgttggtttggggttttttagtcgttttggcgttgttttttttaattttcgtcgtttcgcgtagaacgtcgtttttaggttgtcgttaagttttcgcggtatttttttaggtggttcgacgagatttagagtgattcgcgggacgtttgtatcgatcgcgttttttttttattagcgtgggattcggttgaacgtggagtttttagtaatttttagttttttattagggttagggattcgtttggggcgcgggggaaagaagcgtggcggggttgtagatgtcgcgtgagtaggatgtagattgtatcgttggagcgtttgataattaatcgagcgttggtttagttttgttttttcgtatagtaagttttttgttttttagaggaaggtaaaggtggtgaaagt

SEQ ID NO: 32174 - DNA, 578 bp, Artificial Sequence
  chemically treated genomic DNA (Homo sapiens) CpG-island No: 32174
actttcaccacctttaccttcctctaaaaaacaaaaaacttactatacgaaaaaacaaaactaaaccaacgctcgattaattatcaaacgctccaacgatacaatctacatcctactcacgcgacatctacaaccccgccacgcttctttcccccgcgccccaaacgaatccctaaccctaataaaaaactaaaaattactaaaaactccacgttcaaccgaatcccacgctaataaaaaaaaaacgcgatcgatacaaacgtcccgcgaatcactctaaatctcgtcgaaccacctaaaaaaataccgcgaaaacttaacgacaacctaaaaacgacgttctacgcgaaacgacgaaaattaaaaaaaacaacgccaaaacgactaaaaaaccccaaaccaacaacgaaaatccactcgacccgccctacgactttaaaaccgataccccgaaccactccttaaaaacgataacgcctcttacgtcatcacgcgaacgttaaaacttacgccatcgcgcgtcctaaaatcctaacacgctattaactaactatcaaacaataaaaaaaatcgtaaaa

SEQ ID NO: 32175 - DNA, 578 bp, Artificial Sequence
  chemically treated genomic DNA (Homo sapiens) CpG-island No: 32175
gtttttattatttttatttttttttgaaagatagagagtttgttgtgcgggaaaataaaattaagttaacgttcggttggttgttaagcgttttagcggtgtaatttgtattttatttacgcggtatttatagtttcgttacgtttttttttttcgcgttttagacgagtttttggttttggtgagagattgaagattgttggggattttacgtttaatcgaattttacgttggtgggaagaggacgcggtcgatataggcgtttcgcgggttattttgggtttcgtcgggttatttaggagagtgtcgcgggagtttgacggtagtttgagagcggcgttttacgcggagcggcgggggttggagaggataacgttaagacggttgggaagttttaggttagtagcggaagtttattcggttcgttttgcgattttgaaatcggtgtttcggattattttttggagacggtggcgttttttgcgttattacgcgggcgttggagtttacgttatcgcgcgttttagagttttagtacgttattggttggttgttaagtaatgggaggagtcgtgaga

SEQ ID NO: 32176 - DNA, 578 bp, Artificial Sequence
  chemically treated genomic DNA (Homo sapiens) CpG-island No: 32176
tctcacgactcctcccattacttaacaaccaaccaataacgtactaaaactctaaaacgcgcgataacgtaaactccaacgcccgcgtaataacgcaaaaaacgccaccgtctccaaaaaataatccgaaacaccgatttcaaaatcgcaaaacgaaccgaataaacttccgctactaacctaaaacttcccaaccgtcttaacgttatcctctccaacccccgccgctccgcgtaaaacgccgctctcaaactaccgtcaaactcccgcgacactctcctaaataacccgacgaaacccaaaataacccgcgaaacgcctatatcgaccgcgtcctcttcccaccaacgtaaaattcgattaaacgtaaaatccccaacaatcttcaatctctcaccaaaaccaaaaactcgtctaaaacgcgaaaaaaaaaaacgtaacgaaactataaataccgcgtaaataaaatacaaattacaccgctaaaacgcttaacaaccaaccgaacgttaacttaattttattttcccgcacaacaaactctctatctttcaaaaaaaaataaaaataataaaaac

SEQ ID NO: 32177 - DNA, 591 bp, Artificial Sequence
  chemically treated genomic DNA (Homo sapiens) CpG-island No: 32177
cgtttacgttcgttagtgattttttgtaattttttcgggcgtagtttaattttgcgttttttaatatgaatggttagcgtgttttgcggcggtagaacgtataattgcgttagattattttttttacgcgcggtttttgtcgatggaatgttgataattttgttgtttttgtttttcgatagttgcggtagattatttatcgggaatattaatatacggtttgtttgagtgattgttagtagtatatcggaagtatttttaattattatcggcggtataatatgggtatttttcggtaaggtgattaaagttttatttgtacggttacgcgttattagatcgttaaaggtgtagacgaaatcgtaattcgtatcggaagttattagtagtttttgatcgtcgttttttattagtatatggttaacggtcgttttaggcggtaacgttaatttgtcggtgagcggttcgttttgattacgcgtcgacggtagcgtaatcgggttaatggtatagttacgatcggtggaatttataaatattatcggttggttgtttttattttttatcgtcgttttgaagttattattcgtt

SEQ ID NO: 32178 - DNA, 591 bp, Artificial Sequence
  chemically treated genomic DNA (Homo sapiens) CpG-island No: 32178
aacgaataataacttcaaaacgacgataaaaaataaaaacaaccaaccgataatatttataaattccaccgatcgtaactataccattaacccgattacgctaccgtcgacgcgtaatcaaaacgaaccgctcaccgacaaattaacgttaccgcctaaaacgaccgttaaccatatactaataaaaaacgacgatcaaaaactactaataacttccgatacgaattacgatttcgtctacacctttaacgatctaataacgcgtaaccgtacaaataaaactttaatcaccttaccgaaaaatacccatattataccgccgataataattaaaaatacttccgatatactactaacaatcactcaaacaaaccgtatattaatattcccgataaataatctaccgcaactatcgaaaaacaaaaacaacaaaattatcaacattccatcgacaaaaaccgcgcgtaaaaaaaataatctaacgcaattatacgttctaccgccgcaaaacacgctaaccattcatattaaaaaacgcaaaattaaactacgcccgaaaaaattacaaaaaatcactaacgaacgtaaacg

SEQ ID NO: 32179 - DNA, 591 bp, Artificial Sequence
  chemically treated genomic DNA (Homo sapiens) CpG-island No: 32179
agcgggtgatagttttaaagcggcggtgaaaggtaagagtaattaatcggtagtgtttgtagattttatcggtcgtagttatgttattgattcgattacgttgtcgtcggcgcgtggttagggcgagtcgtttatcggtaaattaacgttgtcgtttggggcgatcgttgattatatgttgatggaaagcgacgattagaaattgttgatggttttcgatgcgggttacggtttcgtttgtatttttaacgatttggtggcgcgtaatcgtgtaggtaaggttttgattattttatcggaaaatgtttatgttatgtcgtcggtggtgattgaagatgttttcgatatgttgttggtaattatttaggtaggtcgtatgttgatgttttcggtaagtgatttgtcgtagttgtcgaagggtaaaggtaataagattattaatattttatcggtagaagtcgcgcgtggagaagatggtttggcgtaattgtacgttttgtcgtcgtaaagtacgttgattatttatgttgggaaacgtaaaattaaattgcgttcggaagagttatagaaagttattggcgaacgtggacg

SEQ ID NO: 32180 - DNA, 591 bp, Artificial Sequence
  chemically treated genomic DNA (Homo sapiens) CpG-island No: 32180
cgtccacgttcgccaataactttctataactcttccgaacgcaatttaattttacgtttcccaacataaataatcaacgtactttacgacgacaaaacgtacaattacgccaaaccatcttctccacgcgcgacttctaccgataaaatattaataatcttattacctttacccttcgacaactacgacaaatcacttaccgaaaacatcaacatacgacctacctaaataattaccaacaacatatcgaaaacatcttcaatcaccaccgacgacataacataaacattttccgataaaataatcaaaaccttacctacacgattacgcgccaccaaatcgttaaaaatacaaacgaaaccgtaacccgcatcgaaaaccatcaacaatttctaatcgtcgctttccatcaacatataatcaacgatcgccccaaacgacaacgttaatttaccgataaacgactcgccctaaccacgcgccgacgacaacgtaatcgaatcaataacataactacgaccgataaaatctacaaacactaccgattaattactcttacctttcaccgccgctttaaaactatcacccgct

SEQ ID NO: 32181 - DNA, 602 bp, Artificial Sequence
  chemically treated genomic DNA (Homo sapiens) CpG-island No: 32181
gggcggggtcggttcgtagtggttagttgggagttacgagcgcggagtttgcgtagaagatttttattagggtgcggggtgtagttgcggttttagggttatggcggaggagtagggtcgggaacgggattcggtttttaagtcgtcggtgttgtttttttatttagatttgggcgtgggcggcgttgagcggttggtgttggacgcggcgttggcgttgtaggcgcgcgggtgtagcgtgaagatttggatagcgtattacgattcgggttattgtttcgtcgagagtcgcgagttatcggtgcgttgtgtcggggattggttgtcgcgaggtttgggttggggcggtcgcggcgtcgtcgtttgcgtttacgtgcgtatggtttttttggcgttttacgtgttgtttttcgtcgacgaggagttcgacgtggtagtgtgcgattaggtgaggcggtcgcggggtcggttgcgcgagtgcggatttcgtcgtggagggcggtcgcgggtatgatttttgagagaagattttttttgtttgcggttcgtaaagatcggaattgatatggagaagttagggttgtgagcgagtttgtggtttt

SEQ ID NO: 32182 - DNA, 602 bp, Artificial Sequence
  chemically treated genomic DNA (Homo sapiens) CpG-island No: 32182
aaaaccacaaactcgctcacaaccctaacttctccatatcaattccgatctttacgaaccgcaaacaaaaaaaatcttctctcaaaaatcatacccgcgaccgccctccacgacgaaatccgcactcgcgcaaccgaccccgcgaccgcctcacctaatcgcacactaccacgtcgaactcctcgtcgacgaaaaacaacacgtaaaacgccaaaaaaaccatacgcacgtaaacgcaaacgacgacgccgcgaccgccccaacccaaacctcgcgacaaccaatccccgacacaacgcaccgataactcgcgactctcgacgaaacaataacccgaatcgtaatacgctatccaaatcttcacgctacacccgcgcgcctacaacgccaacgccgcgtccaacaccaaccgctcaacgccgcccacgcccaaatctaaataaaaaaacaacaccgacgacttaaaaaccgaatcccgttcccgaccctactcctccgccataaccctaaaaccgcaactacaccccgcaccctaataaaaatcttctacgcaaactccgcgctcgtaactcccaactaaccactacgaaccgaccccgccc

SEQ ID NO: 32183 - DNA, 602 bp, Artificial Sequence
  chemically treated genomic DNA (Homo sapiens) CpG-island No: 32183
agaattataggttcgtttataattttgatttttttatgttagtttcgatttttgcgaatcgtagatagggaaggtttttttttaggggttatgttcgcggtcgttttttacggcgaggttcgtattcgcgtagtcggtttcgcggtcgttttatttggtcgtatattattacgtcgaatttttcgtcggcgaggaatagtacgtagagcgttaggaaaattatgcgtacgtaggcgtagacggcggcgtcgcggtcgttttagtttaggtttcgcggtagttagttttcggtatagcgtatcggtagttcgcggttttcggcgaaatagtggttcgggtcgtagtgcgttgtttagatttttacgttatattcgcgcgtttgtagcgttagcgtcgcgtttaatattagtcgtttagcgtcgtttacgtttaggtttgggtggaggaatagtatcgacggtttgggaatcgagtttcgttttcggttttgttttttcgttatggttttggagtcgtaattgtatttcgtattttgatgggggttttttgcgtaagtttcgcgttcgtagtttttagttggttattgcgggtcgatttcgttt

SEQ ID NO: 32184 - DNA, 602 bp, Artificial Sequence
  chemically treated genomic DNA (Homo sapiens) CpG-island No: 32184
aaacgaaatcgacccgcaataaccaactaaaaactacgaacgcgaaacttacgcaaaaaacccccatcaaaatacgaaatacaattacgactccaaaaccataacgaaaaaacaaaaccgaaaacgaaactcgattcccaaaccgtcgatactattcctccacccaaacctaaacgtaaacgacgctaaacgactaatattaaacgcgacgctaacgctacaaacgcgcgaatataacgtaaaaatctaaacaacgcactacgacccgaaccactatttcgccgaaaaccgcgaactaccgatacgctataccgaaaactaactaccgcgaaacctaaactaaaacgaccgcgacgccgccgtctacgcctacgtacgcataattttcctaacgctctacgtactattcctcgccgacgaaaaattcgacgtaataatatacgaccaaataaaacgaccgcgaaaccgactacgcgaatacgaacctcgccgtaaaaaacgaccgcgaacataacccctaaaaaaaaaccttccctatctacgattcgcaaaaatcgaaactaacataaaaaaatcaaaattataaacgaacctataattct

SEQ ID NO: 32185 - DNA, 553 bp, Artificial Sequence
  chemically treated genomic DNA (Homo sapiens) CpG-island No: 32185
ttgaaagtcgatttcgaagtcgggtttggggtcgtgggaattttttcggttttagttattttttcgcggtagttataatattcggggtcgtggttcgataagttataataatagtaattgcgtagatgcgcgattcggcgggggaggtggtttcgtattatagcgcgtttgcgcgtaggtttaagtaggcgtttatttagaggggagggaggacgtcgtatttcgtttttattgaggcgcggagtcggattcggaggcgtcgagtcgtattcggagtcgcgtacgcgtaatttgtatgaacgaaggttagtgtttaaagacgtgttatttattgttagaattcgatttttattggagcggaggaagttcgtgggtggagttggttgtttggcgtttgcgttttgcggcgagcgggttggcgtgcggcgtcgttgcgggcgggagcggttgtaacgtcggtgtttgaggagcgatgtcgagggaaattattattttatagttgggttagtgcggtaattagagtgagcgaaatttcggttttttagttagttag

SEQ ID NO: 32186 - DNA, 553 bp, Artificial Sequence
  chemically treated genomic DNA (Homo sapiens) CpG-island No: 32186
ctaactaactaaaaaaccgaaatttcgctcactctaattaccgcactaacccaactataaaataataatttccctcgacatcgctcctcaaacaccgacgttacaaccgctcccgcccgcaacgacgccgcacgccaacccgctcgccgcaaaacgcaaacgccaaacaaccaactccacccacgaacttcctccgctccaataaaaatcgaattctaacaataaataacacgtctttaaacactaaccttcgttcatacaaattacgcgtacgcgactccgaatacgactcgacgcctccgaatccgactccgcgcctcaataaaaacgaaatacgacgtcctccctcccctctaaataaacgcctacttaaacctacgcgcaaacgcgctataatacgaaaccacctcccccgccgaatcgcgcatctacgcaattactattattataacttatcgaaccacgaccccgaatattataactaccgcgaaaaaataactaaaaccgaaaaaattcccacgaccccaaacccgacttcgaaatcgactttcaa

SEQ ID NO: 32187 - DNA, 553 bp, Artificial Sequence
  chemically treated genomic DNA (Homo sapiens) CpG-island No: 32187
ttggttagttgaggggtcggagtttcgtttattttgattgtcgtattggtttaattgtagggtgatgatttttttcggtatcgttttttaggtatcggcgttgtagtcgttttcgttcgtaacggcgtcgtacgttagttcgttcgtcgtaagacgtaggcgttaaataattagttttatttacgaatttttttcgttttaatgagaatcgagttttggtaatgaatggtacgtttttaagtattggttttcgtttatgtagattgcgcgtgcgcggtttcggatgcggttcggcgttttcggattcggtttcgcgttttagtgagggcggggtacggcgtttttttttttttttgggtgggcgtttgtttgggtttgcgcgtaagcgcgttgtggtgcgaagttatttttttcgtcgaatcgcgtatttgcgtagttgttgttattgtgatttgtcgggttacggtttcggatgttgtggttgtcgcggggagatggttgaggtcgaaggggtttttacgattttaggttcggtttcggggtcgatttttag

SEQ ID NO: 32188 - DNA, 553 bp, Artificial Sequence
  chemically treated genomic DNA (Homo sapiens) CpG-island No: 32188
ctaaaaatcgaccccgaaaccgaacctaaaatcgtaaaaaccccttcgacctcaaccatctccccgcgacaaccacaacatccgaaaccgtaacccgacaaatcacaataacaacaactacgcaaatacgcgattcgacgaaaaaaataacttcgcaccacaacgcgcttacgcgcaaacccaaacaaacgcccacccaaaaaaaaaaaaaaacgccgtaccccgccctcactaaaacgcgaaaccgaatccgaaaacgccgaaccgcatccgaaaccgcgcacgcgcaatctacataaacgaaaaccaatacttaaaaacgtaccattcattaccaaaactcgattctcattaaaacgaaaaaaattcgtaaataaaactaattatttaacgcctacgtcttacgacgaacgaactaacgtacgacgccgttacgaacgaaaacgactacaacgccgatacctaaaaaacgataccgaaaaaaatcatcaccctacaattaaaccaatacgacaatcaaaataaacgaaactccgacccctcaactaaccaa

SEQ ID NO: 32189 - DNA, 577 bp, Artificial Sequence
  chemically treated genomic DNA (Homo sapiens) CpG-island No: 32189
aatttcggatattgcgtcgttagggttaggtaggcggttatggttttagttcggtttatgtttcgtagtcgtttttagtcgtttagtacggtagttgtcgtgtcggcgtcgttttttttttcgcgggtaatgtttttcgtagtgcggtcggtttcgtcgcgtcgggttcgtttcgttcgttttttggttaggttcgggttttagagcgtttcggttagtagggtagcggaagggggcggtttgggggtcgggcggggcgggttttcgcgcggcggggtcgggggcgggagtaggcggtttaggcggggtaggggtattcgcggagagaagtttcgttgtaggttttgtaggcgtagcgtcgttagggcgcgtagcgtgtcgtcgggtgggggcggtcggtttcgtagtagtagagcgtgagtttgtaggggaggtattcggcgttagtgtacgagcggcggcggaatcgtcgcgaaaacgtttcgcggaatttgagtaggtttaggttttagttaagtttttcgcggggttgttatagtgatgaaatgagacggtttagaaaattaggggtttaggt

SEQ ID NO: 32190 - DNA, 577 bp, Artificial Sequence
  chemically treated genomic DNA (Homo sapiens) CpG-island No: 32190
acctaaacccctaattttctaaaccgtctcatttcatcactataacaaccccgcgaaaaacttaactaaaacctaaacctactcaaattccgcgaaacgttttcgcgacgattccgccgccgctcgtacactaacgccgaatacctcccctacaaactcacgctctactactacgaaaccgaccgcccccacccgacgacacgctacgcgccctaacgacgctacgcctacaaaacctacaacgaaacttctctccgcgaatacccctaccccgcctaaaccgcctactcccgcccccgaccccgccgcgcgaaaacccgccccgcccgacccccaaaccgcccccttccgctaccctactaaccgaaacgctctaaaacccgaacctaaccaaaaaacgaacgaaacgaacccgacgcgacgaaaccgaccgcactacgaaaaacattacccgcgaaaaaaaaaacgacgccgacacgacaactaccgtactaaacgactaaaaacgactacgaaacataaaccgaactaaaaccataaccgcctacctaaccctaacgacgcaatatccgaaatt

SEQ ID NO: 32191 - DNA, 577 bp, Artificial Sequence
  chemically treated genomic DNA (Homo sapiens) CpG-island No: 32191
gtttgaatttttggttttttaggtcgttttattttattattatggtagtttcgcgggaggtttgattggaatttagatttgtttagatttcgcgaggcgttttcgcgacggtttcgtcgtcgttcgtatattgacgtcgggtgttttttttgtaggtttacgttttgttgttgcggggtcggtcgtttttattcgacgatacgttgcgcgttttggcggcgttgcgtttgtagagtttgtagcgggattttttttcgcgggtgtttttgtttcgtttggatcgtttgttttcgttttcggtttcgtcgcgcgaagattcgtttcgttcgatttttaggtcgttttttttcgttgttttgttggtcggggcgttttggagttcgggtttggttaagaggcgggcggagcgggttcggcgcggcggggtcggtcgtattgcgggaagtattgttcgcgagggaggaggcggcgtcggtacggtagttgtcgtgttgggcggttggaagcggttacggggtatgggtcgagttgaggttatggtcgtttatttggttttggcggcgtagtgttcggggtt

SEQ ID NO: 32192 - DNA, 577 bp, Artificial Sequence
  chemically treated genomic DNA (Homo sapiens) CpG-island No: 32192
aaccccgaacactacgccgccaaaaccaaataaacgaccataacctcaactcgacccataccccgtaaccgcttccaaccgcccaacacgacaactaccgtaccgacgccgcctcctccctcgcgaacaatacttcccgcaatacgaccgaccccgccgcgccgaacccgctccgcccgcctcttaaccaaacccgaactccaaaacgccccgaccaacaaaacaacgaaaaaaaacgacctaaaaatcgaacgaaacgaatcttcgcgcgacgaaaccgaaaacgaaaacaaacgatccaaacgaaacaaaaacacccgcgaaaaaaaatcccgctacaaactctacaaacgcaacgccgccaaaacgcgcaacgtatcgtcgaataaaaacgaccgaccccgcaacaacaaaacgtaaacctacaaaaaaaacacccgacgtcaatatacgaacgacgacgaaaccgtcgcgaaaacgcctcgcgaaatctaaacaaatctaaattccaatcaaacctcccgcgaaactaccataataataaaataaaacgacctaaaaaaccaaaaattcaaac

SEQ ID NO: 32193 - DNA, 590 bp, Artificial Sequence
  chemically treated genomic DNA (Homo sapiens) CpG-island No: 32193
cgggcgagggttaagtcgttggttattagtagtgcgatatttttgcgtttgttggtagggtagtttcgttcgcgcgtagttagtagatcggtagtatttagtagtagggcgaggttgtagggtagttgtagtattacgaaggtcgttattagagttattacgacgcgtagcgtacgtcggcgttcgggttttttggcggttagtagcgtgcggtttagaagcgcgtagtaggttattatgacgtttagcggtagcgcgaagtttagggttatttgcgttacggcgttcgttttttttatcgtttgcgtgaggttttcggggaagatgaggcgatagcgtcgttggttttttcgttgtttattttggttgaagagtagcgtaggtagcgttaggagtagtgatagtagttatacgatgacggagattaagtgtgcgcggtcgggagtggagggtcgcggttcggttgggagcgttcgcgcgatggttacgtagcggtcggcgttgatataggttaggaagaggaagtcggcgtggaaggaggtcgagtagaggttagagatggtgcggtaggtggtattttttagatttta

SEQ ID NO: 32194 - DNA, 590 bp, Artificial Sequence
  chemically treated genomic DNA (Homo sapiens) CpG-island No: 32194
taaaatctaaaaaataccacctaccgcaccatctctaacctctactcgacctccttccacgccgacttcctcttcctaacctatatcaacgccgaccgctacgtaaccatcgcgcgaacgctcccaaccgaaccgcgaccctccactcccgaccgcgcacacttaatctccgtcatcgtataactactatcactactcctaacgctacctacgctactcttcaaccaaaataaacaacgaaaaaaccaacgacgctatcgcctcatcttccccgaaaacctcacgcaaacgataaaaaaaacgaacgccgtaacgcaaataaccctaaacttcgcgctaccgctaaacgtcataataacctactacgcgcttctaaaccgcacgctactaaccgccaaaaaacccgaacgccgacgtacgctacgcgtcgtaataactctaataacgaccttcgtaatactacaactaccctacaacctcgccctactactaaatactaccgatctactaactacgcgcgaacgaaactaccctaccaacaaacgcaaaaatatcgcactactaataaccaacgacttaaccctcgcccg

SEQ ID NO: 32195 - DNA, 590 bp, Artificial Sequence
  chemically treated genomic DNA (Homo sapiens) CpG-island No: 32195
tggagtttgggaagtgttatttgtcgtattatttttggtttttattcggtttttttttacgtcggttttttttttttggtttgtattagcgtcgatcgttacgtggttatcgcgcgagcgtttttagtcgggtcgcggttttttattttcggtcgcgtatatttggttttcgttatcgtgtggttgttgttattgtttttggcgttgtttgcgttgttttttagttaggatgggtagcgggaaggttaacgacgttgtcgttttatttttttcgagggttttacgtagacggtgaagggggcgagcgtcgtggcgtaggtggttttgggtttcgcgttgtcgttgggcgttatggtagtttgttacgcgtttttgggtcgtacgttgttggtcgttagggggttcgagcgtcggcgtgcgttgcgcgtcgtggtggttttggtggcggttttcgtggtgttgtagttgttttatagtttcgttttgttgttggatattgtcgatttattggttgcgcgcgagcggagttgttttgttagtaaacgtaaggatgtcgtattgttggtgattagcggtttggttttcgttcg

SEQ ID NO: 32196 - DNA, 590 bp, Artificial Sequence
  chemically treated genomic DNA (Homo sapiens) CpG-island No: 32196
cgaacgaaaaccaaaccgctaatcaccaacaatacgacatccttacgtttactaacaaaacaactccgctcgcgcgcaaccaataaatcgacaatatccaacaacaaaacgaaactataaaacaactacaacaccacgaaaaccgccaccaaaaccaccacgacgcgcaacgcacgccgacgctcgaaccccctaacgaccaacaacgtacgacccaaaaacgcgtaacaaactaccataacgcccaacgacaacgcgaaacccaaaaccacctacgccacgacgctcgcccccttcaccgtctacgtaaaaccctcgaaaaaaataaaacgacaacgtcgttaaccttcccgctacccatcctaactaaaaaacaacgcaaacaacgccaaaaacaataacaacaaccacacgataacgaaaaccaaatatacgcgaccgaaaataaaaaaccgcgacccgactaaaaacgctcgcgcgataaccacgtaacgatcgacgctaatacaaaccaaaaaaaaaaaaccgacgtaaaaaaaaaccgaataaaaaccaaaaataatacgacaaataacacttcccaaactcca

SEQ ID NO: 32197 - DNA, 673 bp, Artificial Sequence
  chemically treated genomic DNA (Homo sapiens) CpG-island No: 32197
cgggcggcgtggggcgggggcgggcgtggggggaagggatcggttgcggggagggcggaggtgagggggtcgggtattggtttttttttagtgttgggggaagggagggttggacgtgcgatgaagggtcgagatcggagtgttcggggtgtatggaggtggaggtagcgttgggttgtagcgggtagggtcggggatgtgggggggtggtatcggcggggagagggagggagcgagcgagcgagcggggtataagggtgaggatttttaaagggttgagtggtgcgggcggtttcgtgagaaaggcgggtgagtgcgaggggggcgcgggggcggggataatgggaagaagggttggttggcgggcgggtgggggggggtcgtcgaataatggggtgggaaattggttaattatcgaagcgtttcggtcgttcggtaatttttaaacgcgttaatttcgcggaattttcgttttttttaacgtttgcggggtatttaatttcgatcgtatttttagttttaagttttttttcgttcgatttttaaatttatatttttcgttaatacgattatatcgcgcgtcgttaaaatttttttttttttttgaggaatagattttatatttttaggttattttttaatttttcgtttttttttagatttttattaagtt

SEQ ID NO: 32198 - DNA, 673 bp, Artificial Sequence
  chemically treated genomic DNA (Homo sapiens) CpG-island No: 32198
aacttaataaaaatctaaaaaaaaacgaaaaattaaaaaataacctaaaaatataaaatctattcctcaaaaaaaaaaaaaaattttaacgacgcgcgatataatcgtattaacgaaaaatataaatttaaaaatcgaacgaaaaaaaacttaaaactaaaaatacgatcgaaattaaataccccgcaaacgttaaaaaaaacgaaaattccgcgaaattaacgcgtttaaaaattaccgaacgaccgaaacgcttcgataattaaccaatttcccaccccattattcgacgacccccccccacccgcccgccaaccaacccttcttcccattatccccgcccccgcgcccccctcgcactcacccgcctttctcacgaaaccgcccgcaccactcaaccctttaaaaatcctcacccttataccccgctcgctcgctcgctccctccctctccccgccgataccacccccccacatccccgaccctacccgctacaacccaacgctacctccacctccatacaccccgaacactccgatctcgacccttcatcgcacgtccaaccctcccttcccccaacactaaaaaaaaaccaatacccgaccccctcacctccgccctccccgcaaccgatcccttccccccacgcccgcccccgccccacgccgcccg

SEQ ID NO: 32199 - DNA, 673 bp, Artificial Sequence
  chemically treated genomic DNA (Homo sapiens) CpG-island No: 32199
agtttgatgggggtttgagggggggcgggggattgaggagtggtttgggggtatagagtttgttttttaggggaagggggggattttggcggcgcgcggtatggtcgtgttagcggggggtgtagatttggggatcgggcgggggggggtttgggattagagatgcggtcgggattgggtgtttcgtagacgttggagaaaacggaggtttcgcggaattggcgcgtttgggagttgtcgaacggtcggggcgtttcgataattggttaattttttattttattgttcggcggtttttttttattcgttcgttaattagtttttttttttattgttttcgttttcgcgtttttttcgtatttattcgttttttttacggagtcgttcgtattatttagttttttggaaatttttatttttgtgtttcgttcgttcgttcgtttttttttttttttcgtcggtgttatttttttatattttcggttttgttcgttatagtttaacgttgtttttatttttatgtatttcggatatttcgatttcggttttttatcgtacgtttagttttttttttttttaatattgaaagagagttagtgttcggtttttttattttcgtttttttcgtagtcggttttttttttttacgttcgttttcgttttacgtcgttcg

SEQ ID NO: 32200 - DNA, 673 bp, Artificial Sequence
  chemically treated genomic DNA (Homo sapiens) CpG-island No: 32200
cgaacgacgtaaaacgaaaacgaacgtaaaaaaaaaaaaccgactacgaaaaaaacgaaaataaaaaaaccgaacactaactctctttcaatattaaaaaaaaaaaaaactaaacgtacgataaaaaaccgaaatcgaaatatccgaaatacataaaaataaaaacaacgttaaactataacgaacaaaaccgaaaatataaaaaaataacaccgacgaaaaaaaaaaaaaaacgaacgaacgaacgaaacacaaaaataaaaatttccaaaaaactaaataatacgaacgactccgtaaaaaaaacgaataaatacgaaaaaaacgcgaaaacgaaaacaataaaaaaaaaaactaattaacgaacgaataaaaaaaaaccgccgaacaataaaataaaaaattaaccaattatcgaaacgccccgaccgttcgacaactcccaaacgcgccaattccgcgaaacctccgttttctccaacgtctacgaaacacccaatcccgaccgcatctctaatcccaaacccccccccgcccgatccccaaatctacaccccccgctaacacgaccataccgcgcgccgccaaaatcccccccttcccctaaaaaacaaactctatacccccaaaccactcctcaatcccccgccccccctcaaacccccatcaaact

SEQ ID NO: 32201 - DNA, 513 bp, Artificial Sequence
  chemically treated genomic DNA (Homo sapiens) CpG-island No: 32201
tcgtaaattaataaaaaatagacgagtttattatttattagtaatcgcgacgtatcgtcgttcgtaatatatagttagatataatcgttttttatttaagttattattcgaatacgattaagcgattaatcgttttatattattcgagattacgcgtttagttatatcgatagggttagcgcgcgtattaatcgatataacggatacgagagacgcgacgatacgggggtatattacggacgtagcgacgattataacgttatatattcgttatcgatttaggtaaattaggggacgcgtaagcgggcgaatagacggcgcggggtatatatacgtatatacgtatacgcggtatacgtaggagagcgtttattatatatatatagtaatatcgagatatttatagataagttttattcggttatttaggcgcgaggttagagatataatcgcggtttaaagtaattttcgttttttaggtgagatagatttttttattatagtttttttaga

SEQ ID NO: 32202 - DNA, 513 bp, Artificial Sequence
  chemically treated genomic DNA (Homo sapiens) CpG-island No: 32202
tctaaaaaaactataataaaaaaatctatctcacctaaaaaacgaaaattactttaaaccgcgattatatctctaacctcgcgcctaaataaccgaataaaacttatctataaatatctcgatattactatatatatataataaacgctctcctacgtataccgcgtatacgtatatacgtatatataccccgcgccgtctattcgcccgcttacgcgtcccctaatttacctaaatcgataacgaatatataacgttataatcgtcgctacgtccgtaatatacccccgtatcgtcgcgtctctcgtatccgttatatcgattaatacgcgcgctaaccctatcgatataactaaacgcgtaatctcgaataatataaaacgattaatcgcttaatcgtattcgaataataacttaaataaaaaacgattatatctaactatatattacgaacgacgatacgtcgcgattactaataaataataaactcgtctattttttattaatttacga

SEQ ID NO: 32203 - DNA, 513 bp, Artificial Sequence
  chemically treated genomic DNA (Homo sapiens) CpG-island No: 32203
tttagggaggttgtggtgggagaatttgttttatttgggaggcgggggttgttttgagtcgcgattgtgtttttggtttcgcgtttgggtgatcgagtgagatttgtttgtgggtgtttcggtgttgttgtgtgtgtgtagtgggcgtttttttgcgtgtgtcgcgtgtgcgtgtgtgcgtgtgtgtgtttcgcgtcgtttgttcgttcgtttgcgcgttttttggtttgtttgggtcggtggcgggtgtgtggcgttgtggtcgtcgttgcgttcgtggtgtgttttcgtgtcgtcgcgtttttcgtgttcgttgtgtcggttgatgcgcgcgttggttttgtcggtgtggttgggcgcgtggtttcgggtggtgtagggcggttggtcgtttggtcgtgttcgggtggtggtttgggtggggggcggttgtgtttggttgtgtgttgcgggcggcggtgcgtcgcggttgttggtgggtggtgggttcgtttgttttttgttggtttgcgg

SEQ ID NO: 32204 - DNA, 513 bp, Artificial Sequence
  chemically treated genomic DNA (Homo sapiens) CpG-island No: 32204
ccgcaaaccaacaaaaaacaaacgaacccaccacccaccaacaaccgcgacgcaccgccgcccgcaacacacaaccaaacacaaccgccccccacccaaaccaccacccgaacacgaccaaacgaccaaccgccctacaccacccgaaaccacgcgcccaaccacaccgacaaaaccaacgcgcgcatcaaccgacacaacgaacacgaaaaacgcgacgacacgaaaacacaccacgaacgcaacgacgaccacaacgccacacacccgccaccgacccaaacaaaccaaaaaacgcgcaaacgaacgaacaaacgacgcgaaacacacacacgcacacacgcacacgcgacacacgcaaaaaaacgcccactacacacacacaacaacaccgaaacacccacaaacaaatctcactcgatcacccaaacgcgaaaccaaaaacacaatcgcgactcaaaacaacccccgcctcccaaataaaacaaattctcccaccacaacctccctaaa

SEQ ID NO: 32205 - DNA, 626 bp, Artificial Sequence
  chemically treated genomic DNA (Homo sapiens) CpG-island No: 32205
gggagtgttggggtttcgcgggagataagtagcgtcggcgcgttcgttttttttttttcgtcggcgcgggggtatatagagcgttcggtcgttttttttttgttcgcgtttcgtcgtcgcgcgtcgcgtttcgcgtttcgcgcgttagtttcggcgtcgcgttcgttcgtgttggtgcgttgggttcggcgtcgtgtggtttgcgttgttacgtttggtgtttcggttgtttgttttcgtgtttttggtcgtttttttttatgtttcgttcgggtcgttcgtcgtcgcgtggtttttcgtttttgcgcggtttttttgcgtttttttttttttgttttcgtttgcgtcgtgttttgcgtttttttcgcggcgtttcgcgtcgcgtttttttttttttttttgtttcgttttgtgtgcgttttggttgtgtcgtgcgcgtgtggtgggggttttgtgtttcgcgtttttgtcggttcggcggcgcgcggggtgtttgcgcggttgtcggtgggggcggtcggtcgcggcgtttgtggtgtttttttcgtgttatttttttgtgtgtagtttcgtcgggcgcgtgatgtgttgtgtgtgttcgttggtttttttgttttgttttgtgt

SEQ ID NO: 32206 - DNA, 626 bp, Artificial Sequence
  chemically treated genomic DNA (Homo sapiens) CpG-island No: 32206
acacaaaacaaaacaaaaaaaccaacgaacacacacaacacatcacgcgcccgacgaaactacacacaaaaaaataacacgaaaaaaacaccacaaacgccgcgaccgaccgcccccaccgacaaccgcgcaaacaccccgcgcgccgccgaaccgacaaaaacgcgaaacacaaaacccccaccacacgcgcacgacacaaccaaaacgcacacaaaacgaaacaaaaaaaaaaaaaaaaacgcgacgcgaaacgccgcgaaaaaaacgcaaaacacgacgcaaacgaaaacaaaaaaaaaaaaacgcaaaaaaaccgcgcaaaaacgaaaaaccacgcgacgacgaacgacccgaacgaaacataaaaaaaaacgaccaaaaacacgaaaacaaacaaccgaaacaccaaacgtaacaacgcaaaccacacgacgccgaacccaacgcaccaacacgaacgaacgcgacgccgaaactaacgcgcgaaacgcgaaacgcgacgcgcgacgacgaaacgcgaacaaaaaaaaaacgaccgaacgctctatatacccccgcgccgacgaaaaaaaaaaaacgaacgcgccgacgctacttatctcccgcgaaaccccaacactccc

SEQ ID NO: 32207 - DNA, 626 bp, Artificial Sequence
  chemically treated genomic DNA (Homo sapiens) CpG-island No: 32207
atataagataagataaaagaattaacgaatatatataatatattacgcgttcgacggagttgtatataagagaatagtacgagagaagtattataagcgtcgcgatcggtcgtttttatcggtagtcgcgtaggtatttcgcgcgtcgtcggatcgatagggacgcgaggtatagaatttttattatacgcgtacgatataattaagacgtatataggacggagtaaggagaggaagaagagcgcgacgcggggcgtcgcgggaaggacgtaagatacgacgtagacggaggtaaagaaggagagacgtagaggagtcgcgtaagagcggagagttacgcggcgacggacgattcgaacgaaatatagaaaaagacgattaagagtacgaagatagataatcgaaatattagacgtagtaacgtaagttatacgacgtcgagtttagcgtattagtacgagcgggcgcggcgtcggaattgacgcgcggggcgcgggacgcggcgcgcgacgacggagcgcgagtaggggagaggcggtcgggcgttttgtatgttttcgcgtcgacgagaggagaagagcgggcgcgtcgacgttgtttatttttcgcgggattttaatattttt

SEQ ID NO: 32208 - DNA, 626 bp, Artificial Sequence
  chemically treated genomic DNA (Homo sapiens) CpG-island No: 32208
aaaaatattaaaatcccgcgaaaaataaacaacgtcgacgcgcccgctcttctcctctcgtcgacgcgaaaacatacaaaacgcccgaccgcctctcccctactcgcgctccgtcgtcgcgcgccgcgtcccgcgccccgcgcgtcaattccgacgccgcgcccgctcgtactaatacgctaaactcgacgtcgtataacttacgttactacgtctaatatttcgattatctatcttcgtactcttaatcgtctttttctatatttcgttcgaatcgtccgtcgccgcgtaactctccgctcttacgcgactcctctacgtctctccttctttacctccgtctacgtcgtatcttacgtccttcccgcgacgccccgcgtcgcgctcttcttcctctccttactccgtcctatatacgtcttaattatatcgtacgcgtataataaaaattctatacctcgcgtccctatcgatccgacgacgcgcgaaatacctacgcgactaccgataaaaacgaccgatcgcgacgcttataatacttctctcgtactattctcttatatacaactccgtcgaacgcgtaatatattatatatattcgttaattcttttatcttatcttatat

SEQ ID NO: 32209 - DNA, 590 bp, Artificial Sequence
  chemically treated genomic DNA (Homo sapiens) CpG-island No: 32209
tttttatatattttttttttaattgcgtttcgtattaataaaatatattaatataattcggtgttttttttttatatattttttttgtttttttttttttaatatttttttataatcgagtttcgtttttttatataaaaattgggttttcgtcgttttattttttttattttattaggatttatttttttataaaaagtttataattttttcgttgttattttaaaataattttttttggcgtcgtcggtttagtttttatttttttatcgttttcgttttcgtggttttttttataaattttatttttataatttttttttcggttatatttttttatttttttattttttttacgtcgcggttttttttttttatttagcgcgtttattttttttcgtttcgttatttcgttatttttaattatcgttaatattttgtacgttcgtataatcgtatattttatatattatattatttattcggttttttggcgtttttttgtttttttgttataaatatcgttcgtttacgattttgtcgtgttattatcgcgcgttttatttcgtatattgaatatataatattta

SEQ ID NO: 32210 - DNA, 590 bp, Artificial Sequence
  chemically treated genomic DNA (Homo sapiens) CpG-island No: 32210
taaatattatatattcaatatacgaaataaaacgcgcgataataacacgacaaaatcgtaaacgaacgatatttataacaaaaaaacaaaaaaacgccaaaaaaccgaataaataatataatatataaaatatacgattatacgaacgtacaaaatattaacgataattaaaaataacgaaataacgaaacgaaaaaaaataaacgcgctaaataaaaaaaaaaaaccgcgacgtaaaaaaaataaaaaaataaaaaaatataaccgaaaaaaaaattataaaaataaaatttataaaaaaaaccacgaaaacgaaaacgataaaaaaataaaaactaaaccgacgacgccaaaaaaaattattttaaaataacaacgaaaaaattataaactttttataaaaaaataaatcctaataaaataaaaaaaataaaacgacgaaaacccaatttttatataaaaaaacgaaactcgattataaaaaaatattaaaaaaaaaaaaacaaaaaaaatatataaaaaaaaaacaccgaattatattaatatattttattaatacgaaacgcaattaaaaaaaaaatatataaaaa

SEQ ID NO: 32211 - DNA, 590 bp, Artificial Sequence
  chemically treated genomic DNA (Homo sapiens) CpG-island No: 32211
tgggtgttgtatatttagtgtacggagtggggcgcgcggtggtggtacggtagagtcgtaggcggacggtgtttgtgataggagagtagaaaggcgttagagggtcgaatggatgatgtaatgtgtagagtgtgcggttgtgcgagcgtatagggtattggcggtaattgagagtagcgaggtagcggggcgaagagggatgggcgcgttaggtaggggaaaggggtcgcggcgtgaggaaagtagaagggtggaggggtgtggtcgaggggggggttgtaaagatgaggtttgtaaaaggagttacgggggcgggggcggtagagagatggggattgagtcggcggcgttaggggaggttgttttaaggtgataacgggggggttgtagattttttgtggggaagtgggttttggtagaatgggaaaagtggaacggcgggggtttagtttttatgtggaggggcgggattcggttatgagaaggtgttgagggggggggaataggggggatatgtaagggggaggtatcgggttgtgttgatatgttttattaatacggggcgtagttagaggggaaatgtgtggggg

SEQ ID NO: 32212 - DNA, 590 bp, Artificial Sequence
  chemically treated genomic DNA (Homo sapiens) CpG-island No: 32212
cccccacacatttcccctctaactacgccccgtattaataaaacatatcaacacaacccgatacctcccccttacatatcccccctattccccccccctcaacaccttctcataaccgaatcccgcccctccacataaaaactaaacccccgccgttccacttttcccattctaccaaaacccacttccccacaaaaaatctacaacccccccgttatcaccttaaaacaacctcccctaacgccgccgactcaatccccatctctctaccgcccccgcccccgtaactccttttacaaacctcatctttacaacccccccctcgaccacacccctccacccttctactttcctcacgccgcgacccctttcccctacctaacgcgcccatccctcttcgccccgctacctcgctactctcaattaccgccaataccctatacgctcgcacaaccgcacactctacacattacatcatccattcgaccctctaacgcctttctactctcctatcacaaacaccgtccgcctacgactctaccgtaccaccaccgcgcgccccactccgtacactaaatatacaacaccca

SEQ ID NO: 32213 - DNA, 742 bp, Artificial Sequence
  chemically treated genomic DNA (Homo sapiens) CpG-island No: 32213
  misc_feature (303)..(303): n is either a, c, g or t
ttttttaacgtcggtttttttcgtttttttttttttttcggtattttttttttttttcgttttttcggcgcgttagggcgcgcggatagtcgagtttttttcggcgtcgcgaggagaggggcgcggcgagttttttttcggttttcgtttttcgcggtcggcgagcgttcgtgaggggataacgcggagatagagagcgaagcggtcgggtgcgcgtatcgcggatcgcgcggcgtcgcggttggttttattcgagagtagcgcgtgcgggggttcgttcgatatatatttcgcgttcggttncgcggtttcgtatcgttcgttttttcgcgtttttcggagttcgtcgtttcgtcgtttcgcggagaatttaacgagagtaggaggcgtcggtcgagtagagaatttagtcgattcggcgtacgtgtgatcgatcgatcggggcgacgcgcgttttcgttcggcgcggcggcggttttttgcgttgtatcgcgtttcggatcgttcgtcggttttttcgttgtcgttttcgcgcgcgttcgttcgattcgttcgcggtcgcgttcgtacgttacgcgggtttgtcgggggcgtacggcgcggcgcgttcgcgtcgagggacgcgagcgggcgttatggtataagtaggcgggacgaattcgatcggatttggcgttcgatcgagatttttcgttcgtcgcgtcgtgtttttgtgtcgttcgcgtcggtgggggaggttagt

SEQ ID NO: 32214 - DNA, 742 bp, Artificial Sequence
  chemically treated genomic DNA (Homo sapiens) CpG-island No: 32214
  misc_feature (440)..(440): n is either a, c, g or t
actaacctcccccaccgacgcgaacgacacaaaaacacgacgcgacgaacgaaaaatctcgatcgaacgccaaatccgatcgaattcgtcccgcctacttataccataacgcccgctcgcgtccctcgacgcgaacgcgccgcgccgtacgcccccgacaaacccgcgtaacgtacgaacgcgaccgcgaacgaatcgaacgaacgcgcgcgaaaacgacaacgaaaaaaccgacgaacgatccgaaacgcgatacaacgcaaaaaaccgccgccgcgccgaacgaaaacgcgcgtcgccccgatcgatcgatcacacgtacgccgaatcgactaaattctctactcgaccgacgcctcctactctcgttaaattctccgcgaaacgacgaaacgacgaactccgaaaaacgcgaaaaaacgaacgatacgaaaccgcgnaaccgaacgcgaaatatatatcgaacgaacccccgcacgcgctactctcgaataaaaccaaccgcgacgccgcgcgatccgcgatacgcgcacccgaccgcttcgctctctatctccgcgttatcccctcacgaacgctcgccgaccgcgaaaaacgaaaaccgaaaaaaaactcgccgcgcccctctcctcgcgacgccgaaaaaaactcgactatccgcgcgccctaacgcgccgaaaaaacgaaaaaaaaaaaaaataccgaaaaaaaaaaaaaaacgaaaaaaaccgacgttaaaaaa

SEQ ID NO: 32215 - DNA, 742 bp, Artificial Sequence
  chemically treated genomic DNA (Homo sapiens) CpG-island No: 32215
  misc_feature (440)..(440): n is either a, c, g or t
gttaattttttttatcggcgcgggcgatatagaggtacgacgcggcgggcggggggtttcgatcggacgttaggttcggtcgggttcgtttcgtttgtttatattatgacgttcgttcgcgtttttcggcgcgggcgcgtcgcgtcgtgcgttttcggtaggttcgcgtggcgtgcgggcgcgatcgcgggcggatcgggcgagcgcgcgcgggggcggtagcgggggggtcggcgggcggttcggagcgcggtgtagcgtaggggatcgtcgtcgcgtcgggcggaggcgcgcgtcgtttcggtcgatcggttatacgtgcgtcgggtcggttgggttttttgttcgatcggcgttttttgttttcgttgagtttttcgcggagcggcggggcggcgggtttcgggggacgcgggggggcgggcggtgcggggtcgcgnggtcgggcgcggggtgtgtgtcgggcgggttttcgtacgcgttgttttcgggtggggttagtcgcggcgtcgcgcggttcgcggtgcgcgtattcggtcgtttcgttttttgttttcgcgttgtttttttacgggcgttcgtcggtcgcggggggcgggggtcgggggggggttcgtcgcgttttttttttcgcggcgtcggggggggttcggttgttcgcgcgttttggcgcgtcgggggggcgggggggggggggggtgtcggggggggggggggggcggggggggtcggcgttgggggg

SEQ ID NO: 32216 - DNA, 742 bp, Artificial Sequence
  chemically treated genomic DNA (Homo sapiens) CpG-island No: 32216
  misc_feature (303)..(303): n is either a, c, g or t
ccccccaacgccgaccccccccgccccccccccccccccgacacccccccccccccccgcccccccgacgcgccaaaacgcgcgaacaaccgaaccccccccgacgccgcgaaaaaaaaaacgcgacgaacccccccccgacccccgccccccgcgaccgacgaacgcccgtaaaaaaacaacgcgaaaacaaaaaacgaaacgaccgaatacgcgcaccgcgaaccgcgcgacgccgcgactaaccccacccgaaaacaacgcgtacgaaaacccgcccgacacacaccccgcgcccgaccncgcgaccccgcaccgcccgcccccccgcgtcccccgaaacccgccgccccgccgctccgcgaaaaactcaacgaaaacaaaaaacgccgatcgaacaaaaaacccaaccgacccgacgcacgtataaccgatcgaccgaaacgacgcgcgcctccgcccgacgcgacgacgatcccctacgctacaccgcgctccgaaccgcccgccgacccccccgctaccgcccccgcgcgcgctcgcccgatccgcccgcgatcgcgcccgcacgccacgcgaacctaccgaaaacgcacgacgcgacgcgcccgcgccgaaaaacgcgaacgaacgtcataatataaacaaacgaaacgaacccgaccgaacctaacgtccgatcgaaaccccccgcccgccgcgtcgtacctctatatcgcccgcgccgataaaaaaaattaac

SEQ ID NO: 32217 - DNA, 579 bp, Artificial Sequence
  chemically treated genomic DNA (Homo sapiens) CpG-island No: 32217
  misc_feature (485)..(485): n is either a, c, g or t
  misc_feature (506)..(506): n is either a, c, g or t
  misc_feature (534)..(534): n is either a, c, g or t
gaagtttttcgttttgtgtggtcggaggtaacgtagtacgtagcgtgggagcgcggggtagttgttacgaggagatatttcgggtagtttagtgtgggtgtttgtgcgtcgggtgttgaaggcgcggagagcggtgattagttttgagcgagaggcgtggggtgatttcgtatatagtttgagattagagggtagagtcgttgtgtgtagtgttttaggcgcgtggtttcgcgttgagcgttacgtgggatcgggcgtgcgggcgggtaggcgtacgttgtcggttcggggggtattgtcgatcgtggtagtgatggtgaggagaggaggagtacgtgcgggatcgtggttaaggtttatgataagataggaagtcgtagtttcgacgggttagattaggcgcgagcgcgtacggtaatcggagtttcgttagttggtggttttcgcgcgcgagtattcgcggtttcgcgtcgtttagggcgcgncgtgcgagtatttagcgcgantatcgaagtgttacggattatgttttgntgacgcgttttatggtatagtgttggttgtgtttagtaggtagtt

SEQ ID NO: 32218 - DNA, 579 bp, Artificial Sequence
  chemically treated genomic DNA (Homo sapiens) CpG-island No: 32218
  misc_feature (46)..(46): n is either a, c, g or t
  misc_feature (74)..(74): n is either a, c, g or t
  misc_feature (95)..(95): n is either a, c, g or t
aactacctactaaacacaaccaacactataccataaaacgcgtcancaaaacataatccgtaacacttcgatantcgcgctaaatactcgcacgncgcgccctaaacgacgcgaaaccgcgaatactcgcgcgcgaaaaccaccaactaacgaaactccgattaccgtacgcgctcgcgcctaatctaacccgtcgaaactacgacttcctatcttatcataaaccttaaccacgatcccgcacgtactcctcctctcctcaccatcactaccacgatcgacaataccccccgaaccgacaacgtacgcctacccgcccgcacgcccgatcccacgtaacgctcaacgcgaaaccacgcgcctaaaacactacacacaacgactctaccctctaatctcaaactatatacgaaatcaccccacgcctctcgctcaaaactaatcaccgctctccgcgccttcaacacccgacgcacaaacacccacactaaactacccgaaatatctcctcgtaacaactaccccgcgctcccacgctacgtactacgttacctccgaccacacaaaacgaaaaacttc

SEQ ID NO: 32219 - DNA, 579 bp, Artificial Sequence
  chemically treated genomic DNA (Homo sapiens) CpG-island No: 32219
  misc_feature (46)..(46): n is either a, c, g or t
  misc_feature (74)..(74): n is either a, c, g or t
  misc_feature (95)..(95): n is either a, c, g or t
aattatttattaaatatagttagtattatattataagacgcgttantaggatatgattcgtgatatttcgatantcgcgttggatgttcgtacgncgcgttttgaacggcgcggagtcgcgagtgttcgcgcgcgagggttattagttggcgggatttcggttatcgtacgcgttcgcgtttagtttgattcgtcggagttgcggttttttgttttgttatgagttttagttacggtttcgtacgtattttttttttttttattattattgttacgatcggtaatgtttttcgaatcggtaacgtgcgtttgttcgttcgtacgttcggttttacgtgacgtttagcgcgagattacgcgtttggagtattgtatataacggttttattttttggttttagattgtatgcggggttattttacgtttttcgtttaagattagttatcgtttttcgcgtttttaatattcgacgtataagtatttatattgggttattcggaatgttttttcgtaatagttatttcgcgtttttacgttacgtgttgcgttgttttcggttatataagacgaagagtttt

SEQ ID NO: 32220 - DNA, 579 bp, Artificial Sequence
  chemically treated genomic DNA (Homo sapiens) CpG-island No: 32220
  misc_feature (485)..(485): n is either a, c, g or t
  misc_feature (506)..(506): n is either a, c, g or t
  misc_feature (534)..(534): n is either a, c, g or t
aaaactcttcgtcttatataaccgaaaacaacgcaacacgtaacgtaaaaacgcgaaataactattacgaaaaaacattccgaataacccaatataaatacttatacgtcgaatattaaaaacgcgaaaaacgataactaatcttaaacgaaaaacgtaaaataaccccgcatacaatctaaaaccaaaaaataaaaccgttatatacaatactccaaacgcgtaatctcgcgctaaacgtcacgtaaaaccgaacgtacgaacgaacaaacgcacgttaccgattcgaaaaacattaccgatcgtaacaataataataaaaaaaaaaaaaatacgtacgaaaccgtaactaaaactcataacaaaacaaaaaaccgcaactccgacgaatcaaactaaacgcgaacgcgtacgataaccgaaatcccgccaactaataaccctcgcgcgcgaacactcgcgactccgcgccgttcaaaacgcgncgtacgaacatccaacgcgantatcgaaatatcacgaatcatatcctantaacgcgtcttataatataatactaactatatttaataaataatt

SEQ ID NO: 32221 - DNA, 632 bp, Artificial Sequence
  chemically treated genomic DNA (Homo sapiens) CpG-island No: 32221
  misc_feature (230)..(230): n is either a, c, g or t
atgcgtttttgagagattcgttatattttcgatttggaagtttcgcggggatttagttttcgggttttcgttttttttttatttcggtcgttaagtttggttgcggagtagcgcggtcggtcgggggtggggtttcggtatcgtttcgggttcgggattcgcgaagttacgcgttttcgtaggtttgcggggtattttcgtttacggatacgttttttttgcggaggtangttttagcgattttttgtttagtttcggcgttttattcgcgacgtttttaaattgtttaaggttttttagtcgtttttattttagaaaatcgtttcgttcgcgtttttttttttaggcgtattttatcgtggagaggagaggagcggattgggaacgtcgaatcgtttcgtaggttcggggaaacggatttttttttcgtttttcgtttattttttttatttcgtttttcgttttttgcgcgaatttattttttagttttggttattagaggcgtagcgtatagttttttcggtggaattagtgcgaaaatattcgaggaaatgaaaagaataagaaagtgttattttggtaattacgggcgtttagtggttagttggtgggttggggagggcggtcgttgt

SEQ ID NO: 32222 - DNA, 632 bp, Artificial Sequence
  chemically treated genomic DNA (Homo sapiens) CpG-island No: 32222
  misc_feature (403)..(403): n is either a, c, g or t
acaacgaccgccctccccaacccaccaactaaccactaaacgcccgtaattaccaaaataacactttcttattcttttcatttcctcgaatattttcgcactaattccaccgaaaaaactatacgctacgcctctaataaccaaaactaaaaaataaattcgcgcaaaaaacgaaaaacgaaataaaaaaaataaacgaaaaacgaaaaaaaaatccgtttccccgaacctacgaaacgattcgacgttcccaatccgctcctctcctctccacgataaaatacgcctaaaaaaaaaaacgcgaacgaaacgattttctaaaataaaaacgactaaaaaaccttaaacaatttaaaaacgtcgcgaataaaacgccgaaactaaacaaaaaatcgctaaaacntacctccgcaaaaaaaacgtatccgtaaacgaaaataccccgcaaacctacgaaaacgcgtaacttcgcgaatcccgaacccgaaacgataccgaaaccccacccccgaccgaccgcgctactccgcaaccaaacttaacgaccgaaataaaaaaaaaacgaaaacccgaaaactaaatccccgcgaaacttccaaatcgaaaatataacgaatctctcaaaaacgcat

SEQ ID NO: 32223 - DNA, 632 bp, Artificial Sequence
  chemically treated genomic DNA (Homo sapiens) CpG-island No: 32223
  misc_feature (403)..(403): n is either a, c, g or t
gtagcggtcgttttttttagtttattagttggttattaaacgttcgtggttgttaaggtagtatttttttgttttttttattttttcgggtgttttcgtattggttttatcggaaaggttgtgcgttgcgtttttggtgattaggattggaaaatgggttcgcgtagggggcggggggcgaggtgaaggggatgggcggggagcggaaggggggttcgttttttcgagtttgcggggcggttcggcgtttttagttcgttttttttttttttacggtggggtgcgtttggagggagagacgcggacggggcgattttttaaagtgggaacgattgaaaggttttgagtagtttgggagcgtcgcgagtgaggcgtcgaagttgggtagagggtcgttggggtntgttttcgtagaaagggcgtgttcgtgggcgaaggtgtttcgtaagtttgcggaagcgcgtgatttcgcgaatttcgagttcggggcggtgtcggagttttattttcggtcggtcgcgttgtttcgtaattagatttggcggtcgagatggggagggggcgggggttcgggggttgggttttcgcggaatttttagatcggaagtgtggcgggttttttaggaacgtat

SEQ ID NO: 32224 - DNA, 632 bp, Artificial Sequence
  chemically treated genomic DNA (Homo sapiens) CpG-island No: 32224
  misc_feature (230)..(230): n is either a, c, g or t
atacgttcctaaaaaacccgccacacttccgatctaaaaattccgcgaaaacccaacccccgaacccccgccccctccccatctcgaccgccaaatctaattacgaaacaacgcgaccgaccgaaaataaaactccgacaccgccccgaactcgaaattcgcgaaatcacgcgcttccgcaaacttacgaaacaccttcgcccacgaacacgccctttctacgaaaacanaccccaacgaccctctacccaacttcgacgcctcactcgcgacgctcccaaactactcaaaacctttcaatcgttcccactttaaaaaatcgccccgtccgcgtctctccctccaaacgcaccccaccgtaaaaaaaaaaaaaacgaactaaaaacgccgaaccgccccgcaaactcgaaaaaacgaaccccccttccgctccccgcccatccccttcacctcgccccccgccccctacgcgaacccattttccaatcctaatcaccaaaaacgcaacgcacaacctttccgataaaaccaatacgaaaacacccgaaaaaataaaaaaaacaaaaaaatactaccttaacaaccacgaacgtttaataaccaactaataaactaaaaaaaacgaccgctac

SEQ ID NO: 32225 - DNA, 543 bp, Artificial Sequence
  chemically treated genomic DNA (Homo sapiens) CpG-island No: 32225
  misc_feature (459)..(459): n is either a, c, g or t
tattttcgtttatcgtttttacgtttattatttttttatgttttgtatttttattttcgttttgtttttttttttttatcgcgatatttttttttagttttttttttttcgttatttttcgtttttcgcgttttgttttgttttttattttttttaagttatattattttcggttttttttttttatttatttttttttttttatcgttcgttttttattttttttcgttattttttttttttttgcgtttatttttgtttgattttttttcgtttatttcggttttcgttcgtttttgtttatattattattttatttcgtttttttttttatttttttttttttgttttttttttttttatttttttttcgttttattataattcggagttttagtttttatatttttttgtatttttttttcgttgttatcgttttgtacgtgttcgttttattanttttcgttcgttttttgtttttttttatgtatattttttttagttttttttttttttttcgtttttcgttttttttatttatga

SEQ ID NO: 32226 - DNA, 543 bp, Artificial Sequence
  chemically treated genomic DNA (Homo sapiens) CpG-island No: 32226
  misc_feature (85)..(85): n is either a, c, g or t
tcataaataaaaaaaacgaaaaacgaaaaaaaaaaaaaaaactaaaaaaaatatacataaaaaaaaacaaaaaacgaacgaaaantaataaaacgaacacgtacaaaacgataacaacgaaaaaaaaatacaaaaaaatataaaaactaaaactccgaattataataaaacgaaaaaaaaataaaaaaaaaaaaaacaaaaaaaaaaaaataaaaaaaaaaacgaaataaaataataatataaacaaaaacgaacgaaaaccgaaataaacgaaaaaaaatcaaacaaaaataaacgcaaaaaaaaaaaaaataacgaaaaaaaataaaaaacgaacgataaaaaaaaaaaaataaataaaaaaaaaaaaccgaaaataatataacttaaaaaaaataaaaaacaaaacaaaacgcgaaaaacgaaaaataacgaaaaaaaaaaaactaaaaaaaaatatcgcgataaaaaaaaaaaaacaaaacgaaaataaaaatacaaaacataaaaaaataataaacgtaaaaacgataaacgaaaata

SEQ ID NO: 32227 - DNA, 543 bp, Artificial Sequence
  chemically treated genomic DNA (Homo sapiens) CpG-island No: 32227
  misc_feature (85)..(85): n is either a, c, g or t
ttataggtagaaagagcgaggagcggaagagaagaaggagattggaagagatatgtatagagagagatagagagcgagcggggantagtagggcgagtacgtgtaaagcggtgatagcggagaaggagtatagggaagtatggggattgaggtttcggattatgatggaacgggaaaaggatgagagaggaggagatagaagagagggggtgagagaaggaacgagatggagtaatgatgtgagtaggaacgagcgagaatcggagtgaacgggagagggttaggtagaggtgagcgtagggagagggagagtaacgggggggggtggggagcgaacggtggagagggggaggtgagtggaaaagggaggtcgaagataatgtagtttggggagagtgaagagtaaggtagagcgcgaagaacgaggagtagcgggggaggggagattggaggggagtgtcgcggtggagggggggggatagggcgggagtgggagtgtagggtatgaggaagtgatagacgtgggaacggtgggcgaaggta

SEQ ID NO: 32228 - DNA, 543 bp, Artificial Sequence
  chemically treated genomic DNA (Homo sapiens) CpG-island No: 32228
  misc_feature (459)..(459): n is either a, c, g or t
taccttcgcccaccgttcccacgtctatcacttcctcataccctacactcccactcccgccctatccccccccctccaccgcgacactcccctccaatctcccctcccccgctactcctcgttcttcgcgctctaccttactcttcactctccccaaactacattatcttcgacctcccttttccactcacctccccctctccaccgttcgctccccacccccccccgttactctccctctccctacgctcacctctacctaaccctctcccgttcactccgattctcgctcgttcctactcacatcattactccatctcgttccttctctcaccccctctcttctatctcctcctctctcatccttttcccgttccatcataatccgaaacctcaatccccatacttccctatactccttctccgctatcaccgctttacacgtactcgccctactantccccgctcgctctctatctctctctatacatatctcttccaatctccttcttctcttccgctcctcgctctttctacctataa

SEQ ID NO: 32229 - DNA, 792 bp, Artificial Sequence
  chemically treated genomic DNA (Homo sapiens) CpG-island No: 32229
cgatcgtttacgcgttttgttaagcggtgcgcggacgcgtaggtattatttttataagaagtagttttttttgttaaaggtagagcgatagttagtttttacgattcgtcgtcgtagcgtgcggtttttcggagatcgtagtagtagaggtttatacgtttttttcggttgtttcggttttagttggtttttgtttgcgattttacgttacgtagcgttagatcgtcgtagttatcgttagttttaggattttattgtggtgggagaagaggggcgggggtattgtagagggggtaacgcgcggcgggatatgcgtcgttttttcggtaacggcgtcgcgggggcgagaattcgttggcgggagtttaatgcgagttagattggagttatgtgattcgtcggagtttgtggtgtcgtttttggttttttaagtcgaaaagagattatattaacgaattcgtttttattcgtttaggaattatgtattttagaatgttaattagatttcgcgttttaaacgtttgtcggttataggtggaggattataaattttagtatgtcgtgcgttttcgggttgatcgcggagcgtagggttttaggtttatgcggaagtgtattgattttttagttcgtggagaaagagcggaggcgttgtgcggtttttcgtgggggtgttagtttcggttcgtgtcggaagaaggagttaagatcgggatcgtttttttgttttttttttattttatattcggttacgaagaggtggaaataaaaggatatttataatgtagttta

SEQ ID NO: 32230 - DNA, 792 bp, Artificial Sequence
  chemically treated genomic DNA (Homo sapiens) CpG-island No: 32230
taaactacattataaatatccttttatttccacctcttcgtaaccgaatataaaataaaaaaaaaacaaaaaaacgatcccgatcttaactccttcttccgacacgaaccgaaactaacacccccacgaaaaaccgcacaacgcctccgctctttctccacgaactaaaaaatcaatacacttccgcataaacctaaaaccctacgctccgcgatcaacccgaaaacgcacgacatactaaaatttataatcctccacctataaccgacaaacgtttaaaacgcgaaatctaattaacattctaaaatacataattcctaaacgaataaaaacgaattcgttaatataatctcttttcgacttaaaaaaccaaaaacgacaccacaaactccgacgaatcacataactccaatctaactcgcattaaactcccgccaacgaattctcgcccccgcgacgccgttaccgaaaaaacgacgcatatcccgccgcgcgttaccccctctacaatacccccgcccctcttctcccaccacaataaaatcctaaaactaacgataactacgacgatctaacgctacgtaacgtaaaatcgcaaacaaaaaccaactaaaaccgaaacaaccgaaaaaaacgtataaacctctactactacgatctccgaaaaaccgcacgctacgacgacgaatcgtaaaaactaactatcgctctacctttaacaaaaaaaactacttcttataaaaataatacctacgcgtccgcgcaccgcttaacaaaacgcgtaaacgatcg

SEQ ID NO: 32231 - DNA, 792 bp, Artificial Sequence
  chemically treated genomic DNA (Homo sapiens) CpG-island No: 32231
tggattatattgtaagtgtttttttgtttttattttttcgtgatcgaatgtggggtgaggaaggggtaaaaaagcgatttcggttttggttttttttttcggtacgggtcggagttgatatttttacggaaaatcgtatagcgttttcgttttttttttacgggttgagggattaatgtattttcgtataggtttagggttttacgtttcgcgattagttcggaagcgtacggtatgttgggatttgtagttttttatttgtggtcggtaggcgtttagaacgcgaggtttagttggtattttgggatatatagtttttgggcgggtgggggcggattcgttggtgtaattttttttcggtttaaagagttagaagcgatattatagatttcggcgggttatatgattttagtttagttcgtattgggttttcgttagcgagttttcgttttcgcggcgtcgttgtcgaggagacggcgtatgtttcgtcgcgcgttgttttttttgtagtattttcgtttttttttttttattataatgagattttaagattggcggtggttgcggcggtttggcgttgcgtagcgtgaggtcgtaaatagaggttagttggggtcgaggtagtcgaggaaaacgtgtgggtttttattgttgcggttttcgaagggtcgtacgttgcggcggcgggtcgtgggggttgattgtcgttttgtttttgataggagaggttgttttttgtagaggtaatgtttgcgcgttcgcgtatcgtttggtagagcgcgtaggcggtcg

SEQ ID NO: 32232 - DNA, 792 bp, Artificial Sequence
  chemically treated genomic DNA (Homo sapiens) CpG-island No: 32232
cgaccgcctacgcgctctaccaaacgatacgcgaacgcgcaaacattacctctacaaaaaacaacctctcctatcaaaaacaaaacgacaatcaacccccacgacccgccgccgcaacgtacgacccttcgaaaaccgcaacaataaaaacccacacgttttcctcgactacctcgaccccaactaacctctatttacgacctcacgctacgcaacgccaaaccgccgcaaccaccgccaatcttaaaatctcattataataaaaaaaaaaaaacgaaaatactacaaaaaaaacaacgcgcgacgaaacatacgccgtctcctcgacaacgacgccgcgaaaacgaaaactcgctaacgaaaacccaatacgaactaaactaaaatcatataacccgccgaaatctataatatcgcttctaactctttaaaccgaaaaaaaattacaccaacgaatccgcccccacccgcccaaaaactatatatcccaaaataccaactaaacctcgcgttctaaacgcctaccgaccacaaataaaaaactacaaatcccaacataccgtacgcttccgaactaatcgcgaaacgtaaaaccctaaacctatacgaaaatacattaatccctcaacccgtaaaaaaaaaacgaaaacgctatacgattttccgtaaaaatatcaactccgacccgtaccgaaaaaaaaaaccaaaaccgaaatcgcttttttaccccttcctcaccccacattcgatcacgaaaaaataaaaacaaaaaaacacttacaatataatcca

SEQ ID NO: 32233 - DNA, 860 bp, Artificial Sequence
  chemically treated genomic DNA (Homo sapiens) CpG-island No: 32233
gcgtcgtttaatttttttagtttcgaaatggcggttattagatcgttaggttacgtttcgggggcggggtttgagtttaggttagagcgatggatgttcgagttaagttagaagtcgattgttagtagggttcgcgtagaatcggagagtcggtggcgtcgtaggtcgggaggacgagtatcgagtcgagggttcgttcgtttgggtcgttcgagagttttaatcgcgggcgtttgggtcgttattttagatggcgggagtaagaggaaaacgattgtgaggcgggaacggttttttgttgttttttttgggtttcgaaaagggttagttggtcgggttttggggcgcgtgttttgaggcgcggagcgcgtttgttacgatgcgggggttgttcggggtttcgttttttgggttggggacgcgtcgaatgtgatcgtttttcgtttttttattcgtcgcggggaggaggagcgggcgagaagttgtcgtcgaacgataggacgttggggcggttttggtttttttaggtaggtggtaggatcgggtcgtggatgtcgggggagtcgggcggcggggttaagggatcggtttttagggcgatcgggtttgggtggcgttgatggagcgttttcgcggttgtcgggtagagggtttgggttagttcgttgttatttcgggtagcgttgggcgggggtttcggagttcggtgttatggtcggcgagtcgagtttttatattttatttaaatttttttgtgtttggcggaaacgtgttaacgttatttttatgttatgcgtattttttatatttggtagtgggaaaattcgtttagagttgttttatatttgttgttatttgga

SEQ ID NO: 32234 - DNA, 860 bp, Artificial Sequence
  chemically treated genomic DNA (Homo sapiens) CpG-island No: 32234
tccaaataacaacaaatataaaacaactctaaacgaattttcccactaccaaatataaaaaatacgcataacataaaaataacgttaacacgtttccgccaaacacaaaaaaatttaaataaaatataaaaactcgactcgccgaccataacaccgaactccgaaacccccgcccaacgctacccgaaataacaacgaactaacccaaaccctctacccgacaaccgcgaaaacgctccatcaacgccacccaaacccgatcgccctaaaaaccgatcccttaaccccgccgcccgactcccccgacatccacgacccgatcctaccacctacctaaaaaaaccaaaaccgccccaacgtcctatcgttcgacgacaacttctcgcccgctcctcctccccgcgacgaataaaaaaacgaaaaacgatcacattcgacgcgtccccaacccaaaaaacgaaaccccgaacaacccccgcatcgtaacaaacgcgctccgcgcctcaaaacacgcgccccaaaacccgaccaactaacccttttcgaaacccaaaaaaaacaacaaaaaaccgttcccgcctcacaatcgttttcctcttactcccgccatctaaaataacgacccaaacgcccgcgattaaaactctcgaacgacccaaacgaacgaaccctcgactcgatactcgtcctcccgacctacgacgccaccgactctccgattctacgcgaaccctactaacaatcgacttctaacttaactcgaacatccatcgctctaacctaaactcaaaccccgcccccgaaacgtaacctaacgatctaataaccgccatttcgaaactaaaaaaattaaacgacgc

SEQ ID NO: 32235 - DNA, 860 bp, Artificial Sequence
  chemically treated genomic DNA (Homo sapiens) CpG-island No: 32235
tttaagtgataatagatatggggtagttttgggcggatttttttattgttaaatatgaggaatgcgtatggtataagggtggcgttggtacgttttcgttaaatataaggaaatttgagtgggatgtgggaattcggttcgtcggttatgatatcggatttcggggttttcgtttaacgttattcggggtgatagcgggttggtttaagttttttgttcggtagtcgcgagggcgttttattagcgttatttaggttcggtcgttttggaagtcgattttttagtttcgtcgttcggttttttcggtatttacgattcggttttgttatttatttgagggagttagggtcgttttaacgttttgtcgttcggcggtagtttttcgttcgtttttttttttcgcggcgggtgagggagcgggaggcggttatattcggcgcgtttttagtttaggggacggagtttcgagtagttttcgtatcgtagtaaacgcgtttcgcgttttagggtacgcgttttaaagttcggttagttgatttttttcggggtttaaaaaaggtagtagaaagtcgttttcgttttataatcgttttttttttattttcgttatttaagatggcggtttaagcgttcgcgattaagattttcgggcggtttagacgagcgagttttcgattcggtgttcgttttttcgatttgcgacgttatcggtttttcgattttgcgcgagttttattggtagtcgatttttaatttggttcgggtatttatcgttttggtttgaatttaggtttcgttttcggggcgtggtttagcgatttggtggtcgttatttcgaagttgaagaggttaggcgacgt

SEQ ID NO: 32236 - DNA, 860 bp, Artificial Sequence
  chemically treated genomic DNA (Homo sapiens) CpG-island No: 32236
acgtcgcctaacctcttcaacttcgaaataacgaccaccaaatcgctaaaccacgccccgaaaacgaaacctaaattcaaaccaaaacgataaatacccgaaccaaattaaaaatcgactaccaataaaactcgcgcaaaatcgaaaaaccgataacgtcgcaaatcgaaaaaacgaacaccgaatcgaaaactcgctcgtctaaaccgcccgaaaatcttaatcgcgaacgcttaaaccgccatcttaaataacgaaaataaaaaaaaaacgattataaaacgaaaacgactttctactaccttttttaaaccccgaaaaaaatcaactaaccgaactttaaaacgcgtaccctaaaacgcgaaacgcgtttactacgatacgaaaactactcgaaactccgtcccctaaactaaaaacgcgccgaatataaccgcctcccgctccctcacccgccgcgaaaaaaaaaaacgaacgaaaaactaccgccgaacgacaaaacgttaaaacgaccctaactccctcaaataaataacaaaaccgaatcgtaaataccgaaaaaaccgaacgacgaaactaaaaaatcgacttccaaaacgaccgaacctaaataacgctaataaaacgccctcgcgactaccgaacaaaaaacttaaaccaacccgctatcaccccgaataacgttaaacgaaaaccccgaaatccgatatcataaccgacgaaccgaattcccacatcccactcaaatttccttatatttaacgaaaacgtaccaacgccacccttataccatacgcattcctcatatttaacaataaaaaaatccgcccaaaactaccccatatctattatcacttaaa

SEQ ID NO: 32237 - DNA, 542 bp, Artificial Sequence
  chemically treated genomic DNA (Homo sapiens) CpG-island No: 32237
gcgtcggttttagggcgttgtgggtcgcggtaaggtcgaggttcggtggcgaggtttgtacgttcgcgggagtgggtcgttagttagagtcgagagagggtttcgttcgagttttgtagttaggtttttaggtcggtcgcgggtcggggcgtcggtcgttgggaaatttcgcggtttggcggagtgtaggggtcgggtcggtttcggggattggagggtggggtggttcggtcgggaggcgagcgttttgcgttcgaaggagttaaaatcgagattgatagacgggacggcgagcggggtttattggtcggggagaaggggtcggggcggcgaaagtaagtttagtagggttcgcggttgttggttttttaggtttttcggtaggatgagtcgttgacggtttaggagggggtcgttttttttggtttcgaagggcgaggtcgttatagcgggggttttcgttacggttgaggtttttcgcgtttcgagtagacggggtttagttgggtttgtttcgggttttcggggatttttttaggaaa

SEQ ID NO: 32238 - DNA, 542 bp, Artificial Sequence
  chemically treated genomic DNA (Homo sapiens) CpG-island No: 32238
tttcctaaaaaaatccccgaaaacccgaaacaaacccaactaaaccccgtctactcgaaacgcgaaaaacctcaaccgtaacgaaaacccccgctataacgacctcgcccttcgaaaccaaaaaaaacgaccccctcctaaaccgtcaacgactcatcctaccgaaaaacctaaaaaaccaacaaccgcgaaccctactaaacttactttcgccgccccgaccccttctccccgaccaataaaccccgctcgccgtcccgtctatcaatctcgattttaactccttcgaacgcaaaacgctcgcctcccgaccgaaccaccccaccctccaatccccgaaaccgacccgacccctacactccgccaaaccgcgaaatttcccaacgaccgacgccccgacccgcgaccgacctaaaaacctaactacaaaactcgaacgaaaccctctctcgactctaactaacgacccactcccgcgaacgtacaaacctcgccaccgaacctcgaccttaccgcgacccacaacgccctaaaaccgacgc

SEQ ID NO: 32239 - DNA, 542 bp, Artificial Sequence
  chemically treated genomic DNA (Homo sapiens) CpG-island No: 32239
ttttttgggaggattttcgggggttcgaggtaggtttagttgggtttcgtttgttcgggacgcgggaggttttagtcgtggcgggagttttcgttgtggcggtttcgtttttcgaggttaggagaagcggtttttttttaagtcgttagcggtttattttatcgggagatttggaaaattagtagtcgcgggttttgttgggtttgttttcgtcgtttcggtttttttttttcggttagtggatttcgttcgtcgtttcgtttgttagtttcggttttagttttttcgggcgtagggcgttcgtttttcggtcgggttattttattttttaattttcgaggtcgattcgatttttgtatttcgttaggtcgcgaggttttttagcgatcggcgtttcggttcgcggtcgatttggaggtttgattgtagggttcgggcggggttttttttcggttttggttggcggtttattttcgcgggcgtataggtttcgttatcgggtttcggttttgtcgcggtttatagcgttttgggatcggcgt

SEQ ID NO: 32240 - DNA, 542 bp, Artificial Sequence
  chemically treated genomic DNA (Homo sapiens) CpG-island No: 32240
acgccgatcccaaaacgctataaaccgcgacaaaaccgaaacccgataacgaaacctatacgcccgcgaaaataaaccgccaaccaaaaccgaaaaaaaaccccgcccgaaccctacaatcaaacctccaaatcgaccgcgaaccgaaacgccgatcgctaaaaaacctcgcgacctaacgaaatacaaaaatcgaatcgacctcgaaaattaaaaaataaaataacccgaccgaaaaacgaacgccctacgcccgaaaaaactaaaaccgaaactaacaaacgaaacgacgaacgaaatccactaaccgaaaaaaaaaaaccgaaacgacgaaaacaaacccaacaaaacccgcgactactaattttccaaatctcccgataaaataaaccgctaacgacttaaaaaaaaaccgcttctcctaacctcgaaaaacgaaaccgccacaacgaaaactcccgccacgactaaaacctcccgcgtcccgaacaaacgaaacccaactaaacctacctcgaacccccgaaaatcctcccaaaaaa

SEQ ID NO: 32241 - DNA, 1111 bp, Artificial Sequence
  chemically treated genomic DNA (Homo sapiens) CpG-island No: 32241
cgcgttttttttagtagttcgttgcggatagattattttaatttcgtaggagtgcggagttcggttcgaaggcgggcggggttaaggggcgagtttgcgtcgttaatcgaaggtcgtttataaagagtcgagttcgaggttagtcgtgtaggaaagtagtcgggattattagaaacgtttttcgggattttggcgattatttatttatgggtcgtttgaaggtttttttcgagaagtattagattagcggatttggtagttgtatcgaatattcgggttatagcgagttcggcggtttcgtttttcggtaattcgggcgatagtttcgaagtttttttttcgttttcgggtttaggtttcgagatttcgtttttcggacgtggttggttagcgtttcgtttttttttcgcggagttagtgggtaagggtcgggtttgaagttatagttgcgggatcgtattcgtttttttcgacgtagattatggagagcgcgttggcggtgtttcggttgttttcgtatgatttagggacgtcggtgttgtcggtggtggatatgtatacgggcggcgagtttttgcgtatcgtgttggcggggtgttcggaggtgtttgggtttattttgttggttaagcggcgttatatgcgttagtattttgattacgtgcggcgacggtttatgttcgagtttcgagggtatcgggatatgtacggggcggttttagtttcgagcgagttgtcggacgcgtatttgggcgttttgtttttgtataacgagggttatagttttatgtgcggttacgtagtgtggcgttgggtcgtttcgttttggatttcgggtttgtgtcggcgttttttgcgggtattcgcgaggttcgcgttaatatttattgtttttgcgggttggtgatcgttttcgtggtatgcgaggacggtcgtagttacggatcggtgcgtttttatagcgtttcggttttcgtgttggttataggtaatgggcgggatttttttagtttagggtagagttgtaatcgggacgcgattaattatattaacggtttttttgggttggaattttggtaattaatttatttcgcgaatttttgtaattaat

SEQ ID NO: 32242 - DNA, 1111 bp, Artificial Sequence
  chemically treated genomic DNA (Homo sapiens) CpG-island No: 32242
attaattacaaaaattcgcgaaataaattaattaccaaaattccaacccaaaaaaaccgttaatataattaatcgcgtcccgattacaactctaccctaaactaaaaaaatcccgcccattacctataaccaacacgaaaaccgaaacgctataaaaacgcaccgatccgtaactacgaccgtcctcgcataccacgaaaacgatcaccaacccgcaaaaacaataaatattaacgcgaacctcgcgaatacccgcaaaaaacgccgacacaaacccgaaatccaaaacgaaacgacccaacgccacactacgtaaccgcacataaaactataaccctcgttatacaaaaacaaaacgcccaaatacgcgtccgacaactcgctcgaaactaaaaccgccccgtacatatcccgataccctcgaaactcgaacataaaccgtcgccgcacgtaatcaaaatactaacgcatataacgccgcttaaccaacaaaataaacccaaacacctccgaacaccccgccaacacgatacgcaaaaactcgccgcccgtatacatatccaccaccgacaacaccgacgtccctaaatcatacgaaaacaaccgaaacaccgccaacgcgctctccataatctacgtcgaaaaaaacgaatacgatcccgcaactataacttcaaacccgacccttacccactaactccgcgaaaaaaaaacgaaacgctaaccaaccacgtccgaaaaacgaaatctcgaaacctaaacccgaaaacgaaaaaaaaacttcgaaactatcgcccgaattaccgaaaaacgaaaccgccgaactcgctataacccgaatattcgatacaactaccaaatccgctaatctaatacttctcgaaaaaaaccttcaaacgacccataaataaataatcgccaaaatcccgaaaaacgtttctaataatcccgactactttcctacacgactaacctcgaactcgactctttataaacgaccttcgattaacgacgcaaactcgccccttaaccccgcccgccttcgaaccgaactccgcactcctacgaaattaaaataatctatccgcaacgaactactaaaaaaaacgcg

SEQ ID NO: 32243 - DNA, 1111 bp, Artificial Sequence
  chemically treated genomic DNA (Homo sapiens) CpG-island No: 32243
attaattgtaagggttcgcggagtaggttagttgttagagttttagtttagaaaaatcgttaatgtagttagtcgcgtttcggttgtagttttgttttgggttggaaaggtttcgtttattatttgtggttagtacgaaggtcgggacgttgtggaagcgtatcggttcgtggttgcggtcgttttcgtatgttacgaaggcggttattagttcgtaggggtagtggatattgacgcgggtttcgcgggtgttcgtagggggcgtcggtataagttcgaagtttaaagcgaagcggtttagcgttatattgcgtggtcgtatatggagttgtagttttcgttgtgtaggaataggacgtttagatgcgcgttcggtagttcgttcgggattaggatcgtttcgtatatgtttcggtgttttcggggttcgaatatgagtcgtcgtcgtacgtggttaaggtgttggcgtatgtagcgtcgtttggttagtagggtgggtttagatattttcggatatttcgttagtacgatacgtaagggttcgtcgttcgtgtgtatgtttattatcgatagtatcggcgtttttggattatgcgggggtagtcggggtatcgttagcgcgttttttatggtttgcgtcgggggagacgagtacggtttcgtagttatggttttaagttcgatttttatttattgatttcgcgggaggagggcgggacgttaattagttacgttcggggggcggggtttcggagtttaaattcggaagcgagggaggaatttcggagttgtcgttcgggttatcgggaggcggagtcgtcgagttcgttgtggttcggatgttcggtgtagttgttagattcgttgatttagtgtttttcgaaaaaaatttttaggcggtttatgggtgagtggtcgttaagatttcgggaagcgtttttggtagtttcgattatttttttatacggttggtttcgggttcggttttttgtaggcggttttcggttggcggcgtaggttcgttttttgatttcgttcgttttcgggtcgggtttcgtatttttgcggggttggggtggtttgttcgtaacgggttattaggggaggcgcg

SEQ ID NO: 32244 - DNA, 1111 bp, Artificial Sequence
  chemically treated genomic DNA (Homo sapiens) CpG-island No: 32244
cgcgcctcccctaataacccgttacgaacaaaccaccccaaccccgcaaaaatacgaaacccgacccgaaaacgaacgaaatcaaaaaacgaacctacgccgccaaccgaaaaccgcctacaaaaaaccgaacccgaaaccaaccgtataaaaaaataatcgaaactaccaaaaacgcttcccgaaatcttaacgaccactcacccataaaccgcctaaaaatttttttcgaaaaacactaaatcaacgaatctaacaactacaccgaacatccgaaccacaacgaactcgacgactccgcctcccgataacccgaacgacaactccgaaattcctccctcgcttccgaatttaaactccgaaaccccgccccccgaacgtaactaattaacgtcccgccctcctcccgcgaaatcaataaataaaaatcgaacttaaaaccataactacgaaaccgtactcgtctcccccgacgcaaaccataaaaaacgcgctaacgataccccgactacccccgcataatccaaaaacgccgatactatcgataataaacatacacacgaacgacgaacccttacgtatcgtactaacgaaatatccgaaaatatctaaacccaccctactaaccaaacgacgctacatacgccaacaccttaaccacgtacgacgacgactcatattcgaaccccgaaaacaccgaaacatatacgaaacgatcctaatcccgaacgaactaccgaacgcgcatctaaacgtcctattcctacacaacgaaaactacaactccatatacgaccacgcaatataacgctaaaccgcttcgctttaaacttcgaacttataccgacgccccctacgaacacccgcgaaacccgcgtcaatatccactacccctacgaactaataaccgccttcgtaacatacgaaaacgaccgcaaccacgaaccgatacgcttccacaacgtcccgaccttcgtactaaccacaaataataaacgaaacctttccaacccaaaacaaaactacaaccgaaacgcgactaactacattaacgatttttctaaactaaaactctaacaactaacctactccgcgaacccttacaattaat

SEQ ID NO: 32245 - DNA, 1177 bp, Artificial Sequence
  chemically treated genomic DNA (Homo sapiens) CpG-island No: 32245
atttggtattttcggaaattcgaatattcgggtcggtaattttcggagtggcggtgtcgcgggtcggttttgtagcgggtattgggttgtcgtttcgtttcgcgtttttgcgtaaatacgcggttttttcggtaacgttggaatttacgttaaaggtttcgttaggtttttagcgatcgttattttttcggtcgagtttagtttttcgcggcggtcgttagttttcggtttcgagttattatttcgatttagtggtcgtcgttttcggtgcgggatgaggagattcgcggtcgttattgggttttatggaggagtcgtcgtcgtttcgtttattagcgagtatggttttattgggtagttagtatttcggcgtttttttcgcggtcggtttatttggcgggatttttttcgcggttacggcggtcgtgtttttttttagtatcgtggcgatcgcggcgttggggaatttgagcgacgtaagcggaggcggtatagttgtcgttttcggtggcggcggttttggcgggttcggggtagcgcgggaggcgggggcggcggtgaggcggtcgttaggttcggaggcggcgtcgttgttgtcgtacggagttgtagtggcggtttaggcgttcgtttttttgtttatttttttgttgtttagttttggtaattgcgcggtgatgggggtgattgtgaagtatcggtagtttcgtatcgttattaacgtttttattttgtcgttgtttttatcggatttgtttacggcgttgttttgtttgttcgtcgtttttttggatttttttatttcgttcgggggttcggcgtttgtcgtcgtcgcggggttttggcgcggtttttgcgtcgttagtcgtttttttagttcgtgtttcggtatcgtgtttacgtttagcgtggcgtttatttcgttggatcgttattgcgttatcgtgcggtcgtcgcgggagaagatcggtcgtcgtcgcgcgttgtagttgttggcgggcgtttggttgacggttttgggtttttttttgttttgggagttgttcggggcgtttcgggaattcgcggcggcgtagagtttttacggttgtttttatcggattttttcggatttcgcgtagttgggcgcggtttttagcgtggggttggtggtggtttgttatttgttgtttttttt

SEQ ID NO: 32246 - DNA, 1177 bp, Artificial Sequence
  chemically treated genomic DNA (Homo sapiens) CpG-island No: 32246
aaaaaaaacaacaaataacaaaccaccaccaaccccacgctaaaaaccgcgcccaactacgcgaaatccgaaaaaatccgataaaaacaaccgtaaaaactctacgccgccgcgaattcccgaaacgccccgaacaactcccaaaacaaaaaaaaacccaaaaccgtcaaccaaacgcccgccaacaactacaacgcgcgacgacgaccgatcttctcccgcgacgaccgcacgataacgcaataacgatccaacgaaataaacgccacgctaaacgtaaacacgataccgaaacacgaactaaaaaaacgactaacgacgcaaaaaccgcgccaaaaccccgcgacgacgacaaacgccgaacccccgaacgaaataaaaaaatccaaaaaaacgacgaacaaacaaaacaacgccgtaaacaaatccgataaaaacaacgacaaaataaaaacgttaataacgatacgaaactaccgatacttcacaatcacccccatcaccgcgcaattaccaaaactaaacaacaaaaaaataaacaaaaaaacgaacgcctaaaccgccactacaactccgtacgacaacaacgacgccgcctccgaacctaacgaccgcctcaccgccgcccccgcctcccgcgctaccccgaacccgccaaaaccgccgccaccgaaaacgacaactataccgcctccgcttacgtcgctcaaattccccaacgccgcgatcgccacgatactaaaaaaaaacacgaccgccgtaaccgcgaaaaaaatcccgccaaataaaccgaccgcgaaaaaaacgccgaaatactaactacccaataaaaccatactcgctaataaacgaaacgacgacgactcctccataaaacccaataacgaccgcgaatctcctcatcccgcaccgaaaacgacgaccactaaatcgaaataataactcgaaaccgaaaactaacgaccgccgcgaaaaactaaactcgaccgaaaaaataacgatcgctaaaaacctaacgaaacctttaacgtaaattccaacgttaccgaaaaaaccgcgtatttacgcaaaaacgcgaaacgaaacgacaacccaatacccgctacaaaaccgacccgcgacaccgccactccgaaaattaccgacccgaatattcgaatttccgaaaataccaaat

SEQ ID NO: 32247 - DNA, 1177 bp, Artificial Sequence
  chemically treated genomic DNA (Homo sapiens) CpG-island No: 32247
aggaagggtagtaggtagtaggttattattagttttacgttgaaggtcgcgtttagttgcgcggggttcggggaggttcggtagaggtagtcgtggaagttttgcgtcgtcgcgagttttcggggcgtttcgagtagtttttagggtaaggagaagtttagggtcgttagttaggcgttcgttagtagttgtagcgcgcggcggcggtcgattttttttcgcggcggtcgtacgatagcgtagtaacggtttaacgagatgagcgttacgttgagcgtggatacgatgtcgaagtacgagttgaagaagcggttggcggcgtagaagtcgcgttagggtttcgcggcggcggtaggcgtcgaattttcgggcggagtgaagaggtttaggaaggcggcgggtaggtagagtagcgtcgtgagtagattcgatagggatagcgataggatgaaggcgttggtgacggtgcggagttgtcggtgttttataattatttttattatcgcgtagttgttaaggttagatagtaggaagatgagtaggaggacgagcgtttgggtcgttattgtagtttcgtgcgatagtagcggcgtcgttttcgggtttagcggtcgttttatcgtcgttttcgtttttcgcgttgtttcggattcgttaaggtcgtcgttatcgggagcggtagttgtgtcgttttcgtttgcgtcgtttaggttttttagcgtcgcggtcgttacggtgttgaaggagagtacggtcgtcgtggtcgcggaggaagtttcgttaggtgggtcggtcgcggagggggcgtcggagtgttggttgtttagtaaggttatgttcgttggtgggcggggcggcggcggtttttttatggggtttagtggcggtcgcggatttttttatttcgtatcgggggcggcggttattaggtcggagtggtggttcggggtcgggggttagcggtcgtcgcggggagttgggttcggtcggaggggtggcggtcgttggggatttggcggagtttttgacgtgggttttagcgttgtcgagggaatcgcgtgtttacgtaggagcgcggggcgggacggtagtttagtattcgttgtaaagtcgattcgcgatatcgttatttcggaggttatcggttcgggtgttcgggttttcgagagtgttaggt

SEQ ID NO: 32248 - DNA, 1177 bp, Artificial Sequence
  chemically treated genomic DNA (Homo sapiens) CpG-island No: 32248
acctaacactctcgaaaacccgaacacccgaaccgataacctccgaaataacgatatcgcgaatcgactttacaacgaatactaaactaccgtcccgccccgcgctcctacgtaaacacgcgattccctcgacaacgctaaaacccacgtcaaaaactccgccaaatccccaacgaccgccacccctccgaccgaacccaactccccgcgacgaccgctaacccccgaccccgaaccaccactccgacctaataaccgccgcccccgatacgaaataaaaaaatccgcgaccgccactaaaccccataaaaaaaccgccgccgccccgcccaccaacgaacataaccttactaaacaaccaacactccgacgccccctccgcgaccgacccacctaacgaaacttcctccgcgaccacgacgaccgtactctccttcaacaccgtaacgaccgcgacgctaaaaaacctaaacgacgcaaacgaaaacgacacaactaccgctcccgataacgacgaccttaacgaatccgaaacaacgcgaaaaacgaaaacgacgataaaacgaccgctaaacccgaaaacgacgccgctactatcgcacgaaactacaataacgacccaaacgctcgtcctcctactcatcttcctactatctaaccttaacaactacgcgataataaaaataattataaaacaccgacaactccgcaccgtcaccaacgccttcatcctatcgctatccctatcgaatctactcacgacgctactctacctacccgccgccttcctaaacctcttcactccgcccgaaaattcgacgcctaccgccgccgcgaaaccctaacgcgacttctacgccgccaaccgcttcttcaactcgtacttcgacatcgtatccacgctcaacgtaacgctcatctcgttaaaccgttactacgctatcgtacgaccgccgcgaaaaaaaatcgaccgccgccgcgcgctacaactactaacgaacgcctaactaacgaccctaaacttctccttaccctaaaaactactcgaaacgccccgaaaactcgcgacgacgcaaaacttccacgactacctctaccgaacctccccgaaccccgcgcaactaaacgcgaccttcaacgtaaaactaataataacctactacctactacccttcct

SEQ ID NO: 32249 - DNA, 555 bp, Artificial Sequence
  chemically treated genomic DNA (Homo sapiens) CpG-island No: 32249
  misc_feature (466)..(468): n is either a, c, g or t
ttatagtttttataaggagatgttcggtatgagttagagtttgttttcgttggtcgttacgtcgttgggtaacgggttaggcggtttttataacgcgtagtagagtttgtttaattacggttcgtcgggttacgataaaatgtttagttttaatttcgacgcgtattatattgttatgttgattcgcggtgagtaatatttgtttcgcggtttgggtattttatttgcggttatgatgtcgtatttgaacggtttgtattattcgggttatatttagttttacgggtcggtgttggtatttagtcgcgagcggttattttcgtttttatcgggttcgtaggtggttacgtcgggttagttggaagaaattaatattaaagaggtggtttagcgtattatagcggagttgaagcgttatagtattttttaggcgatttttgcgtagagggtgttgtgtcggttttannngatttttttcgatttgtttcggaatttaaaatcgtggagtaaatttaaatttggtagggagatttttcgtaggatgtggaagtggtt

SEQ ID NO: 32250 - DNA, 555 bp, Artificial Sequence
  chemically treated genomic DNA (Homo sapiens) CpG-island No: 32250
  misc_feature (88)..(90): n is either a, c, g or t
aaccacttccacatcctacgaaaaatctccctaccaaatttaaatttactccacgattttaaattccgaaacaaatcgaaaaaaatcnnntaaaaccgacacaacaccctctacgcaaaaatcgcctaaaaaatactataacgcttcaactccgctataatacgctaaaccacctctttaatattaatttcttccaactaacccgacgtaaccacctacgaacccgataaaaacgaaaataaccgctcgcgactaaataccaacaccgacccgtaaaactaaatataacccgaataatacaaaccgttcaaatacgacatcataaccgcaaataaaatacccaaaccgcgaaacaaatattactcaccgcgaatcaacataacaatataatacgcgtcgaaattaaaactaaacattttatcgtaacccgacgaaccgtaattaaacaaactctactacgcgttataaaaaccgcctaacccgttacccaacgacgtaacgaccaacgaaaacaaactctaactcataccgaacatctccttataaaaactataa

SEQ ID NO: 32251 - DNA, 555 bp, Artificial Sequence
  chemically treated genomic DNA (Homo sapiens) CpG-island No: 32251
  misc_feature (88)..(90): n is either a, c, g or t
agttatttttatattttgcggaaggtttttttgttagatttgagtttattttacggttttggatttcggagtaggtcggagagagttnnntgagatcggtatagtattttttgcgtaaagatcgtttgggggatattgtagcgttttagtttcgttgtgatgcgttgggttatttttttggtgttgattttttttagttggttcgacgtggttatttgcgagttcgatgaggacgagggtggtcgttcgcgattgggtgttagtatcggttcgtgagattgagtgtggttcgggtggtgtaggtcgtttaggtgcgatattatggtcgtaggtggggtgtttaggtcgcgggataggtgttgtttatcgcgggttagtatggtagtgtggtgcgcgtcgaagttggggttgagtattttgtcgtggttcggcggatcgtagttgggtagattttgttgcgcgttgtggaggtcgtttagttcgttgtttagcggcgtggcggttagcggggataggttttggtttatgtcgggtatttttttgtagggattgtag

SEQ ID NO: 32252 - DNA, 555 bp, Artificial Sequence
  chemically treated genomic DNA (Homo sapiens) CpG-island No: 32252
  misc_feature (466)..(468): n is either a, c, g or t
ctacaatccctacaaaaaaatacccgacataaaccaaaacctatccccgctaaccgccacgccgctaaacaacgaactaaacgacctccacaacgcgcaacaaaatctacccaactacgatccgccgaaccacgacaaaatactcaaccccaacttcgacgcgcaccacactaccatactaacccgcgataaacaacacctatcccgcgacctaaacaccccacctacgaccataatatcgcacctaaacgacctacaccacccgaaccacactcaatctcacgaaccgatactaacacccaatcgcgaacgaccaccctcgtcctcatcgaactcgcaaataaccacgtcgaaccaactaaaaaaaatcaacaccaaaaaaataacccaacgcatcacaacgaaactaaaacgctacaatatcccccaaacgatctttacgcaaaaaatactataccgatctcannnaactctctccgacctactccgaaatccaaaaccgtaaaataaactcaaatctaacaaaaaaaccttccgcaaaatataaaaataact

SEQ ID NO: 32253 - DNA, 503 bp, Artificial Sequence
  chemically treated genomic DNA (Homo sapiens) CpG-island No: 32253
ttagatggtgagagtcgcggggatattcgacgtcggggtaggttgatttacgattttgggtgtgcgtaacgtcgtttggggtttcgtgggcgagggacgtgtggggataggtgtatcggaaattgttagattggagagttgaggtatcggaggcgcgagaatagtattattattgcggcgagacgagcgcggcgtattttaaagttcggttaaatgcgttcgtttttgggaggggagggaggcgcgtttggagcggggataggtgaggtcgcgcgaacgttttagtttggcgcggttgcgggattcgggcgcgttgggaaagcgagtaggatttcgcgcgggaattagggagtatcgtaggttgtcgggtagtttttcgcggaagtgcgggttggggcgggttggggcgggttggggtaggtcggggcgtttagtttattttttttcggggtttgtttcgtcgttttgatggaggtgtaaatatttggagaagggcgggggtg

SEQ ID NO: 32254 - DNA, 503 bp, Artificial Sequence
  chemically treated genomic DNA (Homo sapiens) CpG-island No: 32254
cacccccgcccttctccaaatatttacacctccatcaaaacgacgaaacaaaccccgaaaaaaaataaactaaacgccccgacctaccccaacccgccccaacccgccccaacccgcacttccgcgaaaaactacccgacaacctacgatactccctaattcccgcgcgaaatcctactcgctttcccaacgcgcccgaatcccgcaaccgcgccaaactaaaacgttcgcgcgacctcacctatccccgctccaaacgcgcctccctcccctcccaaaaacgaacgcatttaaccgaactttaaaatacgccgcgctcgtctcgccgcaataataatactattctcgcgcctccgatacctcaactctccaatctaacaatttccgatacacctatccccacacgtccctcgcccacgaaaccccaaacgacgttacgcacacccaaaatcgtaaatcaacctaccccgacgtcgaatatccccgcgactctcaccatctaa

SEQ ID NO: 32255 - DNA, 503 bp, Artificial Sequence
  chemically treated genomic DNA (Homo sapiens) CpG-island No: 32255
tattttcgtttttttttaaatgtttgtatttttattaaagcggcggggtaagtttcggaggaaggtaagttggacgtttcggtttgttttagttcgttttagttcgttttagttcgtattttcgcgaggggttgttcggtagtttgcgatgttttttgattttcgcgcggggttttgttcgtttttttagcgcgttcggatttcgtagtcgcgttaggttggaacgttcgcgcggttttatttgttttcgttttaggcgcgtttttttttttttttagggacgagcgtatttggtcgggttttgggatgcgtcgcgttcgtttcgtcgtagtagtagtgttgttttcgcgttttcgatgttttaattttttagtttggtagttttcggtgtatttgtttttatacgtttttcgtttacggagttttaggcggcgttacgtatatttaggatcgtggattagtttgtttcggcgtcgggtgttttcgcggtttttattatttgg

SEQ ID NO: 32256 - DNA, 503 bp, Artificial Sequence
  chemically treated genomic DNA (Homo sapiens) CpG-island No: 32256
ccaaataataaaaaccgcgaaaacacccgacgccgaaacaaactaatccacgatcctaaatatacgtaacgccgcctaaaactccgtaaacgaaaaacgtataaaaacaaatacaccgaaaactaccaaactaaaaaattaaaacatcgaaaacgcgaaaacaacactactactacgacgaaacgaacgcgacgcatcccaaaacccgaccaaatacgctcgtccctaaaaaaaaaaaaaaacgcgcctaaaacgaaaacaaataaaaccgcgcgaacgttccaacctaacgcgactacgaaatccgaacgcgctaaaaaaacgaacaaaaccccgcgcgaaaatcaaaaaacatcgcaaactaccgaacaacccctcgcgaaaatacgaactaaaacgaactaaaacgaactaaaacaaaccgaaacgtccaacttaccttcctccgaaacttaccccgccgctttaataaaaatacaaacatttaaaaaaaaacgaaaata

SEQ ID NO: 32257 - DNA, 509 bp, Artificial Sequence
  chemically treated genomic DNA (Homo sapiens) CpG-island No: 32257
ggcgtaggggtttaaagagttacggcgtttcgtattattgatcgtattggggattcgacgcgaatttattttattacgagttaggcgaggaaaagtttggacgtcgttgcgtcgaggcgtcgatcgtttacggttttttttttggtttattcgatttttatttattcgcgggggagggagtcggtcgcgtattatcgagttataggatacgtttcggtcgggtcggtcgaggtttaggcgggcggttgcgggttcgagattcggtcgggggcggtcggtcgcgttttattttatttattggtcggttagtcgcggggtcgaatcgtttttaaaattttttcgtttttttttttttttttcgggtcgggtagggggcgggcgcggggcggggtagcgtcgtcgttatgtgttttcgagtcggttcgtttttagtttttttgttttgttttttaattttgtttcgttttttaatttaaggttaattttttttttttttgtttcgaaattag

SEQ ID NO: 32258 - DNA, 509 bp, Artificial Sequence
  chemically treated genomic DNA (Homo sapiens) CpG-island No: 32258
ctaatttcgaaacaaaaaaaaaaaaaattaaccttaaattaaaaaacgaaacaaaattaaaaaacaaaacaaaaaaactaaaaacgaaccgactcgaaaacacataacgacgacgctaccccgccccgcgcccgccccctacccgacccgaaaaaaaaaaaaaaaaacgaaaaaattttaaaaacgattcgaccccgcgactaaccgaccaataaataaaataaaacgcgaccgaccgcccccgaccgaatctcgaacccgcaaccgcccgcctaaacctcgaccgacccgaccgaaacgtatcctataactcgataatacgcgaccgactccctcccccgcgaataaataaaaatcgaataaaccaaaaaaaaaaccgtaaacgatcgacgcctcgacgcaacgacgtccaaacttttcctcgcctaactcgtaataaaataaattcgcgtcgaatccccaatacgatcaataatacgaaacgccgtaactctttaaacccctacgcc

SEQ ID NO: 32259 - DNA, 509 bp, Artificial Sequence
  chemically treated genomic DNA (Homo sapiens) CpG-island No: 32259
ttgatttcgggataaggagggagaaagttggttttgagttgggggacgggatagagttgggggataggatagagaaattgggggcgggtcggttcgggggtatatgacggcgacgttgtttcgtttcgcgttcgttttttgttcggttcggggagggggggaggagacgggaaggttttaaaagcgattcggtttcgcggttggtcggttagtgagtggggtggagcgcggtcggtcgttttcggtcggatttcgggttcgtagtcgttcgtttgagtttcggtcggttcggtcggggcgtgttttgtagttcggtagtgcgcgatcggttttttttttcgcgggtaagtggaagtcggatggattaggaagaaggtcgtgagcgatcggcgtttcggcgtagcggcgtttagattttttttcgtttggttcgtagtgaagtagattcgcgtcgggtttttaatacgattagtaatgcgaggcgtcgtggttttttgaatttttgcgtt

SEQ ID NO: 32260 - DNA, 509 bp, Artificial Sequence
  chemically treated genomic DNA (Homo sapiens) CpG-island No: 32260
aacgcaaaaattcaaaaaaccacgacgcctcgcattactaatcgtattaaaaacccgacgcgaatctacttcactacgaaccaaacgaaaaaaaatctaaacgccgctacgccgaaacgccgatcgctcacgaccttcttcctaatccatccgacttccacttacccgcgaaaaaaaaaaccgatcgcgcactaccgaactacaaaacacgccccgaccgaaccgaccgaaactcaaacgaacgactacgaacccgaaatccgaccgaaaacgaccgaccgcgctccaccccactcactaaccgaccaaccgcgaaaccgaatcgcttttaaaaccttcccgtctcctccccccctccccgaaccgaacaaaaaacgaacgcgaaacgaaacaacgtcgccgtcatatacccccgaaccgacccgcccccaatttctctatcctatcccccaactctatcccgtcccccaactcaaaaccaactttctccctccttatcccgaaatcaa

SEQ ID NO: 32261 - DNA, 818 bp, Artificial Sequence
  chemically treated genomic DNA (Homo sapiens) CpG-island No: 32261
  misc_feature (602)..(602): n is either a, c, g or t
tttcgtttcggaaatcgtggtttgtaagtttaagaggtcggtttttgattcggtcgaatttatttgggagattttggaggtaatgaaggcgagtacgaaggtaaggggcgtcgggtcggaaatcgtgtaattttagatattttttagattcggtttatcgttttcgttcgtagtttgggttagggtgtttgtttatttgggttatgcgtttgcgaatttgcgttatttttttttgaaattcgatatttttttgcggattaagcgataggattggtttagtcggtttagaaaaagtcgttatgttaaaagttgtcgacgttaattacgcggcgttttcggaaacgtcgggtttttagttttttcgaggcggaagtagagttaggataggtggcggggcgaagcgttaaggcgaggcgaggcgtggcgaggagcggggagggttatgagtcgggcgcggggttggagtaggagttgttcggagaagcgggggcgtggtacggatgtggcgaggcgcgggtgggttttaaattgcgttaggggcgagggcgcgttcgaggtcgtgtcgagagattgggagaggcgtgagtcgcgcggattttgtnggggcgtgacgaggagcggagggcgggttttgagatacgtcgaggcgcggaggcggggtataggggcgtgtcgaggcgcggtagcggggtttggggttggggttgggtcgtggggagttttcgtattttcggttgtcggggcgtcggttggtttcgtttaagagtgtttgaaataattacgtttacgtttatttttaaaaaaggtttaaaataaat

SEQ ID NO: 32262 - DNA, 818 bp, Artificial Sequence
  chemically treated genomic DNA (Homo sapiens) CpG-island No: 32262
  misc_feature (217)..(217): n is either a, c, g or t
atttattttaaaccttttttaaaaataaacgtaaacgtaattatttcaaacactcttaaacgaaaccaaccgacgccccgacaaccgaaaatacgaaaactccccacgacccaaccccaaccccaaaccccgctaccgcgcctcgacacgcccctataccccgcctccgcgcctcgacgtatctcaaaacccgccctccgctcctcgtcacgccccnacaaaatccgcgcgactcacgcctctcccaatctctcgacacgacctcgaacgcgccctcgcccctaacgcaatttaaaacccacccgcgcctcgccacatccgtaccacgcccccgcttctccgaacaactcctactccaaccccgcgcccgactcataaccctccccgctcctcgccacgcctcgcctcgccttaacgcttcgccccgccacctatcctaactctacttccgcctcgaaaaaactaaaaacccgacgtttccgaaaacgccgcgtaattaacgtcgacaacttttaacataacgactttttctaaaccgactaaaccaatcctatcgcttaatccgcaaaaaaatatcgaatttcaaaaaaaaataacgcaaattcgcaaacgcataacccaaataaacaaacaccctaacccaaactacgaacgaaaacgataaaccgaatctaaaaaatatctaaaattacacgatttccgacccgacgccccttaccttcgtactcgccttcattacctccaaaatctcccaaataaattcgaccgaatcaaaaaccgacctcttaaacttacaaaccacgatttccgaaacgaaa

SEQ ID NO: 32263 - DNA, 818 bp, Artificial Sequence
  chemically treated genomic DNA (Homo sapiens) CpG-island No: 32263
  misc_feature (217)..(217): n is either a, c, g or t
atttattttagattttttttgaaagtaggcgtgaacgtaattgttttaggtatttttaagcgaagttagtcggcgtttcgatagtcgagggtgcgggagttttttacggtttagttttagttttagatttcgttgtcgcgtttcggtacgtttttgtgtttcgttttcgcgtttcggcgtattttaagattcgtttttcgtttttcgttacgttttnatagggttcgcgcgatttacgttttttttagtttttcggtacgatttcgaacgcgttttcgtttttggcgtaatttaaaatttattcgcgtttcgttatattcgtgttacgttttcgttttttcgggtaatttttgttttaatttcgcgttcgatttatggtttttttcgtttttcgttacgtttcgtttcgttttagcgtttcgtttcgttatttgttttgattttattttcgtttcgggggagttgggagttcgacgttttcgggagcgtcgcgtggttagcgtcggtagtttttggtatggcgattttttttgggtcggttgggttaattttgtcgtttaattcgtaggaagatgtcgagttttaaaaggaggtggcgtaggttcgtaagcgtataatttaggtgagtaggtattttggtttaggttgcgagcgggggcgatggatcgggtttagagagtatttggggttgtacggttttcggttcggcgttttttgttttcgtgttcgtttttattatttttagggttttttaagtggattcgatcgaattagggatcgattttttaagtttgtaggttacggttttcgagacgaaa

SEQ ID NO: 32264 - DNA, 818 bp, Artificial Sequence
  chemically treated genomic DNA (Homo sapiens) CpG-island No: 32264
  misc_feature (602)..(602): n is either a, c, g or t
tttcgtctcgaaaaccgtaacctacaaacttaaaaaatcgatccctaattcgatcgaatccacttaaaaaaccctaaaaataataaaaacgaacacgaaaacaaaaaacgccgaaccgaaaaccgtacaaccccaaatactctctaaacccgatccatcgcccccgctcgcaacctaaaccaaaatacctactcacctaaattatacgcttacgaacctacgccacctccttttaaaactcgacatcttcctacgaattaaacgacaaaattaacccaaccgacccaaaaaaaatcgccataccaaaaactaccgacgctaaccacgcgacgctcccgaaaacgtcgaactcccaactcccccgaaacgaaaataaaatcaaaacaaataacgaaacgaaacgctaaaacgaaacgaaacgtaacgaaaaacgaaaaaaaccataaatcgaacgcgaaattaaaacaaaaattacccgaaaaaacgaaaacgtaacacgaatataacgaaacgcgaataaattttaaattacgccaaaaacgaaaacgcgttcgaaatcgtaccgaaaaactaaaaaaaacgtaaatcgcgcgaaccctatnaaaacgtaacgaaaaacgaaaaacgaatcttaaaatacgccgaaacgcgaaaacgaaacacaaaaacgtaccgaaacgcgacaacgaaatctaaaactaaaactaaaccgtaaaaaactcccgcaccctcgactatcgaaacgccgactaacttcgcttaaaaatacctaaaacaattacgttcacgcctactttcaaaaaaaatctaaaataaat

SEQ ID NO: 32265 - DNA, 683 bp, Artificial Sequence
  chemically treated genomic DNA (Homo sapiens) CpG-island No: 32265
gttcgtcgcggggttttcggtgcgtttcgttttttcgattttcggtagtttcgcgttttaggagtaggtgtcgggagtttgcgcggttgttgtaatttgtgtttttagcggatcgtagtcgttggttattcgtttaggggaagggcgcgtaggcgggtatatggagagcggcggtggaatgtttcggtcggggtttcggggcggcgagcgagtttttttagtgttcgtcgtcgtcgggggtggagggcgcggtcgggtcggcggagttcgacggggcggcggagggcgcggtaggcggtagcggcgagggcgagagtgggggcgggtcgcggcgggttttgcgggtagtatacgtgcgtagtgagagtttttagggcggcgcggtcggcggttcggaggttggggcgcggtagtgtttgttgcgggtttgcgaggtcgagggcgtttattttattttcgtgtttttcggggagttggatttcggggagacggtcgtgttcgacgttttttacgacgtaggtgagagcggtttcgtttttattttagttttagtttatttatttttatacgagttagggtattcgtttcgttttttcgtttttttttttcgtttttttttttttcgttttttttttttttttttcgttttttttttttttttttcgtttttttttttttttttt

SEQ ID NO: 32266 - DNA, 683 bp, Artificial Sequence
  chemically treated genomic DNA (Homo sapiens) CpG-island No: 32266
aaaaaaaaaaaaaaaaaacgaaaaaaaaaaaaaaaaaacgaaaaaaaaaaaaaaaaaacgaaaaaaaaaaaaacgaaaaaaaaaaacgaaaaaacgaaacgaataccctaactcgtataaaaataaataaactaaaactaaaataaaaacgaaaccgctctcacctacgtcgtaaaaaacgtcgaacacgaccgtctccccgaaatccaactccccgaaaaacacgaaaataaaataaacgccctcgacctcgcaaacccgcaacaaacactaccgcgccccaacctccgaaccgccgaccgcgccgccctaaaaactctcactacgcacgtatactacccgcaaaacccgccgcgacccgcccccactctcgccctcgccgctaccgcctaccgcgccctccgccgccccgtcgaactccgccgacccgaccgcgccctccacccccgacgacgacgaacactaaaaaaactcgctcgccgccccgaaaccccgaccgaaacattccaccgccgctctccatatacccgcctacgcgcccttcccctaaacgaataaccaacgactacgatccgctaaaaacacaaattacaacaaccgcgcaaactcccgacacctactcctaaaacgcgaaactaccgaaaatcgaaaaaacgaaacgcaccgaaaaccccgcgacgaac

SEQ ID NO: 32267 - DNA, 683 bp, Artificial Sequence
  chemically treated genomic DNA (Homo sapiens) CpG-island No: 32267
agggggaggggagggggacgagggggaggggagggggacgagggggaggggagggggacgagggggagggggacgggggagaagggcgagggggcggggcgggtgttttggttcgtgtgagggtaggtgaattgggattgaggtggggacgaagtcgtttttatttgcgtcgtagaaggcgtcgagtacggtcgttttttcgaagtttagtttttcgaagggtacggaggtgaggtgagcgttttcggtttcgtaggttcgtagtaggtattgtcgcgttttagttttcgggtcgtcggtcgcgtcgttttgggagtttttattgcgtacgtatattgttcgtagagttcgtcgcggttcgtttttattttcgttttcgtcgttgtcgtttgtcgcgtttttcgtcgtttcgtcgggtttcgtcggttcggtcgcgttttttattttcggcggcggcgggtattgaggggattcgttcgtcgtttcgaggtttcggtcggagtattttatcgtcgttttttatgtgttcgtttgcgcgttttttttttgggcgagtggttagcggttgcgattcgttagaggtataagttatagtagtcgcgtaggttttcggtatttgtttttgaagcgcgggattatcgggaatcgagggaacggagcgtatcggggatttcgcggcgggt

SEQ ID NO: 32268 - DNA, 683 bp, Artificial Sequence
  chemically treated genomic DNA (Homo sapiens) CpG-island No: 32268
acccgccgcgaaatccccgatacgctccgttccctcgattcccgataatcccgcgcttcaaaaacaaataccgaaaacctacgcgactactataacttatacctctaacgaatcgcaaccgctaaccactcgcccaaaaaaaaaacgcgcaaacgaacacataaaaaacgacgataaaatactccgaccgaaacctcgaaacgacgaacgaatcccctcaatacccgccgccgccgaaaataaaaaacgcgaccgaaccgacgaaacccgacgaaacgacgaaaaacgcgacaaacgacaacgacgaaaacgaaaataaaaacgaaccgcgacgaactctacgaacaatatacgtacgcaataaaaactcccaaaacgacgcgaccgacgacccgaaaactaaaacgcgacaatacctactacgaacctacgaaaccgaaaacgctcacctcacctccgtacccttcgaaaaactaaacttcgaaaaaacgaccgtactcgacgccttctacgacgcaaataaaaacgacttcgtccccacctcaatcccaattcacctaccctcacacgaaccaaaacacccgccccgccccctcgcccttctcccccgtccccctccccctcgtccccctcccctccccctcgtccccctcccctccccctcgtccccctcccctccccct

SEQ ID NO: 32269 - DNA, 864 bp, Artificial Sequence
  chemically treated genomic DNA (Homo sapiens) CpG-island No: 32269
agttcgcgttaacgttttcgttttagtaggtttattcggtattttaaattcgaaagggtttgtagaaatcggggcggggtaagggtttattttcgtcgtggtagaaattgattttttttagaaagtttaaaaaattatttattaattatttcggttttttttttcgagagatgtcgtcgttcgtcgtttttttttaggttttgggtttggcgtaggttcggagggttggcgtcgtcggttttttttcgttattcgggttcggattcggcgtttacgggacgagttgttgtaattttttcgtattcgtttttttcggtcggggcggttttcggcgtcgggttttcgacgggtagagacgtttttcgtttcgtttattcgttcgggtggtgttcgttaggtcgtggttggtcgtttttcggggaaatttttttagttttcggtcgtttaggtttagtattttagtgatcgtcgttttttttagggttcgatcgagagagcggttttacgagttcgggttaaaattagggtttgtttcggagtttgggtcgtagtgaatattagggaggttatttttcgacgttatcgtgttagagtattcggtagtcgttgttatagcgattaagttcgcggtcgttattttttagtcgataatattcgggttcgttagtttagcgtatgcgcggtcggatcgttgggtgggcggagaaaggggtttacggatcgatttcggacggttttcgtgatgggtagtatcgtggtgtttttcggcgtagttaggcgtttgttttcgtttatatgatgcgttttttaagggaagttaaaacggattttataaatttagagtagttttttattttaattttt

SEQ ID NO: 32270 - DNA, 864 bp, Artificial Sequence
  chemically treated genomic DNA (Homo sapiens) CpG-island No: 32270
aaaaattaaaataaaaaactactctaaatttataaaatccgttttaacttcccttaaaaaacgcatcatataaacgaaaacaaacgcctaactacgccgaaaaacaccacgatactacccatcacgaaaaccgtccgaaatcgatccgtaaacccctttctccgcccacccaacgatccgaccgcgcatacgctaaactaacgaacccgaatattatcgactaaaaaataacgaccgcgaacttaatcgctataacaacgactaccgaatactctaacacgataacgtcgaaaaataacctccctaatattcactacgacccaaactccgaaacaaaccctaattttaacccgaactcgtaaaaccgctctctcgatcgaaccctaaaaaaaacgacgatcactaaaatactaaacctaaacgaccgaaaactaaaaaaatttccccgaaaaacgaccaaccacgacctaacgaacaccacccgaacgaataaacgaaacgaaaaacgtctctacccgtcgaaaacccgacgccgaaaaccgccccgaccgaaaaaaacgaatacgaaaaaattacaacaactcgtcccgtaaacgccgaatccgaacccgaataacgaaaaaaaaccgacgacgccaaccctccgaacctacgccaaacccaaaacctaaaaaaaaacgacgaacgacgacatctctcgaaaaaaaaaaccgaaataattaataaataattttttaaactttctaaaaaaaatcaatttctaccacgacgaaaataaacccttaccccgccccgatttctacaaaccctttcgaatttaaaataccgaataaacctactaaaacgaaaacgttaacgcgaact

SEQ ID NO: 32271 - DNA, 864 bp, Artificial Sequence
  chemically treated genomic DNA (Homo sapiens) CpG-island No: 32271
ggaggttagagtagggggttgttttggatttgtgaggttcgttttaattttttttgaaaagcgtattatgtgggcgggggtaagcgtttggttgcgtcggggggtattacggtgttgtttattacgggaatcgttcggggtcggttcgtgagttttttttttcgtttatttagcggttcggtcgcgtatgcgttgagttggcgggttcgagtgttgtcggttgggaaatggcggtcgcgggtttggtcgttgtggtagcggttgtcgagtattttggtacggtagcgtcgggaggtaatttttttggtgtttattgcggtttaagtttcggggtaggttttggttttggttcgggttcgtggagtcgttttttcgatcgagttttggaggaggcggcggttattggggtgttgagtttgagcggtcggaaattgagggagttttttcggggagcggttaattacgatttgacggatattattcgggcgggtgagcggggcggggggcgtttttgttcgtcggagattcggcgtcgggagtcgtttcggtcgggggaggcggatgcgggggagttatagtagttcgtttcgtaggcgtcgggttcggattcgggtaacggggagaagtcgacggcgttagtttttcgggtttgcgttagatttagagtttggggagaggcggcgggcggcggtatttttcggggaagggggtcggagtgattgatggatgattttttaggttttttgaggaaaattagtttttgttacggcggaggtagatttttgtttcgtttcggtttttgtaggttttttcggatttggggtgtcgaatggatttgttaagacgggaacgttagcgcgagtt

SEQ ID NO: 32272 - DNA, 864 bp, Artificial Sequence
  chemically treated genomic DNA (Homo sapiens) CpG-island No: 32272
aactcgcgctaacgttcccgtcttaacaaatccattcgacaccccaaatccgaaaaaacctacaaaaaccgaaacgaaacaaaaatctacctccgccgtaacaaaaactaattttcctcaaaaaacctaaaaaatcatccatcaatcactccgacccccttccccgaaaaataccgccgcccgccgcctctccccaaactctaaatctaacgcaaacccgaaaaactaacgccgtcgacttctccccgttacccgaatccgaacccgacgcctacgaaacgaactactataactcccccgcatccgcctcccccgaccgaaacgactcccgacgccgaatctccgacgaacaaaaacgccccccgccccgctcacccgcccgaataatatccgtcaaatcgtaattaaccgctccccgaaaaaactccctcaatttccgaccgctcaaactcaacaccccaataaccgccgcctcctccaaaactcgatcgaaaaaacgactccacgaacccgaaccaaaaccaaaacctaccccgaaacttaaaccgcaataaacaccaaaaaaattacctcccgacgctaccgtaccaaaatactcgacaaccgctaccacaacgaccaaacccgcgaccgccatttcccaaccgacaacactcgaacccgccaactcaacgcatacgcgaccgaaccgctaaataaacgaaaaaaaaaactcacgaaccgaccccgaacgattcccgtaataaacaacaccgtaataccccccgacgcaaccaaacgcttacccccgcccacataatacgcttttcaaaaaaaattaaaacgaacctcacaaatccaaaacaaccccctactctaacctcc

SEQ ID NO: 32273 - DNA, 525 bp, Artificial Sequence
  chemically treated genomic DNA (Homo sapiens) CpG-island No: 32273
  misc_feature (469)..(469): n is either a, c, g or t
  misc_feature (472)..(472): n is either a, c, g or t
  misc_feature (479)..(479): n is either a, c, g or t
tttcgtcgcgtttgtattttagtatagtatttttttatcgcggaatttcggggttcgtagcgattttttgtttttagtcgcggttattttttttttattttattggtcgcggcggtggtagagggtttgggggcggggtcggttgcgcgttcgggttgagcgagagtcgtagtagcgttcggttgtcgcgcgcgttttagttgggattcgtcgcgagttcgtttaggttatgcgcgcgattttgtttggttttttaagttttgacgcgggttgcgttttttttattttaaaggcggagcgggtaagaggtaagcggttgggttggttcgggaattttttgagcgtaggggcggacgggaggcgggtagtaatttttcgtttttgttttcgtttagagttggtcggtaggtttagaaattgaagtcggggatcggtgttttttcgtagattttcggtatttttttacggnttnacgttgnttgtttattgtttcggggtttttttggggaaaagggagggaaggga

SEQ ID NO: 32274 - DNA, 525 bp, Artificial Sequence
  chemically treated genomic DNA (Homo sapiens) CpG-island No: 32274
  misc_feature (47)..(47): n is either a, c, g or t
  misc_feature (54)..(54): n is either a, c, g or t
  misc_feature (57)..(57): n is either a, c, g or t
tcccttccctcccttttccccaaaaaaaccccgaaacaataaacaancaacgtnaanccgtaaaaaaataccgaaaatctacgaaaaaacaccgatccccgacttcaatttctaaacctaccgaccaactctaaacgaaaacaaaaacgaaaaattactacccgcctcccgtccgcccctacgctcaaaaaattcccgaaccaacccaaccgcttacctcttacccgctccgcctttaaaataaaaaaaacgcaacccgcgtcaaaacttaaaaaaccaaacaaaatcgcgcgcataacctaaacgaactcgcgacgaatcccaactaaaacgcgcgcgacaaccgaacgctactacgactctcgctcaacccgaacgcgcaaccgaccccgcccccaaaccctctaccaccgccgcgaccaataaaataaaaaaaaaataaccgcgactaaaaacaaaaaatcgctacgaaccccgaaattccgcgataaaaaaatactatactaaaatacaaacgcgacgaaa

SEQ ID NO: 32275 - DNA, 525 bp, Artificial Sequence
  chemically treated genomic DNA (Homo sapiens) CpG-island No: 32275
  misc_feature (47)..(47): n is either a, c, g or t
  misc_feature (54)..(54): n is either a, c, g or t
  misc_feature (57)..(57): n is either a, c, g or t
tttttttttttttttttttttaagggggtttcggagtaatgggtaantagcgtnaantcgtgagggggtgtcgaaaatttgcgggaaagtatcggttttcggttttagtttttaagtttatcggttagttttggacgggagtaagggcgagaggttgttgttcgtttttcgttcgtttttgcgtttaagaggttttcgaattagtttagtcgtttgttttttgttcgtttcgtttttgaagtgagaagggcgtagttcgcgttagaatttagagggttaggtagggtcgcgcgtatggtttgggcgggttcgcggcgggttttagttgggacgcgcgcggtagtcgagcgttgttgcggttttcgtttagttcgggcgcgtaatcggtttcgtttttaggttttttgttatcgtcgcgattaatgaggtgagagggaggtgatcgcggttgagggtagggggtcgttgcgaatttcggggtttcgcggtggaggggtgttatattgggatgtaggcgcggcgggg

SEQ ID NO: 32276 - DNA, 525 bp, Artificial Sequence
  chemically treated genomic DNA (Homo sapiens) CpG-island No: 32276
  misc_feature (469)..(469): n is either a, c, g or t
  misc_feature (472)..(472): n is either a, c, g or t
  misc_feature (479)..(479): n is either a, c, g or t
ccccgccgcgcctacatcccaatataacacccctccaccgcgaaaccccgaaattcgcaacgaccccctaccctcaaccgcgatcacctccctctcacctcattaatcgcgacgataacaaaaaacctaaaaacgaaaccgattacgcgcccgaactaaacgaaaaccgcaacaacgctcgactaccgcgcgcgtcccaactaaaacccgccgcgaacccgcccaaaccatacgcgcgaccctacctaaccctctaaattctaacgcgaactacgcccttctcacttcaaaaacgaaacgaacaaaaaacaaacgactaaactaattcgaaaacctcttaaacgcaaaaacgaacgaaaaacgaacaacaacctctcgcccttactcccgtccaaaactaaccgataaacttaaaaactaaaaccgaaaaccgatactttcccgcaaattttcgacaccccctcacganttnacgctanttacccattactccgaaacccccttaaaaaaaaaaaaaaaaaaaaa

SEQ ID NO: 32277 - DNA, 576 bp, Artificial Sequence
  chemically treated genomic DNA (Homo sapiens) CpG-island No: 32277
ttggagcggagagtatagcgcggttagttgcgtgagtcggggagtcggcgcgcgagttcgggggtgtaggggttgttggggtcgttagggtggggcggagggcgttgcggtcggggttcgtttgcgcggggagcgtcgggattaggacggtcgttagggagcgttgcggtttttaattcgttcgtttttcggtaggcggggtcgcgttttttttgtagtcgttatcgtagtcgtcgtttgggtcgtttcgtgttttcggtggagtcgtcgtcgtcgtcgtcgggagttcgatgcggacggagttcgggtcgagttatggggatttttagtattacggattaggttagtttttttgttttttttcgttttttttttttagggttcggcgttgtcgttacgcgagttcggggatgtgcggtttaggttgggtttgagttcggggttttcgtagttttcgtttcgttttatgtcgcgttttttttaatcgagtcggtgtttttggggatttggtaatcggcggaggtatcgcgggagttcgttttagttagaatttttagagtggagtttttttacgga

SEQ ID NO: 32278 - DNA, 576 bp, Artificial Sequence
  chemically treated genomic DNA (Homo sapiens) CpG-island No: 32278
tccgtaaaaaaactccactctaaaaattctaactaaaacgaactcccgcgatacctccgccgattaccaaatccccaaaaacaccgactcgattaaaaaaaacgcgacataaaacgaaacgaaaactacgaaaaccccgaactcaaacccaacctaaaccgcacatccccgaactcgcgtaacgacaacgccgaaccctaaaaaaaaaaaacgaaaaaaaacaaaaaaactaacctaatccgtaatactaaaaatccccataactcgacccgaactccgtccgcatcgaactcccgacgacgacgacgacgactccaccgaaaacacgaaacgacccaaacgacgactacgataacgactacaaaaaaaacgcgaccccgcctaccgaaaaacgaacgaattaaaaaccgcaacgctccctaacgaccgtcctaatcccgacgctccccgcgcaaacgaaccccgaccgcaacgccctccgccccaccctaacgaccccaacaacccctacacccccgaactcgcgcgccgactccccgactcacgcaactaaccgcgctatactctccgctccaa

SEQ ID NO: 32279 - DNA, 576 bp, Artificial Sequence
  chemically treated genomic DNA (Homo sapiens) CpG-island No: 32279
ttcgtggaggggttttattttagggattttggttggagcgagttttcgcggtgttttcgtcggttgttaggtttttaaggatatcggttcggttgaggggagcgcggtatggggcggggcgggagttgcgggagtttcgggtttaggtttagtttaggtcgtatattttcgggttcgcgtgacggtagcgtcgagttttggaaggaggaagcgggaaagggtaggagggttgatttggttcgtgatgttgaggatttttatggttcggttcgggtttcgttcgtatcgagttttcggcggcggcggcggcggttttatcggggatacggagcggtttaggcggcggttgcggtggcggttgtagggagagcgcggtttcgtttatcggggggcgggcgagttggaggtcgtagcgttttttggcggtcgttttggtttcggcgtttttcgcgtaaacggatttcggtcgtagcgtttttcgttttattttggcggttttagtagtttttgtattttcgaattcgcgcgtcggtttttcggtttacgtagttggtcgcgttgtgtttttcgttttag

SEQ ID NO: 32280 - DNA, 576 bp, Artificial Sequence
  chemically treated genomic DNA (Homo sapiens) CpG-island No: 32280
ctaaaacgaaaaacacaacgcgaccaactacgtaaaccgaaaaaccgacgcgcgaattcgaaaatacaaaaactactaaaaccgccaaaataaaacgaaaaacgctacgaccgaaatccgtttacgcgaaaaacgccgaaaccaaaacgaccgccaaaaaacgctacgacctccaactcgcccgccccccgataaacgaaaccgcgctctccctacaaccgccaccgcaaccgccgcctaaaccgctccgtatccccgataaaaccgccgccgccgccgccgaaaactcgatacgaacgaaacccgaaccgaaccataaaaatcctcaacatcacgaaccaaatcaaccctcctaccctttcccgcttcctccttccaaaactcgacgctaccgtcacgcgaacccgaaaatatacgacctaaactaaacctaaacccgaaactcccgcaactcccgccccgccccataccgcgctcccctcaaccgaaccgatatccttaaaaacctaacaaccgacgaaaacaccgcgaaaactcgctccaaccaaaatccctaaaataaaacccctccacgaa

SEQ ID NO: 32281 - DNA, 568 bp, Artificial Sequence
  chemically treated genomic DNA (Homo sapiens) CpG-island No: 32281
  misc_feature (502)..(502): n is either a, c, g or t
ttgttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtaattttacggcggttttaggttgtcggagatgggtgatgtcggntttttttttattattgataatcgtggtaagttttaaagtttttggtcgggggtttttagatttgtt

SEQ ID NO: 32282 - DNA, 568 bp, Artificial Sequence
  chemically treated genomic DNA (Homo sapiens) CpG-island No: 32282
  misc_feature (67)..(67): n is either a, c, g or t
aacaaatctaaaaacccccgaccaaaaactttaaaacttaccacgattatcaataataaaaaaaaanccgacatcacccatctccgacaacctaaaaccgccgtaaaattactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacaa

SEQ ID NO: 32283 - DNA, 568 bp, Artificial Sequence
  chemically treated genomic DNA (Homo sapiens) CpG-island No: 32283
  misc_feature (67)..(67): n is either a, c, g or t
aataagtttaaaaattttcggttaagggttttaaagtttattacggttattagtaatgaagaaaagntcggtattatttattttcgatagtttgggatcgtcgtgaagttgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaataa

SEQ ID NO: 32284 - DNA, 568 bp, Artificial Sequence
  chemically treated genomic DNA (Homo sapiens) CpG-island No: 32284
  misc_feature (502)..(502): n is either a, c, g or t
ttattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacaacttcacgacgatcccaaactatcgaaaataaataataccgancttttcttcattactaataaccgtaataaactttaaaacccttaaccgaaaatttttaaacttatt

SEQ ID NO: 32285 - DNA, 730 bp, Artificial Sequence
  chemically treated genomic DNA (Homo sapiens) CpG-island No: 32285
gagcggaagaggtagtttaaggggagcgttaaggggtacgagttgttcgatagttgcgtagatcggcggtatggattttaacgagcggttgtagtaagaacgttttaacgcgtaggtttttttttgcgcgttggttggttagttgggtattattcggttgatagatatcgtttttggtattacgttggatgtcggataaatagtcgaatcgttggcgttgttcggtgaggatgatgatatggattttcgtttattacgtagttattaggtggtaaatggtatcgcggttttgtcggatttcggtacgttggttagtaaaattcgtgcgttttagttttatttcgggatgacggggtatagcgggattattgttcgtttgtagtaggtaattagagatttcggcgttgacgggatttttttggatatggatacgtcgggtggaatggtgttcggggcgtttgattgcgtcgatattattggtcgtatgcgcgatattaaatttatttgggcgttggttaaagataagaaattgtacgtaaggtaatttatttgttagagggtatcgcgacggttggttatataaacggttaggaacggttttattgggggtatgatggcgtataataattatggcgttgcgtttaaaaataaacggcgttgaggggtaacgttggaaattaaagggggtaaatcgttaagggcgaaagggtaaattttttaaaaaaaaggt

SEQ ID NO: 32286 - DNA, 730 bp, Artificial Sequence
  chemically treated genomic DNA (Homo sapiens) CpG-island No: 32286
accttttttttaaaaaatttaccctttcgcccttaacgatttaccccctttaatttccaacgttacccctcaacgccgtttatttttaaacgcaacgccataattattatacgccatcatacccccaataaaaccgttcctaaccgtttatataaccaaccgtcgcgataccctctaacaaataaattaccttacgtacaatttcttatctttaaccaacgcccaaataaatttaatatcgcgcatacgaccaataatatcgacgcaatcaaacgccccgaacaccattccacccgacgtatccatatccaaaaaaatcccgtcaacgccgaaatctctaattacctactacaaacgaacaataatcccgctataccccgtcatcccgaaataaaactaaaacgcacgaattttactaaccaacgtaccgaaatccgacaaaaccgcgataccatttaccacctaataactacgtaataaacgaaaatccatatcatcatcctcaccgaacaacgccaacgattcgactatttatccgacatccaacgtaataccaaaaacgatatctatcaaccgaataatacccaactaaccaaccaacgcgcaaaaaaaaacctacgcgttaaaacgttcttactacaaccgctcgttaaaatccataccgccgatctacgcaactatcgaacaactcgtaccccttaacgctccccttaaactacctcttccgctc

SEQ ID NO: 32287 - DNA, 730 bp, Artificial Sequence
  chemically treated genomic DNA (Homo sapiens) CpG-island No: 32287
attttttttttaaggggtttgttttttcgtttttggcgatttgttttttttaatttttagcgttgttttttaacgtcgtttatttttaggcgtagcgttatagttattgtgcgttattatgtttttaatggagtcgtttttggtcgtttgtgtgattagtcgtcgcgatgttttttggtaaataagttgttttgcgtgtagttttttgtttttggttagcgtttagatgggtttgatgtcgcgtatacggttaataatgtcggcgtagttaaacgtttcggatattattttattcggcgtatttatatttagaagaatttcgttaacgtcggggtttttgattgtttgttgtaggcgagtaatgatttcgttgtatttcgttatttcggaataaggttgaagcgtacgggttttgttgattagcgtgtcggaattcggtaagatcgcgatattatttgttatttgatagttgcgtgatggacggggatttatgttattatttttatcgaatagcgttagcggttcggttatttgttcggtatttagcgtgatgttagagacggtatttgttagtcgggtgatgtttaattggttagttagcgcgtaaaagaaaatttgcgcgttgaagcgtttttgttgtaatcgttcgttaaagtttatgtcgtcgatttgcgtaattatcgggtagttcgtgttttttagcgttttttttaaattgtttttttcgttt

SEQ ID NO: 32288 - DNA, 730 bp, Artificial Sequence
  chemically treated genomic DNA (Homo sapiens) CpG-island No: 32288
aaacgaaaaaaacaatttaaaaaaaacgctaaaaaacacgaactacccgataattacgcaaatcgacgacataaactttaacgaacgattacaacaaaaacgcttcaacgcgcaaattttcttttacgcgctaactaaccaattaaacatcacccgactaacaaataccgtctctaacatcacgctaaataccgaacaaataaccgaaccgctaacgctattcgataaaaataataacataaatccccgtccatcacgcaactatcaaataacaaataatatcgcgatcttaccgaattccgacacgctaatcaacaaaacccgtacgcttcaaccttattccgaaataacgaaatacaacgaaatcattactcgcctacaacaaacaatcaaaaaccccgacgttaacgaaattcttctaaatataaatacgccgaataaaataatatccgaaacgtttaactacgccgacattattaaccgtatacgcgacatcaaacccatctaaacgctaaccaaaaacaaaaaactacacgcaaaacaacttatttaccaaaaaacatcgcgacgactaatcacacaaacgaccaaaaacgactccattaaaaacataataacgcacaataactataacgctacgcctaaaaataaacgacgttaaaaaacaacgctaaaaattaaaaaaaacaaatcgccaaaaacgaaaaaacaaaccccttaaaaaaaaaat

SEQ ID NO: 32289 - DNA, 726 bp, Artificial Sequence
  chemically treated genomic DNA (Homo sapiens) CpG-island No: 32289
  misc_feature (701)..(701): n is either a, c, g or t
  misc_feature (710)..(710): n is either a, c, g or t
  misc_feature (713)..(714): n is either a, c, g or t
  misc_feature (716)..(716): n is either a, c, g or t
  misc_feature (718)..(718): n is either a, c, g or t
  misc_feature (721)..(723): n is either a, c, g or t
  misc_feature (725)..(725): n is either a, c, g or t
tgaacgcgttaaatattatcgtcgattatgaggtgattcgcgtcgttgaaattggtttggtatagatttaggcgcggatgggcggtatcggcgaacgtttttttgtcggcgacgttacgttgattcgcgtcgtcgtgcgtttgattgacggtacgttcggttatagttgggtgtaggggcgtgataaatagtacgtcgaacgttgcgcgttgattgacgcgttgatgtagtaatttcgttatttttaaaatttattagaaatttttattgtttcgttggacgttgatcgtatggtacgtattgtcgtacgttaggtcgaagtgaacgttagtcgggtcgatttttttacgatggttcgcggagataacgtatgattttggaaatcgtttttatgtttttcgtgtaggatgtttagtatagttttcgtcgtttgttaaaggttatgagcgagtcgggcgtgattgtcgttttgtattagtttaaacgcggttggtaatcgttgaatatcgttattattagcgtgttgttgacgttggtcgataacgatacgtcggtgtggttttttattttattaaataacgatatcgttaattagagtttgcgtttttatattaacgcgtcgttggttagttagtcggaataggcgattttcgcggtgacggatgaggcgatttttaacgaatagtttaacgttttttttnttaatattnttnntntnttnnnant

SEQ ID NO: 32290 - DNA, 726 bp, Artificial Sequence
  chemically treated genomic DNA (Homo sapiens) CpG-island No: 32290
  misc_feature (2)..(2): n is either a, c, g or t
  misc_feature (4)..(6): n is either a, c, g or t
  misc_feature (9)..(9): n is either a, c, g or t
  misc_feature (11)..(11): n is either a, c, g or t
  misc_feature (13)..(14): n is either a, c, g or t
  misc_feature (17)..(17): n is either a, c, g or t
  misc_feature (26)..(26): n is either a, c, g or t
antnnnaananannaanaatattaanaaaaaaaacgttaaactattcgttaaaaatcgcctcatccgtcaccgcgaaaatcgcctattccgactaactaaccaacgacgcgttaatataaaaacgcaaactctaattaacgatatcgttatttaataaaataaaaaaccacaccgacgtatcgttatcgaccaacgtcaacaacacgctaataataacgatattcaacgattaccaaccgcgtttaaactaatacaaaacgacaatcacgcccgactcgctcataacctttaacaaacgacgaaaactatactaaacatcctacacgaaaaacataaaaacgatttccaaaatcatacgttatctccgcgaaccatcgtaaaaaaatcgacccgactaacgttcacttcgacctaacgtacgacaatacgtaccatacgatcaacgtccaacgaaacaataaaaatttctaataaattttaaaaataacgaaattactacatcaacgcgtcaatcaacgcgcaacgttcgacgtactatttatcacgcccctacacccaactataaccgaacgtaccgtcaatcaaacgcacgacgacgcgaatcaacgtaacgtcgccgacaaaaaaacgttcgccgataccgcccatccgcgcctaaatctataccaaaccaatttcaacgacgcgaatcacctcataatcgacgataatatttaacgcgttca

SEQ ID NO: 32291 - DNA, 726 bp, Artificial Sequence
  chemically treated genomic DNA (Homo sapiens) CpG-island No: 32291
  misc_feature (2)..(2): n is either a, c, g or t
  misc_feature (4)..(6): n is either a, c, g or t
  misc_feature (9)..(9): n is either a, c, g or t
  misc_feature (11)..(11): n is either a, c, g or t
  misc_feature (13)..(14): n is either a, c, g or t
  misc_feature (17)..(17): n is either a, c, g or t
  misc_feature (26)..(26): n is either a, c, g or t
gntnnnggngnannggnggtgttggnggaaagggcgttgagttgttcgttggaaatcgttttattcgttatcgcgaaggtcgtttgtttcggttggttgattagcggcgcgttggtatgaaaacgtaggttttggttgacgatatcgttatttaatggggtagaaagttatatcggcgtgtcgttatcggttagcgttagtagtacgttggtggtggcgatatttagcggttgttagtcgcgtttgagttgatgtagggcgataattacgttcggttcgtttatggtttttaataggcgacgaaaattgtgttgggtattttgtacgggaagtataaaagcggtttttagggttatgcgttgttttcgcgaattatcgtaaagaagtcgattcggttggcgtttatttcggtttggcgtgcggtaatgcgtgttatacggttagcgtttagcggggtaataagggtttttgataagttttgaaagtggcgagattgttgtattagcgcgttaattagcgcgtagcgttcggcgtgttgtttattacgtttttgtatttagttgtagtcgagcgtgtcgttagttaggcgtacggcggcgcgggttagcgtggcgtcgtcggtaaaaaaacgttcgtcggtgtcgtttattcgcgtttgaatttgtattaggttagttttagcggcgcggattattttatagtcggcggtgatgtttagcgcgttta

SEQ ID NO: 32292 - DNA, 726 bp, Artificial Sequence
  chemically treated genomic DNA (Homo sapiens) CpG-island No: 32292
  misc_feature (701)..(701): n is either a, c, g or t
  misc_feature (710)..(710): n is either a, c, g or t
  misc_feature (713)..(714): n is either a, c, g or t
  misc_feature (716)..(716): n is either a, c, g or t
  misc_feature (718)..(718): n is either a, c, g or t
  misc_feature (721)..(723): n is either a, c, g or t
  misc_feature (725)..(725): n is either a, c, g or t
taaacgcgctaaacatcaccgccgactataaaataatccgcgccgctaaaactaacctaatacaaattcaaacgcgaataaacgacaccgacgaacgtttttttaccgacgacgccacgctaacccgcgccgccgtacgcctaactaacgacacgctcgactacaactaaatacaaaaacgtaataaacaacacgccgaacgctacgcgctaattaacgcgctaatacaacaatctcgccactttcaaaacttatcaaaaacccttattaccccgctaaacgctaaccgtataacacgcattaccgcacgccaaaccgaaataaacgccaaccgaatcgacttctttacgataattcgcgaaaacaacgcataaccctaaaaaccgcttttatacttcccgtacaaaatacccaacacaattttcgtcgcctattaaaaaccataaacgaaccgaacgtaattatcgccctacatcaactcaaacgcgactaacaaccgctaaatatcgccaccaccaacgtactactaacgctaaccgataacgacacgccgatataactttctaccccattaaataacgatatcgtcaaccaaaacctacgttttcataccaacgcgccgctaatcaaccaaccgaaacaaacgaccttcgcgataacgaataaaacgatttccaacgaacaactcaacgccctttccnccaacaccnccnntncnccnnnanc

SEQ ID NO: 32293 - DNA, 996 bp, Artificial Sequence
  chemically treated genomic DNA (Homo sapiens) CpG-island No: 32293
  misc_feature (453)..(453): n is either a, c, g or t
tatttagcgttagttatcgcgtgcggcgttgattggtagtaggagttttacgaataattggtcgtgattgttaacgttgttattttcgttgcgtatgaagggcgcgtttttgaacgttttacgtaatatggttcgttggcgatgttgtcgatgtttgacggacgttgttcgttggtttggtgttatttattggaacggcgcgaagaggtgttgtcgtggagtgacgagaagttttgtcgtgaattttagtcggtttttggttggcgatttgggaaaattatttacgttggtaaacgtagtgtttattcgttggcgttaatttacgtcgttagatttattatttatcgtatcgtgttggtgggtaatgcggcgtaaattttgtattcgattgtcgggtaagggtttaatttcggtatgcgagatgtgatgagttttgcggaaattttgatttangcgtaggagcgcggagaagatatgggggattacggcgtattgtgtcgttattagtagcgtcgatagagcgatcgcgaagtaattattggcgttacggatagttttgtatatttttttgttaattcgtgggtatcgtttgtttgtcggcgtaatatcgggttgatgacgatgggattatttattttcgtacgcgatgtgttgtcgtagcgtattttcggttgggtggcgcgttgaaggcggttttaaggaataaataatgtaaagtgttgatgtagttattgttggcggcggtatggtggggttggcggttgtttgtggtttataggggagcggtttacgcgttgtcgtattggagtagcgcgtataggaatttttggcggcgaatgtattattataattgcgcgtttcggttattaatgtcgttagcgaaaaattatttattcgttttggcgtttggtaggatattttttttcgtagggttagttgttattacggtatggaagtgtgggataaagatagttttggttatatttcgtttgacga

SEQ ID NO: 32294 - DNA, 996 bp, Artificial Sequence
  chemically treated genomic DNA (Homo sapiens) CpG-island No: 32294
  misc_feature (544)..(544): n is either a, c, g or t
tcgtcaaacgaaatataaccaaaactatctttatcccacacttccataccgtaataacaactaaccctacgaaaaaaaatatcctaccaaacgccaaaacgaataaataatttttcgctaacgacattaataaccgaaacgcgcaattataataatacattcgccgccaaaaattcctatacgcgctactccaatacgacaacgcgtaaaccgctcccctataaaccacaaacaaccgccaaccccaccataccgccgccaacaataactacatcaacactttacattatttattccttaaaaccgccttcaacgcgccacccaaccgaaaatacgctacgacaacacatcgcgtacgaaaataaataatcccatcgtcatcaacccgatattacgccgacaaacaaacgatacccacgaattaacaaaaaaatatacaaaactatccgtaacgccaataattacttcgcgatcgctctatcgacgctactaataacgacacaatacgccgtaatcccccatatcttctccgcgctcctacgcntaaatcaaaatttccgcaaaactcatcacatctcgcataccgaaattaaacccttacccgacaatcgaatacaaaatttacgccgcattacccaccaacacgatacgataaataataaatctaacgacgtaaattaacgccaacgaataaacactacgtttaccaacgtaaataattttcccaaatcgccaaccaaaaaccgactaaaattcacgacaaaacttctcgtcactccacgacaacacctcttcgcgccgttccaataaataacaccaaaccaacgaacaacgtccgtcaaacatcgacaacatcgccaacgaaccatattacgtaaaacgttcaaaaacgcgcccttcatacgcaacgaaaataacaacgttaacaatcacgaccaattattcgtaaaactcctactaccaatcaacgccgcacgcgataactaacgctaaata

SEQ ID NO: 32295 - DNA, 996 bp, Artificial Sequence
  chemically treated genomic DNA (Homo sapiens) CpG-island No: 32295
  misc_feature (544)..(544): n is either a, c, g or t
tcgttaaacgaaatgtgattaaagttgtttttgttttatatttttatatcgtgataatagttggttttacgagagagaatgttttgttagacgttaagacgggtgagtaatttttcgttggcggtattgatagtcgaaacgcgtagttgtggtggtgtattcgtcgttagaggtttttgtacgcgttgttttagtacggtaacgcgtaagtcgtttttttgtaagttataggtaatcgttagttttattatgtcgtcgttaataatggttatattaatattttgtattgtttattttttaaaatcgtttttaacgcgttatttaatcgagggtgcgttgcgatagtatatcgcgtgcgggggtgaataattttatcgttattagttcgatgttgcgtcgataaataagcggtgtttacgggttggtaaaaagatgtataaggttgttcgtgacgttaatggttgtttcgcgatcgttttgtcgacgttgttgataacggtataatacgtcgtaattttttatgtttttttcgcgtttttgcgtntgagttagggttttcgtaagatttattatatttcgtatatcgaggttaaatttttgttcggtaatcgggtgtagagtttgcgtcgtattgtttattagtacggtacgatgggtaatagatttggcggcgtgggttaacgttagcggataagtattgcgtttattagcgtgggtaatttttttaagtcgttagttaaaggtcgattggagtttacggtaaaatttttcgttattttacgataatattttttcgcgtcgttttagtggatgatattagattagcgaatagcgttcgttagatatcggtaatatcgttagcgggttatgttgcgtaaagcgtttaaaagcgcgttttttatgcgtaacggaagtagtaacgttggtaattacggttagttgttcgtaaggtttttgttgttagttaacgtcgtacgcggtggttaacgttgaatg

SEQ ID NO: 32296 - DNA, 996 bp, Artificial Sequence
  chemically treated genomic DNA (Homo sapiens) CpG-island No: 32296
  misc_feature (453)..(453): n is either a, c, g or t
cattcaacgttaaccaccgcgtacgacgttaactaacaacaaaaaccttacgaacaactaaccgtaattaccaacgttactacttccgttacgcataaaaaacgcgcttttaaacgctttacgcaacataacccgctaacgatattaccgatatctaacgaacgctattcgctaatctaatatcatccactaaaacgacgcgaaaaaatattatcgtaaaataacgaaaaattttaccgtaaactccaatcgacctttaactaacgacttaaaaaaattacccacgctaataaacgcaatacttatccgctaacgttaacccacgccgccaaatctattacccatcgtaccgtactaataaacaatacgacgcaaactctacacccgattaccgaacaaaaatttaacctcgatatacgaaatataataaatcttacgaaaaccctaactcanacgcaaaaacgcgaaaaaaacataaaaaattacgacgtattataccgttatcaacaacgtcgacaaaacgatcgcgaaacaaccattaacgtcacgaacaaccttatacatctttttaccaacccgtaaacaccgcttatttatcgacgcaacatcgaactaataacgataaaattattcacccccgcacgcgatatactatcgcaacgcaccctcgattaaataacgcgttaaaaacgattttaaaaaataaacaatacaaaatattaatataaccattattaacgacgacataataaaactaacgattacctataacttacaaaaaaacgacttacgcgttaccgtactaaaacaacgcgtacaaaaacctctaacgacgaatacaccaccacaactacgcgtttcgactatcaataccgccaacgaaaaattactcacccgtcttaacgtctaacaaaacattctctctcgtaaaaccaactattatcacgatataaaaatataaaacaaaaacaactttaatcacatttcgtttaacga

SEQ ID NO: 32297 - DNA, 583 bp, Artificial Sequence
  chemically treated genomic DNA (Homo sapiens) CpG-island No: 32297
tttagttattggtcgatcgtcggttttatttcgttaaataggttgggcgtaatcgggtattcgcgagcgataacgtttaacgggcggagaaaaaatggtttagttttttacgttattttttcggttttttacgttgcgttcgttagacgcgggtcggatttttattatgtagatgtatttttttacgatttagtttttttataattatcgcgtaatttattatttttagtatgggcgtatcgtttggtttatcgtttaggttaagtgtggttgggcgtttgtttgataattgttgataggtcgcgataatttagttggtagtttgatttttttcggtagaagtatttagtacgtgttagatgcgcgtattttgtataaattgtaagtttagttcgtttagacgagcggtaaattgtgttatacgttcgttattgtcgcgttagattagcgttatcgacgttttatgaagttgcgttagcgtcgtttggttacggtttaatttcgtttattcggcgacggttgtatcgtcgatattattaaaagtcgcgaatttataacgttttttttcgcgtagcgtatttaa

SEQ ID NO: 32298 - DNA, 583 bp, Artificial Sequence
  chemically treated genomic DNA (Homo sapiens) CpG-island No: 32298
ttaaatacgctacgcgaaaaaaaacgttataaattcgcgacttttaataatatcgacgatacaaccgtcgccgaataaacgaaattaaaccgtaaccaaacgacgctaacgcaacttcataaaacgtcgataacgctaatctaacgcgacaataacgaacgtataacacaatttaccgctcgtctaaacgaactaaacttacaatttatacaaaatacgcgcatctaacacgtactaaatacttctaccgaaaaaaatcaaactaccaactaaattatcgcgacctatcaacaattatcaaacaaacgcccaaccacacttaacctaaacgataaaccaaacgatacgcccatactaaaaataataaattacgcgataattataaaaaaactaaatcgtaaaaaaatacatctacataataaaaatccgacccgcgtctaacgaacgcaacgtaaaaaaccgaaaaaataacgtaaaaaactaaaccattttttctccgcccgttaaacgttatcgctcgcgaatacccgattacgcccaacctatttaacgaaataaaaccgacgatcgaccaataactaaa

SEQ ID NO: 32299 - DNA, 583 bp, Artificial Sequence
  chemically treated genomic DNA (Homo sapiens) CpG-island No: 32299
ttaaatacgttacgcgagaaagaacgttgtaaattcgcgatttttgatgatgtcggcgatgtagtcgtcgtcgaatggacgggattaagtcgtagttaggcggcgttgacgtagttttatgaggcgtcggtaacgttaatttggcgcgatagtgacgagcgtatggtataatttatcgttcgtttgaacgaattgggtttatagtttatgtagggtgcgcgtatttggtacgtattggatgtttttgtcggaaaagattaggttgttaattggattatcgcgatttattaataattgttaggtaaacgtttaattatatttggtttgggcgatgggttaaacgatgcgtttatattggaggtaatggattacgcggtgattgtgaaagggttaaatcgtgaaggggtgtatttgtatgatgaggattcggttcgcgtttggcgaacgtagcgtgaaggatcggaaggatggcgtgaagggttggattatttttttttcgttcgttaagcgttatcgttcgcgaatattcgattacgtttagtttgtttagcgagataaagtcgacggtcggttagtgattgga

SEQ ID NO: 32300 - DNA, 583 bp, Artificial Sequence
  chemically treated genomic DNA (Homo sapiens) CpG-island No: 32300
tccaatcactaaccgaccgtcgactttatctcgctaaacaaactaaacgtaatcgaatattcgcgaacgataacgcttaacgaacgaaaaaaaaataatccaacccttcacgccatccttccgatccttcacgctacgttcgccaaacgcgaaccgaatcctcatcatacaaatacaccccttcacgatttaaccctttcacaatcaccgcgtaatccattacctccaatataaacgcatcgtttaacccatcgcccaaaccaaatataattaaacgtttacctaacaattattaataaatcgcgataatccaattaacaacctaatcttttccgacaaaaacatccaatacgtaccaaatacgcgcaccctacataaactataaacccaattcgttcaaacgaacgataaattataccatacgctcgtcactatcgcgccaaattaacgttaccgacgcctcataaaactacgtcaacgccgcctaactacgacttaatcccgtccattcgacgacgactacatcgccgacatcatcaaaaatcgcgaatttacaacgttctttctcgcgtaacgtatttaa

SEQ ID NO: 32301 - DNA, 600 bp, Artificial Sequence
  chemically treated genomic DNA (Homo sapiens) CpG-island No: 32301
taggtggcggcgatttgtagtcgtttacggttagtaatgatatcgttatgtagacgtttaatggtttttttcgtattagttagtttttcggtgtatttggtatttagtgtagcgatattacgttgacgggtttgtatgtttttgatggtgtcgttagttaggcggagatttttggtggttttgtcgcgttggtttttgtaggtgatggcgttgtcgcggtagtggttaatggtttaggttatggaaattagtaggtagataacgatagcgtagatgattgcggttaatcggtttatttttggttttattcgtagattttacgtttaatttcgcgtcgggtgattagttttttttattgtttgtcgttagtataagtttagcgttgtagttttttatacgtattcggaatattatcggagtttagtttttttagtagcgtcgagttggtaaaagtattagagttaacgttataggtgaaggagtaaagcgcggcgtagggtttgtttagggatgcgaattttgattagcgggtcgatggcgttgttatttttcgtagatttgttttagtaggtgtttattttttgtcggttatcgggatcg

SEQ ID NO: 32302 - DNA, 600 bp, Artificial Sequence
  chemically treated genomic DNA (Homo sapiens) CpG-island No: 32302
cgatcccgataaccgacaaaaaataaacacctactaaaacaaatctacgaaaaataacaacgccatcgacccgctaatcaaaattcgcatccctaaacaaaccctacgccgcgctttactccttcacctataacgttaactctaatacttttaccaactcgacgctactaaaaaaactaaactccgataatattccgaatacgtataaaaaactacaacgctaaacttatactaacgacaaacaataaaaaaaactaatcacccgacgcgaaattaaacgtaaaatctacgaataaaaccaaaaataaaccgattaaccgcaatcatctacgctatcgttatctacctactaatttccataacctaaaccattaaccactaccgcgacaacgccatcacctacaaaaaccaacgcgacaaaaccaccaaaaatctccgcctaactaacgacaccatcaaaaacatacaaacccgtcaacgtaatatcgctacactaaataccaaatacaccgaaaaactaactaatacgaaaaaaaccattaaacgtctacataacgatatcattactaaccgtaaacgactacaaatcgccgccaccta

SEQ ID NO: 32303 - DNA, 600 bp, Artificial Sequence
  chemically treated genomic DNA (Homo sapiens) CpG-island No: 32303
cggtttcgataatcggtaaagagtggatatttgttaaggtagatttgcgaaaggtggtagcgttatcgattcgttgattaaggttcgtatttttgagtaaattttgcgtcgcgttttatttttttatttataacgttggttttggtgtttttgttagttcgacgttgttgaagaagttgaatttcggtgatgtttcgggtgcgtgtaaagaattgtagcgttggatttatgttggcggtaagtagtggaaggggttgattattcggcgcgagattgagcgtgaagtttgcgagtggggttagaaatgagtcgattaatcgtaattatttgcgttgtcgttatttgtttgttggtttttatggtttgggttattaattattatcgcgataacgttattatttataaagattagcgcgataaagttattaaaagttttcgtttggttaacgatattattaaagatatgtagattcgttagcgtgatgtcgttgtattggatgttaaatatatcggagaattggttgatgcgaaagaaattattgagcgtttgtatagcgatgttattgttggtcgtaagcggttgtaagtcgtcgttatttg

SEQ ID NO: 32304 - DNA, 600 bp, Artificial Sequence
  chemically treated genomic DNA (Homo sapiens) CpG-island No: 32304
caaataacgacgacttacaaccgcttacgaccaacaataacatcgctatacaaacgctcaataatttctttcgcatcaaccaattctccgatatatttaacatccaatacaacgacatcacgctaacgaatctacatatctttaataatatcgttaaccaaacgaaaacttttaataactttatcgcgctaatctttataaataataacgttatcgcgataataattaataacccaaaccataaaaaccaacaaacaaataacgacaacgcaaataattacgattaatcgactcatttctaaccccactcgcaaacttcacgctcaatctcgcgccgaataatcaaccccttccactacttaccgccaacataaatccaacgctacaattctttacacgcacccgaaacatcaccgaaattcaacttcttcaacaacgtcgaactaacaaaaacaccaaaaccaacgttataaataaaaaaataaaacgcgacgcaaaatttactcaaaaatacgaaccttaatcaacgaatcgataacgctaccacctttcgcaaatctaccttaacaaatatccactctttaccgattatcgaaaccg

SEQ ID NO: 32305 - DNA, 934 bp, Artificial Sequence
  chemically treated genomic DNA (Homo sapiens) CpG-island No: 32305
gtaaagtttttaagtcgattgtgagatcgggcggagtttggcgttgtaggaagaggcgatagttatagttttattgacgagttcgaggggtgaatttttcggcgggaggttcgaatttttaaatatcgggaagcggaggtgggggtcggttgggggatcggtttatcggtttttatttcggcgtatagggattttaggtttcggcgagcgttggtttagcggtttttatagcgataggtcgggcgcgcgttttcgcgcgtgcgtagtttttcgttcgttttcgggtgggcggagtaaggaatagttgggcggggacgatcgttttacgtcgcgcgggaatttttgggggtcggggttgtaggtagttgggaatcgcgggcgttaggcgcgcgtatttagtattcggttttagtcgataaatttggggtagcgcgcggtaggagttgcgggcggttaggtttttttttgcgttcgtatttggtttcgcgcgtttttttcgggcgttcggttttcggcgttttggcggttcgggtggcggcggttcgggcggtcgtttggttgtttttcggggcggcgatcgggtttacgcgcgggttcgtcgcggtttttatcgtcgcgcgttttgacgtcggtaaggggggcggggtttggggggttagagcgtgggagcggtttcggttttcgggtttttcggcgggttgcggggatgtggggattcggcgcgggatttagattagtagggcgagtcggaggaggttagatattagagtcgtgtgttttttttttttttcgtgcgttttgttttgcggcggatttcgggttttcgggagagtcgggttcgggttttgcggtttttaggttggattggtcgttttgttattaaagttttgagaaggaaagttagtcgttaagcgttttgggatgtttttgagtt

SEQ ID NO: 32306 - DNA, 934 bp, Artificial Sequence
  chemically treated genomic DNA (Homo sapiens) CpG-island No: 32306
aactcaaaaacatcccaaaacgcttaacgactaactttccttctcaaaactttaataacaaaacgaccaatccaacctaaaaaccgcaaaacccgaacccgactctcccgaaaacccgaaatccgccgcaaaacaaaacgcacgaaaaaaaaaaaaaacacacgactctaatatctaacctcctccgactcgccctactaatctaaatcccgcgccgaatccccacatccccgcaacccgccgaaaaacccgaaaaccgaaaccgctcccacgctctaaccccccaaaccccgccccccttaccgacgtcaaaacgcgcgacgataaaaaccgcgacgaacccgcgcgtaaacccgatcgccgccccgaaaaacaaccaaacgaccgcccgaaccgccgccacccgaaccgccaaaacgccgaaaaccgaacgcccgaaaaaaacgcgcgaaaccaaatacgaacgcaaaaaaaaacctaaccgcccgcaactcctaccgcgcgctaccccaaatttatcgactaaaaccgaatactaaatacgcgcgcctaacgcccgcgattcccaactacctacaaccccgacccccaaaaattcccgcgcgacgtaaaacgatcgtccccgcccaactattccttactccgcccacccgaaaacgaacgaaaaactacgcacgcgcgaaaacgcgcgcccgacctatcgctataaaaaccgctaaaccaacgctcgccgaaacctaaaatccctatacgccgaaataaaaaccgataaaccgatcccccaaccgacccccacctccgcttcccgatatttaaaaattcgaacctcccgccgaaaaattcacccctcgaactcgtcaataaaactataactatcgcctcttcctacaacgccaaactccgcccgatctcacaatcgacttaaaaactttac

SEQ ID NO: 32307 - DNA, 934 bp, Artificial Sequence
  chemically treated genomic DNA (Homo sapiens) CpG-island No: 32307
agtttaagagtattttaagacgtttgacggttgatttttttttttagaattttagtaatagggcggttagtttagtttgggaatcgtagggttcgagttcgattttttcggagattcgggattcgtcgtagagtaaagcgtacgggagggaaggagggtatacggttttagtgtttgatttttttcggttcgttttattgatttaggtttcgcgtcgggtttttatattttcgtaattcgtcgagaggttcgggagtcgggatcgtttttacgttttggttttttaagtttcgttttttttatcggcgttagagcgcgcggcggtgaaggtcgcggcgggttcgcgcgtgagttcggtcgtcgtttcgaggagtagttaggcggtcgttcgaatcgtcgttattcgagtcgttaggacgtcggaagtcggacgttcgagaggggcgcgcggggttaggtgcggacgtaggaaggggtttggtcgttcgtagtttttatcgcgcgttgttttagatttatcggttgggatcgagtgttgggtgcgcgcgtttagcgttcgcggtttttagttgtttgtagtttcggtttttaagggttttcgcgcggcgtggggcggtcgttttcgtttagttgttttttgtttcgtttattcgggggcgggcgaggagttgcgtacgcgcggggacgcgcgttcggtttgtcgttgtggaaatcgttaggttagcgttcgtcgggatttggaatttttgtacgtcgaggtgggagtcggtggatcggttttttagtcggtttttattttcgtttttcggtgtttgagggttcgggtttttcgtcggggagtttatttttcgggttcgttagtagggttgtggttgtcgtttttttttgtagcgttaggtttcgttcggttttatagtcggtttaggggttttgt

SEQ ID NO: 32308 - DNA, 934 bp, Artificial Sequence
  chemically treated genomic DNA (Homo sapiens) CpG-island No: 32308
acaaaacccctaaaccgactataaaaccgaacgaaacctaacgctacaaaaaaaaacgacaaccacaaccctactaacgaacccgaaaaataaactccccgacgaaaaacccgaaccctcaaacaccgaaaaacgaaaataaaaaccgactaaaaaaccgatccaccgactcccacctcgacgtacaaaaattccaaatcccgacgaacgctaacctaacgatttccacaacgacaaaccgaacgcgcgtccccgcgcgtacgcaactcctcgcccgcccccgaataaacgaaacaaaaaacaactaaacgaaaacgaccgccccacgccgcgcgaaaacccttaaaaaccgaaactacaaacaactaaaaaccgcgaacgctaaacgcgcgcacccaacactcgatcccaaccgataaatctaaaacaacgcgcgataaaaactacgaacgaccaaaccccttcctacgtccgcacctaaccccgcgcgcccctctcgaacgtccgacttccgacgtcctaacgactcgaataacgacgattcgaacgaccgcctaactactcctcgaaacgacgaccgaactcacgcgcgaacccgccgcgaccttcaccgccgcgcgctctaacgccgataaaaaaaacgaaacttaaaaaaccaaaacgtaaaaacgatcccgactcccgaacctctcgacgaattacgaaaatataaaaacccgacgcgaaacctaaatcaataaaacgaaccgaaaaaaatcaaacactaaaaccgtataccctccttccctcccgtacgctttactctacgacgaatcccgaatctccgaaaaaatcgaactcgaaccctacgattcccaaactaaactaaccgccctattactaaaattctaaaaaaaaaaatcaaccgtcaaacgtcttaaaatactcttaaact

SEQ ID NO: 32309 - DNA, 621 bp, Artificial Sequence
  chemically treated genomic DNA (Homo sapiens) CpG-island No: 32309
tcgcgcgggtttgtttatgggaggtggcgttcgttttcgtttcggggagtttcggtttcggggcgggaggggttttgggttttggtttcgtttcgtttcgtttttcgtcgttttttttttttagggttgtggttacgcgtagcggcggcggttgtttcgtttttttttcggttcgggtcgtcgttattgtcgaaggttttttttttttttttttttggcgtgcgtaggatttcgtcgtcgttgggtttagcggtagtagcggttgttttagcgcggcgttttttttcgtttcgttttttttttttttttttttttttttcgtatcgcgcgttagttcggggcggtttcgtagttcgtcgggagttttgatcgaggcgtttcgttggggcggggattttgttttgttcggggtaagtgtatataggtcggtcggcgcgggacgtaggtcgggtttttttttttttttttttttttcgtggtttggcgggcgggagcggttcgggacggtcgatttgtttcgcgcggggtcggggagtcgttatttgcgtgttgggagtcgtagtttttggggcggtggtttattgtttgttttttagggtcgtttttttcgttggttttagt

SEQ ID NO: 32310 - DNA, 621 bp, Artificial Sequence
  chemically treated genomic DNA (Homo sapiens) CpG-island No: 32310
actaaaaccaacgaaaaaaacgaccctaaaaaacaaacaataaaccaccgccccaaaaactacgactcccaacacgcaaataacgactccccgaccccgcgcgaaacaaatcgaccgtcccgaaccgctcccgcccgccaaaccacgaaaaaaaaaaaaaaaaaaaaaaacccgacctacgtcccgcgccgaccgacctatatacacttaccccgaacaaaacaaaatccccgccccaacgaaacgcctcgatcaaaactcccgacgaactacgaaaccgccccgaactaacgcgcgatacgaaaaaaaaaaaaaaaaaaaaaaaaaacgaaacgaaaaaaaacgccgcgctaaaacaaccgctactaccgctaaacccaacgacgacgaaatcctacgcacgccaaaaaaaaaaaaaaaaaaaaccttcgacaataacgacgacccgaaccgaaaaaaaaacgaaacaaccgccgccgctacgcgtaaccacaaccctaaaaaaaaaaaacgacgaaaaacgaaacgaaacgaaaccaaaacccaaaacccctcccgccccgaaaccgaaactccccgaaacgaaaacgaacgccacctcccataaacaaacccgcgcga

SEQ ID NO: 32311 - DNA, 621 bp, Artificial Sequence
  chemically treated genomic DNA (Homo sapiens) CpG-island No: 32311
gttaaagttagcgaagaaaacggttttggggagtagataatgagttatcgttttaggagttgcggtttttagtacgtaggtggcggtttttcggtttcgcgcggggtaggtcggtcgtttcgggtcgttttcgttcgttaggttacggagaaggaaggaggaggaagagattcggtttgcgtttcgcgtcggtcggtttgtgtgtatttatttcgggtaaggtaaggttttcgttttagcgaggcgtttcggttagagttttcggcgggttgcggagtcgtttcgggttagcgcgcggtgcggggaggggaggggagggaaggggaagcggggcgggaagagacgtcgcgttggagtagtcgttgttatcgttaggtttagcggcggcggagttttgcgtacgttagggaggggaggggagggagttttcggtaatggcgacggttcgggtcggaggggaagcggaataatcgtcgtcgttgcgcgtggttataattttgggggaggaagacggcggggagcggggcggggcggggttagaatttagaatttttttcgtttcgaagtcggagtttttcggggcggagacgagcgttattttttatgggtaggttcgcgcgg

SEQ ID NO: 32312 - DNA, 621 bp, Artificial Sequence
  chemically treated genomic DNA (Homo sapiens) CpG-island No: 32312
ccgcgcgaacctacccataaaaaataacgctcgtctccgccccgaaaaactccgacttcgaaacgaaaaaaattctaaattctaaccccgccccgccccgctccccgccgtcttcctcccccaaaattataaccacgcgcaacgacgacgattattccgcttcccctccgacccgaaccgtcgccattaccgaaaactccctcccctcccctccctaacgtacgcaaaactccgccgccgctaaacctaacgataacaacgactactccaacgcgacgtctcttcccgccccgcttccccttccctcccctcccctccccgcaccgcgcgctaacccgaaacgactccgcaacccgccgaaaactctaaccgaaacgcctcgctaaaacgaaaaccttaccttacccgaaataaatacacacaaaccgaccgacgcgaaacgcaaaccgaatctcttcctcctccttccttctccgtaacctaacgaacgaaaacgacccgaaacgaccgacctaccccgcgcgaaaccgaaaaaccgccacctacgtactaaaaaccgcaactcctaaaacgataactcattatctactccccaaaaccgttttcttcgctaactttaac

SEQ ID NO: 32313 - DNA, 506 bp, Artificial Sequence
  chemically treated genomic DNA (Homo sapiens) CpG-island No: 32313
tgagttgcgggtcgcggacgttgattttttattatttaatttcgttcgagttcgtttatttggagaagggtttcggttgtgtttcggggacgtttttacgcgggaaatatttacggttttcgtaggcgtaggcggttgcgcggggcgtatcgttttcgggggtttcggttttttcgagagtagtcgaacgcggggttgggttatttttttgttgtggggtattagattattttagtattagcggaaggaacggacggaaattgaagttatatggagagcgggttgttcggcgatttagtataggtttatttagattcggttttttagagggaagcgcggcgcgggcgcgggggtggggcgggtcgggggagcggggttcgaatatttgtcggtttagcggtcgagtagcggggatgtttagacgattttttagtaatgcgatcgaggttttttcggtttttttgcgttggtgttttggtagggttgggggcggttagttaggggtt

SEQ ID NO: 32314 - DNA, 506 bp, Artificial Sequence
  chemically treated genomic DNA (Homo sapiens) CpG-island No: 32314
aacccctaactaaccgcccccaaccctaccaaaacaccaacgcaaaaaaaccgaaaaaacctcgatcgcattactaaaaaatcgtctaaacatccccgctactcgaccgctaaaccgacaaatattcgaaccccgctcccccgacccgccccacccccgcgcccgcgccgcgcttccctctaaaaaaccgaatctaaataaacctatactaaatcgccgaacaacccgctctccatataacttcaatttccgtccgttccttccgctaatactaaaataatctaataccccacaacaaaaaaataacccaaccccgcgttcgactactctcgaaaaaaccgaaacccccgaaaacgatacgccccgcgcaaccgcctacgcctacgaaaaccgtaaatatttcccgcgtaaaaacgtccccgaaacacaaccgaaacccttctccaaataaacgaactcgaacgaaattaaataataaaaaatcaacgtccgcgacccgcaactca

SEQ ID NO: 32315 - DNA, 506 bp, Artificial Sequence
  chemically treated genomic DNA (Homo sapiens) CpG-island No: 32315
ggtttttagttggtcgtttttagttttgttaaggtattaacgtaagaaagtcgggggagtttcggtcgtattgttggaagatcgtttaaatattttcgttgttcggtcgttaggtcggtaggtgttcgggtttcgttttttcggttcgttttattttcgcgttcgcgtcgcgtttttttttaagaggtcgggtttgagtgagtttgtgttgagtcgtcgagtagttcgttttttatgtgattttagttttcgttcgtttttttcgttggtgttaaaataatttgatgttttatagtaaggaggtagtttagtttcgcgttcggttgttttcgaggaggtcggagttttcggagacgatgcgtttcgcgtagtcgtttgcgtttgcgggagtcgtgagtatttttcgcgtgggggcgttttcggggtatagtcggggtttttttttaggtgggcgagttcgagcgaggttgggtggtaggaggttagcgttcgcggttcgtagttta

SEQ ID NO: 32316 - DNA, 506 bp, Artificial Sequence
  chemically treated genomic DNA (Homo sapiens) CpG-island No: 32316
taaactacgaaccgcgaacgctaacctcctaccacccaacctcgctcgaactcgcccacctaaaaaaaaaccccgactataccccgaaaacgcccccacgcgaaaaatactcacgactcccgcaaacgcaaacgactacgcgaaacgcatcgtctccgaaaactccgacctcctcgaaaacaaccgaacgcgaaactaaactacctccttactataaaacatcaaattattttaacaccaacgaaaaaaacgaacgaaaactaaaatcacataaaaaacgaactactcgacgactcaacacaaactcactcaaacccgacctcttaaaaaaaaacgcgacgcgaacgcgaaaataaaacgaaccgaaaaaacgaaacccgaacacctaccgacctaacgaccgaacaacgaaaatatttaaacgatcttccaacaatacgaccgaaactcccccgactttcttacgttaataccttaacaaaactaaaaacgaccaactaaaaacc

SEQ ID NO: 32317 - DNA, 804 bp, Artificial Sequence
  chemically treated genomic DNA (Homo sapiens) CpG-island No: 32317
  misc_feature (687)..(687): n is either a, c, g or t
ttcgcgcggtatgtcgaatattacgtaatttgtttcgttttgcgtaagggtttatgttttcgtttgacgtatcgttaatattttcgtcgcgtcgtcgttgtttatatcggttaggattattttaatcgtattacgtttcgtttgtttggcgatagaatggaataatatatttatcgaaggtcgatgacggttaatcgtcgggtttatcgtgaattttgatttggtaatttgcgttattacgcgatagttttatatgtcgatcgttcggcgtaatataggtatgtttcggtaagatacgtttttcgttttcggtttttttaatttcgatttggtaaagtttattaagtttgtcggtaaaagagcgggtgaaatcgggcggtatatgttgggtaattaatagtgtcgggttggaaagcggtaacggttgtagtacgtgacgaattgttttagttttattcgttgaagtattaatcgtaattagttttttagaatttaataacggtttcgtttttagcgttgtcggtgtcgataatggtttatgtgttgtaaggttcgtttttgttgtcgtacgtatttttttagtaattatttcgttatacgttagtatattttcgcgaatattagtgcggttggtgataaaatttatcgtttttagttttagcgcgcgtagcgtgatttttgattttntgtcggttagggaagaaattattataacgggtattggacgtaaacgtattaatttttcgaggaaatttagttcgtttattcgcggtattttaatatttagcgttagtatatcgggat

SEQ ID NO: 32318 - DNA, 804 bp, Artificial Sequence
  chemically treated genomic DNA (Homo sapiens) CpG-island No: 32318
  misc_feature (118)..(118): n is either a, c, g or t
atcccgatatactaacgctaaatattaaaataccgcgaataaacgaactaaatttcctcgaaaaattaatacgtttacgtccaatacccgttataataatttcttccctaaccgacanaaaatcaaaaatcacgctacgcgcgctaaaactaaaaacgataaattttatcaccaaccgcactaatattcgcgaaaatatactaacgtataacgaaataattactaaaaaaatacgtacgacaacaaaaacgaaccttacaacacataaaccattatcgacaccgacaacgctaaaaacgaaaccgttattaaattctaaaaaactaattacgattaatacttcaacgaataaaactaaaacaattcgtcacgtactacaaccgttaccgctttccaacccgacactattaattacccaacatataccgcccgatttcacccgctcttttaccgacaaacttaataaactttaccaaatcgaaattaaaaaaaccgaaaacgaaaaacgtatcttaccgaaacatacctatattacgccgaacgatcgacatataaaactatcgcgtaataacgcaaattaccaaatcaaaattcacgataaacccgacgattaaccgtcatcgaccttcgataaatatattattccattctatcgccaaacaaacgaaacgtaatacgattaaaataatcctaaccgatataaacaacgacgacgcgacgaaaatattaacgatacgtcaaacgaaaacataaacccttacgcaaaacgaaacaaattacgtaatattcgacataccgcgcgaa

SEQ ID NO: 32319 - DNA, 804 bp, Artificial Sequence
  chemically treated genomic DNA (Homo sapiens) CpG-island No: 32319
  misc_feature (118)..(118): n is either a, c, g or t
atttcgatgtgttgacgttggatgttgaaatgtcgcggatggacggattggattttttcgaaaaattaatgcgtttgcgtttaatgttcgttgtgatggttttttttttgatcggtanagggttagaagttacgttgcgcgcgttggagttgggggcgatagattttgttattaatcgtattggtattcgcgaaggtatgttggcgtataacgaaatgattgttgaaaaggtgcgtacggtagtaaaggcgagttttgtagtatataagttattgtcggtatcgataacgttgaaggcggggtcgttgttgagttttgaaaaattgattgcgattggtgttttaacgggtggaattgaggtaattcgttacgtattgtaatcgttgtcgttttttagttcggtattgttaattatttagtatatgtcgttcggttttattcgtttttttgtcgatagatttaataagttttgttagatcggggttaaagaagtcgaagacggagaacgtgttttgtcggggtatgtttatattgcgtcgggcgatcggtatatggagttgtcgcgtagtggcgtaaattattaaattaaaatttacgatgggttcggcggttaatcgttatcggttttcggtagatgtgttgttttattttgtcgttaaataggcggggcgtaatgcggttggggtgattttgatcggtatgggtaacgacggcgcggcgggaatgttggcgatgcgttaggcgggggtatggatttttgcgtaaaacgaagtaagttgcgtggtgttcggtatgtcgcgcgag

SEQ ID NO: 32320 - DNA, 804 bp, Artificial Sequence
  chemically treated genomic DNA (Homo sapiens) CpG-island No: 32320
  misc_feature (687)..(687): n is either a, c, g or t
ctcgcgcgacataccgaacaccacgcaacttacttcgttttacgcaaaaatccatacccccgcctaacgcatcgccaacattcccgccgcgccgtcgttacccataccgatcaaaatcaccccaaccgcattacgccccgcctatttaacgacaaaataaaacaacacatctaccgaaaaccgataacgattaaccgccgaacccatcgtaaattttaatttaataatttacgccactacgcgacaactccatataccgatcgcccgacgcaatataaacataccccgacaaaacacgttctccgtcttcgacttctttaaccccgatctaacaaaacttattaaatctatcgacaaaaaaacgaataaaaccgaacgacatatactaaataattaacaataccgaactaaaaaacgacaacgattacaatacgtaacgaattacctcaattccacccgttaaaacaccaatcgcaatcaatttttcaaaactcaacaacgaccccgccttcaacgttatcgataccgacaataacttatatactacaaaactcgcctttactaccgtacgcaccttttcaacaatcatttcgttatacgccaacataccttcgcgaataccaatacgattaataacaaaatctatcgcccccaactccaacgcgcgcaacgtaacttctaaccctntaccgatcaaaaaaaaaaccatcacaacgaacattaaacgcaaacgcattaatttttcgaaaaaatccaatccgtccatccgcgacatttcaacatccaacgtcaacacatcgaaat

SEQ ID NO: 32321 - DNA, 693 bp, Artificial Sequence
  chemically treated genomic DNA (Homo sapiens) CpG-island No: 32321
  misc_feature (240)..(240): n is either a, c, g or t
tgataggttatcgtacgatgttgttaggcgttcggttgtcgttgttcggtttgaagttatgtatataacgttatatcgggtagcgtgtttcgatatattttgttagacggttttaggcggcggtatcgtaggaaggcgatatatcgtttagtaagcgaattattgtcgggtaattatttgtaatattcggtaattgattttgttattgacgttgtttcgttagcggtaagggtttcgatnaaatcgttattttcgtcggcgttgttaggtaaggatgattttttagtagagacgttagtcgcgttattaaagtttggttgatacgcgtatcgttttggaaaggatagcgttgtagtaataaatcggtagtttcgcgtggattgttcgttttgtattagttgttaggttagttgatttaggcgggtaagatttgtcggtttttgttgatatagtaatcgtgttagacgtagagttttagttttgttacgggtcgttacgttgatagtataacgttttttaagtattttattggcggggagggtggcgagtagtttttgcgttgcgtcgtattgatttttttttaatagtatcggtagcgtcgcgttaataatatattggcggttgtcggtaaattgtatcgtataattcgttaacgtttgaacggggttagcgttgtatttagataatagatag

SEQ ID NO: 32322 - DNA, 693 bp, Artificial Sequence
  chemically treated genomic DNA (Homo sapiens) CpG-island No: 32322
  misc_feature (454)..(454): n is either a, c, g or t
ctatctattatctaaatacaacgctaaccccgttcaaacgttaacgaattatacgatacaatttaccgacaaccgccaatatattattaacgcgacgctaccgatactattaaaaaaaaatcaatacgacgcaacgcaaaaactactcgccaccctccccgccaataaaatacttaaaaaacgttatactatcaacgtaacgacccgtaacaaaactaaaactctacgtctaacacgattactatatcaacaaaaaccgacaaatcttacccgcctaaatcaactaacctaacaactaatacaaaacgaacaatccacgcgaaactaccgatttattactacaacgctatcctttccaaaacgatacgcgtatcaaccaaactttaataacgcgactaacgtctctactaaaaaatcatccttacctaacaacgccgacgaaaataacgatttnatcgaaacccttaccgctaacgaaacaacgtcaataacaaaatcaattaccgaatattacaaataattacccgacaataattcgcttactaaacgatatatcgccttcctacgataccgccgcctaaaaccgtctaacaaaatatatcgaaacacgctacccgatataacgttatatacataacttcaaaccgaacaacgacaaccgaacgcctaacaacatcgtacgataacctatca

SEQ ID NO: 32323 - DNA, 693 bp, Artificial Sequence
  chemically treated genomic DNA (Homo sapiens) CpG-island No: 32323
  misc_feature (454)..(454): n is either a, c, g or t
ttatttgttatttaaatatagcgttaatttcgtttaggcgttggcgaattatacggtatagtttgtcgataatcgttagtatgttgttggcgcgacgttatcggtgttgttaaaagaaggttagtacgacgtagcgtaaaaattgttcgttatttttttcgttaatgaaatgtttgaggagcgttatgttgttagcgtggcgattcgtaataaggttgaagttttgcgtttggtacgattgttgtattagtaagaatcggtaaattttattcgtttggattaattaatttggtaattgatgtagaacgagtagtttacgcgaagttgtcgatttattgttgtaacgttattttttttagggcgatgcgcgtgttagttagattttaatggcgcgattggcgtttttgttggaaagttatttttatttggtaacgtcggcgaaggtggcgatttnatcgaaatttttatcgttggcggagtaacgttagtggtaaagttagttgtcgggtattgtagataattgttcggtaatagttcgtttgttgggcgatatgtcgtttttttacgatgtcgtcgtttggaatcgtttggtaaagtgtatcgggatacgttattcggtgtggcgttgtatgtatggttttaggtcgaataacgataatcgagcgtttggtaatatcgtgcggtagtttatta

SEQ ID NO: 32324 - DNA, 693 bp, Artificial Sequence
  chemically treated genomic DNA (Homo sapiens) CpG-island No: 32324
  misc_feature (240)..(240): n is either a, c, g or t
taataaactaccgcacgatattaccaaacgctcgattatcgttattcgacctaaaaccatacatacaacgccacaccgaataacgtatcccgatacactttaccaaacgattccaaacgacgacatcgtaaaaaaacgacatatcgcccaacaaacgaactattaccgaacaattatctacaatacccgacaactaactttaccactaacgttactccgccaacgataaaaatttcgatnaaatcgccaccttcgccgacgttaccaaataaaaataactttccaacaaaaacgccaatcgcgccattaaaatctaactaacacgcgcatcgccctaaaaaaaataacgttacaacaataaatcgacaacttcgcgtaaactactcgttctacatcaattaccaaattaattaatccaaacgaataaaatttaccgattcttactaatacaacaatcgtaccaaacgcaaaacttcaaccttattacgaatcgccacgctaacaacataacgctcctcaaacatttcattaacgaaaaaaataacgaacaatttttacgctacgtcgtactaaccttcttttaacaacaccgataacgtcgcgccaacaacatactaacgattatcgacaaactataccgtataattcgccaacgcctaaacgaaattaacgctatatttaaataacaaataa

SEQ ID NO: 32325 - DNA, 577 bp, Artificial Sequence
  chemically treated genomic DNA (Homo sapiens) CpG-island No: 32325
  misc_feature (535)..(535): n is either a, c, g or t
tagcgttagtttcgaggtcggaatcgggtcgtaatttataatcgatgggttataattaacgatcgttatcgaacgtatacgagcgcgcggtttaagatttaatttatgggcgcggtttttatttattattagtatggtagttgcgttatcggaaagtgtagaagatgtgttcgtcgttattatatcgtttattggattaaacgtcggacgtagcgtggcgagggtttttacggtggttttcgggcgaattatttcgtcgtaattaaattgttttaggacgtcgtcggtatcgtgattatcggtcgggatgattttatttttaaatgcggtcgattgcgtggcggtttaggcgcgggcgtgtgatcgcgcggtaaaggtattttgtattttacggttgatatcgtgtatacgcgttagtatttttgtcgttaagtttattatgttcgtcgttttggcgatattgcggtttaggtcggggtgaaaatcgacgttcgtgatttatcggtatatgtgtttatatgtttttacgtcgttnattagatattttttgcgtatcgttcgttatgattattcggtg

SEQ ID NO: 32326 - DNA, 577 bp, Artificial Sequence
  chemically treated genomic DNA (Homo sapiens) CpG-island No: 32326
  misc_feature (43)..(43): n is either a, c, g or t
caccgaataatcataacgaacgatacgcaaaaaatatctaatnaacgacgtaaaaacatataaacacatataccgataaatcacgaacgtcgattttcaccccgacctaaaccgcaatatcgccaaaacgacgaacataataaacttaacgacaaaaatactaacgcgtatacacgatatcaaccgtaaaatacaaaatacctttaccgcgcgatcacacgcccgcgcctaaaccgccacgcaatcgaccgcatttaaaaataaaatcatcccgaccgataatcacgataccgacgacgtcctaaaacaatttaattacgacgaaataattcgcccgaaaaccaccgtaaaaaccctcgccacgctacgtccgacgtttaatccaataaacgatataataacgacgaacacatcttctacactttccgataacgcaactaccatactaataataaataaaaaccgcgcccataaattaaatcttaaaccgcgcgctcgtatacgttcgataacgatcgttaattataacccatcgattataaattacgacccgattccgacctcgaaactaacgcta

SEQ ID NO: 32327 - DNA, 577 bp, Artificial Sequence
  chemically treated genomic DNA (Homo sapiens) CpG-island No: 32327
  misc_feature (43)..(43): n is either a, c, g or t
tatcgaatgattatgacgggcgatgcgtaaggaatgtttggtnggcggcgtggagatatatgggtatatgtgtcgatgagttacgggcgtcgatttttatttcggtttgagtcgtaatgtcgttaaagcggcgggtatgatgggtttaacggtagaaatgttggcgcgtatgtacggtattagtcgtgaaatgtaggatgtttttgtcgcgcggttatacgttcgcgtttgggtcgttacgtagtcggtcgtatttaaaaatgaaattatttcgatcggtggttacgatgtcgacggcgttttgaagtagtttaattacgacgaagtgattcgttcggaaattatcgtggaagttttcgttacgttgcgttcggcgtttgatttagtaaacggtatggtaacggcgggtatattttttgtatttttcgatggcgtagttgttatgttggtgatgagtgaaagtcgcgtttatgaattaggttttaagtcgcgcgttcgtgtgcgttcgatggcggtcgttggttgtgatttatcgattatgggttacggttcggtttcggtttcgaaattggcgttg

SEQ ID NO: 32328 - DNA, 577 bp, Artificial Sequence
  chemically treated genomic DNA (Homo sapiens) CpG-island No: 32328
  misc_feature (535)..(535): n is either a, c, g or t
caacgccaatttcgaaaccgaaaccgaaccgtaacccataatcgataaatcacaaccaacgaccgccatcgaacgcacacgaacgcgcgacttaaaacctaattcataaacgcgactttcactcatcaccaacataacaactacgccatcgaaaaatacaaaaaatatacccgccgttaccataccgtttactaaatcaaacgccgaacgcaacgtaacgaaaacttccacgataatttccgaacgaatcacttcgtcgtaattaaactacttcaaaacgccgtcgacatcgtaaccaccgatcgaaataatttcatttttaaatacgaccgactacgtaacgacccaaacgcgaacgtataaccgcgcgacaaaaacatcctacatttcacgactaataccgtacatacgcgccaacatttctaccgttaaacccatcatacccgccgctttaacgacattacgactcaaaccgaaataaaaatcgacgcccgtaactcatcgacacatatacccatatatctccacgccgccnaccaaacattccttacgcatcgcccgtcataatcattcgata

SEQ ID NO: 32329 - DNA, 628 bp, Artificial Sequence
  chemically treated genomic DNA (Homo sapiens) CpG-island No: 32329
ggtatcgttttgggtaatgttaagtttattcgttagcgatttttcgatttttataaattgttttggttgtaaaatcgcgtttaatagcgcgtgtttggtttagtagtggaagtgttcggttagacgataggtggtttcgatatacgggaatttatcggttttatttaatgtttcggcgtcgtttttaaagatacgtgtagtcgggttcgagataacgtttggatgtagcgggttagtttttagcggcgttttaaacggttcgtagtgtttcgggaacggatttttcgttattttatcgagggtaaatagacgttttatgtttttttgttgtatgataaacggttcgacgtcgttattcggaggcgttgcgttgtagttcggaatattttagtcggtttatttagtgtcgttttattttagtaattgacgtttcggattttacgggttattttgcggatttgcggaggcgcggttatatagaatgcggcggttaagcggttatgtttatgtttagtttagcgtgttatcgaggttagacggatcggcgttattacggcgtgttatttggttgtttttcggcgttagttatcggcgaaaatttaggtagtataggagttgttcgttatcg

SEQ ID NO: 32330 - DNA, 628 bp, Artificial Sequence
  chemically treated genomic DNA (Homo sapiens) CpG-island No: 32330
cgataacgaacaactcctatactacctaaattttcgccgataactaacgccgaaaaacaaccaaataacacgccgtaataacgccgatccgtctaacctcgataacacgctaaactaaacataaacataaccgcttaaccgccgcattctatataaccgcgcctccgcaaatccgcaaaataacccgtaaaatccgaaacgtcaattactaaaataaaacgacactaaataaaccgactaaaatattccgaactacaacgcaacgcctccgaataacgacgtcgaaccgtttatcatacaacaaaaaaacataaaacgtctatttaccctcgataaaataacgaaaaatccgttcccgaaacactacgaaccgtttaaaacgccgctaaaaactaacccgctacatccaaacgttatctcgaacccgactacacgtatctttaaaaacgacgccgaaacattaaataaaaccgataaattcccgtatatcgaaaccacctatcgtctaaccgaacacttccactactaaaccaaacacgcgctattaaacgcgattttacaaccaaaacaatttataaaaatcgaaaaatcgctaacgaataaacttaacattacccaaaacgatacc

SEQ ID NO: 32331 - DNA, 628 bp, Artificial Sequence
  chemically treated genomic DNA (Homo sapiens) CpG-island No: 32331
cgatgacggataatttttgtgttgtttggattttcgtcggtagttgacgtcggaaggtaattagatggtacgtcgtgataacgtcgattcgtttggtttcggtaatacgttgggttgggtatgggtatggtcgtttaatcgtcgtattttgtataatcgcgttttcgtagattcgtagggtaattcgtgggattcgaagcgttagttgttgaaatgggacggtattaagtggatcggttgggatatttcggattatagcgtagcgttttcgggtagcggcgtcgggtcgtttattatgtagtaggaaggtatggggcgtttgtttgttttcgataagatggcggaaggttcgttttcggaatattacgagtcgtttgaaacgtcgttgggaattaattcgttgtatttaaacgttatttcgaattcggttgtacgtatttttaaagacgacgtcgaagtattgggtaaagtcgataagttttcgtatgtcggaattatttatcgtttgatcgagtatttttattattggattaaatacgcgttgttgaacgcgattttgtagttagagtagtttgtggaaatcggggagtcgttggcgaataaatttggtattgtttagggcgatatt

SEQ ID NO: 32332 - DNA, 628 bp, Artificial Sequence
  chemically treated genomic DNA (Homo sapiens) CpG-island No: 32332
aatatcgccctaaacaataccaaatttattcgccaacgactccccgatttccacaaactactctaactacaaaatcgcgttcaacaacgcgtatttaatccaataataaaaatactcgatcaaacgataaataattccgacatacgaaaacttatcgactttacccaatacttcgacgtcgtctttaaaaatacgtacaaccgaattcgaaataacgtttaaatacaacgaattaattcccaacgacgtttcaaacgactcgtaatattccgaaaacgaaccttccgccatcttatcgaaaacaaacaaacgccccataccttcctactacataataaacgacccgacgccgctacccgaaaacgctacgctataatccgaaatatcccaaccgatccacttaataccgtcccatttcaacaactaacgcttcgaatcccacgaattaccctacgaatctacgaaaacgcgattatacaaaatacgacgattaaacgaccatacccatacccaacccaacgtattaccgaaaccaaacgaatcgacgttatcacgacgtaccatctaattaccttccgacgtcaactaccgacgaaaatccaaacaacacaaaaattatccgtcatcg

SEQ ID NO: 32333 - DNA, 575 bp, Artificial Sequence
  chemically treated genomic DNA (Homo sapiens) CpG-island No: 32333
  misc_feature (99)..(99): n is either a, c, g or t
ttcgacggtagtcgtttttttcgtaaattaggttattttaagcggatcgggtgttatacgttattttttagtaatggttttcgttatataacgttgttngcgtttaatgtcgtgatgtaggaattttgcgttttcgcgtatggttttgttgatttttttagcggcgatattatcggtataaggggttagtagtttcgtagggtcgaattttgttagatttgttagcgtaacgaagttttgtattatttgaatatcgtttgtatttttagtttattatgcgaattagtgcggtaagttgttggcgatcgcgaagtttcggtaatatattggcgtaggcgaaacggtgtagtagtatcgtttgtttattcgtttagtatattaatttggcgtttcgttggaaattattttaagggaaaattaatgacgtcgaaaagtttttatttttacgcgtaatattttatttagtagacgcgagcgggtcgtttttagcgcgggtgagcgatataggaaggtgttgagtagatttttaatttttgtcgttattaaaggtttaaaaggtattttcggttttttgt

SEQ ID NO: 32334 - DNA, 575 bp, Artificial Sequence
  chemically treated genomic DNA (Homo sapiens) CpG-island No: 32334
  misc_feature (477)..(477): n is either a, c, g or t
acaaaaaaccgaaaataccttttaaacctttaataacgacaaaaattaaaaatctactcaacaccttcctatatcgctcacccgcgctaaaaacgacccgctcgcgtctactaaataaaatattacgcgtaaaaataaaaacttttcgacgtcattaattttcccttaaaataatttccaacgaaacgccaaattaatatactaaacgaataaacaaacgatactactacaccgtttcgcctacgccaatatattaccgaaacttcgcgatcgccaacaacttaccgcactaattcgcataataaactaaaaatacaaacgatattcaaataatacaaaacttcgttacgctaacaaatctaacaaaattcgaccctacgaaactactaaccccttataccgataatatcgccgctaaaaaaatcaacaaaaccatacgcgaaaacgcaaaattcctacatcacgacattaaacgcnaacaacgttatataacgaaaaccattactaaaaaataacgtataacacccgatccgcttaaaataacctaatttacgaaaaaaacgactaccgtcgaa

SEQ ID NO: 32335 - DNA, 575 bp, Artificial Sequence
  chemically treated genomic DNA (Homo sapiens) CpG-island No: 32335
  misc_feature (477)..(477): n is either a, c, g or t
ataggagatcggaaatgttttttaaatttttagtgacggtaggaattgaaagtttgtttaatatttttttgtatcgtttattcgcgttgaaaacggttcgttcgcgtttgttgggtaaagtattgcgcgtggaggtaaaggtttttcgacgttattgatttttttttggggtggtttttagcgaaacgttaggttgatgtattgggcgaatgggtaggcgatgttattgtatcgtttcgtttacgttagtgtgttgtcgaaatttcgcgatcgttagtagtttatcgtattgattcgtatggtgagttggaagtgtaggcgatatttaggtggtgtaaaatttcgttgcgttggtagatttggtagagttcgattttgcggaattgttggttttttatatcggtgatatcgtcgttgaaggaattagtaaagttatgcgcggaggcgtaaagtttttgtattacggtattaagcgtnagtaacgttatgtggcggaagttattattgaagagtggcgtatggtattcggttcgtttgaagtggtttggtttgcggaagagacggttgtcgtcgag

SEQ ID NO: 32336 - DNA, 575 bp, Artificial Sequence
  chemically treated genomic DNA (Homo sapiens) CpG-island No: 32336
  misc_feature (99)..(99): n is either a, c, g or t
ctcgacgacaaccgtctcttccgcaaaccaaaccacttcaaacgaaccgaataccatacgccactcttcaataataacttccgccacataacgttactnacgcttaataccgtaatacaaaaactttacgcctccgcgcataactttactaattccttcaacgacgatatcaccgatataaaaaaccaacaattccgcaaaatcgaactctaccaaatctaccaacgcaacgaaattttacaccacctaaatatcgcctacacttccaactcaccatacgaatcaatacgataaactactaacgatcgcgaaatttcgacaacacactaacgtaaacgaaacgatacaataacatcgcctacccattcgcccaatacatcaacctaacgtttcgctaaaaaccaccccaaaaaaaaatcaataacgtcgaaaaacctttacctccacgcgcaatactttacccaacaaacgcgaacgaaccgttttcaacgcgaataaacgatacaaaaaaatattaaacaaactttcaattcctaccgtcactaaaaatttaaaaaacatttccgatctcctat

SEQ ID NO: 32337 - DNA, 533 bp, Artificial Sequence
  chemically treated genomic DNA (Homo sapiens) CpG-island No: 32337
aaggttttcgtgtcgggtggtatttgagtttttaggtagtttaagcgcgagtcgagtagaatcgcggcgatgttttgtcgggagggggcgtcgttagggtttcgggaggttttggtagggcgttttcgacgtttgtttagttttgttttgggatttattttttagttcgaatttgtaaaattttttcgttacgtttcgaattagggcgggcggtttcgtgttacgttttcgttggcgttttagacgtcgtataaggtcgtagattacgttgtttagggtttcggcgtagcgggcggtcgtttgaggtcggaggaggagcggggttaggagattgcggagtttttgttatttttcgttttttttgtagggttgaggagagagtgcgtatcgggaaggtggggacggttcgacgggattggttgtagtgaaggagcgcgttcggttgcggtggttaggagagggattgcgtttgtttttttggggtacggaaatttgtatcggtttgcgtttgttttttagtttttttttttttt

SEQ ID NO: 32338 - DNA, 533 bp, Artificial Sequence
  chemically treated genomic DNA (Homo sapiens) CpG-island No: 32338
aaaaaaaaaaaaaactaaaaaacaaacgcaaaccgatacaaatttccgtaccccaaaaaaacaaacgcaatccctctcctaaccaccgcaaccgaacgcgctccttcactacaaccaatcccgtcgaaccgtccccaccttcccgatacgcactctctcctcaaccctacaaaaaaaacgaaaaataacaaaaactccgcaatctcctaaccccgctcctcctccgacctcaaacgaccgcccgctacgccgaaaccctaaacaacgtaatctacgaccttatacgacgtctaaaacgccaacgaaaacgtaacacgaaaccgcccgccctaattcgaaacgtaacgaaaaaattttacaaattcgaactaaaaaataaatcccaaaacaaaactaaacaaacgtcgaaaacgccctaccaaaacctcccgaaaccctaacgacgccccctcccgacaaaacatcgccgcgattctactcgactcgcgcttaaactacctaaaaactcaaataccacccgacacgaaaacctt

SEQ ID NO: 32339 - DNA, 533 bp, Artificial Sequence
  chemically treated genomic DNA (Homo sapiens) CpG-island No: 32339
aaagaggaagggggttggaagataggcgtaggtcggtgtaggttttcgtattttaagggggtagacgtaattttttttttggttatcgtagtcgaacgcgtttttttattgtagttagtttcgtcgagtcgtttttattttttcgatgcgtattttttttttaattttgtagggaaggcgaagaatggtaaaggtttcgtagttttttggtttcgtttttttttcggttttaagcggtcgttcgttacgtcggaattttgaataacgtagtttgcgattttgtgcggcgtttgaggcgttagcggggacgtggtacggggtcgttcgttttggttcgggacgtggcgggggaattttataagttcggattggaaggtgagttttaggatagagttgggtaggcgtcgggggcgttttattagagtttttcggaattttgacggcgttttttttcgataaggtatcgtcgcggttttgttcggttcgcgtttgggttgtttggaggtttaagtgttattcgatacggagatttt

SEQ ID NO: 32340 - DNA, 533 bp, Artificial Sequence
  chemically treated genomic DNA (Homo sapiens) CpG-island No: 32340
aaaatctccgtatcgaataacacttaaacctccaaacaacccaaacgcgaaccgaacaaaaccgcgacgataccttatcgaaaaaaaacgccgtcaaaattccgaaaaactctaataaaacgcccccgacgcctacccaactctatcctaaaactcaccttccaatccgaacttataaaattcccccgccacgtcccgaaccaaaacgaacgaccccgtaccacgtccccgctaacgcctcaaacgccgcacaaaatcgcaaactacgttattcaaaattccgacgtaacgaacgaccgcttaaaaccgaaaaaaaaacgaaaccaaaaaactacgaaacctttaccattcttcgccttccctacaaaattaaaaaaaaaatacgcatcgaaaaaataaaaacgactcgacgaaactaactacaataaaaaaacgcgttcgactacgataaccaaaaaaaaaattacgtctacccccttaaaatacgaaaacctacaccgacctacgcctatcttccaacccccttcctcttt

SEQ ID NO: 32341 - DNA, 693 bp, Artificial Sequence
  chemically treated genomic DNA (Homo sapiens) CpG-island No: 32341
gagcgcgcgcgtgtttacggttttaggagcgcggcgagcgggcgagggcgcgcgcggaggggcggagcgcggggttaagaggaggcgggtaggttggtgggttgggcgggcggcgagcggtcgggaagcgcgcggtggattcggtcgcggcgagtagttagttagttgttgttagttagtgttagttgttcggcggcggcggtcgtggttattaggaaggggacgggacggacggtgatggtggtcgtcgcggcggcgtgtgcgttttttaggtaatagcggttcggttgttcgtattcgttcggttgttttttatttacgcgtcgtttgtgggattagggttgtcgcgggttgagggcgttgattcgggggaattcgggcggggcggcgcgggtattgggtggcggcgcgggttttgggtggcgtcgcgtcggggtttttgcgttcggttcgtttcgttcgggcggttattagtttttcggttattttcgcgtttcgtcggtgtcgcgcgttttttgtcggttttgttttttttttcggcggcggttttggagcgcgacgtttttagaggaaggaaagttgggatttgtcgcgaggacgttttcgggtcgggttgggaggttgcgggggaaagtgaagtttggaggagttggacgcggggaggtcggggtaggaggggtttttttggttttt

SEQ ID NO: 32342 - DNA, 693 bp, Artificial Sequence
  chemically treated genomic DNA (Homo sapiens) CpG-island No: 32342
aaaaaccaaaaaaacccctcctaccccgacctccccgcgtccaactcctccaaacttcactttcccccgcaacctcccaacccgacccgaaaacgtcctcgcgacaaatcccaactttccttcctctaaaaacgtcgcgctccaaaaccgccgccgaaaaaaaaaacaaaaccgacaaaaaacgcgcgacaccgacgaaacgcgaaaataaccgaaaaactaataaccgcccgaacgaaacgaaccgaacgcaaaaaccccgacgcgacgccacccaaaacccgcgccgccacccaatacccgcgccgccccgcccgaattcccccgaatcaacgccctcaacccgcgacaaccctaatcccacaaacgacgcgtaaataaaaaacaaccgaacgaatacgaacaaccgaaccgctattacctaaaaaacgcacacgccgccgcgacgaccaccatcaccgtccgtcccgtccccttcctaataaccacgaccgccgccgccgaacaactaacactaactaacaacaactaactaactactcgccgcgaccgaatccaccgcgcgcttcccgaccgctcgccgcccgcccaacccaccaacctacccgcctcctcttaaccccgcgctccgcccctccgcgcgcgccctcgcccgctcgccgcgctcctaaaaccgtaaacacgcgcgcgctc

SEQ ID NO: 32343 - DNA, 693 bp, Artificial Sequence
  chemically treated genomic DNA (Homo sapiens) CpG-island No: 32343
aggagttagagaagttttttttgtttcggttttttcgcgtttagtttttttaggttttattttttttcgtaattttttagttcggttcgggggcgttttcgcggtaggttttaatttttttttttttgggggcgtcgcgttttagggtcgtcgtcgagggagggggtagggtcggtagggggcgcgcggtatcggcggggcgcgggggtggtcggggagttagtagtcgttcgggcgggacgaatcgagcgtaagagtttcggcgcggcgttatttagaattcgcgtcgttatttagtattcgcgtcgtttcgttcggattttttcgggttagcgtttttaattcgcggtaattttggttttatagacggcgcgtgagtagaagataatcgagcggatgcggatagtcgggtcgttgttatttgaggggcgtatacgtcgtcgcggcgattattattatcgttcgtttcgttttttttttggtgattacggtcgtcgtcgtcgagtaattgatattgattaataataattaattaattattcgtcgcggtcgagtttatcgcgcgtttttcggtcgttcgtcgttcgtttagtttattagtttgttcgtttttttttggtttcgcgtttcgttttttcgcgcgcgttttcgttcgttcgtcgcgtttttggagtcgtgagtacgcgcgcgttt

SEQ ID NO: 32344 - DNA, 693 bp, Artificial Sequence
  chemically treated genomic DNA (Homo sapiens) CpG-island No: 32344
aaacgcgcgcgtactcacgactccaaaaacgcgacgaacgaacgaaaacgcgcgcgaaaaaacgaaacgcgaaaccaaaaaaaaacgaacaaactaataaactaaacgaacgacgaacgaccgaaaaacgcgcgataaactcgaccgcgacgaataattaattaattattattaatcaatatcaattactcgacgacgacgaccgtaatcaccaaaaaaaaaacgaaacgaacgataataataatcgccgcgacgacgtatacgcccctcaaataacaacgacccgactatccgcatccgctcgattatcttctactcacgcgccgtctataaaaccaaaattaccgcgaattaaaaacgctaacccgaaaaaatccgaacgaaacgacgcgaatactaaataacgacgcgaattctaaataacgccgcgccgaaactcttacgctcgattcgtcccgcccgaacgactactaactccccgaccacccccgcgccccgccgataccgcgcgccccctaccgaccctaccccctccctcgacgacgaccctaaaacgcgacgcccccaaaaaaaaaaaaattaaaacctaccgcgaaaacgcccccgaaccgaactaaaaaattacgaaaaaaaataaaacctaaaaaaactaaacgcgaaaaaaccgaaacaaaaaaaacttctctaactcct

SEQ ID NO: 32345 - DNA, 653 bp, Artificial Sequence
  chemically treated genomic DNA (Homo sapiens) CpG-island No: 32345
tcgtttcgtgtgagttttcggcgtcggtttttggtttttgatttggcgtttttttcgcgtttcggtatttcggcgggcggggggcgttagttgtgcggtttcggtcggttgggcggcgcgggcggagggcgggtcgggtcgggggcgttttcgcgagtggagttagtttgtgtggttggagttgttggggcggcggggggcggcgtatttgcgggaggttcgggcgcggggacggggtcgttgtagttgcggggtcgggcggggtgcgggttttcggtttcgcgtcgcgttttcgcgggtcggtgtagttgcggcgcggggcgggttttcggtcggtgtagttgcggtggcgtttttcgggtgcggagggcggcgggttgggggagggggtttgggagtagtcgtagttgtagtggcgttcgggacggtcgcggtttcggggatcggtgtagttgtagtggcgttcgggggagggggtcggcgggggagggggttttttcgggttggtgtagttgttcggaggtttcgggggttcgcgcgtcgcggtatcggggaagcggtagtaattatttttttttcgttggttgttttttacgattttttttttgttgttgtcgtgattcgggtttgtttttttttttgttgtttaaggt

SEQ ID NO: 32346 - DNA, 653 bp, Artificial Sequence
  chemically treated genomic DNA (Homo sapiens) CpG-island No: 32346
accttaaacaacaaaaaaaaaaacaaacccgaatcacgacaacaacaaaaaaaaaatcgtaaaaaacaaccaacgaaaaaaaaataattactaccgcttccccgataccgcgacgcgcgaacccccgaaacctccgaacaactacaccaacccgaaaaaaccccctcccccgccgaccccctcccccgaacgccactacaactacaccgatccccgaaaccgcgaccgtcccgaacgccactacaactacgactactcccaaaccccctcccccaacccgccgccctccgcacccgaaaaacgccaccgcaactacaccgaccgaaaacccgccccgcgccgcaactacaccgacccgcgaaaacgcgacgcgaaaccgaaaacccgcaccccgcccgaccccgcaactacaacgaccccgtccccgcgcccgaacctcccgcaaatacgccgccccccgccgccccaacaactccaaccacacaaactaactccactcgcgaaaacgcccccgacccgacccgccctccgcccgcgccgcccaaccgaccgaaaccgcacaactaacgccccccgcccgccgaaataccgaaacgcgaaaaaaacgccaaatcaaaaaccaaaaaccgacgccgaaaactcacacgaaacga

SEQ ID NO: 32347 - DNA, 653 bp, Artificial Sequence
  chemically treated genomic DNA (Homo sapiens) CpG-island No: 32347
attttaaataatagaggagaaaatagattcgggttacggtaataataaaagaaaagtcgtaagaagtagttagcgggaggagagtggttgttatcgttttttcgatgtcgcgacgcgcgagttttcggggttttcgggtaattgtattagttcgggagggttttttttttcgtcggttttttttttcgggcgttattgtagttgtatcggttttcggagtcgcggtcgtttcgggcgttattgtagttgcggttgtttttaagtttttttttttagttcgtcgtttttcgtattcgagaggcgttatcgtagttgtatcggtcgggagttcgtttcgcgtcgtagttgtatcggttcgcgggggcgcggcgcggagtcgggaattcgtatttcgttcgatttcgtagttgtagcggtttcgttttcgcgttcgggtttttcgtagatgcgtcgtttttcgtcgttttaatagttttaattatataaattaattttattcgcgggggcgttttcgattcggttcgtttttcgttcgcgtcgtttagtcggtcggggtcgtatagttggcgtttttcgttcgtcggggtgtcggggcgcggagggggcgttaggttaggggttaggggtcggcgtcggagatttatacggagcgg

SEQ ID NO: 32348 - DNA, 653 bp, Artificial Sequence
  chemically treated genomic DNA (Homo sapiens) CpG-island No: 32348
ccgctccgtataaatctccgacgccgacccctaacccctaacctaacgccccctccgcgccccgacaccccgacgaacgaaaaacgccaactatacgaccccgaccgactaaacgacgcgaacgaaaaacgaaccgaatcgaaaacgcccccgcgaataaaattaatttatataattaaaactattaaaacgacgaaaaacgacgcatctacgaaaaacccgaacgcgaaaacgaaaccgctacaactacgaaatcgaacgaaatacgaattcccgactccgcgccgcgcccccgcgaaccgatacaactacgacgcgaaacgaactcccgaccgatacaactacgataacgcctctcgaatacgaaaaacgacgaactaaaaaaaaaaacttaaaaacaaccgcaactacaataacgcccgaaacgaccgcgactccgaaaaccgatacaactacaataacgcccgaaaaaaaaaaccgacgaaaaaaaaaaccctcccgaactaatacaattacccgaaaaccccgaaaactcgcgcgtcgcgacatcgaaaaaacgataacaaccactctcctcccgctaactacttcttacgacttttcttttattattaccgtaacccgaatctattttctcctctattatttaaaat

SEQ ID NO: 32349 - DNA, 973 bp, Artificial Sequence
  chemically treated genomic DNA (Homo sapiens) CpG-island No: 32349
tagtgttgcgagtttttgaggtgcgtaattttcgtacgatcgtgggtgggaaatatcgaagttaaaatttcgttatagttttttagatgaaggcgtcgtttgattggtgatagtttggcgcgaatttgagtacgtcgaataaaggaagtgacggtagaagtcgcgtatttgacgagggtgggattatacggcgttgcgtcgcggtagtattgttttgattggttgattttttgcgatatcgttttgttagttttttgttttcgttagtgcggagggttttgtttttcgtaaagatggtcgcggaggtttttggagttaattgggagcgtagtacgcgttttttggagtatgggtagaggagataggaataagcgtacgattcgtgagtatcgattggttgaagcgagtatttcgggagttgattggtttcgtttattcgcgggaaggcgtttgtggtgttagagaaaagtagttagagcgcgtagtggcggtcgggtgttgtggtttttcgttatttttttagattcgtattttttcggtttttttgcggagaatcgtgattaagatgtggaatagtaatgatgggggtgcggggtggaggaggaagagaatcgtaggaggttttagtaagagggcgagtttagggttcgagaggcgtgtggtagcgggagaggaagggcgggacggagttggggcgtttgggggttatcgtaggaaggcgcgaggaaggttagggagattcgggtagtgtttgaaggggcgatttcgggagtttgcgggtttttcggaggcgtgggacgtggtataggtattaattttgttgtttaaaataggtggattcgaaagttatggtagttttttatacgggggagtcggcggttatacgtagttttcggggggttttggatcgttcgtatttttttaagtcgaaaagaaattagtaggttgaaaggagtatttagttttgttttat

SEQ ID NO: 32350 - DNA, 973 bp, Artificial Sequence
  chemically treated genomic DNA (Homo sapiens) CpG-island No: 32350
ataaaacaaaactaaatactcctttcaacctactaatttcttttcgacttaaaaaaatacgaacgatccaaaaccccccgaaaactacgtataaccgccgactcccccgtataaaaaactaccataactttcgaatccacctattttaaacaacaaaattaatacctataccacgtcccacgcctccgaaaaacccgcaaactcccgaaatcgccccttcaaacactacccgaatctccctaaccttcctcgcgccttcctacgataacccccaaacgccccaactccgtcccgcccttcctctcccgctaccacacgcctctcgaaccctaaactcgccctcttactaaaacctcctacgattctcttcctcctccaccccgcacccccatcattactattccacatcttaatcacgattctccgcaaaaaaaccgaaaaaatacgaatctaaaaaaataacgaaaaaccacaacacccgaccgccactacgcgctctaactacttttctctaacaccacaaacgccttcccgcgaataaacgaaaccaatcaactcccgaaatactcgcttcaaccaatcgatactcacgaatcgtacgcttattcctatctcctctacccatactccaaaaaacgcgtactacgctcccaattaactccaaaaacctccgcgaccatctttacgaaaaacaaaaccctccgcactaacgaaaacaaaaaactaacaaaacgatatcgcaaaaaatcaaccaatcaaaacaatactaccgcgacgcaacgccgtataatcccaccctcgtcaaatacgcgacttctaccgtcacttcctttattcgacgtactcaaattcgcgccaaactatcaccaatcaaacgacgccttcatctaaaaaactataacgaaattttaacttcgatatttcccacccacgatcgtacgaaaattacgcacctcaaaaactcgcaacacta

SEQ ID NO: 32351 - DNA, 973 bp, Artificial Sequence
  chemically treated genomic DNA (Homo sapiens) CpG-island No: 32351
ataaaataaaattaaatattttttttaatttattgattttttttcggtttgagaaggtgcgggcgatttaaagtttttcggggattgcgtgtagtcgtcggttttttcgtatgaggagttgttatagttttcgaatttatttgttttgaataataggattagtgtttgtgttacgttttacgttttcgagaaattcgtaggttttcggagtcgtttttttaaatattgttcgagtttttttaatttttttcgcgtttttttgcggtgatttttaaacgttttagtttcgtttcgttttttttttttcgttattatacgtttttcggattttaggttcgtttttttgttaaaattttttgcgatttttttttttttttatttcgtatttttattattattgttttatattttggttacgatttttcgtaaagaggtcgagaaggtgcgggtttgggggaatagcggaaaattatagtattcggtcgttattgcgcgttttggttatttttttttggtattataaacgttttttcgcgaatgggcggagttagttagttttcggggtgttcgttttagttaatcggtgtttacggatcgtacgtttgtttttgttttttttgtttatgttttagaaaacgcgtattgcgtttttagttggttttaaaagttttcgcggttatttttacgaagggtaaaatttttcgtattagcggaagtaaggggttggtagagcggtatcgtaagaaattaattaattagaataatattatcgcgacgtagcgtcgtgtgattttattttcgttaagtgcgcgatttttgtcgttattttttttgttcggcgtgtttaggttcgcgttaaattattattaattagacgacgtttttatttaaagggttgtagcggagttttggtttcggtgttttttatttacggtcgtgcgggaattgcgtattttagggattcgtagtatta

SEQ ID NO: 32352 - DNA, 973 bp, Artificial Sequence
  chemically treated genomic DNA (Homo sapiens) CpG-island No: 32352
taatactacgaatccctaaaatacgcaattcccgcacgaccgtaaataaaaaacaccgaaaccaaaactccgctacaaccctttaaataaaaacgtcgtctaattaataataatttaacgcgaacctaaacacgccgaacaaaaaaaataacgacaaaaatcgcgcacttaacgaaaataaaatcacacgacgctacgtcgcgataatattattctaattaattaatttcttacgataccgctctaccaaccccttacttccgctaatacgaaaaattttacccttcgtaaaaataaccgcgaaaacttttaaaaccaactaaaaacgcaatacgcgttttctaaaacataaacaaaaaaaacaaaaacaaacgtacgatccgtaaacaccgattaactaaaacgaacaccccgaaaactaactaactccgcccattcgcgaaaaaacgtttataataccaaaaaaaaataaccaaaacgcgcaataacgaccgaatactataattttccgctattcccccaaacccgcaccttctcgacctctttacgaaaaatcgtaaccaaaatataaaacaataataataaaaatacgaaataaaaaaaaaaaaaaatcgcaaaaaattttaacaaaaaaacgaacctaaaatccgaaaaacgtataataacgaaaaaaaaaaaacgaaacgaaactaaaacgtttaaaaatcaccgcaaaaaaacgcgaaaaaaattaaaaaaactcgaacaatatttaaaaaaacgactccgaaaacctacgaatttctcgaaaacgtaaaacgtaacacaaacactaatcctattattcaaaacaaataaattcgaaaactataacaactcctcatacgaaaaaaccgacgactacacgcaatccccgaaaaactttaaatcgcccgcaccttctcaaaccgaaaaaaaatcaataaattaaaaaaaatatttaattttattttat

SEQ ID NO: 32353 - DNA, 711 bp, Artificial Sequence
  chemically treated genomic DNA (Homo sapiens) CpG-island No: 32353
cgatttcgtttcgacggtagcggtttagttttgttttttgatttttgtttgagcgtcgttaggtttttcgttagttcgtcgcgttttatttgtattcggttacgttcgcggtttaatagttttagttttcgtcgtagttcgcgtagtttttgttggtatagttggtcggcgcgcgtcggtttttggtttcgggtttggtttagtttttcgcgtagggtcgcgttttgttgttttagaaagcgtattttttcgatgaagttggcgaagcggtcgttgagtttttgtagtttttgtttttcgttgttgcgcgtggttaggaatttttggttgagggtttcggttatggagaagtcgaggcgtttcgagggtaggcgtaggagggcgttcgttttcgttcgggggttacggaagttgtttaggcgtatcgaggagttcggggacgcggagtttagtaggcggttgttggagaagcgggagttggacgagtaggagaaggtttcgggggatagtgagggcggtggatcgaaggtacggcggtatgaggtggagttgaagtcggttcggaggttcgacgggtggtggtttattgcggttaaggatgggtagttatcgttcgtagagttaggtcgggggttgggaaggagtcgtagatcgttgcgaggcggttttatagttttgcggttttagggggggtacgggtagtttttttta

SEQ ID NO: 32354 - DNA, 711 bp, Artificial Sequence
  chemically treated genomic DNA (Homo sapiens) CpG-island No: 32354
taaaaaaaactacccgtaccccccctaaaaccgcaaaactataaaaccgcctcgcaacgatctacgactccttcccaacccccgacctaactctacgaacgataactacccatccttaaccgcaataaaccaccacccgtcgaacctccgaaccgacttcaactccacctcataccgccgtaccttcgatccaccgccctcactatcccccgaaaccttctcctactcgtccaactcccgcttctccaacaaccgcctactaaactccgcgtccccgaactcctcgatacgcctaaacaacttccgtaacccccgaacgaaaacgaacgccctcctacgcctaccctcgaaacgcctcgacttctccataaccgaaaccctcaaccaaaaattcctaaccacgcgcaacaacgaaaaacaaaaactacaaaaactcaacgaccgcttcgccaacttcatcgaaaaaatacgctttctaaaacaacaaaacgcgaccctacgcgaaaaactaaaccaaacccgaaaccaaaaaccgacgcgcgccgaccaactataccaacaaaaactacgcgaactacgacgaaaactaaaactattaaaccgcgaacgtaaccgaatacaaataaaacgcgacgaactaacgaaaaacctaacgacgctcaaacaaaaatcaaaaaacaaaactaaaccgctaccgtcgaaacgaaatcg

SEQ ID NO: 32355 - DNA, 711 bp, Artificial Sequence
  chemically treated genomic DNA (Homo sapiens) CpG-island No: 32355
tgggaggagttgttcgtgttttttttgagatcgtagggttataaagtcgtttcgtagcggtttgcggtttttttttagttttcggtttagttttgcgaacggtgattgtttatttttggtcgtaatgagttattattcgtcgggttttcgggtcggttttagttttattttatatcgtcgtattttcggtttatcgtttttattatttttcggggtttttttttattcgtttagttttcgtttttttagtagtcgtttgttgggtttcgcgttttcgagtttttcggtgcgtttgggtagttttcgtagttttcgagcgggagcgggcgtttttttgcgtttgttttcggagcgtttcgatttttttatggtcgaggtttttaattaggagtttttggttacgcgtagtaacgagaagtaggagttgtaggagtttaacgatcgtttcgttaattttatcgagaaggtacgttttttggagtagtagaacgcggttttgcgcggggagttgagttaagttcggggttaggagtcggcgcgcgtcgattagttgtgttagtaggagttgcgcgagttgcggcgagagttggagttgttgggtcgcgagcgtgatcgggtgtaggtggagcgcgacgggttggcggaggatttggcggcgtttaagtagaggttagggggtagggttgggtcgttgtcgtcgaggcgaggtcg

SEQ ID NO: 32356 - DNA, 711 bp, Artificial Sequence
  chemically treated genomic DNA (Homo sapiens) CpG-island No: 32356
cgacctcgcctcgacgacaacgacccaaccctaccccctaacctctacttaaacgccgccaaatcctccgccaacccgtcgcgctccacctacacccgatcacgctcgcgacccaacaactccaactctcgccgcaactcgcgcaactcctactaacacaactaatcgacgcgcgccgactcctaaccccgaacttaactcaactccccgcgcaaaaccgcgttctactactccaaaaaacgtaccttctcgataaaattaacgaaacgatcgttaaactcctacaactcctacttctcgttactacgcgtaaccaaaaactcctaattaaaaacctcgaccataaaaaaatcgaaacgctccgaaaacaaacgcaaaaaaacgcccgctcccgctcgaaaactacgaaaactacccaaacgcaccgaaaaactcgaaaacgcgaaacccaacaaacgactactaaaaaaacgaaaactaaacgaataaaaaaaaaccccgaaaaataataaaaacgataaaccgaaaatacgacgatataaaataaaactaaaaccgacccgaaaacccgacgaataataactcattacgaccaaaaataaacaatcaccgttcgcaaaactaaaccgaaaactaaaaaaaaaccgcaaaccgctacgaaacgactttataaccctacgatctcaaaaaaaacacgaacaactcctccca

SEQ ID NO: 32357 - DNA, 539 bp, Artificial Sequence
  chemically treated genomic DNA (Homo sapiens) CpG-island No: 32357
gtcgtcgtcgtagtgcgggtgtaggaatcgggttagtattgcgtttagggcgtagtagagcgttggggaggaataaaggcggcgtttaggcgtttgtgttattcgagagattttcgggggtcgcgggtagttcgtttgtcgcgatcgaggggtttggggcgtttcggttgggtttcgtgtttgtgcgtacggtttcgttgatgttgaggggttattttttgtttcgcgttgttttttggggatcgggagaggaggaggtatttaaaaagagcgggggcgttgggcgagttgggggacgtgggagggggaacgggaataaagcgtagtttagggttagcgtgggaagatttttcgcggtttttggcgttttggaaagatatttatatattttcgggaaaatatggtgagtttttgtcggagttttcggtagcgggtgttagggcggcgtaggggcggggttgtttgtttttggtttttatggcgttggagttattgggcggggttcgtttttattgaattttttttgttaggagttgatt

SEQ ID NO: 32358 - DNA, 539 bp, Artificial Sequence
  chemically treated genomic DNA (Homo sapiens) CpG-island No: 32358
aatcaactcctaacaaaaaaaattcaataaaaacgaaccccgcccaataactccaacgccataaaaaccaaaaacaaacaaccccgcccctacgccgccctaacacccgctaccgaaaactccgacaaaaactcaccatattttcccgaaaatatataaatatctttccaaaacgccaaaaaccgcgaaaaatcttcccacgctaaccctaaactacgctttattcccgttccccctcccacgtcccccaactcgcccaacgcccccgctctttttaaatacctcctcctctcccgatccccaaaaaacaacgcgaaacaaaaaataacccctcaacatcaacgaaaccgtacgcacaaacacgaaacccaaccgaaacgccccaaacccctcgatcgcgacaaacgaactacccgcgacccccgaaaatctctcgaataacacaaacgcctaaacgccgcctttattcctccccaacgctctactacgccctaaacgcaatactaacccgattcctacacccgcactacgacgacgac

SEQ ID NO: 32359 - DNA, 539 bp, Artificial Sequence
  chemically treated genomic DNA (Homo sapiens) CpG-island No: 32359
agttagtttttgatagaagaggtttagtgagggcgaatttcgtttagtggttttaacgttatagaagttagaaataaataatttcgtttttgcgtcgttttgatattcgttgtcgggggtttcggtagaaatttattatgttttttcgggaatgtgtgggtatttttttaaaacgttaaagatcgcggagggtttttttacgttaattttaggttgcgttttgttttcgtttttttttttacgttttttagttcgtttaacgttttcgttttttttgggtgtttttttttttttcggtttttagagaataacgcgagatagaaagtggttttttagtattagcgaaatcgtgcgtatagatacggggtttagtcgggacgttttagatttttcggtcgcggtagacgggttgttcgcggttttcgaaagtttttcggataatataggcgtttaggcgtcgtttttgtttttttttagcgttttgttgcgttttgggcgtagtattggttcggtttttgtattcgtattgcggcggcggt

SEQ ID NO: 32360 - DNA, 539 bp, Artificial Sequence
  chemically treated genomic DNA (Homo sapiens) CpG-island No: 32360
accgccgccgcaatacgaatacaaaaaccgaaccaatactacgcccaaaacgcaacaaaacgctaaaaaaaaacaaaaacgacgcctaaacgcctatattatccgaaaaactttcgaaaaccgcgaacaacccgtctaccgcgaccgaaaaatctaaaacgtcccgactaaaccccgtatctatacgcacgatttcgctaatactaaaaaaccactttctatctcgcgttattctctaaaaaccgaaaaaaaaaaaaacacccaaaaaaaacgaaaacgttaaacgaactaaaaaacgtaaaaaaaaaaacgaaaacaaaacgcaacctaaaattaacgtaaaaaaaccctccgcgatctttaacgttttaaaaaaatacccacacattcccgaaaaaacataataaatttctaccgaaacccccgacaacgaatatcaaaacgacgcaaaaacgaaattatttatttctaacttctataacgttaaaaccactaaacgaaattcgccctcactaaacctcttctatcaaaaactaact

SEQ ID NO: 32361 - DNA, 584 bp, Artificial Sequence
  chemically treated genomic DNA (Homo sapiens) CpG-island No: 32361
gttttcgtacgtttagtcgtttcgatttttttcgttattttagttttatatagagtatgagtaggtttttttttttcgataggttcgggttagcgttattgtttaggacgcggattagaattacgattacgttagtaatagcgttattttgtatttggacgtgggcgacgaggtttttattaagttggacggcgggaaagtgtacggcggtaatattaataagtatagtatttttttcggtttattatttatttcgattgagtcggtttcgtttcgtgttttcgttcgttttttttttttcggtttttatttatttttttggtcgttttattcgaggcgttattttattttttgagagtttggcggtggggtggattttttcgttttcgttggcggtttaaatgggcgaatttttggtgtttaagggtataagtggtcgggaagaggaggagattcggttagaggagtagagcgattttcggagggattattcgtatttaagtgcgcgttggattttataggggtagaggtcgtggtttttttttttgtatagagatggggagtagttttaatagcgggattta

SEQ ID NO: 32362 - DNA, 584 bp, Artificial Sequence
  chemically treated genomic DNA (Homo sapiens) CpG-island No: 32362
taaatcccgctattaaaactactccccatctctatacaaaaaaaaaaaccacgacctctacccctataaaatccaacgcgcacttaaatacgaataatccctccgaaaatcgctctactcctctaaccgaatctcctcctcttcccgaccacttatacccttaaacaccaaaaattcgcccatttaaaccgccaacgaaaacgaaaaaatccaccccaccgccaaactctcaaaaaataaaataacgcctcgaataaaacgaccaaaaaaataaataaaaaccgaaaaaaaaaaaacgaacgaaaacacgaaacgaaaccgactcaatcgaaataaataataaaccgaaaaaaatactatacttattaatattaccgccgtacactttcccgccgtccaacttaataaaaacctcgtcgcccacgtccaaatacaaaataacgctattactaacgtaatcgtaattctaatccgcgtcctaaacaataacgctaacccgaacctatcgaaaaaaaaaaacctactcatactctatataaaactaaaataacgaaaaaaatcgaaacgactaaacgtacgaaaac

SEQ ID NO: 32363 - DNA, 584 bp, Artificial Sequence
  chemically treated genomic DNA (Homo sapiens) CpG-island No: 32363
tgagtttcgttattaaaattgttttttatttttgtataaaagagaaagttacgatttttgtttttatggggtttagcgcgtatttgggtgcgggtgattttttcggaagtcgttttgtttttttggtcgggttttttttttttttcggttatttatatttttgagtattaagagttcgtttatttaggtcgttaacgggaacggaagggtttattttatcgttaggtttttaaagggtggggtggcgtttcgggtggggcggttaagaaggtgggtgaggatcgggagagaaggggcgagcgggggtacggggcggggtcggtttagtcggggtagatgataagtcggagaaggtgttgtatttgttggtgttgtcgtcgtgtattttttcgtcgtttagtttgatgaagatttcgtcgtttacgtttaggtgtagaatgacgttgttgttggcgtagtcgtagttttggttcgcgttttgagtaatggcgttggttcggatttatcgagggagaagaatttgtttatgttttgtgtggagttggggtgacgagaggggtcggggcggttgggcgtgcgaaggt

SEQ ID NO: 32364 - DNA, 584 bp, Artificial Sequence
  chemically treated genomic DNA (Homo sapiens) CpG-island No: 32364
accttcgcacgcccaaccgccccgacccctctcgtcaccccaactccacacaaaacataaacaaattcttctccctcgataaatccgaaccaacgccattactcaaaacgcgaaccaaaactacgactacgccaacaacaacgtcattctacacctaaacgtaaacgacgaaatcttcatcaaactaaacgacgaaaaaatacacgacgacaacaccaacaaatacaacaccttctccgacttatcatctaccccgactaaaccgaccccgccccgtacccccgctcgccccttctctcccgatcctcacccaccttcttaaccgccccacccgaaacgccaccccaccctttaaaaacctaacgataaaataaacccttccgttcccgttaacgacctaaataaacgaactcttaatactcaaaaatataaataaccgaaaaaaaaaaaaaacccgaccaaaaaaacaaaacgacttccgaaaaaatcacccgcacccaaatacgcgctaaaccccataaaaacaaaaatcgtaactttctcttttatacaaaaataaaaaacaattttaataacgaaactca

SEQ ID NO: 32365 - DNA, 882 bp, Artificial Sequence
  chemically treated genomic DNA (Homo sapiens) CpG-island No: 32365
tgcgggtgttgttgcgggtgcggcgcgggcggcggcggcggttgttgcggcgtcggcggcggttttttcgttacgttattcgcgtcgttcgacgggtgggtattttttttcgaggggttcgcggcgtcgtggtcgtttttggagtttttttgtttggtcgagggtatggcgggcgcggcggcggttcgggtcgcgggttgggaggcgagcgagcgcggcgcgcggttcgggaaatttgtaggggttttttcgggattgggcgagcggtacgcgggcgttgttggcgtcggagcggcgagaggacgcgcggtcggggaaggaggtcgggtcgaggaggcgggaggagggggtttgttttcgtcgtcgcggcgtcgatttcgtttttcggtaagggaggtcgagcgagtcgagtcgggagagtttgttacgtacgtcggttcggcggtttttttttttcgtcgttacgatttcggagagggagggtcgggcggggtttacgggggtcgggaagtcggcgcgggggtggttgggcgcggggcggggtttcggcggggtttgcggaggtcggggtgggtatcgaggtggtcgcgaggggaggggagaagagcggagcggaggggaggggacgcggtcgaggtggggttggcggttcggcgggttttacgtaggttgggggcggagggttagatcgattttagtcggggcggtcgagtagggtttacgggggtcggggatgggcggttaggcggggtcggagggacgaaagtcggggtgaatttgcgtcgcgggttaagcgcgatttttttttttttcgatttgtgcggagaggagagaaatgaaggggggcgtttaaggagttttggtttcgggagtgggagttag

SEQ ID NO: 32366 - DNA, 882 bp, Artificial Sequence
  chemically treated genomic DNA (Homo sapiens) CpG-island No: 32366
ctaactcccactcccgaaaccaaaactccttaaacgccccccttcatttctctcctctccgcacaaatcgaaaaaaaaaaaaatcgcgcttaacccgcgacgcaaattcaccccgactttcgtccctccgaccccgcctaaccgcccatccccgacccccgtaaaccctactcgaccgccccgactaaaatcgatctaaccctccgcccccaacctacgtaaaacccgccgaaccgccaaccccacctcgaccgcgtcccctcccctccgctccgctcttctcccctcccctcgcgaccacctcgatacccaccccgacctccgcaaaccccgccgaaaccccgccccgcgcccaaccacccccgcgccgacttcccgacccccgtaaaccccgcccgaccctccctctccgaaatcgtaacgacgaaaaaaaaaaaccgccgaaccgacgtacgtaacaaactctcccgactcgactcgctcgacctcccttaccgaaaaacgaaatcgacgccgcgacgacgaaaacaaaccccctcctcccgcctcctcgacccgacctccttccccgaccgcgcgtcctctcgccgctccgacgccaacaacgcccgcgtaccgctcgcccaatcccgaaaaaacccctacaaatttcccgaaccgcgcgccgcgctcgctcgcctcccaacccgcgacccgaaccgccgccgcgcccgccataccctcgaccaaacaaaaaaactccaaaaacgaccacgacgccgcgaacccctcgaaaaaaaatacccacccgtcgaacgacgcgaataacgtaacgaaaaaaccgccgccgacgccgcaacaaccgccgccgccgcccgcgccgcacccgcaacaacacccgca

SEQ ID NO: 32367 - DNA, 882 bp, Artificial Sequence
  chemically treated genomic DNA (Homo sapiens) CpG-island No: 32367
ttgatttttattttcggggttagggttttttgggcgtttttttttatttttttttttttcgtataggtcgggaagggagggggtcgcgtttggttcgcggcgtaggtttatttcggttttcgttttttcgatttcgtttggtcgtttattttcgattttcgtggattttgttcggtcgtttcggttggggtcgatttggtttttcgtttttagtttgcgtggaattcgtcgggtcgttagttttatttcggtcgcgttttttttttttcgtttcgtttttttttttttttttcgcggttatttcggtgtttatttcggttttcgtagatttcgtcgggatttcgtttcgcgtttagttattttcgcgtcggtttttcggttttcgtagatttcgttcggtttttttttttcggggtcgtggcggcggggaggaggggtcgtcgggtcggcgtgcgtggtaagttttttcggttcggttcgttcggttttttttatcgggaggcggggtcggcgtcgcggcggcggaggtaggtttttttttttcgttttttcggttcggttttttttttcggtcgcgcgttttttcgtcgtttcgacgttagtagcgttcgcgtgtcgttcgtttagtttcgggggagtttttgtaagtttttcgggtcgcgcgtcgcgttcgttcgttttttagttcgcggttcgagtcgtcgtcgcgttcgttatgttttcggttaaataaaggggttttaagggcggttacggcgtcgcgagtttttcggagaagggtgtttattcgtcgggcggcgcggatgacgtggcgaagaagtcgtcgtcggcgtcgtagtagtcgtcgtcgtcgttcgcgtcgtattcgtagtagtattcgta

SEQ ID NO: 32368 - DNA, 882 bp, Artificial Sequence
  chemically treated genomic DNA (Homo sapiens) CpG-island No: 32368
tacgaatactactacgaatacgacgcgaacgacgacgacgactactacgacgccgacgacgacttcttcgccacgtcatccgcgccgcccgacgaataaacacccttctccgaaaaactcgcgacgccgtaaccgcccttaaaacccctttatttaaccgaaaacataacgaacgcgacgacgactcgaaccgcgaactaaaaaacgaacgaacgcgacgcgcgacccgaaaaacttacaaaaactcccccgaaactaaacgaacgacacgcgaacgctactaacgtcgaaacgacgaaaaaacgcgcgaccgaaaaaaaaaaccgaaccgaaaaaacgaaaaaaaaaaacctacctccgccgccgcgacgccgaccccgcctcccgataaaaaaaaccgaacgaaccgaaccgaaaaaacttaccacgcacgccgacccgacgacccctcctccccgccgccacgaccccgaaaaaaaaaaaccgaacgaaatctacgaaaaccgaaaaaccgacgcgaaaataactaaacgcgaaacgaaatcccgacgaaatctacgaaaaccgaaataaacaccgaaataaccgcgaaaaaaaaaaaaaaaaacgaaacgaaaaaaaaaaaacgcgaccgaaataaaactaacgacccgacgaattccacgcaaactaaaaacgaaaaaccaaatcgaccccaaccgaaacgaccgaacaaaatccacgaaaatcgaaaataaacgaccaaacgaaatcgaaaaaacgaaaaccgaaataaacctacgccgcgaaccaaacgcgaccccctcccttcccgacctatacgaaaaaaaaaaaaataaaaaaaaacgcccaaaaaaccctaaccccgaaaataaaaatcaa

SEQ ID NO: 32369 - DNA, 796 bp, Artificial Sequence
  chemically treated genomic DNA (Homo sapiens) CpG-island No: 32369
  misc_feature (679)..(679): n is either a, c, g or t
  misc_feature (702)..(702): n is either a, c, g or t
agcgattttttcgttgtcgaggaaaagttagtttaagaagtcgggggaagggtggggtatcgcgtgtttcggagtagcgtttttcgaaggcgggggtaggaagtagtcgtcgcgtttcgtttcgttttttttttttcgggttagaataatggttttttgttcggaaaacggagttgggagtaagggcgggcgcgtttcgggaattacgcgggattcggtgggcgttttaggttcgaagtttttaggtatttttttttttagttaggggttcgttcgcgtttttattttcgttttcgttttcgttcggggtttcgcgcgggatttttcgtcggagcgcgaggtttagttcgtcgcggataatgcgcgtttcgtttcgtttcgtattcgttttttttcgttgattggttcgtacgggatttgggtagcgcgcgggggcgggcggcgggtcggggcgcgggcgcggagcggcggtgcgcgtgcgcggggcgggtcggcgtcgggcgggggcggtgttttgtgtgttgtcggcggggcgcgcggcggtgcgggcgggtgattggcggcgggcgtcgcggtcgggttggttgtcgggtagtatggaggagttgagtagcgtgggcgagtaggttttcgtcgtcgagtgtattttgagtaagcggtttcgtaaggtgcgtgcggntcgtcgggtttttcgttcggcgntcgttgttcgtttggtttacgggttttttttttttttcgtagggtaagttggagtattttggttaagtggcgcggttggtttttttagtgaagt

SEQ ID NO: 32370 - DNA, 796 bp, Artificial Sequence
  chemically treated genomic DNA (Homo sapiens) CpG-island No: 32370
  misc_feature (95)..(95): n is either a, c, g or t
  misc_feature (118)..(118): n is either a, c, g or t
acttcactaaaaaaaccaaccgcgccacttaaccaaaatactccaacttaccctacgaaaaaaaaaaaaaacccgtaaaccaaacgaacaacgancgccgaacgaaaaacccgacganccgcacgcaccttacgaaaccgcttactcaaaatacactcgacgacgaaaacctactcgcccacgctactcaactcctccatactacccgacaaccaacccgaccgcgacgcccgccgccaatcacccgcccgcaccgccgcgcgccccgccgacaacacacaaaacaccgcccccgcccgacgccgacccgccccgcgcacgcgcaccgccgctccgcgcccgcgccccgacccgccgcccgcccccgcgcgctacccaaatcccgtacgaaccaatcaacgaaaaaaaacgaatacgaaacgaaacgaaacgcgcattatccgcgacgaactaaacctcgcgctccgacgaaaaatcccgcgcgaaaccccgaacgaaaacgaaaacgaaaataaaaacgcgaacgaacccctaactaaaaaaaaaaatacctaaaaacttcgaacctaaaacgcccaccgaatcccgcgtaattcccgaaacgcgcccgcccttactcccaactccgttttccgaacaaaaaaccattattctaacccgaaaaaaaaaaaacgaaacgaaacgcgacgactacttcctacccccgccttcgaaaaacgctactccgaaacacgcgataccccacccttcccccgacttcttaaactaacttttcctcgacaacgaaaaaatcgct

SEQ ID NO: 32371 - DNA, 796 bp, Artificial Sequence
  chemically treated genomic DNA (Homo sapiens) CpG-island No: 32371
  misc_feature (95)..(95): n is either a, c, g or t
  misc_feature (118)..(118): n is either a, c, g or t
attttattgggaggattagtcgcgttatttgattaaggtattttagtttgttttgcggggagagaagagggttcgtgagttaaacggatagcggncgtcgggcggggggttcggcggntcgtacgtattttgcggagtcgtttgtttaggatgtattcggcggcgaagatttgttcgtttacgttgtttagtttttttatgttgttcggtagttagttcgatcgcggcgttcgtcgttagttattcgttcgtatcgtcgcgcgtttcgtcggtagtatataaagtatcgttttcgttcggcgtcggttcgtttcgcgtacgcgtatcgtcgtttcgcgttcgcgtttcggttcgtcgttcgttttcgcgcgttgtttaaatttcgtgcgggttaattagcgagggggggcgggtgcggggcggggcggggcgcgtattgttcgcggcgggttgggtttcgcgtttcggcggggggtttcgcgcggggtttcgggcgggggcgggggcgggggtgggggcgcgggcgggtttttggttgggggaggaggtgtttagggatttcgggtttggggcgtttatcgagtttcgcgtgattttcggggcgcgttcgtttttgtttttaatttcgtttttcgggtaaaaagttattgttttggttcgaagggagggaagcgggacggggcgcggcggttgttttttgttttcgttttcgaggggcgttgtttcggggtacgcggtgttttatttttttttcggttttttgaattggttttttttcggtagcgggggagtcgtt

SEQ ID NO: 32372 - DNA, 796 bp, Artificial Sequence
  chemically treated genomic DNA (Homo sapiens) CpG-island No: 32372
  misc_feature (679)..(679): n is either a, c, g or t
  misc_feature (702)..(702): n is either a, c, g or t
aacgactcccccgctaccgaaaaaaaaccaattcaaaaaaccgaaaaaaaaataaaacaccgcgtaccccgaaacaacgcccctcgaaaacgaaaacaaaaaacaaccgccgcgccccgtcccgcttccctcccttcgaaccaaaacaataactttttacccgaaaaacgaaattaaaaacaaaaacgaacgcgccccgaaaatcacgcgaaactcgataaacgccccaaacccgaaatccctaaacacctcctcccccaaccaaaaacccgcccgcgcccccacccccgcccccgcccccgcccgaaaccccgcgcgaaaccccccgccgaaacgcgaaacccaacccgccgcgaacaatacgcgccccgccccgccccgcacccgccccccctcgctaattaacccgcacgaaatttaaacaacgcgcgaaaacgaacgacgaaccgaaacgcgaacgcgaaacgacgatacgcgtacgcgaaacgaaccgacgccgaacgaaaacgatactttatatactaccgacgaaacgcgcgacgatacgaacgaataactaacgacgaacgccgcgatcgaactaactaccgaacaacataaaaaaactaaacaacgtaaacgaacaaatcttcgccgccgaatacatcctaaacaaacgactccgcaaaatacgtacganccgccgaaccccccgcccgacgnccgctatccgtttaactcacgaaccctcttctctccccgcaaaacaaactaaaataccttaatcaaataacgcgactaatcctcccaataaaat

SEQ ID NO: 32373 - DNA, 634 bp, Artificial Sequence
  chemically treated genomic DNA (Homo sapiens) CpG-island No: 32373
gggcgatttcggtagtcgagcgacgttttttttttttttttttttttttattttttttttttttttagttagtttcgtttttttttttttttcgggttcgtttgttttgatagtaatggcggtcgtcgatcgcggttcggttcgttattggttggcgtttggttacgtgacgggcgtcggtcgcgcggggggagcgaggggcgggcgggggaggggttcggagtggcggcggcggcggcggttcgcgggaggcgttgttgagttgagcgcggtcgggtttttcggtcgggaagagggagggagggaggtagagagggagagaaagaagtgcgggcggtcgggtttttcggcgggcggcggattgtcggttcgtggttgtcgtgggttgtttttcgtggtcgtttcgttttttcgcggtgtattgatcgtggcggggcgggatcgtgggtttcgggcgcgttcgtggtggtcgcggaggagggcgcgggattttcggtttgtgttttcgtagtttaggtcggttggcgtggcgcggcggtcgcgatgtgggttaggtagcgggttcgagtgttttggggaatgtgtttttagaggttcgcgtcgtcgttcgttttttgtagaggagaaaattaaa

SEQ ID NO: 32374 - DNA, 634 bp, Artificial Sequence
  chemically treated genomic DNA (Homo sapiens) CpG-island No: 32374
tttaattttctcctctacaaaaaacgaacgacgacgcgaacctctaaaaacacattccccaaaacactcgaacccgctacctaacccacatcgcgaccgccgcgccacgccaaccgacctaaactacgaaaacacaaaccgaaaatcccgcgccctcctccgcgaccaccacgaacgcgcccgaaacccacgatcccgccccgccacgatcaatacaccgcgaaaaaacgaaacgaccacgaaaaacaacccacgacaaccacgaaccgacaatccgccgcccgccgaaaaacccgaccgcccgcacttctttctctccctctctacctccctccctccctcttcccgaccgaaaaacccgaccgcgctcaactcaacaacgcctcccgcgaaccgccgccgccgccgccactccgaacccctcccccgcccgcccctcgctccccccgcgcgaccgacgcccgtcacgtaaccaaacgccaaccaataacgaaccgaaccgcgatcgacgaccgccattactatcaaaacaaacgaacccgaaaaaaaaaaaaaaacgaaactaactaaaaaaaaaaaaaaaataaaaaaaaaaaaaaaaaaaaaaaacgtcgctcgactaccgaaatcgccc

SEQ ID NO: 32375 - DNA, 634 bp, Artificial Sequence
  chemically treated genomic DNA (Homo sapiens) CpG-island No: 32375
tttagtttttttttttgtaaaaggcggacggcggcgcgagtttttgaggatatattttttagggtattcggattcgttgtttggtttatatcgcggtcgtcgcgttacgttagtcggtttgggttgcgagggtataggtcgggggtttcgcgttttttttcgcggttattacgggcgcgttcgggatttacggtttcgtttcgttacgattagtgtatcgcgagggggcggggcggttacgaggggtagtttacggtagttacgggtcggtagttcgtcgttcgtcggggagttcggtcgttcgtatttttttttttttttttttgttttttttttttttttttttcggtcggaggattcggtcgcgtttagtttagtagcgtttttcgcgagtcgtcgtcgtcgtcgttatttcggatttttttttcgttcgtttttcgtttttttcgcgcggtcggcgttcgttacgtgattaagcgttagttaatggcgggtcgagtcgcggtcggcggtcgttattgttgttagagtaagcgagttcggggagggaggagaagcgaggttgattggggaggaggggggggtgggggaggaagaggaaggaggggacgtcgttcggttgtcggggtcgttt

SEQ ID NO: 32376 - DNA, 634 bp, Artificial Sequence
  chemically treated genomic DNA (Homo sapiens) CpG-island No: 32376
aaacgaccccgacaaccgaacgacgtcccctccttcctcttcctcccccacccccccctcctccccaatcaacctcgcttctcctccctccccgaactcgcttactctaacaacaataacgaccgccgaccgcgactcgacccgccattaactaacgcttaatcacgtaacgaacgccgaccgcgcgaaaaaaacgaaaaacgaacgaaaaaaaaatccgaaataacgacgacgacgacgactcgcgaaaaacgctactaaactaaacgcgaccgaatcctccgaccgaaaaaaaaaaaaaaaaaaaacaaaaaaaaaaaaaaaaaaatacgaacgaccgaactccccgacgaacgacgaactaccgacccgtaactaccgtaaactacccctcgtaaccgccccgccccctcgcgatacactaatcgtaacgaaacgaaaccgtaaatcccgaacgcgcccgtaataaccgcgaaaaaaaacgcgaaacccccgacctataccctcgcaacccaaaccgactaacgtaacgcgacgaccgcgatataaaccaaacaacgaatccgaataccctaaaaaatatatcctcaaaaactcgcgccgccgtccgccttttacaaaaaaaaaaactaaa

SEQ ID NO: 32377 - DNA, 600 bp, Artificial Sequence
  chemically treated genomic DNA (Homo sapiens) CpG-island No: 32377
gattcgtaattgtttttttgattatagcggttatcgtttaatattttcgagaagttatcgttattatcggtaggagaatttagggtttataaagttattttcgcgatcgattaaagttacgttaataattatggcgggcgacgggcggcgggtagaggcggtgcgggaaggatggggtgtgtacgttatttttagggtttttattcgagagggaaggggtcggttcgttttttaaaatggcggtagtagcgatgcgtttgcgtatagaattttttcgtcgcgttagggtcggcgggaagtgaggttttcggacgagtcgttagaagtgtacggcgatttcgagtttttggtggttaaagaaaggttttcggtgggaaaacgaattcggttagaagagtttcggttcgattttgcgaaagaggaagtgagagaaagcgcgtattattttcggtttaggtagcggaggtagtcgcgattttaggaaatcgaggaaatgaagacgcgaaggattattcgtttttagtagtagtatttagagtagttttcgttatagtcgttttttgttacgattaggagagggttgcgggatttttatttttt

SEQ ID NO: 32378 - DNA, 600 bp, Artificial Sequence
  chemically treated genomic DNA (Homo sapiens) CpG-island No: 32378
aaaaaataaaaatcccgcaaccctctcctaatcgtaacaaaaaacgactataacgaaaactactctaaatactactactaaaaacgaataatccttcgcgtcttcatttcctcgatttcctaaaatcgcgactacctccgctacctaaaccgaaaataatacgcgctttctctcacttcctctttcgcaaaatcgaaccgaaactcttctaaccgaattcgttttcccaccgaaaacctttctttaaccaccaaaaactcgaaatcgccgtacacttctaacgactcgtccgaaaacctcacttcccgccgaccctaacgcgacgaaaaaattctatacgcaaacgcatcgctactaccgccattttaaaaaacgaaccgaccccttccctctcgaataaaaaccctaaaaataacgtacacaccccatccttcccgcaccgcctctacccgccgcccgtcgcccgccataattattaacgtaactttaatcgatcgcgaaaataactttataaaccctaaattctcctaccgataataacgataacttctcgaaaatattaaacgataaccgctataatcaaaaaaacaattacgaatc

SEQ ID NO: 32379 - DNA, 600 bp, Artificial Sequence
  chemically treated genomic DNA (Homo sapiens) CpG-island No: 32379
gaggaatgagagtttcgtagtttttttttggtcgtaataggagacggttgtagcggaggttgttttgagtgttgttgttgaaggcgggtagtttttcgcgtttttattttttcggttttttggggtcgcggttgttttcgttgtttagatcgaaggtagtacgcgtttttttttattttttttttcgtagaatcggatcggaatttttttagtcgggttcgtttttttatcggggatttttttttggttattaggggttcgaagtcgtcgtatatttttggcggttcgttcgagaattttatttttcgtcggttttggcgcgacggaggagttttgtacgtaggcgtatcgttgttgtcgttattttgaggggcgagtcggttttttttttttcggatgggggttttgggggtgacgtatatattttatttttttcgtatcgtttttgttcgtcgttcgtcgttcgttatagttgttgacgtagttttagtcgatcgcgaagatggttttatggattttaggtttttttgtcggtggtggcgatggtttttcgggggtgttgggcggtggtcgttgtggttagggaggtagttgcgagtt

SEQ ID NO: 32380 - DNA, 600 bp, Artificial Sequence
  chemically treated genomic DNA (Homo sapiens) CpG-island No: 32380
aactcgcaactacctccctaaccacaacgaccaccgcccaacacccccgaaaaaccatcgccaccaccgacaaaaaaacctaaaatccataaaaccatcttcgcgatcgactaaaactacgtcaacaactataacgaacgacgaacgacgaacaaaaacgatacgaaaaaaataaaatatatacgtcacccccaaaacccccatccgaaaaaaaaaaaaccgactcgcccctcaaaataacgacaacaacgatacgcctacgtacaaaactcctccgtcgcgccaaaaccgacgaaaaataaaattctcgaacgaaccgccaaaaatatacgacgacttcgaacccctaataaccaaaaaaaaatccccgataaaaaaacgaacccgactaaaaaaattccgatccgattctacgaaaaaaaaaataaaaaaaaacgcgtactaccttcgatctaaacaacgaaaacaaccgcgaccccaaaaaaccgaaaaaataaaaacgcgaaaaactacccgccttcaacaacaacactcaaaacaacctccgctacaaccgtctcctattacgaccaaaaaaaaactacgaaactctcattcctc

SEQ ID NO: 32381 - DNA, 967 bp, Artificial Sequence
  chemically treated genomic DNA (Homo sapiens) CpG-island No: 32381
aggtcgcgtcgtttcgtttcgtttttcgttttacgtatcgtagttcgtgtagtcgtcggtttttcgtttggttttaggttattagttcgcggtgttcggcggcgttttttagggttttgcgtttcgttagaatttcggttcgggtttcgtgtatttttttttgtatttcggatacgaattttattttgggtgtagacgcgttaggaattagtatttttttcgtttatttttatcgttattagcgcgcgcgggcggttattttttttcggtcgtatatttgagggcgcgtacggtttggcggtagtgttggtaacgttttattagtacgaagaatttcgtagggtttatcgcgggcggtatgtttattcgttcgattttggatttggttagcgggtcgtggcgggttttgcggtcgcgcgttggtagtattagaggggttcggggtttgtacggggttttcgcgtttaggcggtttagcgcgcgtagtatggtcgagtttttttattgcggtcgcggtgtcgggacgttatcgtgtttcggaagcggcgcggggaattttgggatttgtagttttcgggttgttttttacgtttcgttcggtcgtgtggtttttggaatcgaagcggcgattttgcggacgttcgtatttcgtttttaggttttggttcggttttttcgttagggttcggggttattttttagttattttcgttcgcggggtcggattcgcgtttttttagtttttacgtagggaagggttttagcggggaagatagggaggggacgaaggatagaattcgacgtaatagtttcggagaattttatattttattggaggatggcggggcggggcggggttttcgggttgcggtttgcggagggagaggtggcggttatgttttaggatattggtttcgtaatcgtcgagttgttatttttttggtttttttttttttcgtttttttta

SEQ ID NO: 32382 - DNA, 967 bp, Artificial Sequence
  chemically treated genomic DNA (Homo sapiens) CpG-island No: 32382
taaaaaaaacgaaaaaaaaaaaaaccaaaaaaataacaactcgacgattacgaaaccaatatcctaaaacataaccgccacctctccctccgcaaaccgcaacccgaaaaccccgccccgccccgccatcctccaataaaatataaaattctccgaaactattacgtcgaattctatccttcgtcccctccctatcttccccgctaaaacccttccctacgtaaaaactaaaaaaacgcgaatccgaccccgcgaacgaaaataactaaaaaataaccccgaaccctaacgaaaaaaccgaaccaaaacctaaaaacgaaatacgaacgtccgcaaaatcgccgcttcgattccaaaaaccacacgaccgaacgaaacgtaaaaaacaacccgaaaactacaaatcccaaaattccccgcgccgcttccgaaacacgataacgtcccgacaccgcgaccgcaataaaaaaactcgaccatactacgcgcgctaaaccgcctaaacgcgaaaaccccgtacaaaccccgaacccctctaatactaccaacgcgcgaccgcaaaacccgccacgacccgctaaccaaatccaaaatcgaacgaataaacataccgcccgcgataaaccctacgaaattcttcgtactaataaaacgttaccaacactaccgccaaaccgtacgcgccctcaaatatacgaccgaaaaaaaataaccgcccgcgcgcgctaataacgataaaaataaacgaaaaaaatactaattcctaacgcgtctacacccaaaataaaattcgtatccgaaatacaaaaaaaaatacacgaaacccgaaccgaaattctaacgaaacgcaaaaccctaaaaaacgccgccgaacaccgcgaactaataacctaaaaccaaacgaaaaaccgacgactacacgaactacgatacgtaaaacgaaaaacgaaacgaaacgacgcgacct

SEQ ID NO: 32383 - DNA, 967 bp, Artificial Sequence
  chemically treated genomic DNA (Homo sapiens) CpG-island No: 32383
tgggggggacgagaggggagagaattaggaagatggtagttcggcggttacgagattagtgttttgagatatgatcgttattttttttttcgtagatcgtagttcgagagtttcgtttcgtttcgttattttttaataaagtgtgaggtttttcgaagttgttgcgtcgagttttgtttttcgttttttttttgtttttttcgttgagatttttttttgcgtgggggttggagggacgcgggttcggtttcgcgggcgggagtaattaagggatggtttcgggttttggcgggaaggtcgggttagagtttgggggcgggatgcggacgttcgtagggtcgtcgtttcggttttagaggttatacggtcgggcggggcgtgagggatagttcgaggattataggttttaaggtttttcgcgtcgttttcggggtacggtggcgtttcggtatcgcggtcgtagtgaggagattcggttatgttacgcgcgttgagtcgtttgggcgcggggatttcgtgtaggtttcgggtttttttggtgttgttagcgcgcggtcgtaagattcgttacgattcgttggttaaatttaagatcgagcgagtgaatatgtcgttcgcggtggattttgcggagtttttcgtgttgatggagcgttattagtattatcgttagatcgtgcgcgtttttaggtgtgcggtcggggggaggtggtcgttcgcgcgcgttggtgacggtgggagtgggcggagagggtgttgatttttggcgcgtttgtatttaggatggagttcgtgttcgaggtgtagaggaaggtgtacgaggttcgagtcggggttttggcggagcgtaaggttttgaaggacgtcgtcgagtatcgcgagttgatggtttggaattaggcggagaatcggcggttgtacgagttgcggtgcgtggggcgggaggcggggcggggcggcgcggttt

SEQ ID NO: 32384 - DNA, 967 bp, Artificial Sequence
  chemically treated genomic DNA (Homo sapiens) CpG-island No: 32384
aaaccgcgccgccccgccccgcctcccgccccacgcaccgcaactcgtacaaccgccgattctccgcctaattccaaaccatcaactcgcgatactcgacgacgtccttcaaaaccttacgctccgccaaaaccccgactcgaacctcgtacaccttcctctacacctcgaacacgaactccatcctaaatacaaacgcgccaaaaatcaacaccctctccgcccactcccaccgtcaccaacgcgcgcgaacgaccacctccccccgaccgcacacctaaaaacgcgcacgatctaacgataatactaataacgctccatcaacacgaaaaactccgcaaaatccaccgcgaacgacatattcactcgctcgatcttaaatttaaccaacgaatcgtaacgaatcttacgaccgcgcgctaacaacaccaaaaaaacccgaaacctacacgaaatccccgcgcccaaacgactcaacgcgcgtaacataaccgaatctcctcactacgaccgcgataccgaaacgccaccgtaccccgaaaacgacgcgaaaaaccttaaaacctataatcctcgaactatccctcacgccccgcccgaccgtataacctctaaaaccgaaacgacgaccctacgaacgtccgcatcccgcccccaaactctaacccgaccttcccgccaaaacccgaaaccatcccttaattactcccgcccgcgaaaccgaacccgcgtccctccaacccccacgcaaaaaaaaatctcaacgaaaaaaacaaaaaaaaaacgaaaaacaaaactcgacgcaacaacttcgaaaaacctcacactttattaaaaaataacgaaacgaaacgaaactctcgaactacgatctacgaaaaaaaaaataacgatcatatctcaaaacactaatctcgtaaccgccgaactaccatcttcctaattctctcccctctcgtccccccca

SEQ ID NO: 32385 - DNA, 550 bp, Artificial Sequence
  chemically treated genomic DNA (Homo sapiens) CpG-island No: 32385
tcgggcgtagcggtcgcgaatatttatagagtcgggcgttgggcgggatcgttggggacgaggatagcggtttcgtttcggtttcgcggcggcgtttcgggtcgttattagtttttagggtcgtcgttcggttcgcggtttcgagtttcgcggcggcggcggcggtttcgtttttatggcgaggggaagcggttgaggggcgattgggcgggcgatagtgatggcggtagcggtcggggttcgagcgcgatcgcgcgcgcgcgcgtttttgttagcgtcgtattcgtcgtagtttcgttttcgattcggttttggttgtaaggcgcgtgtttattggttgtttagagataggcgttggttggtcgatagcgaacgggcgttttcggttcgcgcgggtatcgtttttgcgtttcgttgggcgtttatttgtcggttggggcgtcgaattcggtcgtacgtttttttggtagttttagaggggttcgtttcggggttgtttagtttttcgggaagttggatttcggaaggatcggttgcgagtgtattagtg

SEQ ID NO: 32386 - DNA, 550 bp, Artificial Sequence
  chemically treated genomic DNA (Homo sapiens) CpG-island No: 32386
cactaatacactcgcaaccgatccttccgaaatccaacttcccgaaaaactaaacaaccccgaaacgaacccctctaaaactaccaaaaaaacgtacgaccgaattcgacgccccaaccgacaaataaacgcccaacgaaacgcaaaaacgatacccgcgcgaaccgaaaacgcccgttcgctatcgaccaaccaacgcctatctctaaacaaccaataaacacgcgccttacaaccaaaaccgaatcgaaaacgaaactacgacgaatacgacgctaacaaaaacgcgcgcgcgcgcgatcgcgctcgaaccccgaccgctaccgccatcactatcgcccgcccaatcgcccctcaaccgcttcccctcgccataaaaacgaaaccgccgccgccgccgcgaaactcgaaaccgcgaaccgaacgacgaccctaaaaactaataacgacccgaaacgccgccgcgaaaccgaaacgaaaccgctatcctcgtccccaacgatcccgcccaacgcccgactctataaatattcgcgaccgctacgcccga

SEQ ID NO: 32387 - DNA, 550 bp, Artificial Sequence
  chemically treated genomic DNA (Homo sapiens) CpG-island No: 32387
tattggtgtattcgtagtcggttttttcggggtttagtttttcgaaggattgggtagtttcggggcgaatttttttggagttattaggagaacgtgcgatcgggttcggcgttttagtcggtaagtgagcgtttagcggagcgtaagggcggtgttcgcgcgggtcggagacgttcgttcgttgtcggttaattagcgtttgtttttgaatagttaatgaatacgcgttttatagttaaggtcgggtcgggagcgaggttgcggcgagtgcggcgttgatagagacgcgcgcgcgcgcgatcgcgttcggatttcggtcgttgtcgttattattgtcgttcgtttagtcgttttttagtcgttttttttcgttatggaggcgaggtcgtcgtcgtcgtcgcggggttcggagtcgcgggtcgggcggcggttttgagggttagtggcggttcgaaacgtcgtcgcggagtcgaggcggagtcgttgttttcgtttttagcggtttcgtttaacgttcgattttgtgagtgttcgcggtcgttgcgttcgg

SEQ ID NO: 32388 - DNA, 550 bp, Artificial Sequence
  chemically treated genomic DNA (Homo sapiens) CpG-island No: 32388
ccgaacgcaacgaccgcgaacactcacaaaatcgaacgttaaacgaaaccgctaaaaacgaaaacaacgactccgcctcgactccgcgacgacgtttcgaaccgccactaaccctcaaaaccgccgcccgacccgcgactccgaaccccgcgacgacgacgacgacctcgcctccataacgaaaaaaaacgactaaaaaacgactaaacgaacgacaataataacgacaacgaccgaaatccgaacgcgatcgcgcgcgcgcgcgtctctatcaacgccgcactcgccgcaacctcgctcccgacccgaccttaactataaaacgcgtattcattaactattcaaaaacaaacgctaattaaccgacaacgaacgaacgtctccgacccgcgcgaacaccgcccttacgctccgctaaacgctcacttaccgactaaaacgccgaacccgatcgcacgttctcctaataactccaaaaaaattcgccccgaaactacccaatccttcgaaaaactaaaccccgaaaaaaccgactacgaatacaccaata

SEQ ID NO: 32389 - DNA, 637 bp, Artificial Sequence
  chemically treated genomic DNA (Homo sapiens) CpG-island No: 32389
gtcgttttatattaagttagtttacgtcgtttttattcgagttttagggtaatttttttcgttttttagatgcgtatgttggggtttcgttcgttatcgagttgagtagaagtataatatatggtgttttgcgatggaggtgttttttgcgatacgtttggcgggggaggggaggtttaaaacgtagagaggagttagagtgcgttttttttcggtcggggttggggcgcgtatttttttttcggcgttttcggtacggcgtttggtgcgtgatattcgcgaagtaatcgtttagtttatttagcggtagtaggtttttatacggattttcgcgggtgttgtaggatttgagcgtttgcggttgaaagtcgattacgtagtcgagataggtggtggtaaatgcgatatttcgtcgggttgtgatttttagtagggatttttggatatttcgagattcgcgtagggcgagcggttgggcgtttgtaggtaaaagatagattgtatagtagcgtataaatcgagtttgcgggtaggggacgttttattttagatttagagtttgcggttttcggggtaggtggcggcgagttttttttttagatcgggtaatttttgagttttttttacgtattttagg

SEQ ID NO: 32390 - DNA, 637 bp, Artificial Sequence
  chemically treated genomic DNA (Homo sapiens) CpG-island No: 32390
cctaaaatacgtaaaaaaaactcaaaaattacccgatctaaaaaaaaaactcgccgccacctaccccgaaaaccgcaaactctaaatctaaaataaaacgtcccctacccgcaaactcgatttatacgctactatacaatctatcttttacctacaaacgcccaaccgctcgccctacgcgaatctcgaaatatccaaaaatccctactaaaaatcacaacccgacgaaatatcgcatttaccaccacctatctcgactacgtaatcgactttcaaccgcaaacgctcaaatcctacaacacccgcgaaaatccgtataaaaacctactaccgctaaataaactaaacgattacttcgcgaatatcacgcaccaaacgccgtaccgaaaacgccgaaaaaaaaatacgcgccccaaccccgaccgaaaaaaaacgcactctaactcctctctacgttttaaacctcccctcccccgccaaacgtatcgcaaaaaacacctccatcgcaaaacaccatatattatacttctactcaactcgataacgaacgaaaccccaacatacgcatctaaaaaacgaaaaaaattaccctaaaactcgaataaaaacgacgtaaactaacttaatataaaacgac

SEQ ID NO: 32391 - DNA, 637 bp, Artificial Sequence
  chemically treated genomic DNA (Homo sapiens) CpG-island No: 32391
tttggggtgcgtgagggggatttaggggttgttcggtttggaggagagattcgtcgttatttatttcgggaatcgtagattttgggtttgggataaagcgttttttattcgtaagttcggtttgtgcgttattgtgtaatttgttttttgtttgtagacgtttagtcgttcgttttgcgcgggtttcggaatgtttaggggtttttattggggattataattcggcgaaatgtcgtatttgttattatttatttcgattgcgtaatcggtttttagtcgtagacgtttaggttttgtagtattcgcggggattcgtgtaggaatttgttgtcgttggatggattgagcgattgtttcgcgggtgttacgtattagacgtcgtgtcgggagcgtcgggaagggggtacgcgttttaatttcggtcgggggagggcgtattttggtttttttttgcgttttgagttttttttttttcgttaggcgtatcgtaaaaggtatttttatcgtagagtattatgtgttgtgtttttatttagttcggtggcgagcggggttttagtatgcgtatttggaaagcgggggagattattttggagttcgggtggggacggcgtgggttgatttgatataagacgat

SEQ ID NO: 32392 - DNA, 637 bp, Artificial Sequence
  chemically treated genomic DNA (Homo sapiens) CpG-island No: 32392
atcgtcttatatcaaatcaacccacgccgtccccacccgaactccaaaataatctcccccgctttccaaatacgcatactaaaaccccgctcgccaccgaactaaataaaaacacaacacataatactctacgataaaaataccttttacgatacgcctaacgaaaaaaaaaaaactcaaaacgcaaaaaaaaaccaaaatacgccctcccccgaccgaaattaaaacgcgtacccccttcccgacgctcccgacacgacgtctaatacgtaacacccgcgaaacaatcgctcaatccatccaacgacaacaaattcctacacgaatccccgcgaatactacaaaacctaaacgtctacgactaaaaaccgattacgcaatcgaaataaataataacaaatacgacatttcgccgaattataatccccaataaaaacccctaaacattccgaaacccgcgcaaaacgaacgactaaacgtctacaaacaaaaaacaaattacacaataacgcacaaaccgaacttacgaataaaaaacgctttatcccaaacccaaaatctacgattcccgaaataaataacgacgaatctctcctccaaaccgaacaacccctaaatccccctcacgcaccccaaa

SEQ ID NO: 32393 - DNA, 581 bp, Artificial Sequence
  chemically treated genomic DNA (Homo sapiens) CpG-island No: 32393
gcgttttcgaattacgtgtttgcgttagttgtcggattggttgagcgtattttagcgttgcggtttagacgttcgcggtttcgtttagttgttagaggagtcgggatatcgagggaagaggtcggagggagatcgcggaggggagggggcgggaggggggtggggtattttgagtcgttcgtggttcggagtttggaaggttttagagcggcgttagtcgattcgtttcgttataatttgtttagattagatacgttttattttgcgttttgtaagaaggagtcggtttgttttttttcgttttgttgtttttcggttttcgcgggttcggttcgcgttagtagcgattttggggtttgggttttttgtgtcgttttcgttcgtttgtagcgttcggtattcgtttaggagcgcgtagttggggtgagtcgagatcggggatgcgttaggcgtttataggaggtggttgacggggtatttcgatattcgcgaagtcggtttttttgtttttttaggttgcgagtcgagtttttgtagatttagttggagtagtcgtcgttgtttttattgtttgtttgttt

SEQ ID NO: 32394 - DNA, 581 bp, Artificial Sequence
  chemically treated genomic DNA (Homo sapiens) CpG-island No: 32394
aaacaaacaaacaataaaaacaacgacgactactccaactaaatctacaaaaactcgactcgcaacctaaaaaaacaaaaaaaccgacttcgcgaatatcgaaataccccgtcaaccacctcctataaacgcctaacgcatccccgatctcgactcaccccaactacgcgctcctaaacgaataccgaacgctacaaacgaacgaaaacgacacaaaaaacccaaaccccaaaatcgctactaacgcgaaccgaacccgcgaaaaccgaaaaacaacaaaacgaaaaaaaacaaaccgactccttcttacaaaacgcaaaataaaacgtatctaatctaaacaaattataacgaaacgaatcgactaacgccgctctaaaaccttccaaactccgaaccacgaacgactcaaaataccccacccccctcccgccccctcccctccgcgatctccctccgacctcttccctcgatatcccgactcctctaacaactaaacgaaaccgcgaacgtctaaaccgcaacgctaaaatacgctcaaccaatccgacaactaacgcaaacacgtaattcgaaaacgc

SEQ ID NO: 32395 - DNA, 581 bp, Artificial Sequence
  chemically treated genomic DNA (Homo sapiens) CpG-island No: 32395
aggtaaataggtagtgggggtagcggcggttattttagttggatttgtagaggttcggttcgtagtttggagaggtaggagggtcggtttcgcgggtatcgggatgtttcgttagttattttttgtgggcgtttggcgtattttcggtttcggtttattttagttgcgcgtttttgggcgggtgtcgggcgttgtaggcgggcgggggcgatataggggatttagattttagggtcgttgttgacgcgggtcgggttcgcggaggtcgaggagtagtaaagcggagagaggtaggtcggtttttttttgtagggcgtaggatgaaacgtgtttggtttgggtaagttgtggcgaggcgggtcgattggcgtcgttttagggttttttagatttcggattacggacgatttaggatattttatttttttttcgttttttttttttcgcgattttttttcggttttttttttcggtgtttcggtttttttggtaattgggcgggatcgcgagcgtttagatcgtagcgttaaaatgcgtttagttaattcggtagttggcgtagatacgtggttcgggggcgt

SEQ ID NO: 32396 - DNA, 581 bp, Artificial Sequence
  chemically treated genomic DNA (Homo sapiens) CpG-island No: 32396
acgcccccgaaccacgtatctacgccaactaccgaattaactaaacgcattttaacgctacgatctaaacgctcgcgatcccgcccaattaccaaaaaaaccgaaacaccgaaaaaaaaaaccgaaaaaaaatcgcgaaaaaaaaaaaacgaaaaaaaaataaaatatcctaaatcgtccgtaatccgaaatctaaaaaaccctaaaacgacgccaatcgacccgcctcgccacaacttacccaaaccaaacacgtttcatcctacgccctacaaaaaaaaaccgacctacctctctccgctttactactcctcgacctccgcgaacccgacccgcgtcaacaacgaccctaaaatctaaatcccctatatcgcccccgcccgcctacaacgcccgacacccgcccaaaaacgcgcaactaaaataaaccgaaaccgaaaatacgccaaacgcccacaaaaaataactaacgaaacatcccgatacccgcgaaaccgaccctcctacctctccaaactacgaaccgaacctctacaaatccaactaaaataaccgccgctacccccactacctatttacct

SEQ ID NO: 32397 - DNA, 721 bp, Artificial Sequence
  chemically treated genomic DNA (Homo sapiens) CpG-island No: 32397
gggttcgcgagtgaagaggaggaaaggtgtgtggtttattagtacgcgtcggcgtttcggtagtagttgcgttcgttcgtcgtcggttttcgtttaggttttagtggttttggagtttagtagaggaaggtagcggtgggcggggttcgggcgacgttacgttttagagcgtcgtcgttatttaatcgttttttttttggcggtttttttttcgggttcgtcggggtcgtggttcgcgttgataggttgcggaggtcgtcgtttcgtttcgtttttgataggataacgtggaagtacgagacgaggttgcgttcgtcggtcgtagagttgttagtaagttttaaatcgcggttgtcgttcggagggaagtagacggggagtcggtggcggtcgtcgagttcgtatgcgtaggttgtaaaggtttttttgggtcggtttcgtcgcgttaggttggcgagtgggattatttgattttttttaggttcgttagcgtggtgttacgagaggaaagcgtagtcgtagcgtacgaatgggaaggttaaatacggtttcggggagtttgagggaagttgtagggcgtttggaattggggtttcgagtgagtcggtaaaaatcgtttttcgttgagcgtttcggaataaatattgtttgaattgagtcgtaagtaagaaacggttaggagaagttggggcgatttgatgattagaatattttagggatt

SEQ ID NO: 32398 - DNA, 721 bp, Artificial Sequence
  chemically treated genomic DNA (Homo sapiens) CpG-island No: 32398
aatccctaaaatattctaatcatcaaatcgccccaacttctcctaaccgtttcttacttacgactcaattcaaacaatatttattccgaaacgctcaacgaaaaacgatttttaccgactcactcgaaaccccaattccaaacgccctacaacttccctcaaactccccgaaaccgtatttaaccttcccattcgtacgctacgactacgctttcctctcgtaacaccacgctaacgaacctaaaaaaaatcaaataatcccactcgccaacctaacgcgacgaaaccgacccaaaaaaacctttacaacctacgcatacgaactcgacgaccgccaccgactccccgtctacttccctccgaacgacaaccgcgatttaaaacttactaacaactctacgaccgacgaacgcaacctcgtctcgtacttccacgttatcctatcaaaaacgaaacgaaacgacgacctccgcaacctatcaacgcgaaccacgaccccgacgaacccgaaaaaaaaaccgccaaaaaaaaaacgattaaataacgacgacgctctaaaacgtaacgtcgcccgaaccccgcccaccgctaccttcctctactaaactccaaaaccactaaaacctaaacgaaaaccgacgacgaacgaacgcaactactaccgaaacgccgacgcgtactaataaaccacacacctttcctcctcttcactcgcgaaccc

SEQ ID NO: 32399 - DNA, 721 bp, Artificial Sequence
  chemically treated genomic DNA (Homo sapiens) CpG-island No: 32399
agtttttgaaatgttttaattattagatcgttttagttttttttgatcgttttttgtttacggtttagtttagatagtatttgtttcgggacgtttagcgggaggcggtttttatcggtttattcgagattttaattttaggcgttttgtagttttttttagatttttcgggatcgtgtttggtttttttattcgtacgttgcggttgcgtttttttttcgtaatattacgttggcgaatttggaaaggattaaatagttttattcgttaatttagcgcggcgggatcggtttaaaagggtttttgtagtttgcgtatgcggattcggcggtcgttatcgatttttcgtttgttttttttcgggcggtagtcgcggtttggagtttgttgatagttttgcgatcggcgggcgtagtttcgtttcgtgtttttacgttattttattagggacggggcggggcggcggttttcgtagtttattagcgcgaattacgatttcggcgagttcgggaggaaagtcgttagaaagaaggcgattggatggcggcggcgttttggggcgtagcgtcgttcgggtttcgtttatcgttgtttttttttgttgggttttagagttattgaggtttgagcgagagtcgacggcgggcgggcgtagttgttgtcggagcgtcggcgcgtgttggtgggttatatatttttttttttttttattcgcgagttt

SEQ ID NO: 32400 - DNA, 721 bp, Artificial Sequence
  chemically treated genomic DNA (Homo sapiens) CpG-island No: 32400
aaactcgcgaataaaaaaaaaaaaaaatatataacccaccaacacgcgccgacgctccgacaacaactacgcccgcccgccgtcgactctcgctcaaacctcaataactctaaaacccaacaaaaaaaaacaacgataaacgaaacccgaacgacgctacgccccaaaacgccgccgccatccaatcgccttctttctaacgactttcctcccgaactcgccgaaatcgtaattcgcgctaataaactacgaaaaccgccgccccgccccgtccctaataaaataacgtaaaaacacgaaacgaaactacgcccgccgatcgcaaaactatcaacaaactccaaaccgcgactaccgcccgaaaaaaaacaaacgaaaaatcgataacgaccgccgaatccgcatacgcaaactacaaaaacccttttaaaccgatcccgccgcgctaaattaacgaataaaactatttaatcctttccaaattcgccaacgtaatattacgaaaaaaaaacgcaaccgcaacgtacgaataaaaaaaccaaacacgatcccgaaaaatctaaaaaaaactacaaaacgcctaaaattaaaatctcgaataaaccgataaaaaccgcctcccgctaaacgtcccgaaacaaatactatctaaactaaaccgtaaacaaaaaacgatcaaaaaaaactaaaacgatctaataattaaaacatttcaaaaact

SEQ ID NO: 32401 - DNA, 607 bp, Artificial Sequence
  chemically treated genomic DNA (Homo sapiens) CpG-island No: 32401
aggcggtcgttaggggttttcgttcggcgttttcgcgagatagtcgagtttcggtcggttgcgcggcgcgttgggtgtatgagggggttgtttcggagcgacggcggttgtagttggagttaggcgttcgttcgttcgtcggttggttcgtcgggatttcgcgtatcggcggtagagttttttgcgtggattggtaagcgacgttttatttgtttcgagtttattattttttttcgcgttggttgtagttgattcggcgaagggagtcgatcgggttttgggttggaggtaaaattttacggtgagtaagaattcgttttaagttaggggaggcggcgtagttcggtggttgttcgttttcgatttcgttcgggcgggcggcgaggtttggggcgtatttgggcgcgggtgtaagaaggtgcgggaggcggcggatcggttttttgttcgtcggttacgggttttcggggttggagttttttttagatttttgtcggcgtttgggtttttggtcggtttttcgtgtgtatttttcggtaggaataagggtcgtttattttttatttcgggattttgatttgtttttgatttgaaaagatataaatta

SEQ ID NO: 32402 - DNA, 607 bp, Artificial Sequence
  chemically treated genomic DNA (Homo sapiens) CpG-island No: 32402
taatttatatcttttcaaatcaaaaacaaatcaaaatcccgaaataaaaaataaacgacccttattcctaccgaaaaatacacacgaaaaaccgaccaaaaacccaaacgccgacaaaaatctaaaaaaaactccaaccccgaaaacccgtaaccgacgaacaaaaaaccgatccgccgcctcccgcaccttcttacacccgcgcccaaatacgccccaaacctcgccgcccgcccgaacgaaatcgaaaacgaacaaccaccgaactacgccgcctcccctaacttaaaacgaattcttactcaccgtaaaattttacctccaacccaaaacccgatcgactcccttcgccgaatcaactacaaccaacgcgaaaaaaaataataaactcgaaacaaataaaacgtcgcttaccaatccacgcaaaaaactctaccgccgatacgcgaaatcccgacgaaccaaccgacgaacgaacgaacgcctaactccaactacaaccgccgtcgctccgaaacaaccccctcatacacccaacgcgccgcgcaaccgaccgaaactcgactatctcgcgaaaacgccgaacgaaaacccctaacgaccgcct

SEQ ID NO: 32403 - DNA, 607 bp, Artificial Sequence
  chemically treated genomic DNA (Homo sapiens) CpG-island No: 32403
tgatttatatttttttaaattaaggataaattaagatttcggggtggaaagtgggcgatttttgtttttgtcgggaagtgtatacgaggagtcggttagaaatttaggcgtcggtaggggtttgaagaggattttagtttcggaagttcgtggtcggcgggtagaagatcggttcgtcgtttttcgtatttttttgtattcgcgtttaggtgcgttttaaatttcgtcgttcgttcgggcgagatcgggagcgagtagttatcgggttgcgtcgttttttttagtttggagcgggtttttatttatcgtggggttttatttttagtttagggttcggtcggtttttttcgtcgggttagttgtagttagcgcgaaagaaaatggtgagttcggggtaggtggggcgtcgtttgttaatttacgtaagggattttgtcgtcggtgcgcgaggtttcggcgagttaatcggcggacgggcgagcgtttggttttagttgtagtcgtcgtcgtttcggagtagtttttttatgtatttagcgcgtcgcgtagtcggtcggggttcgattgtttcgcggggacgtcgagcggggatttttggcggtcgttt

SEQ ID NO: 32404 - DNA, 607 bp, Artificial Sequence
  chemically treated genomic DNA (Homo sapiens) CpG-island No: 32404
aaacgaccgccaaaaatccccgctcgacgtccccgcgaaacaatcgaaccccgaccgactacgcgacgcgctaaatacataaaaaaactactccgaaacgacgacgactacaactaaaaccaaacgctcgcccgtccgccgattaactcgccgaaacctcgcgcaccgacgacaaaatcccttacgtaaattaacaaacgacgccccacctaccccgaactcaccattttctttcgcgctaactacaactaacccgacgaaaaaaaccgaccgaaccctaaactaaaaataaaaccccacgataaataaaaacccgctccaaactaaaaaaaacgacgcaacccgataactactcgctcccgatctcgcccgaacgaacgacgaaatttaaaacgcacctaaacgcgaatacaaaaaaatacgaaaaacgacgaaccgatcttctacccgccgaccacgaacttccgaaactaaaatcctcttcaaacccctaccgacgcctaaatttctaaccgactcctcgtatacacttcccgacaaaaacaaaaatcgcccactttccaccccgaaatcttaatttatccttaatttaaaaaaatataaatca

SEQ ID NO: 32405 - DNA, 645 bp, Artificial Sequence
  chemically treated genomic DNA (Homo sapiens) CpG-island No: 32405
gggtcggggtcggggtcggggcgtggtcggggcgggttcgggggcgggttcggggcggggttgcggttgcggtgtttgcgttcgcggcggcggaggcgtaggcggtggcgagtgggtgagtgaggaggcggtattttggcgggtggttgtttggggttcggttgtcgggaagaggcgcgggtagaagcgggggttttttttagagttcgacgtatttttatttttttttttatttttttgatcgaagttgggtgtcgggttttcgtttttagcgattggtggaattgtttgtattcgggtttcgggtttttcggcggcggcggcggcggcggcggcgtagggataagggatggggatttggttttttttttgttttttcgtttttagtattcgagttgtttttttttcggggattcgttgggagcgttgtcgttgcgggttcgagaaaagggagtttcgggtattgagaggtttcgtttgggggaaggtcggagggtgggcggcgcgcggtttttgcggattaagtcggggttcgttaggaattcgagacggtttttgtcggcgaggagattatgcgggatgagatgggggtgtggagacgtttgtataattttagtttaagtttttagagagtggtgatgattt

SEQ ID NO: 32406 - DNA, 645 bp, Artificial Sequence
  chemically treated genomic DNA (Homo sapiens) CpG-island No: 32406
aaatcatcaccactctctaaaaacttaaactaaaattatacaaacgtctccacacccccatctcatcccgcataatctcctcgccgacaaaaaccgtctcgaattcctaacgaaccccgacttaatccgcaaaaaccgcgcgccgcccaccctccgaccttcccccaaacgaaacctctcaatacccgaaactcccttttctcgaacccgcaacgacaacgctcccaacgaatccccgaaaaaaaaacaactcgaatactaaaaacgaaaaaacaaaaaaaaaaccaaatccccatcccttatccctacgccgccgccgccgccgccgccgccgaaaaacccgaaacccgaatacaaacaattccaccaatcgctaaaaacgaaaacccgacacccaacttcgatcaaaaaaataaaaaaaaaaataaaaatacgtcgaactctaaaaaaaacccccgcttctacccgcgcctcttcccgacaaccgaaccccaaacaaccacccgccaaaataccgcctcctcactcacccactcgccaccgcctacgcctccgccgccgcgaacgcaaacaccgcaaccgcaaccccgccccgaacccgcccccgaacccgccccgaccacgccccgaccccgaccccgaccc

SEQ ID NO: 32407 - DNA, 645 bp, Artificial Sequence
  chemically treated genomic DNA (Homo sapiens) CpG-island No: 32407
aagttattattattttttagaagtttgggttgaaattgtgtaggcgtttttatatttttattttatttcgtatgattttttcgtcggtagggatcgtttcgggtttttagcgaatttcgatttggttcgtagaagtcgcgcgtcgtttatttttcggtttttttttaggcgaggttttttagtattcgaggtttttttttttcgagttcgtagcggtagcgtttttagcgggttttcgggaaggagatagttcgggtattgagggcgggaaagtaaggaagaggttagatttttattttttgtttttgcgtcgtcgtcgtcgtcgtcgtcgtcgggaagttcggggttcggatgtaggtaattttattagtcgttagaggcgaaagttcgatatttagtttcggttagagaaatgagagggaaagtaaaaatgcgtcgagttttgaggagagttttcgtttttattcgcgttttttttcggtagtcgaattttaaatagttattcgttaggatgtcgtttttttatttatttattcgttatcgtttgcgttttcgtcgtcgcgggcgtaggtatcgtaatcgtagtttcgtttcgggttcgttttcgggttcgtttcgattacgtttcggtttcggtttcggttt

SEQ ID NO: 32408 - DNA, 645 bp, Artificial Sequence
  chemically treated genomic DNA (Homo sapiens) CpG-island No: 32408
aaaccgaaaccgaaaccgaaacgtaatcgaaacgaacccgaaaacgaacccgaaacgaaactacgattacgatacctacgcccgcgacgacgaaaacgcaaacgataacgaataaataaataaaaaaacgacatcctaacgaataactatttaaaattcgactaccgaaaaaaaacgcgaataaaaacgaaaactctcctcaaaactcgacgcatttttactttccctctcatttctctaaccgaaactaaatatcgaactttcgcctctaacgactaataaaattacctacatccgaaccccgaacttcccgacgacgacgacgacgacgacgacgcaaaaacaaaaaataaaaatctaacctcttccttactttcccgccctcaatacccgaactatctccttcccgaaaacccgctaaaaacgctaccgctacgaactcgaaaaaaaaaaacctcgaatactaaaaaacctcgcctaaaaaaaaaccgaaaaataaacgacgcgcgacttctacgaaccaaatcgaaattcgctaaaaacccgaaacgatccctaccgacgaaaaaatcatacgaaataaaataaaaatataaaaacgcctacacaatttcaacccaaacttctaaaaaataataataactt

SEQ ID NO: 32409 - DNA, 777 bp, Artificial Sequence
  chemically treated genomic DNA (Homo sapiens) CpG-island No: 32409
aaggaggcggttcggggggcgacgcggcgcgacgcgacgggtatttttattcggtttcgaggcgggggcggcgacggttttttttgagtaatcgtatttcgaaagttttgggtcggaagagtcgcggacggaaaacggtataggattaggcgagaggaaggggagatgtgaggcgcggatagaggggagtttcgttcggaagttgtatcgttcgcggtcgtcgacgtttttatcgtttttttacgattgcgggtcgtcgtcgtcgatttgttcggggtcgtttcggaagttcgtcggcgttagtttcgttgtttggtttgttcggcgttttcgtttcgtttttgggtttcgagtcgtgtcggagcgacgtcggggtaggagcgttcggcgcggagaacgtcggtgaggtgttcgggagtcgggttatatgcggcgggttcggtcgtatttcgtcgggtcgtgtcggtcggagataacgcggaggggtaggattattcgcgtcgtacgagtgggggcggtgtttgtttgcgacgacgtcgcggttggcggcggggtttatttgaggagtagtttatttggagtcggcgggtgaaggatttcgaattgtcgcggaggtttcgagtcgagttcgttggggtagggttatttttttttttgagttttcgttacgtttagttcgatttattttacgcgtcgtttttttataggcggttaagtgattatcgtaattgatttaagttttaggttgttttaacgattatttttaggaaaaaaaaa

SEQ ID NO: 32410 - DNA, 777 bp, Artificial Sequence
  chemically treated genomic DNA (Homo sapiens) CpG-island No: 32410
tttttttttcctaaaaataatcgttaaaacaacctaaaacttaaatcaattacgataatcacttaaccgcctataaaaaaacgacgcgtaaaataaatcgaactaaacgtaacgaaaactcaaaaaaaaaaataaccctaccccaacgaactcgactcgaaacctccgcgacaattcgaaatccttcacccgccgactccaaataaactactcctcaaataaaccccgccgccaaccgcgacgtcgtcgcaaacaaacaccgcccccactcgtacgacgcgaataatcctacccctccgcgttatctccgaccgacacgacccgacgaaatacgaccgaacccgccgcatataacccgactcccgaacacctcaccgacgttctccgcgccgaacgctcctaccccgacgtcgctccgacacgactcgaaacccaaaaacgaaacgaaaacgccgaacaaaccaaacaacgaaactaacgccgacgaacttccgaaacgaccccgaacaaatcgacgacgacgacccgcaatcgtaaaaaaacgataaaaacgtcgacgaccgcgaacgatacaacttccgaacgaaactcccctctatccgcgcctcacatctccccttcctctcgcctaatcctataccgttttccgtccgcgactcttccgacccaaaactttcgaaatacgattactcaaaaaaaaccgtcgccgcccccgcctcgaaaccgaataaaaatacccgtcgcgtcgcgccgcgtcgccccccgaaccgcctcctt

SEQ ID NO: 32411 - DNA, 777 bp, Artificial Sequence
  chemically treated genomic DNA (Homo sapiens) CpG-island No: 32411
ttttttttttttaaaaatggtcgttaaagtagtttaggatttaggttaattgcggtggttatttgatcgtttgtgaggaggcggcgcgtggggtggatcggattgggcgtggcgggggtttaggaaggagggtggttttattttagcgggttcggttcggggttttcgcggtagttcggggttttttattcgtcggttttaggtaggttattttttaggtaagtttcgtcgttagtcgcgacgtcgtcgtagataggtatcgtttttattcgtgcggcgcgagtagttttgttttttcgcgttgttttcggtcggtacggttcggcggggtacggtcgagttcgtcgtatgtggttcggttttcggatattttatcggcgtttttcgcgtcgggcgtttttgtttcgacgtcgtttcggtacggttcggggtttagaggcgaggcgaggacgtcgggtaagttaggtagcggaattgacgtcggcgagttttcggggcggtttcgggtaggtcggcggcggcggttcgtagtcgtggaggagcggtgggagcgtcggcggtcgcgggcgatgtaattttcggacgggatttttttttgttcgcgttttatattttttttttttttcgtttagttttgtgtcgtttttcgttcgcgattttttcggtttagagttttcggagtgcggttgtttaggggaagtcgtcgtcgttttcgtttcggggtcgagtgagagtgttcgtcgcgtcgcgtcgcgtcgtttttcgggtcgttttttt

SEQ ID NO: 32412 - DNA, 777 bp, Artificial Sequence
  chemically treated genomic DNA (Homo sapiens) CpG-island No: 32412
aaaaaaacgacccgaaaaacgacgcgacgcgacgcgacgaacactctcactcgaccccgaaacgaaaacgacgacgacttcccctaaacaaccgcactccgaaaactctaaaccgaaaaaatcgcgaacgaaaaacgacacaaaactaaacgaaaaaaaaaaaaaatataaaacgcgaacaaaaaaaaatcccgtccgaaaattacatcgcccgcgaccgccgacgctcccaccgctcctccacgactacgaaccgccgccgccgacctacccgaaaccgccccgaaaactcgccgacgtcaattccgctacctaacttacccgacgtcctcgcctcgcctctaaaccccgaaccgtaccgaaacgacgtcgaaacaaaaacgcccgacgcgaaaaacgccgataaaatatccgaaaaccgaaccacatacgacgaactcgaccgtaccccgccgaaccgtaccgaccgaaaacaacgcgaaaaaacaaaactactcgcgccgcacgaataaaaacgatacctatctacgacgacgtcgcgactaacgacgaaacttacctaaaaaataacctacctaaaaccgacgaataaaaaaccccgaactaccgcgaaaaccccgaaccgaacccgctaaaataaaaccaccctccttcctaaacccccgccacgcccaatccgatccaccccacgcgccgcctcctcacaaacgatcaaataaccaccgcaattaacctaaatcctaaactactttaacgaccatttttaaaaaaaaaaaa

SEQ ID NO: 32413 - DNA, 743 bp, Artificial Sequence
  chemically treated genomic DNA (Homo sapiens) CpG-island No: 32413
atggggttttgtcgtttttcgaagagtcggatgggggcgttcgttttcggtgtattaagaggttggtttcgttaggggcgagcggttggtatcgaatttcgcgtatttcgtcgcgggcggggttgggtcgtagtcggttcgatttaaggttggtatttaaggttgcggtcggttaggcgaggcgaggcgaggcgacgtgagcgagggtgtttagggagaatagtcgttggtagtttaatgttgggtggttaacgttcgacggtgttcggtagtaattcggtcgatatttcgattcggatttcgagttgcgtcgcggataatgtcgcgggttcgtttcggattacgattttcgacgggttttgcgatcgtttcggggcggtttagcgtgtattgcgtcggttagtttgatagtcgggcgttttattcggttagttttgtttttagttagggacgttggttttttcgcggttttttttcgatgtttttttttattttagttgtttgaaattcggttttacgaatggtaggtagcgtttaaaatttaatttcgtaaagttagtattagttaataaagcgtacggatggaggttacgtgatagtagtgggtcggtttttcggttgagttttgatttttatggttttcgcggttcgttagaaggagtgcggtttattggaggtttttttatattttttttttattattttattgttttcggtggttgttgggatatcggaggattcgg

SEQ ID NO: 32414 - DNA, 743 bp, Artificial Sequence
  chemically treated genomic DNA (Homo sapiens) CpG-island No: 32414
ccgaatcctccgatatcccaacaaccaccgaaaacaataaaataataaaaaaaaaatataaaaaaacctccaataaaccgcactccttctaacgaaccgcgaaaaccataaaaatcaaaactcaaccgaaaaaccgacccactactatcacgtaacctccatccgtacgctttattaactaatactaactttacgaaattaaattttaaacgctacctaccattcgtaaaaccgaatttcaaacaactaaaataaaaaaaaacatcgaaaaaaaaccgcgaaaaaaccaacgtccctaactaaaaacaaaactaaccgaataaaacgcccgactatcaaactaaccgacgcaatacacgctaaaccgccccgaaacgatcgcaaaacccgtcgaaaatcgtaatccgaaacgaacccgcgacattatccgcgacgcaactcgaaatccgaatcgaaatatcgaccgaattactaccgaacaccgtcgaacgttaaccacccaacattaaactaccaacgactattctccctaaacaccctcgctcacgtcgcctcgcctcgcctcgcctaaccgaccgcaaccttaaataccaaccttaaatcgaaccgactacgacccaaccccgcccgcgacgaaatacgcgaaattcgataccaaccgctcgcccctaacgaaaccaacctcttaatacaccgaaaacgaacgcccccatccgactcttcgaaaaacgacaaaaccccat

SEQ ID NO: 32415 - DNA, 743 bp, Artificial Sequence
  chemically treated genomic DNA (Homo sapiens) CpG-island No: 32415
tcgagtttttcggtattttagtagttatcggaggtagtgagataatggaggaagaatgtagggagatttttagtggatcgtattttttttagcgagtcgcggaaattatagagattagggtttagtcggagggtcggtttattgttgttacgtggtttttattcgtgcgttttattggttggtgttggttttacggggttgaattttggacgttgtttgttattcgtgggatcgagttttaggtagttggaataaagagagatatcgggggaaagtcgcgagaaggttagcgtttttggttgggagtagagttagtcgagtagggcgttcggttgttaaattggtcggcgtagtgtacgttgggtcgtttcggagcggtcgtagagttcgtcgggagtcgtagttcgggacgggttcgcggtattgttcgcgacgtagttcgggattcgggtcggggtgtcggtcgggttgttgtcgggtatcgtcgagcgttagttatttagtattgagttgttagcggttgttttttttaagtattttcgtttacgtcgtttcgtttcgtttcgtttgatcggtcgtagttttggatattagttttaaatcgagtcgattacggtttagtttcgttcgcggcgaggtgcgcggggttcggtgttagtcgttcgtttttggcggggttagttttttgatgtatcggggacgggcgtttttattcgatttttcgaggggcggtagggttttat

SEQ ID NO: 32416 - DNA, 743 bp, Artificial Sequence
  chemically treated genomic DNA (Homo sapiens) CpG-island No: 32416
ataaaaccctaccgcccctcgaaaaatcgaataaaaacgcccgtccccgatacatcaaaaaactaaccccgccaaaaacgaacgactaacaccgaaccccgcgcacctcgccgcgaacgaaactaaaccgtaatcgactcgatttaaaactaatatccaaaactacgaccgatcaaacgaaacgaaacgaaacgacgtaaacgaaaatacttaaaaaaaacaaccgctaacaactcaatactaaataactaacgctcgacgatacccgacaacaacccgaccgacaccccgacccgaatcccgaactacgtcgcgaacaataccgcgaacccgtcccgaactacgactcccgacgaactctacgaccgctccgaaacgacccaacgtacactacgccgaccaatttaacaaccgaacgccctactcgactaactctactcccaaccaaaaacgctaaccttctcgcgactttcccccgatatctctctttattccaactacctaaaactcgatcccacgaataacaaacaacgtccaaaattcaaccccgtaaaaccaacaccaaccaataaaacgcacgaataaaaaccacgtaacaacaataaaccgaccctccgactaaaccctaatctctataatttccgcgactcgctaaaaaaaatacgatccactaaaaatctccctacattcttcctccattatctcactacctccgataactactaaaataccgaaaaactcga

SEQ ID NO: 32417 - DNA, 908 bp, Artificial Sequence
  chemically treated genomic DNA (Homo sapiens) CpG-island No: 32417
gcgtttcgggtttcgtttgcgtggttattgatcggaaacgcggcggcgggtgggttaggcggtttatttttcgttcggttcgtcgggcgcggcgttacggcgacgttttttagattcgtttgggtagttgttttatagtggtgttgaatggcgagcgcgttatttattaggttttggtgtagtagggttcggttttcgtcgatcggtcggttttcgttttttttcgtgtggtgttcggcggtcgtagtatggttttcggttattattcggagtattggaaggtgtagcggcgcgtagtttatagtatgatgcgtaatttttttacgcgttagtcgcgtagtcgttaagttttcgagggttacgtgttgagcgaggcgcgcgagttggtggcgttgttggtgcgcggtagcgcggacggcgtttttttcgattcgaggtcgttgatcgtcgtggtcgtggttaacgttatgagtgtcgtgtgtttcggttgtcgttatagttacgacgatttcgagtttcgtgagttgtttagttataacgaagagttcgggcgtacggtgggcgcgggtagtttggtggacgtgatgttttggttgtagtatttttttaattcggtgcgtatcgtttttcgcgaattcgagtagtttaatcgtaattttagtaattttattttggataagtttttgaggtattgcgaaagttttcggttcggggtcgtttttcgcgatatgatggacgtttttattttttttgcggaaaagaaggcggtcggggattcgtacggtggtggcgcgcggttggatttggagaacgtatcggttattattattgatattttcggcgttagttaggatattttgtttatcgcgttgtagtggttgttttttttttttattaggtaaagtttt

SEQ ID NO: 32418 - DNA, 908 bp, Artificial Sequence
  chemically treated genomic DNA (Homo sapiens) CpG-island No: 32418
aaaactttacctaataaaaaaaaaaaacaaccactacaacgcgataaacaaaatatcctaactaacgccgaaaatatcaataataataaccgatacgttctccaaatccaaccgcgcgccaccaccgtacgaatccccgaccgccttcttttccgcaaaaaaaataaaaacgtccatcatatcgcgaaaaacgaccccgaaccgaaaactttcgcaatacctcaaaaacttatccaaaataaaattactaaaattacgattaaactactcgaattcgcgaaaaacgatacgcaccgaattaaaaaaatactacaaccaaaacatcacgtccaccaaactacccgcgcccaccgtacgcccgaactcttcgttataactaaacaactcacgaaactcgaaatcgtcgtaactataacgacaaccgaaacacacgacactcataacgttaaccacgaccacgacgatcaacgacctcgaatcgaaaaaaacgccgtccgcgctaccgcgcaccaacaacgccaccaactcgcgcgcctcgctcaacacgtaaccctcgaaaacttaacgactacgcgactaacgcgtaaaaaaattacgcatcatactataaactacgcgccgctacaccttccaatactccgaataataaccgaaaaccatactacgaccgccgaacaccacacgaaaaaaaacgaaaaccgaccgatcgacgaaaaccgaaccctactacaccaaaacctaataaataacgcgctcgccattcaacaccactataaaacaactacccaaacgaatctaaaaaacgtcgccgtaacgccgcgcccgacgaaccgaacgaaaaataaaccgcctaacccacccgccgccgcgtttccgatcaataaccacgcaaacgaaacccgaaacgc

SEQ ID NO: 32419 - DNA, 908 bp, Artificial Sequence
  chemically treated genomic DNA (Homo sapiens) CpG-island No: 32419
gaggttttatttggtgaagaggaggagtagttattgtagcgcggtggatagggtgttttggttggcgtcgaagatgttagtgatagtggtcggtacgttttttaaatttagtcgcgcgttattatcgtgcgagttttcggtcgttttttttttcgtagagaggataaaggcgtttattatgtcgcggggggcggtttcgggtcgaaggttttcgtagtgttttaagaatttgtttaggatgaagttgttgaagttgcggttgagttgttcgaattcgcggaaaacggtgcgtatcgggttggggaagtattgtagttagggtattacgtttattaggttgttcgcgtttatcgtgcgttcgaatttttcgttgtggttgagtagtttacggaattcggggtcgtcgtggttgtagcggtagtcgaaatatacggtatttatgacgttggttacggttacgacggttagcggtttcgggtcgaggaaggcgtcgttcgcgttgtcgcgtattagtagcgttattagttcgcgcgtttcgtttagtacgtggttttcgaggatttggcggttgcgcggttggcgcgtgaagaagttgcgtattatgttgtgggttgcgcgtcgttgtattttttagtgtttcgagtagtggtcgaaagttatgttgcggtcgtcggatattatacggaaggaggcgaaggtcggtcggtcggcgaaggtcgagttttgttgtattagggtttggtggatggcgcgttcgttatttagtattattatggggtagttgtttaggcggatttggaaaacgtcgtcgtagcgtcgcgttcggcgagtcgaacgagaggtgagtcgtttggtttattcgtcgtcgcgttttcgattagtggttacgtaaacggggttcggggcgt

SEQ ID NO: 32420 - DNA, 908 bp, Artificial Sequence
  chemically treated genomic DNA (Homo sapiens) CpG-island No: 32420
acgccccgaaccccgtttacgtaaccactaatcgaaaacgcgacgacgaataaaccaaacgactcacctctcgttcgactcgccgaacgcgacgctacgacgacgttttccaaatccgcctaaacaactaccccataataatactaaataacgaacgcgccatccaccaaaccctaatacaacaaaactcgaccttcgccgaccgaccgaccttcgcctccttccgtataatatccgacgaccgcaacataactttcgaccactactcgaaacactaaaaaatacaacgacgcgcaacccacaacataatacgcaacttcttcacgcgccaaccgcgcaaccgccaaatcctcgaaaaccacgtactaaacgaaacgcgcgaactaataacgctactaatacgcgacaacgcgaacgacgccttcctcgacccgaaaccgctaaccgtcgtaaccgtaaccaacgtcataaataccgtatatttcgactaccgctacaaccacgacgaccccgaattccgtaaactactcaaccacaacgaaaaattcgaacgcacgataaacgcgaacaacctaataaacgtaataccctaactacaatacttccccaacccgatacgcaccgttttccgcgaattcgaacaactcaaccgcaacttcaacaacttcatcctaaacaaattcttaaaacactacgaaaaccttcgacccgaaaccgccccccgcgacataataaacgcctttatcctctctacgaaaaaaaaaacgaccgaaaactcgcacgataataacgcgcgactaaatttaaaaaacgtaccgaccactatcactaacatcttcgacgccaaccaaaacaccctatccaccgcgctacaataactactcctcctcttcaccaaataaaacctc

SEQ ID NO: 32421 - DNA, 1133 bp, Artificial Sequence
  chemically treated genomic DNA (Homo sapiens) CpG-island No: 32421
ggacggtgttcgatattacgatttagggagcgatatttgagttcgttcggtaattttcgggtttcggggacgggtttgggcggggaaggagtcggggcgcgtagtagtattcggcgagattgtagggcgttcgagtggtcggacgggggagcgagagttaaagtttgcggagcgcgtcgagtcgcgggcgttggcggtttcggtcggggagttgacgcgagtttgtcgggtcgcgggagttgcgggaggcggaggtcgagttgggggcggagcgggcggcgtttgggaggcggaggcggtgttttttagagttgcgtaggcgttgttcgtattttgttgattagttagtgttgggagcgttgttatggcgttttttaaattcgcggtttttttttatacgttcgaggcggagggaaggaggggtaagaggaggaggaggcgagcgggcggtcgtcgtagttgtagatttagggttagaggaggaggcggagcgggagtcgtcgtagttattcgggtcgtcgtcgtcgttcgtagtcgcgcggttgttttgagtttttttcgggcgtgagggtacgcggggcgttttagttatgtttcgtagcggtagttgagtcgggcgtcggtttttttttttcgggtcgttttagtcgtcgcgttttttcggttgttcgcggtcggagttgttcggcgtttttcgcgcgttttagatcgcgagcgcgagtagcggcggtcgtcgaggcgcgggtggtgtcggtggcggcggcgggggagcgcgggataggaggtttcggggaagatggattcggcgttttcgttgggttgtagttttaaggatgtgaagtggagttcggtggtcgtgtcgttcgattttttggttagtatttatcggttgttttagatcgcgcgtttggataacggtgagttttagttggggcgcggggtagacgggcgaggatagtcgtttttacgcgggtgtgcgcgcgtgtgttggaaagggtgggattcgcggggagtgggttgttcgtttttgagcgtcggagttggttcgagcggttgtcgtagttttggcgcgttgtttttaattttttttagtagtagataaggaggtggaaattagagtttttgtagtataa

SEQ ID NO: 32422 - DNA, 1133 bp, Artificial Sequence
  chemically treated genomic DNA (Homo sapiens) CpG-island No: 32422
ttatactacaaaaactctaatttccacctccttatctactactaaaaaaaattaaaaacaacgcgccaaaactacgacaaccgctcgaaccaactccgacgctcaaaaacgaacaacccactccccgcgaatcccaccctttccaacacacgcgcgcacacccgcgtaaaaacgactatcctcgcccgtctaccccgcgccccaactaaaactcaccgttatccaaacgcgcgatctaaaacaaccgataaatactaaccaaaaaatcgaacgacacgaccaccgaactccacttcacatccttaaaactacaacccaacgaaaacgccgaatccatcttccccgaaacctcctatcccgcgctcccccgccgccgccaccgacaccacccgcgcctcgacgaccgccgctactcgcgctcgcgatctaaaacgcgcgaaaaacgccgaacaactccgaccgcgaacaaccgaaaaaacgcgacgactaaaacgacccgaaaaaaaaaaaccgacgcccgactcaactaccgctacgaaacataactaaaacgccccgcgtaccctcacgcccgaaaaaaactcaaaacaaccgcgcgactacgaacgacgacgacgacccgaataactacgacgactcccgctccgcctcctcctctaaccctaaatctacaactacgacgaccgcccgctcgcctcctcctcctcttacccctccttccctccgcctcgaacgtataaaaaaaaaccgcgaatttaaaaaacgccataacaacgctcccaacactaactaatcaacaaaatacgaacaacgcctacgcaactctaaaaaacaccgcctccgcctcccaaacgccgcccgctccgcccccaactcgacctccgcctcccgcaactcccgcgacccgacaaactcgcgtcaactccccgaccgaaaccgccaacgcccgcgactcgacgcgctccgcaaactttaactctcgctcccccgtccgaccactcgaacgccctacaatctcgccgaatactactacgcgccccgactccttccccgcccaaacccgtccccgaaacccgaaaattaccgaacgaactcaaatatcgctccctaaatcgtaatatcgaacaccgtcc

SEQ ID NO: 32423 - DNA, 1133 bp, Artificial Sequence
  chemically treated genomic DNA (Homo sapiens) CpG-island No: 32423
ttatattgtaaggattttgatttttatttttttgtttgttgttggggggagttgagagtaacgcgttagggttgcggtagtcgttcgggttaatttcggcgtttaggggcgggtagtttatttttcgcgggttttattttttttagtatacgcgcgtatattcgcgtggagacggttgttttcgttcgtttgtttcgcgttttagttgggatttatcgttgtttaggcgcgcgatttggggtagtcggtaagtgttgattaggaggtcgagcggtacggttatcgagttttattttatatttttgaggttgtagtttagcgagggcgtcgggtttatttttttcgaagttttttgtttcgcgttttttcgtcgtcgttatcggtattattcgcgtttcggcggtcgtcgttgttcgcgttcgcggtttggggcgcgcgggaggcgtcgggtagtttcggtcgcgggtagtcgggggggcgcggcgattggggcggttcggagggagggggtcggcgttcggtttagttgtcgttgcggggtatggttggggcgtttcgcgtgtttttacgttcggagaagatttagagtagtcgcgcggttgcgggcggcggcggcggttcgggtggttgcggcggttttcgtttcgtttttttttttggttttgggtttgtagttgcggcggtcgttcgttcgtttttttttttttttattttttttttttttcgtttcgagcgtgtgaggaggagtcgcgggtttgagaaacgttatagtagcgtttttagtattgattaattaataaggtgcgagtaacgtttgcgtagttttgggagatatcgttttcgttttttaggcgtcgttcgtttcgtttttagttcggttttcgtttttcgtagttttcgcggttcggtaggttcgcgttagtttttcggtcggggtcgttagcgttcgcggttcggcgcgtttcgtaagttttagttttcgttttttcgttcgattattcgggcgttttgtagtttcgtcgggtgttgttgcgcgtttcggtttttttttcgtttaggttcgttttcggagttcgggaattgtcgagcgagtttaggtatcgttttttgagtcgtggtgtcgggtatcgttt

SEQ ID NO: 32424 - DNA, 1133 bp, Artificial Sequence
  chemically treated genomic DNA (Homo sapiens) CpG-island No: 32424
aaacgatacccgacaccacgactcaaaaaacgatacctaaactcgctcgacaattcccgaactccgaaaacgaacctaaacgaaaaaaaaaccgaaacgcgcaacaacacccgacgaaactacaaaacgcccgaataatcgaacgaaaaaacgaaaactaaaacttacgaaacgcgccgaaccgcgaacgctaacgaccccgaccgaaaaactaacgcgaacctaccgaaccgcgaaaactacgaaaaacgaaaaccgaactaaaaacgaaacgaacgacgcctaaaaaacgaaaacgatatctcccaaaactacgcaaacgttactcgcaccttattaattaatcaatactaaaaacgctactataacgtttctcaaacccgcgactcctcctcacacgctcgaaacgaaaaaaaaaaaaaataaaaaaaaaaaaaaacgaacgaacgaccgccgcaactacaaacccaaaaccaaaaaaaaaaacgaaacgaaaaccgccgcaaccacccgaaccgccgccgccgcccgcaaccgcgcgactactctaaatcttctccgaacgtaaaaacacgcgaaacgccccaaccataccccgcaacgacaactaaaccgaacgccgaccccctccctccgaaccgccccaatcgccgcgcccccccgactacccgcgaccgaaactacccgacgcctcccgcgcgccccaaaccgcgaacgcgaacaacgacgaccgccgaaacgcgaataataccgataacgacgacgaaaaaacgcgaaacaaaaaacttcgaaaaaaataaacccgacgccctcgctaaactacaacctcaaaaatataaaataaaactcgataaccgtaccgctcgacctcctaatcaacacttaccgactaccccaaatcgcgcgcctaaacaacgataaatcccaactaaaacgcgaaacaaacgaacgaaaacaaccgtctccacgcgaatatacgcgcgtatactaaaaaaaataaaacccgcgaaaaataaactacccgcccctaaacgccgaaattaacccgaacgactaccgcaaccctaacgcgttactctcaactccccccaacaacaaacaaaaaaataaaaatcaaaatccttacaatataa

SEQ ID NO: 32425 - DNA, 540 bp, Artificial Sequence
  chemically treated genomic DNA (Homo sapiens) CpG-island No: 32425
gagttcgcgttttcggttgtagtcgcgcggtttaggagcgggtttcggtcgacggaagggagcggcgcggggaggaagtgagtttattcgggaaggaaggaaataaatgaggtttttgttcggtagtcgttaggtcgaagcgtatagttttggggagaggttgcgagcgtaggtttcgttatcgttttttaaggaggtcgggggtagaggtcggttttgtaaagcgttgcggttttcgttatcgatatcgtttcgatttcgcgtattttattcgtcgtgttttcggggaggaaaagcgttaggttttattcgcgaggtttaggtttttaggatagagtgggaggtttagagcgcgcgagggttttatttaggtagatgtcgtttttagtttttacgcgttttatttttttcgcgagtgagatttagttttcgaagttttcgtacgcgcgcgcgtaatttttttttttttttttagtgtttttcgtaaaagtaggttttggagttttgatttacgattagagtgttgagttatttgtatga

SEQ ID NO: 32426 - DNA, 540 bp, Artificial Sequence
  chemically treated genomic DNA (Homo sapiens) CpG-island No: 32426
tcatacaaataactcaacactctaatcgtaaatcaaaactccaaaacctacttttacgaaaaacactaaaaaaaaaaaaaaaaattacgcgcgcgcgtacgaaaacttcgaaaactaaatctcactcgcgaaaaaaataaaacgcgtaaaaactaaaaacgacatctacctaaataaaaccctcgcgcgctctaaacctcccactctatcctaaaaacctaaacctcgcgaataaaacctaacgcttttcctccccgaaaacacgacgaataaaatacgcgaaatcgaaacgatatcgataacgaaaaccgcaacgctttacaaaaccgacctctacccccgacctccttaaaaaacgataacgaaacctacgctcgcaacctctccccaaaactatacgcttcgacctaacgactaccgaacaaaaacctcatttatttccttccttcccgaataaactcacttcctccccgcgccgctcccttccgtcgaccgaaacccgctcctaaaccgcgcgactacaaccgaaaacgcgaactc

SEQ ID NO: 32427 - DNA, 540 bp, Artificial Sequence
  chemically treated genomic DNA (Homo sapiens) CpG-island No: 32427
ttatgtaaataatttaatattttaatcgtaaattaaagttttagggtttatttttgcgaggggtattggagaaagaagagagggttgcgcgcgcgcgtgcgggagtttcggaagttaaattttattcgcggggaggatgggacgcgtggggattgaaggcggtatttgtttgaataaagttttcgcgcgttttgagttttttattttgttttggaggtttgaatttcgcgagtagagtttggcgtttttttttttcgggagtacgacggatagaatgcgcggggtcgagacggtgtcggtagcgggggtcgtagcgttttgtaaagtcggtttttgttttcggtttttttggagggcggtagcgggatttgcgttcgtagtttttttttagggttgtgcgtttcggtttggcggttgtcgggtaaaaattttatttatttttttttttttcgagtgagtttatttttttttcgcgtcgttttttttcgtcggtcggaattcgtttttgggtcgcgcggttgtagtcgggagcgcggattt

SEQ ID NO: 32428 - DNA, 540 bp, Artificial Sequence
  chemically treated genomic DNA (Homo sapiens) CpG-island No: 32428
aaatccgcgctcccgactacaaccgcgcgacccaaaaacgaattccgaccgacgaaaaaaaacgacgcgaaaaaaaaataaactcactcgaaaaaaaaaaaaataaataaaatttttacccgacaaccgccaaaccgaaacgcacaaccctaaaaaaaaactacgaacgcaaatcccgctaccgccctccaaaaaaaccgaaaacaaaaaccgactttacaaaacgctacgacccccgctaccgacaccgtctcgaccccgcgcattctatccgtcgtactcccgaaaaaaaaaaacgccaaactctactcgcgaaattcaaacctccaaaacaaaataaaaaactcaaaacgcgcgaaaactttattcaaacaaataccgccttcaatccccacgcgtcccatcctccccgcgaataaaatttaacttccgaaactcccgcacgcgcgcgcgcaaccctctcttctttctccaatacccctcgcaaaaataaaccctaaaactttaatttacgattaaaatattaaattatttacataa

SEQ ID NO: 32429 - DNA, 553 bp, Artificial Sequence
  chemically treated genomic DNA (Homo sapiens) CpG-island No: 32429
gtagcgaggtttagaaaaaaggttttttaggggatgtggggttaggggagcggagacgtcggggaggggttcgtattagtcgagggttcgggcgttgggggtttcgtttcgtgtttcgttttggtagaggaacgaacgggagtcgggaagaattttcgaaggaagatcgcgatttttagtatttcgatcgttacgtaataggtagcgaaagtttcggagtttagtcgtatcgtggatacgttaggttggatgcggaatcgattttatttggagtttcgttttgttgtagtcgcgttttcggttttaggtagtcgtttttaagtaataacgttaggttttatcgtcgtagcgatagtggcgttacgttcgtcggcgcgttatagtagcgcgttattttcgttagttcgttatagcggggcgttatttcggatatacgaatagcgggcggtgttttcggtttcgtggggtcgttttttcggcgagttcgcgacggtcgtcgtttacggcgaggtacgaggttttaaaaagtttttaatttggaaggtagggtgta

SEQ ID NO: 32430 - DNA, 553 bp, Artificial Sequence
  chemically treated genomic DNA (Homo sapiens) CpG-island No: 32430
tacaccctaccttccaaattaaaaactttttaaaacctcgtacctcgccgtaaacgacgaccgtcgcgaactcgccgaaaaaacgaccccacgaaaccgaaaacaccgcccgctattcgtatatccgaaataacgccccgctataacgaactaacgaaaataacgcgctactataacgcgccgacgaacgtaacgccactatcgctacgacgataaaacctaacgttattacttaaaaacgactacctaaaaccgaaaacgcgactacaacaaaacgaaactccaaataaaatcgattccgcatccaacctaacgtatccacgatacgactaaactccgaaactttcgctacctattacgtaacgatcgaaatactaaaaatcgcgatcttccttcgaaaattcttcccgactcccgttcgttcctctaccaaaacgaaacacgaaacgaaacccccaacgcccgaaccctcgactaatacgaacccctccccgacgtctccgctcccctaaccccacatcccctaaaaaaccttttttctaaacctcgctac

SEQ ID NO: 32431 - DNA, 553 bp, Artificial Sequence
  chemically treated genomic DNA (Homo sapiens) CpG-island No: 32431
tgtattttgttttttaaattaaaaattttttaaaatttcgtatttcgtcgtgggcggcgatcgtcgcggattcgtcgggaagacggttttacggagtcgggaatatcgttcgttgttcgtatgttcgaggtgacgtttcgttgtggcgggttggcggaagtgacgcgttgttgtggcgcgtcggcggacgtgacgttattgtcgttgcgacgataaggtttggcgttattgtttagaggcggttatttggagtcggaagcgcggttgtagtagggcgaggttttaggtggggtcggtttcgtatttagtttagcgtgtttacgatgcggttgggtttcgggattttcgttatttgttgcgtagcgatcgaggtgttagggatcgcggttttttttcggggatttttttcggttttcgttcgtttttttgttagagcggaatacggagcggagtttttagcgttcgaattttcggttggtacggattttttttcggcgttttcgtttttttgattttatattttttagaagattttttttttgagtttcgttgt

SEQ ID NO: 32432 - DNA, 553 bp, Artificial Sequence
  chemically treated genomic DNA (Homo sapiens) CpG-island No: 32432
acaacgaaactcaaaaaaaaaatcttctaaaaaatataaaatcaaaaaaacgaaaacgccgaaaaaaaatccgtaccaaccgaaaattcgaacgctaaaaactccgctccgtattccgctctaacaaaaaaacgaacgaaaaccgaaaaaaatccccgaaaaaaaaccgcgatccctaacacctcgatcgctacgcaacaaataacgaaaatcccgaaacccaaccgcatcgtaaacacgctaaactaaatacgaaaccgaccccacctaaaacctcgccctactacaaccgcgcttccgactccaaataaccgcctctaaacaataacgccaaaccttatcgtcgcaacgacaataacgtcacgtccgccgacgcgccacaacaacgcgtcacttccgccaacccgccacaacgaaacgtcacctcgaacatacgaacaacgaacgatattcccgactccgtaaaaccgtcttcccgacgaatccgcgacgatcgccgcccacgacgaaatacgaaattttaaaaaatttttaatttaaaaaacaaaataca

SEQ ID NO: 32433 - DNA, 610 bp, Artificial Sequence
  chemically treated genomic DNA (Homo sapiens) CpG-island No: 32433
tttaggaagcggtaagtcgttttcgtcgttcgttttaggcgtttggttagaaggcggcgcgcgatttggtcgggtgagttgaggcggtaagtcggagcgcggatgtttcgggttcggtcgcgagcgtagtgtttggggcgcgcgaaatatcgcgtacgtagacggaggcgcggtttcgtaaattcgtgtcggagcgagttcgggcgcggatattcgttttttcgggggattttggttttatttcgacgttacgatttcgttttcgcggtgttgtcggcgtcgggatgtagcgtttttttgcgcgttttaaaattagtttattcgaaattcgaggttcgtacgttattcggggcgtttttttaggtcggggcgtttcgttcgtcgtttattagtttttttttttttttttttttcgcgtttttacggaggttatttttaatttttcgacgttgtagttgggttatcgagtttgaggtcgtttagcgcgttgtttcgggtagagtaggcgataggtcgggggtttcgagtcggagaggaggtttgatagtgtagatgggtttgggtttttgtcgcgattggaaagttaagtatgtggtacgtgttttcgttt

SEQ ID NO: 32434 - DNA, 610 bp, Artificial Sequence
  chemically treated genomic DNA (Homo sapiens) CpG-island No: 32434
aaacgaaaacacgtaccacatacttaactttccaatcgcgacaaaaacccaaacccatctacactatcaaacctcctctccgactcgaaacccccgacctatcgcctactctacccgaaacaacgcgctaaacgacctcaaactcgataacccaactacaacgtcgaaaaattaaaaataacctccgtaaaaacgcgaaaaaaaaaaaaaaaaaaaaactaataaacgacgaacgaaacgccccgacctaaaaaaacgccccgaataacgtacgaacctcgaatttcgaataaactaattttaaaacgcgcaaaaaaacgctacatcccgacgccgacaacaccgcgaaaacgaaatcgtaacgtcgaaataaaaccaaaatcccccgaaaaaacgaatatccgcgcccgaactcgctccgacacgaatttacgaaaccgcgcctccgtctacgtacgcgatatttcgcgcgccccaaacactacgctcgcgaccgaacccgaaacatccgcgctccgacttaccgcctcaactcacccgaccaaatcgcgcgccgccttctaaccaaacgcctaaaacgaacgacgaaaacgacttaccgcttcctaaa

SEQ ID NO: 32435 - DNA, 610 bp, Artificial Sequence
  chemically treated genomic DNA (Homo sapiens) CpG-island No: 32435
gggcgggggtacgtattatatgtttggttttttaatcgcgatagaggtttaggtttatttatattgttaagtttttttttcggttcggagttttcggtttgtcgtttgttttattcgggatagcgcgttaggcggttttaggttcggtagtttagttgtagcgtcgggaagttaaaaataattttcgtgggagcgcgggggaggaagaaagagggaagttggtgggcggcgggcgagacgtttcggtttggagaggcgtttcgggtggcgtgcgggtttcgaatttcgggtgggttagttttagagcgcgtaaaagggcgttgtatttcggcgtcgatagtatcgcgggggcgaggtcgtggcgtcgaggtgaaattaaggtttttcgggagagcggatgttcgcgttcgggttcgtttcgatacgagtttgcggagtcgcgttttcgtttgcgtgcgcggtgtttcgcgcgttttagatattgcgttcgcggtcgggttcgggatattcgcgtttcggtttgtcgttttagtttattcggttaggtcgcgcgtcgttttttagttagacgtttaggacgagcggcgggggcggtttgtcgttttttagg

SEQ ID NO: 32436 - DNA, 610 bp, Artificial Sequence
  chemically treated genomic DNA (Homo sapiens) CpG-island No: 32436
cctaaaaaacgacaaaccgcccccgccgctcgtcctaaacgtctaactaaaaaacgacgcgcgacctaaccgaataaactaaaacgacaaaccgaaacgcgaatatcccgaacccgaccgcgaacgcaatatctaaaacgcgcgaaacaccgcgcacgcaaacgaaaacgcgactccgcaaactcgtatcgaaacgaacccgaacgcgaacatccgctctcccgaaaaaccttaatttcacctcgacgccacgacctcgcccccgcgatactatcgacgccgaaatacaacgcccttttacgcgctctaaaactaacccacccgaaattcgaaacccgcacgccacccgaaacgcctctccaaaccgaaacgtctcgcccgccgcccaccaacttccctctttcttcctcccccgcgctcccacgaaaattatttttaacttcccgacgctacaactaaactaccgaacctaaaaccgcctaacgcgctatcccgaataaaacaaacgacaaaccgaaaactccgaaccgaaaaaaaaacttaacaatataaataaacctaaacctctatcgcgattaaaaaaccaaacatataatacgtacccccgccc

SEQ ID NO: 32437 - DNA, 645 bp, Artificial Sequence
  chemically treated genomic DNA (Homo sapiens) CpG-island No: 32437
ttttttatcgttttttaaagtcgagaagaggtaggtttaggaggagtacgtagttaattagtcgggcggcgttttgaatttcggtacgttttcgcggtgttttttttttcggaggatttaggtagttcggtttcgttttttaatatttggggggttagacgggcgggattcgagagttttcgggcgggtcggggggtattggttgggacgcggggtttttggggtcgtagtttcgcgcgcgtaatcggcgggtgcgttttcgttttgcgcggttttcgggtagttttcgttgggtttagagcgtttcgagcgcgtttcgggaaggtgatttagcgacgcgtttaggggtcgaaaaatttcgagaaataggaacgaggggagggagtaggggcgttattttcgatttttggcgtcgcggcgcgtgtcggaatgatgggttttgtattttcgagttttttatttttttgttttaggaattcggcgcgggcgggggagagagttttgtagtcgtagtgttcgcggttatgcgttgcggggacgcgagcggcggttgtgggatggatgtggtcgcgcggagtttaggattagattcgttcgtttttttttttttttttgtttttttttttttttttttttttagcgagg

SEQ ID NO: 32438 - DNA, 645 bp, Artificial Sequence
  chemically treated genomic DNA (Homo sapiens) CpG-island No: 32438
cctcgctaaaaaaaaaaaaaaaaaaaaaaacaaaaaaaaaaaaaaaaacgaacgaatctaatcctaaactccgcgcgaccacatccatcccacaaccgccgctcgcgtccccgcaacgcataaccgcgaacactacgactacaaaactctctcccccgcccgcgccgaattcctaaaacaaaaaaataaaaaactcgaaaatacaaaacccatcattccgacacgcgccgcgacgccaaaaatcgaaaataacgcccctactccctcccctcgttcctatttctcgaaatttttcgacccctaaacgcgtcgctaaatcaccttcccgaaacgcgctcgaaacgctctaaacccaacgaaaactacccgaaaaccgcgcaaaacgaaaacgcacccgccgattacgcgcgcgaaactacgaccccaaaaaccccgcgtcccaaccaataccccccgacccgcccgaaaactctcgaatcccgcccgtctaaccccccaaatattaaaaaacgaaaccgaactacctaaatcctccgaaaaaaaaaacaccgcgaaaacgtaccgaaattcaaaacgccgcccgactaattaactacgtactcctcctaaacctacctcttctcgactttaaaaaacgataaaaaa

SEQ ID NO: 32439 - DNA, 645 bp, Artificial Sequence
  chemically treated genomic DNA (Homo sapiens) CpG-island No: 32439
tttcgttggaggaagaggaggggaagaaggtagaggagaggggaggggcggacggatttggttttgggtttcgcgcggttatatttattttatagtcgtcgttcgcgttttcgtagcgtatgatcgcgggtattgcggttgtagggttttttttttcgttcgcgtcggatttttggagtaagggggtggggggttcggaggtgtaggatttattatttcgatacgcgtcgcgacgttaggagtcggggatgacgtttttgtttttttttttcgtttttgtttttcggagtttttcgatttttgagcgcgtcgttgagttattttttcggaacgcgttcgggacgttttggatttagcggggattgttcgggggtcgcgtaaggcgaaggcgtattcgtcgattacgcgcgcggagttgcggttttagggatttcgcgttttagttagtgtttttcgattcgttcggggattttcgggtttcgttcgtttgattttttaagtgttgggaaacggggtcgagttgtttgggtttttcggaagagaagatatcgcggaggcgtgtcggagtttagggcgtcgttcggttaattggttgcgtgttttttttggatttgttttttttcgattttaagaagcgatgagaga

SEQ ID NO: 32440 - DNA, 645 bp, Artificial Sequence
  chemically treated genomic DNA (Homo sapiens) CpG-island No: 32440
tctctcatcgcttcttaaaatcgaaaaaaaacaaatccaaaaaaaacacgcaaccaattaaccgaacgacgccctaaactccgacacgcctccgcgatatcttctcttccgaaaaacccaaacaactcgaccccgtttcccaacacttaaaaaatcaaacgaacgaaacccgaaaatccccgaacgaatcgaaaaacactaactaaaacgcgaaatccctaaaaccgcaactccgcgcgcgtaatcgacgaatacgccttcgccttacgcgacccccgaacaatccccgctaaatccaaaacgtcccgaacgcgttccgaaaaaataactcaacgacgcgctcaaaaatcgaaaaactccgaaaaacaaaaacgaaaaaaaaaaacaaaaacgtcatccccgactcctaacgtcgcgacgcgtatcgaaataataaatcctacacctccgaaccccccacccccttactccaaaaatccgacgcgaacgaaaaaaaaaaccctacaaccgcaatacccgcgatcatacgctacgaaaacgcgaacgacgactataaaataaatataaccgcgcgaaacccaaaaccaaatccgtccgcccctcccctctcctctaccttcttcccctcctcttcctccaacgaaa

SEQ ID NO: 32441 - DNA, 675 bp, Artificial Sequence
  chemically treated genomic DNA (Homo sapiens) CpG-island No: 32441
tacgtttttgcgtttttttcggggcgtttttttggtatttttttgggcgcgggtaggtgcgggatgttgaacgagtttcggacggattgtagcgagcggttgggttcgggcgacgagggttggaagtcgattcgggtattttggaggtcgaggtttttgagtatggttacgatgagcgtgtgtagggtcgtgaagttgacggcgtttatttttggcgtgtcgatggagaggttcgttagttttcggagggagatcgtggtcgcgggcggtatcgtggttgttaggagttgtcgtcgtcgcggggcgtcggttaattatttttcgtttattgtacgtcgcgttttggggtttttcgggggttttgcgaggttttcggggcgtttttgtttcgggttcggtcgagttattggatagagtttttgtttttagggaatttgcgttttcgtttttcggcggggttcgcgatggttattttttcgttgtttgtcgttggtttcgggttttcgagttggagttttggatttttagttttcgcgtcggcggacgtttgaaacgtgggggttttcgcgtgttttgaagattttacgtaataatacgtttttttgcgagttacgggggcggggggaagtaaaggttattataaggattataaggggagttttggtaacgggttga

SEQ ID NO: 32442 - DNA, 675 bp, Artificial Sequence
  chemically treated genomic DNA (Homo sapiens) CpG-island No: 32442
tcaacccgttaccaaaactccccttataatccttataataacctttacttccccccgcccccgtaactcgcaaaaaaacgtattattacgtaaaatcttcaaaacacgcgaaaacccccacgtttcaaacgtccgccgacgcgaaaactaaaaatccaaaactccaactcgaaaacccgaaaccaacgacaaacaacgaaaaaataaccatcgcgaaccccgccgaaaaacgaaaacgcaaattccctaaaaacaaaaactctatccaataactcgaccgaacccgaaacaaaaacgccccgaaaacctcgcaaaacccccgaaaaaccccaaaacgcgacgtacaataaacgaaaaataattaaccgacgccccgcgacgacgacaactcctaacaaccacgataccgcccgcgaccacgatctccctccgaaaactaacgaacctctccatcgacacgccaaaaataaacgccgtcaacttcacgaccctacacacgctcatcgtaaccatactcaaaaacctcgacctccaaaatacccgaatcgacttccaaccctcgtcgcccgaacccaaccgctcgctacaatccgtccgaaactcgttcaacatcccgcacctacccgcgcccaaaaaaataccaaaaaaacgccccgaaaaaaacgcaaaaacgta

SEQ ID NO: 32443 - DNA, 675 bp, Artificial Sequence
  chemically treated genomic DNA (Homo sapiens) CpG-island No: 32443
ttagttcgttgttaaggttttttttgtgatttttgtggtggtttttattttttttcgttttcgtggttcgtagggaggcgtgttgttacgtggaatttttagggtacgcgggggtttttacgttttaaacgttcgtcggcgcggggattgggagtttagggttttagttcggggattcgaggttagcgatagatagcggaggggtggttatcgcggatttcgtcggggagcggaggcgtagattttttggaggtaggagttttgtttagtgattcggtcggattcggggtaggggcgtttcgaggatttcgtagggttttcgaaaggttttaaggcgcggcgtgtagtgagcgggaagtggttggtcggcgtttcgcggcggcgatagtttttgatagttacgatgtcgttcgcgattacggttttttttcgggagttggcggatttttttatcggtacgttagaggtgggcgtcgttaattttacggttttgtatacgtttatcgtggttatgtttaagaatttcgatttttaaaatattcggatcgatttttagttttcgtcgttcgagtttagtcgttcgttgtagttcgttcggagttcgtttagtatttcgtatttgttcgcgtttaaggaggtgttaagggggcgtttcgggagaagcgtaggggcgtg

SEQ ID NO: 32444 - DNA, 675 bp, Artificial Sequence
  chemically treated genomic DNA (Homo sapiens) CpG-island No: 32444
cacgcccctacgcttctcccgaaacgcccccttaacacctccttaaacgcgaacaaatacgaaatactaaacgaactccgaacgaactacaacgaacgactaaactcgaacgacgaaaactaaaaatcgatccgaatattttaaaaatcgaaattcttaaacataaccacgataaacgtatacaaaaccgtaaaattaacgacgcccacctctaacgtaccgataaaaaaatccgccaactcccgaaaaaaaaccgtaatcgcgaacgacatcgtaactatcaaaaactatcgccgccgcgaaacgccgaccaaccacttcccgctcactacacgccgcgccttaaaacctttcgaaaaccctacgaaatcctcgaaacgcccctaccccgaatccgaccgaatcactaaacaaaactcctacctccaaaaaatctacgcctccgctccccgacgaaatccgcgataaccacccctccgctatctatcgctaacctcgaatccccgaactaaaaccctaaactcccaatccccgcgccgacgaacgtttaaaacgtaaaaacccccgcgtaccctaaaaattccacgtaacaacacgcctccctacgaaccacgaaaacgaaaaaaaataaaaaccaccacaaaaatcacaaaaaaaaccttaacaacgaactaa

SEQ ID NO: 32445 - DNA, 514 bp, Artificial Sequence
  chemically treated genomic DNA (Homo sapiens) CpG-island No: 32445
cgggtgcgcgcgtagttgttgtttattagtcggtaattgttttagagtcgcggcgcgcgtagggttcgcgttgtcggggttggcgtttttttttcggttcgacgttagagtagtagttacgtgatttggttttttttagtttcgggttcgacggggtgcgttcgcgtcgtcgtagtttttttttttttttttcgtttgttttttattcgaggtgaattttgcgaagagaagttcgggggtgtagtgagagggcggaatcgtttcgcgggcgttcgaaagtttcgtttagtcgtcgtagttcgcggtgatcgagtgtagcgcgtttgcgttcgtcgcgggatacggtaggcggggcggggtcgaatacgagtggttaggggtacgacgggagttgtagtttagggtacggttcgattcgcgtgaagaggggaataattttttttttcggttcggttgtgttgtatatttattttggaagtattttagagggcgggcgttgttttttatttttaga

SEQ ID NO: 32446 - DNA, 514 bp, Artificial Sequence
  chemically treated genomic DNA (Homo sapiens) CpG-island No: 32446
tctaaaaataaaaaacaacgcccgccctctaaaatacttccaaaataaatatacaacacaaccgaaccgaaaaaaaaaattattcccctcttcacgcgaatcgaaccgtaccctaaactacaactcccgtcgtacccctaaccactcgtattcgaccccgccccgcctaccgtatcccgcgacgaacgcaaacgcgctacactcgatcaccgcgaactacgacgactaaacgaaactttcgaacgcccgcgaaacgattccgccctctcactacacccccgaacttctcttcgcaaaattcacctcgaataaaaaacaaacgaaaaaaaaaaaaaaaaactacgacgacgcgaacgcaccccgtcgaacccgaaactaaaaaaaaccaaatcacgtaactactactctaacgtcgaaccgaaaaaaaaacgccaaccccgacaacgcgaaccctacgcgcgccgcgactctaaaacaattaccgactaataaacaacaactacgcgcgcacccg

SEQ ID NO: 32447 - DNA, 514 bp, Artificial Sequence
  chemically treated genomic DNA (Homo sapiens) CpG-island No: 32447
tttgagggtgaggagtagcgttcgttttttaggatgtttttagagtgagtgtgtagtatagtcggatcgaggaaaaggattatttttttttttacgcgggtcgggtcgtgttttggattatagttttcgtcgtgtttttggttattcgtattcggtttcgtttcgtttgtcgtgtttcgcggcgagcgtaggcgcgttgtattcggttatcgcgggttgcggcggttgggcggggttttcgggcgttcgcgggacggtttcgtttttttattgtattttcgggttttttttcgtaaggtttatttcgaatgaggaataagcggggagggaagggaagggttgcggcggcgcgggcgtatttcgtcgggttcggggttgggggaggttaggttacgtaattgttgttttggcgtcgggtcggggagggggcgttagtttcggtagcgcgaattttgcgcgcgtcgcggttttgaaatagttatcggttagtaaataatagttgcgcgcgtattcg

SEQ ID NO: 32448 - DNA, 514 bp, Artificial Sequence
  chemically treated genomic DNA (Homo sapiens) CpG-island No: 32448
cgaatacgcgcgcaactattatttactaaccgataactatttcaaaaccgcgacgcgcgcaaaattcgcgctaccgaaactaacgccccctccccgacccgacgccaaaacaacaattacgtaacctaacctcccccaaccccgaacccgacgaaatacgcccgcgccgccgcaacccttcccttccctccccgcttattcctcattcgaaataaaccttacgaaaaaaaacccgaaaatacaataaaaaaacgaaaccgtcccgcgaacgcccgaaaaccccgcccaaccgccgcaacccgcgataaccgaatacaacgcgcctacgctcgccgcgaaacacgacaaacgaaacgaaaccgaatacgaataaccaaaaacacgacgaaaactataatccaaaacacgacccgacccgcgtaaaaaaaaaaataatccttttcctcgatccgactatactacacactcactctaaaaacatcctaaaaaacgaacgctactcctcaccctcaaa

SEQ ID NO: 32449 - DNA, 605 bp, Artificial Sequence
  chemically treated genomic DNA (Homo sapiens) CpG-island No: 32449
ggattattcgcgggattttcggacggtagagtagggattcgttgggttttgggagttgggttgagcgaggagcgtcggggtttcggtttatagggcgcggaggcgtagacggcgatagggaggatttcggcggggagtttttaggtagaagtagtatcgcgttagggatataggcgtcggtcgttgttcgaggaggggtcgtttttcgggcgttgcgttggggtcggggcgtagcggggaagacgttttcgcggggttgattcggtagagcggttagcgtcgcgttgttcgtttggtttaaagtcgaatttaggcggtttttcgtgcgcgtagggggaggggcggcgttgttcgagaggttcgcgttggaggcggaggtttggcgtttcggaggataggatcgagaggtcggcgcggcggtcgtcgggggattcgttggggtttttcgtagggtttggcgcgcggggttcggggaggagatcgcggtcgtggggaggagagagttcgaggattaggaatagttcggggttttttacgatttcgcgtttgttttcgtttttatcgtttggatgggtttttgcgttagtttagtatggtgaattttg

SEQ ID NO: 32450 - DNA, 605 bp, Artificial Sequence
  chemically treated genomic DNA (Homo sapiens) CpG-island No: 32450
caaaattcaccatactaaactaacgcaaaaacccatccaaacgataaaaacgaaaacaaacgcgaaatcgtaaaaaaccccgaactattcctaatcctcgaactctctcctccccacgaccgcgatctcctccccgaaccccgcgcgccaaaccctacgaaaaaccccaacgaatcccccgacgaccgccgcgccgacctctcgatcctatcctccgaaacgccaaacctccgcctccaacgcgaacctctcgaacaacgccgcccctccccctacgcgcacgaaaaaccgcctaaattcgactttaaaccaaacgaacaacgcgacgctaaccgctctaccgaatcaaccccgcgaaaacgtcttccccgctacgccccgaccccaacgcaacgcccgaaaaacgacccctcctcgaacaacgaccgacgcctatatccctaacgcgatactacttctacctaaaaactccccgccgaaatcctccctatcgccgtctacgcctccgcgccctataaaccgaaaccccgacgctcctcgctcaacccaactcccaaaacccaacgaatccctactctaccgtccgaaaatcccgcgaataatcc

SEQ ID NO: 32451 - DNA, 605 bp, Artificial Sequence
  chemically treated genomic DNA (Homo sapiens) CpG-island No: 32451
tagggtttattatgttgggttggcgtagagatttatttaggcggtaggagcggggataggcgcggggtcgtggagggtttcgggttgtttttgattttcgaatttttttttttttacggtcgcggtttttttttcgggtttcgcgcgttaggttttgcgaaaagttttaacgggtttttcggcgatcgtcgcgtcggtttttcggttttgtttttcgaggcgttaggttttcgtttttagcgcgggtttttcgggtagcgtcgtttttttttttgcgcgtacgggaggtcgtttgggttcggttttggattaggcgagtagcgcggcgttggtcgttttgtcgggttagtttcgcggagacgtttttttcgttgcgtttcggttttagcgtagcgttcggggagcggttttttttcgggtagcggtcggcgtttgtgtttttagcgcggtattgtttttgtttgaggatttttcgtcggggttttttttgtcgtcgtttgcgttttcgcgttttgtgggtcgaggtttcggcgtttttcgtttagtttaatttttaaggtttagcgggtttttgttttgtcgttcggggatttcgcgggtggttt

SEQ ID NO: 32452 - DNA, 605 bp, Artificial Sequence
  chemically treated genomic DNA (Homo sapiens) CpG-island No: 32452
aaaccacccgcgaaatccccgaacgacaaaacaaaaacccgctaaaccttaaaaattaaactaaacgaaaaacgccgaaacctcgacccacaaaacgcgaaaacgcaaacgacgacaaaaaaaaccccgacgaaaaatcctcaaacaaaaacaataccgcgctaaaaacacaaacgccgaccgctacccgaaaaaaaaccgctccccgaacgctacgctaaaaccgaaacgcaacgaaaaaaacgtctccgcgaaactaacccgacaaaacgaccaacgccgcgctactcgcctaatccaaaaccgaacccaaacgacctcccgtacgcgcaaaaaaaaaaacgacgctacccgaaaaacccgcgctaaaaacgaaaacctaacgcctcgaaaaacaaaaccgaaaaaccgacgcgacgatcgccgaaaaacccgttaaaacttttcgcaaaacctaacgcgcgaaacccgaaaaaaaaaccgcgaccgtaaaaaaaaaaaaattcgaaaatcaaaaacaacccgaaaccctccacgaccccgcgcctatccccgctcctaccgcctaaataaatctctacgccaacccaacataataaacccta

SEQ ID NO: 32453 - DNA, 738 bp, Artificial Sequence
  chemically treated genomic DNA (Homo sapiens) CpG-island No: 32453
ggagcggagatcgtaaaatttttttggggtcggtattttttgttttcgttttggcgtagacgtgtttatttttgggacggtttcgagcgtacgtagtcggcgggcgattttttttttagagatttgtacgttgttttcggtttttagcgtatcgttatttttaattcgatatatttaagttcgttttagttacgcgttaagacgtttatttttcgtagtaggcgttttaggtgcggttcggtttaggcgtttagggcgtttggcggtttcgcgcgtcgtagtagttttcgttttttttcgagcgtcgttattcggttttgtagcgcggtcgtttggatatttagtagtaggtaggtagtcgtcgagtttacggagagtagtaggtatagcgcgtttatcgttcgggattcggtcgtcgtcgtcgagcgtttttcgtcgtcgtcgttcgtcgtattgttttttttcgcgtcgtcgtcgttatcggcgcgttcgtttgggtttatggcgcgttcgtcgcgcgtggatttttcgagggggcggtgttgttggggtagaggttgggtgcgagaggagtaggcgggatagttcgaggtacgaggttcgtcgggcgcgggggttagttttcgggtagtagcggatcgtcgcgtacgtttttttcgtcgtagttagtttttttatagcggttattttgggtagttttttttatgtaaatagattttgttagaaaaggagtaggga

SEQ ID NO: 32454 - DNA, 738 bp, Artificial Sequence
  chemically treated genomic DNA (Homo sapiens) CpG-island No: 32454
tccctactccttttctaacaaaatctatttacataaaaaaaactacccaaaataaccgctataaaaaaactaactacgacgaaaaaaacgtacgcgacgatccgctactacccgaaaactaacccccgcgcccgacgaacctcgtacctcgaactatcccgcctactcctctcgcacccaacctctaccccaacaacaccgccccctcgaaaaatccacgcgcgacgaacgcgccataaacccaaacgaacgcgccgataacgacgacgacgcgaaaaaaaacaatacgacgaacgacgacgacgaaaaacgctcgacgacgacgaccgaatcccgaacgataaacgcgctatacctactactctccgtaaactcgacgactacctacctactactaaatatccaaacgaccgcgctacaaaaccgaataacgacgctcgaaaaaaaacgaaaactactacgacgcgcgaaaccgccaaacgccctaaacgcctaaaccgaaccgcacctaaaacgcctactacgaaaaataaacgtcttaacgcgtaactaaaacgaacttaaatatatcgaattaaaaataacgatacgctaaaaaccgaaaacaacgtacaaatctctaaaaaaaaaatcgcccgccgactacgtacgctcgaaaccgtcccaaaaataaacacgtctacgccaaaacgaaaacaaaaaataccgaccccaaaaaaattttacgatctccgctcc

SEQ ID NO: 32455 - DNA, 738 bp, Artificial Sequence
  chemically treated genomic DNA (Homo sapiens) CpG-island No: 32455
tttttgttttttttttggtagggtttatttgtatagaggaaattgtttaaagtggtcgttgtggaggagttggttgcggcgaagggggcgtgcgcggcgattcgttgttattcggaggttaattttcgcgttcggcggatttcgtgtttcgggttgtttcgtttgtttttttcgtatttagtttttgttttagtagtatcgttttttcggagagtttacgcgcgacgaacgcgttatgggtttaggcgagcgcgtcggtggcggcggcgacgcggggaagggtaatgcggcgggcggcggcggcggagggcgttcggcgacgacggtcgggtttcgggcggtgagcgcgttgtgtttgttgtttttcgtgggttcggcggttgtttgtttgttgttgggtgtttaggcggtcgcgttgtagggtcgggtggcggcgttcgaggaggagcgggagttgttgcggcgcgcggggtcgttaggcgttttggacgtttgggtcgagtcgtatttggagcgtttgttgcgggaggtgagcgttttggcgcgtggttggggcggatttgggtgtgtcgggttgagggtggcggtacgttgggagtcgggggtagcgtgtaggtttttgggaggagggtcgttcgtcggttgcgtgcgttcggggtcgttttagagatgggtacgtttgcgttaaggcggaggtagggggtgtcggttttaagggggttttgcggttttcgtttt

SEQ ID NO: 32456 - DNA, 738 bp, Artificial Sequence
  chemically treated genomic DNA (Homo sapiens) CpG-island No: 32456
aaaacgaaaaccgcaaaacccccttaaaaccgacaccccctacctccgccttaacgcaaacgtacccatctctaaaacgaccccgaacgcacgcaaccgacgaacgaccctcctcccaaaaacctacacgctacccccgactcccaacgtaccgccaccctcaacccgacacacccaaatccgccccaaccacgcgccaaaacgctcacctcccgcaacaaacgctccaaatacgactcgacccaaacgtccaaaacgcctaacgaccccgcgcgccgcaacaactcccgctcctcctcgaacgccgccacccgaccctacaacgcgaccgcctaaacacccaacaacaaacaaacaaccgccgaacccacgaaaaacaacaaacacaacgcgctcaccgcccgaaacccgaccgtcgtcgccgaacgccctccgccgccgccgcccgccgcattacccttccccgcgtcgccgccgccaccgacgcgctcgcctaaacccataacgcgttcgtcgcgcgtaaactctccgaaaaaacgatactactaaaacaaaaactaaatacgaaaaaaacaaacgaaacaacccgaaacacgaaatccgccgaacgcgaaaattaacctccgaataacaacgaatcgccgcgcacgcccccttcgccgcaaccaactcctccacaacgaccactttaaacaatttcctctatacaaataaaccctaccaaaaaaaaaacaaaaa

SEQ ID NO: 32457 - DNA, 860 bp, Artificial Sequence
  chemically treated genomic DNA (Homo sapiens) CpG-island No: 32457
agatacgcggtatatattgagggcgggatacgggcgttttttttcggttttattcgagttcgtagagaacgtaaatattttttcggtttagaggtttcgggattcgggtgggcgggggggggggggtggaaatgtttgggtcgcgtagtcgtagtgtggaggttcgagtttcgtttttacgttacgtggagtttcgtttttaggtggagcggcgggagcgcgtaaggttttgttacgtaggcgcgttcgcgcggcgtaggtggtgttagaggcgattcgggggattttagggcgacggcgttgtcgttattttgtggggtgtttgtcgtagcggtcgaggagggaagacggtagtttggcgatatttttcggtcgaagggttatttgtttttgcggaggtagggttgtagatggtgtgtgttgggataggcggttgtcggtttttaggttttcgagttaggtgtcggagaaacgatcgcgttaggggtttgggtttttggagttgagttgggagttttgcgaggcgttgttcggttggtgtacgtcggtagtatcgaaagttgttcgggcgtcgcggttttgtcgttgatttttttttgagggttttggtcgttcgcgtcgcggcgttcggaggtcgtgggttcgcggttttttgttgtttggcgagcgcggttgttggttaattttgtcgggattttttttagtcggcgggcgttaggatttgtcgggagatttttcgagagtcgtttttggtattcgtgttgtcggagattaagtttttttttggatttttggtttgggtcgtttgtagcgtttcgggggttttttagagttaagtatttgtttttgttttgagtgcg

SEQ ID NO: 32458 - DNA, 860 bp, Artificial Sequence
  chemically treated genomic DNA (Homo sapiens) CpG-island No: 32458
cgcactcaaaacaaaaacaaatacttaactctaaaaaacccccgaaacgctacaaacgacccaaaccaaaaatccaaaaaaaaacttaatctccgacaacacgaataccaaaaacgactctcgaaaaatctcccgacaaatcctaacgcccgccgactaaaaaaaatcccgacaaaattaaccaacaaccgcgctcgccaaacaacaaaaaaccgcgaacccacgacctccgaacgccgcgacgcgaacgaccaaaaccctcaaaaaaaaatcaacgacaaaaccgcgacgcccgaacaactttcgatactaccgacgtacaccaaccgaacaacgcctcgcaaaactcccaactcaactccaaaaacccaaacccctaacgcgatcgtttctccgacacctaactcgaaaacctaaaaaccgacaaccgcctatcccaacacacaccatctacaaccctacctccgcaaaaacaaataacccttcgaccgaaaaatatcgccaaactaccgtcttccctcctcgaccgctacgacaaacaccccacaaaataacgacaacgccgtcgccctaaaatcccccgaatcgcctctaacaccacctacgccgcgcgaacgcgcctacgtaacaaaaccttacgcgctcccgccgctccacctaaaaacgaaactccacgtaacgtaaaaacgaaactcgaacctccacactacgactacgcgacccaaacatttccacccccccccccccgcccacccgaatcccgaaacctctaaaccgaaaaaatatttacgttctctacgaactcgaataaaaccgaaaaaaaacgcccgtatcccgccctcaatatataccgcgtatct

SEQ ID NO: 32459 - DNA, 860 bp, Artificial Sequence
  chemically treated genomic DNA (Homo sapiens) CpG-island No: 32459
cgtatttaagataggggtaaatgtttgattttggaaaattttcgaaacgttataaacggtttaggttaggaatttaggggaagatttgattttcgataatacgaatgttagagacggttttcgaagggtttttcgataggttttagcgttcgtcggttggaagaggtttcgatagggttaattaatagtcgcgttcgttaggtagtaggggatcgcgagtttacggttttcggacgtcgcgacgcgagcggttagggtttttagagaagggttagcggtagaatcgcgacgttcgagtaattttcggtgttgtcggcgtgtattagtcgagtagcgtttcgtagaatttttaatttagttttagaagtttaggtttttaacgcggtcgttttttcgatatttggttcggagatttaaagatcgatagtcgtttgttttagtatatattatttgtaattttattttcgtaaaagtaaatggtttttcggtcgagaaatgtcgttaaattgtcgtttttttttttcggtcgttgcgataaatattttataaaatggcggtagcgtcgtcgttttagaatttttcgagtcgtttttagtattatttacgtcgcgcgaacgcgtttgcgtgatagaattttgcgcgttttcgtcgttttatttaagggcggggttttacgtgacgtaagagcggggttcgagtttttatattgcggttgcgcggtttaagtatttttattttttttttttcgtttattcgggtttcggggtttttaggtcgggagggtgtttacgttttttacgggttcgggtggaatcgggaaggaacgttcgtgtttcgtttttagtgtgtatcgcgtgttt

SEQ ID NO: 32460 - DNA, 860 bp, Artificial Sequence
  chemically treated genomic DNA (Homo sapiens) CpG-island No: 32460
aaacacgcgatacacactaaaaacgaaacacgaacgttccttcccgattccacccgaacccgtaaaaaacgtaaacaccctcccgacctaaaaaccccgaaacccgaataaacgaaaaaaaaaaaataaaaatacttaaaccgcgcaaccgcaatataaaaactcgaaccccgctcttacgtcacgtaaaaccccgcccttaaataaaacgacgaaaacgcgcaaaattctatcacgcaaacgcgttcgcgcgacgtaaataatactaaaaacgactcgaaaaattctaaaacgacgacgctaccgccattttataaaatatttatcgcaacgaccgaaaaaaaaaaacgacaatttaacgacatttctcgaccgaaaaaccatttacttttacgaaaataaaattacaaataatatatactaaaacaaacgactatcgatctttaaatctccgaaccaaatatcgaaaaaacgaccgcgttaaaaacctaaacttctaaaactaaattaaaaattctacgaaacgctactcgactaatacacgccgacaacaccgaaaattactcgaacgtcgcgattctaccgctaacccttctctaaaaaccctaaccgctcgcgtcgcgacgtccgaaaaccgtaaactcgcgatcccctactacctaacgaacgcgactattaattaaccctatcgaaacctcttccaaccgacgaacgctaaaacctatcgaaaaacccttcgaaaaccgtctctaacattcgtattatcgaaaatcaaatcttcccctaaattcctaacctaaaccgtttataacgtttcgaaaattttccaaaatcaaacatttacccctatcttaaatacg

SEQ ID NO: 32461 - DNA, 1683 bp, Artificial Sequence
  chemically treated genomic DNA (Homo sapiens) CpG-island No: 32461
gtatttataacggggttggtagttcgagtagtcggtgaacgttagtaattgttcgtagcggttttaggttatttgtcgggtgttgttcgtcgtattcgttgtcgtcgtcggtaatttattgtgcgcgttatcgtagcggtagcgtattgttttttcgttgcgcgatgttttcgatattagtttgttcggtttattatattttcggcggttttttagttcgttcggggatattatcgtcgttagttggtttcgcgtcgtgtataagttaagaatgtgtcgtgttcgtcgcgtcgtcgcggtgtggtgatgttcgtgatatcgtcggatattatatttagatcgtattttgtttttcgtttcgtcgcgttcgtttgcgtcgtgagtttttttgtcgcgttatattcgttgcgcgtgacgttgtcgttcgttagttttttttttattattcgttttagttcggtttcgttttttgtatgtagtattttacgtcggtttaggttgtcggtgatggtgatgcggttttgtttatattgatacgtgtagtttaagtttgtcgggtttagttgtttttgttattcgttcgttttgtcgtacggtacggatttcggtcggtcgtgtgacggtgcgttatttattcggtttcggtatttattatcgtaagtaaagttgcgtatttgtttgttattacggttatatattatcgttagttcgtcgcgtggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggtttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagaggatgaacggtagcgggtcgggtagggcgatgtcggttttatcgggaaggatttttgtatcgagtttggggattgatcggatggtcggacgttatttcgtcggggtatatcgaataggttacgttcggtgggggtattaatacgtatattcggtttaatttttgaataatgttatcgttatattgcgttatgttatttgacgcgtcgtcgtttttcgtttatcgtaaaatttt

SEQ ID NO: 32462 - DNA, 1683 bp, Artificial Sequence
  chemically treated genomic DNA (Homo sapiens) CpG-island No: 32462
aaaattttacgataaacgaaaaacgacgacgcgtcaaataacataacgcaatataacgataacattattcaaaaattaaaccgaatatacgtattaatacccccaccgaacgtaacctattcgatataccccgacgaaataacgtccgaccatccgatcaatccccaaactcgatacaaaaatccttcccgataaaaccgacatcgccctacccgacccgctaccgttcatcctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccacgcgacgaactaacgataatatataaccgtaataacaaacaaatacgcaactttacttacgataataaataccgaaaccgaataaataacgcaccgtcacacgaccgaccgaaatccgtaccgtacgacaaaacgaacgaataacaaaaacaactaaacccgacaaacttaaactacacgtatcaatataaacaaaaccgcatcaccatcaccgacaacctaaaccgacgtaaaatactacatacaaaaaacgaaaccgaactaaaacgaataataaaaaaaaaactaacgaacgacaacgtcacgcgcaacgaatataacgcgacaaaaaaactcacgacgcaaacgaacgcgacgaaacgaaaaacaaaatacgatctaaatataatatccgacgatatcacgaacatcaccacaccgcgacgacgcgacgaacacgacacattcttaacttatacacgacgcgaaaccaactaacgacgataatatccccgaacgaactaaaaaaccgccgaaaatataataaaccgaacaaactaatatcgaaaacatcgcgcaacgaaaaaacaatacgctaccgctacgataacgcgcacaataaattaccgacgacgacaacgaatacgacgaacaacacccgacaaataacctaaaaccgctacgaacaattactaacgttcaccgactactcgaactaccaaccccgttataaatac

SEQ ID NO: 32463 - DNA, 1683 bp, Artificial Sequence
  chemically treated genomic DNA (Homo sapiens) CpG-island No: 32463
aggattttacgatgagcggaaaacggcggcgcgttaggtgatatgacgtagtatggcggtagtattgtttaggggttgagtcgggtgtacgtattggtgtttttatcgagcgtggtttgttcggtgtgtttcggcggagtgacgttcggttattcggttaatttttagattcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgttacgcggcgaattggcggtggtgtatgatcgtagtggtaaataggtgcgtagttttatttacgatgataaatatcggggtcggatgggtggcgtatcgttatacggtcggtcggaattcgtatcgtacgataggacgggcgggtgataggaatagttaaattcggtaggtttaagttatacgtattagtatgagtaggatcgtattattattatcgatagtttgaatcggcgtgaagtgttgtatatagaaggcggggtcgggttgaaacgggtggtgaaaaaagaattggcggacggtagcgttacgcgtagcgggtatgacgcggtaggaaggtttacggcgtagacggacgcggcgggacggaggatagagtacggtttgaatgtggtgttcggcgatattacggatattattatatcgcgacggcgcggcgagtacgatatatttttaatttatatacgacgcggaattagttgacggcggtggtgttttcggacgggttggagagtcgtcgggaatatgatgaatcgggtaggttggtatcggagatatcgcgtagcggggagatagtacgttatcgttacgatgacgcgtatagtgagttatcggcgacgataacggatgcgacgggtagtattcggtagatgatttggagtcgttacgggtagttgttggcgtttatcgattgttcgggttattagtttcgttatgaatat

SEQ ID NO: 32464 - DNA, 1683 bp, Artificial Sequence
  chemically treated genomic DNA (Homo sapiens) CpG-island No: 32464
atattcataacgaaactaataacccgaacaatcgataaacgccaacaactacccgtaacgactccaaatcatctaccgaatactacccgtcgcatccgttatcgtcgccgataactcactatacgcgtcatcgtaacgataacgtactatctccccgctacgcgatatctccgataccaacctacccgattcatcatattcccgacgactctccaacccgtccgaaaacaccaccgccgtcaactaattccgcgtcgtatataaattaaaaatatatcgtactcgccgcgccgtcgcgatataataatatccgtaatatcgccgaacaccacattcaaaccgtactctatcctccgtcccgccgcgtccgtctacgccgtaaaccttcctaccgcgtcatacccgctacgcgtaacgctaccgtccgccaattcttttttcaccacccgtttcaacccgaccccgccttctatatacaacacttcacgccgattcaaactatcgataataataatacgatcctactcatactaatacgtataacttaaacctaccgaatttaactattcctatcacccgcccgtcctatcgtacgatacgaattccgaccgaccgtataacgatacgccacccatccgaccccgatatttatcatcgtaaataaaactacgcacctatttaccactacgatcatacaccaccgccaattcgccgcgtaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaatctaaaaattaaccgaataaccgaacgtcactccgccgaaacacaccgaacaaaccacgctcgataaaaacaccaatacgtacacccgactcaacccctaaacaatactaccgccatactacgtcatatcacctaacgcgccgccgttttccgctcatcgtaaaatcct

SEQ ID NO: 32465 - DNA, 1342 bp, Artificial Sequence
  chemically treated genomic DNA (Homo sapiens) CpG-island No: 32465
  misc_feature (1262)..(1262): n is either a, c, g or t
  misc_feature (1314)..(1314): n is either a, c, g or t
ttttgcgttatttattgtgggtttcgcgtttagttaaaattgtaggtacgcgtcgatagtgtatttttacgtaaatgtaagaaattgtttaaaggtcgcgatttttttaatcgtgtagaattttttacgtttcgatttcggaattatcggcgcgttgttgcgtttttttatacgttgggtacgtattggaatatttttttgttttattatcgtagttatggtatcgattacgggcgcgtattggcggcgttcgaatttggcgattatgaatcggatttcgaaattcggttgaatgagttgggttacgattgttacgacgaaattaataattcggcgtttaggttttttttggcgggttagggaaaaatgtttgatagcgtttcgtttattaggtttattcgcgcgataacgttatttgtggttcggtaaaattttttagaatgttttaattagcggtttatgtagtcgttttttttgcgtatatacgtttagtttaaacggcgtttttttatcgttgcgttttaaaattattacgcggttacgtatcggttcggggttgttttttagtattattttcggtaataatgttacgttatagtcgagtgttattatcgatattatcgttttatgttcgttaatcgtggcgtaaattatcgggttattgattttattgcgtcgaaattatagtttaatgcggcggcgtatcggtttttgatcggttataataaacggtatcgttgattagttcggtttttttatcgatatttgattacgtatcgggtagggtagcgcgggggtaattagtattattgttagattttttagtatcgaaaacgttattgcgtcgggtaaggttttcggtttattcgtaatcgttagattcgttttattagtgattattttttttatcgtatttgtcgtattattagtagtaagtttaatttttatcgacgggtgtttcgcgcggaagcgatttagaatcggcggtagatggttgtaggtagcggttatcgagtagaagatatgtaattcgttagagagcgacggtttttgttgatcgatggtgtggcgtaattgttgatattgtaatagcgtttgttgggcgaaaacgcgtagtttttcgttcgttttagttagcgttatcgtgcggttatcgcgtataaatagcggttgatcgagatttttttttaggcgttgaatttgtcgtgagagcgtggatgggttaacgtgtatcgttcgcgcgttgcggttaaaatggcggnttttcgttagatgtaggaaggtttttagatcgcgtaaatttatagggatagntttcgatgttgacgttgtaaaaattgcg

SEQ ID NO: 32466 - DNA, 1342 bp, Artificial Sequence
  chemically treated genomic DNA (Homo sapiens) CpG-island No: 32466
  misc_feature (29)..(29): n is either a, c, g or t
  misc_feature (81)..(81): n is either a, c, g or t
cgcaatttttacaacgtcaacatcgaaanctatccctataaatttacgcgatctaaaaaccttcctacatctaacgaaaanccgccattttaaccgcaacgcgcgaacgatacacgttaacccatccacgctctcacgacaaattcaacgcctaaaaaaaaatctcgatcaaccgctatttatacgcgataaccgcacgataacgctaactaaaacgaacgaaaaactacgcgttttcgcccaacaaacgctattacaatatcaacaattacgccacaccatcgatcaacaaaaaccgtcgctctctaacgaattacatatcttctactcgataaccgctacctacaaccatctaccgccgattctaaatcgcttccgcgcgaaacacccgtcgataaaaattaaacttactactaataatacgacaaatacgataaaaaaaataatcactaataaaacgaatctaacgattacgaataaaccgaaaaccttacccgacgcaataacgttttcgatactaaaaaatctaacaataatactaattacccccgcgctaccctacccgatacgtaatcaaatatcgataaaaaaaccgaactaatcaacgataccgtttattataaccgatcaaaaaccgatacgccgccgcattaaactataatttcgacgcaataaaatcaataacccgataatttacgccacgattaacgaacataaaacgataatatcgataataacactcgactataacgtaacattattaccgaaaataatactaaaaaacaaccccgaaccgatacgtaaccgcgtaataattttaaaacgcaacgataaaaaaacgccgtttaaactaaacgtatatacgcaaaaaaaacgactacataaaccgctaattaaaacattctaaaaaattttaccgaaccacaaataacgttatcgcgcgaataaacctaataaacgaaacgctatcaaacatttttccctaacccgccaaaaaaaacctaaacgccgaattattaatttcgtcgtaacaatcgtaacccaactcattcaaccgaatttcgaaatccgattcataatcgccaaattcgaacgccgccaatacgcgcccgtaatcgataccataactacgataataaaacaaaaaaatattccaatacgtacccaacgtataaaaaaacgcaacaacgcgccgataattccgaaatcgaaacgtaaaaaattctacacgattaaaaaaatcgcgacctttaaacaatttcttacatttacgtaaaaatacactatcgacgcgtacctacaattttaactaaacgcgaaacccacaataaataacgcaaaa

SEQ ID NO: 32467 - DNA, 1342 bp, Artificial Sequence
  chemically treated genomic DNA (Homo sapiens) CpG-island No: 32467
  misc_feature (29)..(29): n is either a, c, g or t
  misc_feature (81)..(81): n is either a, c, g or t
cgtaatttttgtaacgttaatatcgaggnttgtttttgtggatttacgcgatttgaaaatttttttgtatttggcggaaantcgttattttggtcgtagcgcgcgggcgatgtacgttagtttatttacgtttttacggtagatttagcgtttggaagaagatttcggttagtcgttgtttgtgcgcgataatcgtacggtgacgttgattgaagcgggcgaagagttgcgcgttttcgtttagtaaacgttgttgtagtattagtagttgcgttatattatcgattagtaagggtcgtcgttttttggcgaattatatattttttgttcggtgatcgttgtttatagttatttgtcgtcgattttggatcgttttcgcgcggaatattcgtcggtggagattaaatttattattggtgatgcggtagatgcgatggaaaaggtggttattggtgaagcggatttggcgattgcgggtaaatcggaaattttgttcggcgtagtggcgttttcgatgttggagaatttggtagtagtgttgattgttttcgcgttgttttgttcggtgcgtaattaggtgtcggtagagaagtcggattggttaacggtgtcgtttattatggtcgattaggggtcggtacgtcgtcgtattgaattgtggtttcgacgtaataaaattagtaattcgatgatttacgttacggttggcgggtatgaagcgatggtatcgatggtggtattcggttgtggcgtggtattgttgtcggaagtggtgttggaaaatagtttcgaatcggtgcgtaatcgcgtgatgattttagagcgtagcgatgagaaaacgtcgtttgagttgggcgtgtgtgcgtagaaaaagcggttatatgagtcgttaattgaggtattttggaagattttgtcgaattataaatgacgttgtcgcgcgggtaggtttgataagcgaagcgttattaggtatttttttttaattcgttaaaaagaatttgaacgtcgggttattggtttcgtcgtggtaatcgtagtttagtttatttagtcgggtttcgaaattcggtttatggtcgttaagttcgaacgtcgttagtacgcgttcgtagtcggtgttatggttgcgatagtggaataaagaaatgttttagtacgtatttagcgtgtgaggaagcgtagtagcgcgtcggtgatttcggaatcgaagcgtgaaaggttttgtacggttggaggagtcgcgatttttaggtagttttttgtatttgcgtgagggtatattgtcggcgcgtgtttgtaattttggttaggcgcggggtttataataggtggcgtaagg

SEQ ID NO: 32468 - DNA, 1342 bp, Artificial Sequence
  chemically treated genomic DNA (Homo sapiens) CpG-island No: 32468
  misc_feature (1262)..(1262): n is either a, c, g or t
  misc_feature (1314)..(1314): n is either a, c, g or t
ccttacgccacctattataaaccccgcgcctaaccaaaattacaaacacgcgccgacaatataccctcacgcaaatacaaaaaactacctaaaaatcgcgactcctccaaccgtacaaaacctttcacgcttcgattccgaaatcaccgacgcgctactacgcttcctcacacgctaaatacgtactaaaacatttctttattccactatcgcaaccataacaccgactacgaacgcgtactaacgacgttcgaacttaacgaccataaaccgaatttcgaaacccgactaaataaactaaactacgattaccacgacgaaaccaataacccgacgttcaaattctttttaacgaattaaaaaaaaatacctaataacgcttcgcttatcaaacctacccgcgcgacaacgtcatttataattcgacaaaatcttccaaaatacctcaattaacgactcatataaccgctttttctacgcacacacgcccaactcaaacgacgttttctcatcgctacgctctaaaatcatcacgcgattacgcaccgattcgaaactattttccaacaccacttccgacaacaataccacgccacaaccgaataccaccatcgataccatcgcttcatacccgccaaccgtaacgtaaatcatcgaattactaattttattacgtcgaaaccacaattcaatacgacgacgtaccgacccctaatcgaccataataaacgacaccgttaaccaatccgacttctctaccgacacctaattacgcaccgaacaaaacaacgcgaaaacaatcaacactactaccaaattctccaacatcgaaaacgccactacgccgaacaaaatttccgatttacccgcaatcgccaaatccgcttcaccaataaccaccttttccatcgcatctaccgcatcaccaataataaatttaatctccaccgacgaatattccgcgcgaaaacgatccaaaatcgacgacaaataactataaacaacgatcaccgaacaaaaaatatataattcgccaaaaaacgacgacccttactaatcgataatataacgcaactactaatactacaacaacgtttactaaacgaaaacgcgcaactcttcgcccgcttcaatcaacgtcaccgtacgattatcgcgcacaaacaacgactaaccgaaatcttcttccaaacgctaaatctaccgtaaaaacgtaaataaactaacgtacatcgcccgcgcgctacgaccaaaataacgantttccgccaaatacaaaaaaattttcaaatcgcgtaaatccacaaaaacaancctcgatattaacgttacaaaaattacg

SEQ ID NO: 32469 - DNA, 896 bp, Artificial Sequence
  chemically treated genomic DNA (Homo sapiens) CpG-island No: 32469
tttttagcgtgatcgattagtttttttttaatttcgcgatggtttattgtaaggcggcgatggatgttggcgcgatgattcgcgtaggtagtatcgttacggtaatgattcgtaacggtaatatgttcgggattcgggtaagcgggttgggcgaacgttggtttattgcgtttgtaaatatttcgtaaggtttgttttttatcggtttttcgtaggagtaggcgaattcggatatgggcgatagcgcgattatcgaaatttttggtatcggaggtgcggtaatgatcgtagcgtttggcgtaacgcgttttgtcggtgcgggtggtatggaagcggtaagagcggtatttgaagagatggcggaaatttattttgaacgtaatatgtagttgtagattttaagttgggatttttagggcgcgtgtttggggttggatattcgtcgcgtggtagaaatcggtattacgttatttattaatatcggtatcgtttataaagaggcggggatcgggtagattggcgtaggtatcgtgcgggtatcgtatggcgtgttttgaataggcgttggaagtattggttgaaagtatgggtattggttgaggaacgcgtaatgacgattatttattttttgtttgttagtagtagcgtatcgaattatcgttagttttggcggttagcgggagtgtggcggcgggcgattaatttgatgacggaaagcggcgaattgttaacgttgtatcgttagggtagtggtttcggtttcggaggatgggtgtttcgtcgatgcgtaattcgatgcgttatgcggatggattatgtaggtaatgaacgattataggttgtggtttaagggattcgtttcgggcgtaatacggtataaatagattatagagata

SEQ ID NO: 32470 - DNA, 896 bp, Artificial Sequence
  chemically treated genomic DNA (Homo sapiens) CpG-island No: 32470
tatctctataatctatttataccgtattacgcccgaaacgaatcccttaaaccacaacctataatcgttcattacctacataatccatccgcataacgcatcgaattacgcatcgacgaaacacccatcctccgaaaccgaaaccactaccctaacgatacaacgttaacaattcgccgctttccgtcatcaaattaatcgcccgccgccacactcccgctaaccgccaaaactaacgataattcgatacgctactactaacaaacaaaaaataaataatcgtcattacgcgttcctcaaccaatacccatactttcaaccaatacttccaacgcctattcaaaacacgccatacgatacccgcacgatacctacgccaatctacccgatccccgcctctttataaacgataccgatattaataaataacgtaataccgatttctaccacgcgacgaatatccaaccccaaacacgcgccctaaaaatcccaacttaaaatctacaactacatattacgttcaaaataaatttccgccatctcttcaaataccgctcttaccgcttccataccacccgcaccgacaaaacgcgttacgccaaacgctacgatcattaccgcacctccgataccaaaaatttcgataatcgcgctatcgcccatatccgaattcgcctactcctacgaaaaaccgataaaaaacaaaccttacgaaatatttacaaacgcaataaaccaacgttcgcccaacccgcttacccgaatcccgaacatattaccgttacgaatcattaccgtaacgatactacctacgcgaatcatcgcgccaacatccatcgccgccttacaataaaccatcgcgaaattaaaaaaaaactaatcgatcacgctaaaaa

SEQ ID NO: 32471 - DNA, 896 bp, Artificial Sequence
  chemically treated genomic DNA (Homo sapiens) CpG-island No: 32471
tatttttgtggtttgtttatatcgtgttacgttcgaggcgaattttttgagttataatttgtggtcgtttattgtttgtataatttattcgtataacgtatcgaattgcgtatcggcgaagtatttatttttcggggtcgaaattattattttgacgatgtaacgttaatagttcgtcgtttttcgttattaggttaatcgttcgtcgttatattttcgttaatcgttaggattggcgataattcggtgcgttattattggtaagtagaggatggatgatcgttattgcgcgttttttaattaatatttatgtttttagttagtgtttttagcgtttgtttaaagtacgttatgcggtgttcgtacggtgtttgcgttaatttgttcgattttcgtttttttatgggcgatatcggtattgatgagtggcgtaatgtcggtttttattacgcgacgaatgtttagttttaggtacgcgttttgaaaattttagtttgggatttgtaattgtatattgcgtttaaggtaaattttcgttatttttttagatatcgtttttgtcgtttttatgttattcgtatcgataaagcgcgttacgttaggcgttgcgattattgtcgtattttcgatattaaaggtttcggtaatcgcgttatcgtttatattcgggttcgtttgtttttgcgagaagtcggtgaaaaatagattttgcggagtgtttataggcgtagtaaattagcgttcgtttagttcgtttattcgaatttcgaatatattgtcgttgcgggttattgtcgtgacgatgttgtttgcgcggattatcgcgttagtatttatcgtcgttttgtagtaagttatcgcgaggttgaggaagaattgatcggttacgttgagga

SEQ ID NO: 32472 - DNA, 896 bp, Artificial Sequence
  chemically treated genomic DNA (Homo sapiens) CpG-island No: 32472
tcctcaacgtaaccgatcaattcttcctcaacctcgcgataacttactacaaaacgacgataaatactaacgcgataatccgcgcaaacaacatcgtcacgacaataacccgcaacgacaatatattcgaaattcgaataaacgaactaaacgaacgctaatttactacgcctataaacactccgcaaaatctatttttcaccgacttctcgcaaaaacaaacgaacccgaatataaacgataacgcgattaccgaaacctttaatatcgaaaatacgacaataatcgcaacgcctaacgtaacgcgctttatcgatacgaataacataaaaacgacaaaaacgatatctaaaaaaataacgaaaatttaccttaaacgcaatatacaattacaaatcccaaactaaaattttcaaaacgcgtacctaaaactaaacattcgtcgcgtaataaaaaccgacattacgccactcatcaataccgatatcgcccataaaaaaacgaaaatcgaacaaattaacgcaaacaccgtacgaacaccgcataacgtactttaaacaaacgctaaaaacactaactaaaaacataaatattaattaaaaaacgcgcaataacgatcatccatcctctacttaccaataataacgcaccgaattatcgccaatcctaacgattaacgaaaatataacgacgaacgattaacctaataacgaaaaacgacgaactattaacgttacatcgtcaaaataataatttcgaccccgaaaaataaatacttcgccgatacgcaattcgatacgttatacgaataaattatacaaacaataaacgaccacaaattataactcaaaaaattcgcctcgaacgtaacacgatataaacaaaccacaaaaata

SEQ ID NO: 32473 - DNA, 693 bp, Artificial Sequence
  chemically treated genomic DNA (Homo sapiens) CpG-island No: 32473
ggcgacgattcgtaatttgagaggtagtagtggttattcgacgaataattgaaattggcgaaacgttacgatttgtcggtgattttgtatttacggcgtacgtacgataaattggcgatgtattttaaacgttacgatttatcgcgtattggcgtggtttacggttttttcggtagtttgtaataggtcgaacggtttgtatagttgggttataaaattggcgtaggcggtattattatttatttacgcgttagtaaaattcgcgatgttatcgtaaaattatcgttggtatcgttattgttggaaatcgacgcgtcggatatgtcgtttaacggtttttaggggtagtttaatcgttcggagtaggttgttcgtgtgttcgtcgtgttttgcgagttgcgtcgggaatcggcggatgagattgcgtaagcgttgtttaataatacgtatacgttgtttaacgtgtcgtaggtcggataaggcgtttacgtcgtattcggtagttggcgtataatgtttgatgcgacgtttaacgcgttttattatgtttataggtttgtgtcgaatcgtaggtcggataaggcgtttacgtcgtattcggtaattttttgtttttgatgagggcgttaaatgtcgcgtggtttggaattattgattgtttaagattattttgtaaggtttcgatgttttagt

SEQ ID NO: 32474 - DNA, 693 bp, Artificial Sequence
  chemically treated genomic DNA (Homo sapiens) CpG-island No: 32474
actaaaacatcgaaaccttacaaaataatcttaaacaatcaataattccaaaccacgcgacatttaacgccctcatcaaaaacaaaaaattaccgaatacgacgtaaacgccttatccgacctacgattcgacacaaacctataaacataataaaacgcgttaaacgtcgcatcaaacattatacgccaactaccgaatacgacgtaaacgccttatccgacctacgacacgttaaacaacgtatacgtattattaaacaacgcttacgcaatctcatccgccgattcccgacgcaactcgcaaaacacgacgaacacacgaacaacctactccgaacgattaaactacccctaaaaaccgttaaacgacatatccgacgcgtcgatttccaacaataacgataccaacgataattttacgataacatcgcgaattttactaacgcgtaaataaataataataccgcctacgccaattttataacccaactatacaaaccgttcgacctattacaaactaccgaaaaaaccgtaaaccacgccaatacgcgataaatcgtaacgtttaaaatacatcgccaatttatcgtacgtacgccgtaaatacaaaatcaccgacaaatcgtaacgtttcgccaatttcaattattcgtcgaataaccactactacctctcaaattacgaatcgtcgcc

SEQ ID NO: 32475 - DNA, 693 bp, Artificial Sequence
  chemically treated genomic DNA (Homo sapiens) CpG-island No: 32475
attgagatatcgaagttttgtaaaatggttttgagtaattaataattttaggttacgcggtatttagcgtttttattaggagtagagaattgtcggatgcggcgtaaacgttttattcggtttacggttcggtataaatttgtaggtatgataagacgcgttaagcgtcgtattaggtattgtgcgttaattgtcggatgcggcgtgaacgttttattcggtttacggtacgttaaataacgtatacgtgttattaagtaacgtttgcgtaattttattcgtcggttttcggcgtaattcgtaaagtacggcgaatatacgggtagtttgtttcgggcggttaggttgtttttgaaaatcgttgagcggtatattcggcgcgtcggtttttagtaataacgatgttagcggtaattttgcgatgatatcgcgggttttattggcgcgtggataggtgatagtatcgtttacgttaattttgtagtttagttgtataaatcgttcggtttgttgtaggttgtcggaaaaatcgtgaattacgttagtgcgcggtaaatcgtggcgtttaagatgtatcgttagtttgtcgtgcgtgcgtcgtgaatgtaggattatcggtagatcgtagcgtttcgttagttttagttgttcgtcgagtaattattgttgttttttaaattgcggatcgtcgtt

SEQ ID NO: 32476 - DNA, 693 bp, Artificial Sequence
  chemically treated genomic DNA (Homo sapiens) CpG-island No: 32476
aacgacgatccgcaatttaaaaaacaacaataattactcgacgaacaactaaaactaacgaaacgctacgatctaccgataatcctacattcacgacgcacgcacgacaaactaacgatacatcttaaacgccacgatttaccgcgcactaacgtaattcacgatttttccgacaacctacaacaaaccgaacgatttatacaactaaactacaaaattaacgtaaacgatactatcacctatccacgcgccaataaaacccgcgatatcatcgcaaaattaccgctaacatcgttattactaaaaaccgacgcgccgaatataccgctcaacgattttcaaaaacaacctaaccgcccgaaacaaactacccgtatattcgccgtactttacgaattacgccgaaaaccgacgaataaaattacgcaaacgttacttaataacacgtatacgttatttaacgtaccgtaaaccgaataaaacgttcacgccgcatccgacaattaacgcacaatacctaatacgacgcttaacgcgtcttatcatacctacaaatttataccgaaccgtaaaccgaataaaacgtttacgccgcatccgacaattctctactcctaataaaaacgctaaataccgcgtaacctaaaattattaattactcaaaaccattttacaaaacttcgatatctcaat

SEQ ID NO: 32477 - DNA, 855 bp, Artificial Sequence
  chemically treated genomic DNA (Homo sapiens) CpG-island No: 32477
tcgcgttgaataatataggttttattttggtttaggtattggtgtttgttgcggcgcgtgcggtgattattattcgtaatttatttttttcgggcgaattttaatcggggatttttttttacgagttcgatttttgtatcgttattgtaacgtttttgcgtatttggttcgttcgtttttttattaagcgtttcgttgtatttgcgcgaaaattttgcgttcgtttatttaattttttaatttcgtttttgtttagtttattatttttttttttttttcgtttagtatttggtcgttatattacgtcggatagtacgcgttttcgttatatcgtattcggcgttttttttatatattacgttttgttcgtacgtttttgtatattgcgtcgtaaattgcgtcgttttttgtattcgtcgcgttatttttttttttttttttaacgttatttttcgttgtcgcgttattttttattaattcgttaattattgcgttgtattttttttagttattaatttttgttttttgtattggttcgtaataagtttaacgttttaagtttttcgtaatattttcgttataaatattttcgtttgtacggcgttttttgtatcgcgcgttttgtttttgtttttcgggttatttcgtttttatagaataacgtttgttgaattcgttttttcgggaagttcgtattgtgttattaaggttttttattcggttatttattcgaaaacgtcgcgaagaatcgaaacgggttttcgttgtattatcgttttaatttttataaggttaattgtttttgattattaattggtaattttatatcgtttaggttggtatttttatcgcggg

SEQ ID NO: 32478 - DNA, 855 bp, Artificial Sequence
  chemically treated genomic DNA (Homo sapiens) CpG-island No: 32478
cccgcgataaaaataccaacctaaacgatataaaattaccaattaataatcaaaaacaattaaccttataaaaattaaaacgataatacaacgaaaacccgtttcgattcttcgcgacgttttcgaataaataaccgaataaaaaaccttaataacacaatacgaacttcccgaaaaaacgaattcaacaaacgttattctataaaaacgaaataacccgaaaaacaaaaacaaaacgcgcgatacaaaaaacgccgtacaaacgaaaatatttataacgaaaatattacgaaaaacttaaaacgttaaacttattacgaaccaatacaaaaaacaaaaattaataactaaaaaaaatacaacgcaataattaacgaattaataaaaaataacgcgacaacgaaaaataacgttaaaaaaaaaaaaaaaaataacgcgacgaatacaaaaaacgacgcaatttacgacgcaatatacaaaaacgtacgaacaaaacgtaatatataaaaaaaacgccgaatacgatataacgaaaacgcgtactatccgacgtaatataacgaccaaatactaaacgaaaaaaaaaaaaaaataataaactaaacaaaaacgaaattaaaaaattaaataaacgaacgcaaaattttcgcgcaaatacaacgaaacgcttaataaaaaaacgaacgaaccaaatacgcaaaaacgttacaataacgatacaaaaatcgaactcgtaaaaaaaaatccccgattaaaattcgcccgaaaaaaataaattacgaataataatcaccgcacgcgccgcaacaaacaccaatacctaaaccaaaataaaacctatattattcaacgcga

SEQ ID NO: 32479 - DNA, 855 bp, Artificial Sequence
  chemically treated genomic DNA (Homo sapiens) CpG-island No: 32479
ttcgcgataagggtgttaatttggacggtgtaaggttattagttagtgattagggatagttaattttataaaaattagggcggtagtgtagcgagggttcgtttcggtttttcgcggcgttttcgggtgagtgatcgggtgaaaaattttggtgatatagtgcgagtttttcgggaggacgggtttaataggcgttgttttgtaaaggcggagtggttcgggaggtaggagtaaggcgcgcggtgtagggggcgtcgtgtaggcgggggtgtttgtggcgggggtgttgcggggggtttggggcgttaagtttattgcgggttagtgtagagggtaggagttggtagttggaggaggtgtagcgtagtagttggcgggttggtgaagagtagcgcggtagcgagaagtggcgttaaagggaaggaagaaagtagcgcggcgagtgtagggggcggcgtagtttgcggcgtagtgtgtaggggcgtgcgggtagagcgtggtgtgtggagagggcgtcgagtgcggtgtggcgggggcgcgtgttgttcggcgtagtgtagcggttaggtgttgggcggagaaagggggggagtggtgggttgggtaagggcggagttagagggttgggtaagcgggcgtagggttttcgcgtaggtgtagcggagcgtttggtagagaagcgagcgggttaggtgcgtaagggcgttgtagtggcggtgtaggggtcgagttcgtaggagggagttttcggttgaggttcgttcgagagaagtaagttgcgagtagtagttatcgtacgcgtcgtagtaggtattagtgtttaggttaggataaagtttgtgttgtttagcgcga

SEQ ID NO: 32480 - DNA, 855 bp, Artificial Sequence
  chemically treated genomic DNA (Homo sapiens) CpG-island No: 32480
tcgcgctaaacaacacaaactttatcctaacctaaacactaatacctactacgacgcgtacgataactactactcgcaacttacttctctcgaacgaacctcaaccgaaaactccctcctacgaactcgacccctacaccgccactacaacgcccttacgcacctaacccgctcgcttctctaccaaacgctccgctacacctacgcgaaaaccctacgcccgcttacccaaccctctaactccgcccttacccaacccaccactccccccctttctccgcccaacacctaaccgctacactacgccgaacaacacgcgcccccgccacaccgcactcgacgccctctccacacaccacgctctacccgcacgcccctacacactacgccgcaaactacgccgccccctacactcgccgcgctactttcttccttccctttaacgccacttctcgctaccgcgctactcttcaccaacccgccaactactacgctacacctcctccaactaccaactcctaccctctacactaacccgcaataaacttaacgccccaaaccccccgcaacacccccgccacaaacacccccgcctacacgacgccccctacaccgcgcgccttactcctacctcccgaaccactccgcctttacaaaacaacgcctattaaacccgtcctcccgaaaaactcgcactatatcaccaaaatttttcacccgatcactcacccgaaaacgccgcgaaaaaccgaaacgaaccctcgctacactaccgccctaatttttataaaattaactatccctaatcactaactaataaccttacaccgtccaaattaacacccttatcgcgaa

SEQ ID NO: 32481 - DNA, 1039 bp, Artificial Sequence
  chemically treated genomic DNA (Homo sapiens) CpG-island No: 32481
ggcgagtatttttttattttattttttttttcgtttttgtttttagtttacgttttttttagttttttattttaggatcgtttcgtttgtcggtcgcggcgtttagtattcggtatttttataaattttttcgttcggagttttagaaaacgaaagataaagttattcgtttaattcggcggtcggggcgcgggttcgcggggcgttagagtcgggtatgcgtagaggtcgcggcgggttgtcggtttggaagagcgaggttggggcgagaagtcgtcgggatttataattgggtcggcggttcgagtttcgtttgttagcgttcgcggttttaagggtcgggtaggagcggtagggcgtcggcgaaaggcggggcgggggcggcgcgggcggcgggggcgtcgcgtatttggtagcggttagtgagtagttggtttcgcgacggcgtgtatagcggttgcgtgtagtagttgtttaggagtatttcgtcggtcgttagcggcgtttaggtgcggcgtgcggatgcgggattcgtggaagtcgacgtcgttttagtttaggtcgtttgttagtaagaagattaggtgggcggtcggttggtttcggcgttcgagttcggcggcgttaataatagtagtagtagtagcgggaggacgacggggaggagtagtcgtcgaggttcggggtttcggggtaagttcgtcgcgtcgcgcggatttatttttgttcgttcgcggttttagcgtttgtggcgttattagttttttgtatcgttgatagaatgaggaattgggttgtcggggtttgtttcgtttcggcgcgggacggtatttttagcgggtcgtgggtttgcgaggtcgggcgttcggttttcgtcgttttcgattcgggttttcggttgttgtggcggaggaggagttagagacgaattcgcgggcgttcgttgttcggttttttggaaatttagttgacgtttggagggtattaaggttcgttatttttttcggtaattaaatttgtattgtggttttttaaaaaa

SEQ ID NO: 32482 - DNA, 1039 bp, Artificial Sequence
  chemically treated genomic DNA (Homo sapiens) CpG-island No: 32482
ttttttaaaaaaccacaatacaaatttaattaccgaaaaaaataacgaaccttaataccctccaaacgtcaactaaatttccaaaaaaccgaacaacgaacgcccgcgaattcgtctctaactcctcctccgccacaacaaccgaaaacccgaatcgaaaacgacgaaaaccgaacgcccgacctcgcaaacccacgacccgctaaaaataccgtcccgcgccgaaacgaaacaaaccccgacaacccaattcctcattctatcaacgatacaaaaaactaataacgccacaaacgctaaaaccgcgaacgaacaaaaataaatccgcgcgacgcgacgaacttaccccgaaaccccgaacctcgacgactactcctccccgtcgtcctcccgctactactactactattattaacgccgccgaactcgaacgccgaaaccaaccgaccgcccacctaatcttcttactaacaaacgacctaaactaaaacgacgtcgacttccacgaatcccgcatccgcacgccgcacctaaacgccgctaacgaccgacgaaatactcctaaacaactactacacgcaaccgctatacacgccgtcgcgaaaccaactactcactaaccgctaccaaatacgcgacgcccccgccgcccgcgccgcccccgccccgcctttcgccgacgccctaccgctcctacccgacccttaaaaccgcgaacgctaacaaacgaaactcgaaccgccgacccaattataaatcccgacgacttctcgccccaacctcgctcttccaaaccgacaacccgccgcgacctctacgcatacccgactctaacgccccgcgaacccgcgccccgaccgccgaattaaacgaataactttatctttcgttttctaaaactccgaacgaaaaaatttataaaaataccgaatactaaacgccgcgaccgacaaacgaaacgatcctaaaataaaaaactaaaaaaaacgtaaactaaaaacaaaaacgaaaaaaaaaataaaataaaaaaatactcgcc

SEQ ID NO: 32483 - DNA, 1039 bp, Artificial Sequence
  chemically treated genomic DNA (Homo sapiens) CpG-island No: 32483
ttttttaggaaattatagtgtaaatttaattgtcggggaagataacgggttttggtgttttttaagcgttagttgagtttttaagaagtcgggtagcgggcgttcgcgggttcgtttttggtttttttttcgttatagtagtcgggggttcgggtcggaggcggcgggggtcgagcgttcggtttcgtaagtttacggttcgttgggggtgtcgtttcgcgtcggggcggagtaggtttcggtagtttagttttttattttattagcggtataaggggttggtggcgttataggcgttgggatcgcgggcggataaggatgggttcgcgcggcgcggcgagtttgtttcgaggtttcggatttcggcggttgttttttttcgtcgttttttcgttgttgttgttgttgttgttggcgtcgtcgggttcgggcgtcggggttagtcggtcgtttatttggtttttttgttggtagacgatttaggttggaacgacgtcggtttttacgggtttcgtattcgtacgtcgtatttggacgtcgttggcggtcggcggggtgtttttggataattattatacgtagtcgttgtgtacgtcgtcgcggagttagttgtttattggtcgttattaggtacgcggcgttttcgtcgttcgcgtcgttttcgtttcgtttttcgtcggcgttttgtcgtttttattcggtttttgaggtcgcgggcgttggtaggcggggttcggatcgtcgatttagttatgggtttcggcggtttttcgttttaatttcgtttttttaggtcggtagttcgtcgcggtttttgcgtatgttcggttttggcgtttcgcggattcgcgtttcggtcgtcgggttgggcgggtggttttgtttttcgttttttgaagtttcgggcgaaggggtttatgggaatgtcgggtgttgggcgtcgcggtcggtaggcggagcggttttgaggtgggaggttggggagggcgtgggttgggagtaaagacgaggggagaggtaaaatgaaggggtgttcgtt

SEQ ID NO: 32484 - DNA, 1039 bp, Artificial Sequence
  chemically treated genomic DNA (Homo sapiens) CpG-island No: 32484
aacgaacaccccttcattttacctctcccctcgtctttactcccaacccacgccctccccaacctcccacctcaaaaccgctccgcctaccgaccgcgacgcccaacacccgacattcccataaaccccttcgcccgaaacttcaaaaaacgaaaaacaaaaccacccgcccaacccgacgaccgaaacgcgaatccgcgaaacgccaaaaccgaacatacgcaaaaaccgcgacgaactaccgacctaaaaaaacgaaattaaaacgaaaaaccgccgaaacccataactaaatcgacgatccgaaccccgcctaccaacgcccgcgacctcaaaaaccgaataaaaacgacaaaacgccgacgaaaaacgaaacgaaaacgacgcgaacgacgaaaacgccgcgtacctaataacgaccaataaacaactaactccgcgacgacgtacacaacgactacgtataataattatccaaaaacaccccgccgaccgccaacgacgtccaaatacgacgtacgaatacgaaacccgtaaaaaccgacgtcgttccaacctaaatcgtctaccaacaaaaaaaccaaataaacgaccgactaaccccgacgcccgaacccgacgacgccaacaacaacaacaacaacaacgaaaaaacgacgaaaaaaaacaaccgccgaaatccgaaacctcgaaacaaactcgccgcgccgcgcgaacccatccttatccgcccgcgatcccaacgcctataacgccaccaaccccttataccgctaataaaataaaaaactaaactaccgaaacctactccgccccgacgcgaaacgacacccccaacgaaccgtaaacttacgaaaccgaacgctcgacccccgccgcctccgacccgaacccccgactactataacgaaaaaaaaaccaaaaacgaacccgcgaacgcccgctacccgacttcttaaaaactcaactaacgcttaaaaaacaccaaaacccgttatcttccccgacaattaaatttacactataatttcctaaaaaa

SEQ ID NO: 32485 - DNA, 993 bp, Artificial Sequence
  chemically treated genomic DNA (Homo sapiens) CpG-island No: 32485
cgtttcgttcgtgcgggatattagtttttaggatgcgttaatcgtagatcgtttaagcgtaagaggtggcgagaggttattacggttgtttaatagttgcgtttttaggttgtttggtgtgacgtagtagttttcgttcggattttgaggtttggcgtttcgattgagtcgaggtttgtgttattcgatattttttgcgattcggttttttaggtttatttagcgcggtttttttcggtttttcgagttttatcgtagtttttttttattttcgttttttttcggttttttgttagtgttcgtcgcgatgtttttgcgtaattattttaagtgatattagcgtttatattcgtacggagcgagtttgaagtttttatttttcggaatttaacgtcgggtcgttaagggcgggtatttaagcgaggattagcggattaaggtcgcgattagagtttagcggttttcgcgtagttagagttcgatagtttttgcgtattcgtcgtgcgtatttttattcgtgcgcgtgcgcgtattcgtttttttcgtttcgttttagtattaatcgttttttttttacgtttacgattttttaacgtagtttttttcgttttttcgcgcgcgagtagaaaggtttcggcgtgcgcgcgttcgttcgtttcgcgttttgtcgggaaggggagtgagtagaggcgtttacgtcgcgcgggaggcggaggcgacggcgatttcggtggcggcggcggttacgacggagacggttgcgttcgtttgttttttcggcgttatggcggttgtcgggggtagataagcggagggagcgggagcgcgcgcgcgacggcggcggcggcggcggcgacgattggttatttatagtttttgttgttttcgatttttggtgttttaataatgaatgttagttttatttcgtaggggatcgcgcgtcggtgttggcgtatcgggggttttttatttatttattttcgagattaggaa

SEQ ID NO: 32486 - DNA, 993 bp, Artificial Sequence
  chemically treated genomic DNA (Homo sapiens) CpG-island No: 32486
ttcctaatctcgaaaataaataaataaaaaacccccgatacgccaacaccgacgcgcgatcccctacgaaataaaactaacattcattattaaaacaccaaaaatcgaaaacaacaaaaactataaataaccaatcgtcgccgccgccgccgccgccgtcgcgcgcgcgctcccgctccctccgcttatctacccccgacaaccgccataacgccgaaaaaacaaacgaacgcaaccgtctccgtcgtaaccgccgccgccaccgaaatcgccgtcgcctccgcctcccgcgcgacgtaaacgcctctactcactccccttcccgacaaaacgcgaaacgaacgaacgcgcgcacgccgaaacctttctactcgcgcgcgaaaaaacgaaaaaaactacgttaaaaaatcgtaaacgtaaaaaaaaaacgattaatactaaaacgaaacgaaaaaaacgaatacgcgcacgcgcacgaataaaaatacgcacgacgaatacgcaaaaactatcgaactctaactacgcgaaaaccgctaaactctaatcgcgaccttaatccgctaatcctcgcttaaatacccgcccttaacgacccgacgttaaattccgaaaaataaaaacttcaaactcgctccgtacgaatataaacgctaatatcacttaaaataattacgcaaaaacatcgcgacgaacactaacaaaaaaccgaaaaaaaacgaaaataaaaaaaaactacgataaaactcgaaaaaccgaaaaaaaccgcgctaaataaacctaaaaaaccgaatcgcaaaaaatatcgaataacacaaacctcgactcaatcgaaacgccaaacctcaaaatccgaacgaaaactactacgtcacaccaaacaacctaaaaacgcaactattaaacaaccgtaataacctctcgccacctcttacgcttaaacgatctacgattaacgcatcctaaaaactaatatcccgcacgaacgaaacg

SEQ ID NO: 32487 - DNA, 993 bp, Artificial Sequence
  chemically treated genomic DNA (Homo sapiens) CpG-island No: 32487
tttttgatttcgggagtgggtaagtgggaagttttcggtgcgttagtatcgacgcgcgattttttgcggagtggagttgatatttattattgaagtattaagggtcgagggtagtaagagttataagtaattagtcgtcgtcgtcgtcgtcgtcgtcgtcgcgcgcgcgttttcgtttttttcgtttatttgttttcggtagtcgttatgacgtcgagaaagtaagcgagcgtaatcgttttcgtcgtagtcgtcgtcgttatcgaggtcgtcgtcgttttcgtttttcgcgcgacgtaagcgtttttgtttattttttttttcgatagagcgcgaggcgggcgggcgcgcgtacgtcgaagtttttttgttcgcgcgcgggagggcgggagggattacgttgaagggtcgtgggcgtaggaaaaaagcgattggtgttggggcggggcggggggggcgagtgcgcgtacgcgtacgaatgggagtgcgtacggcggatgcgtagaggttgtcggattttgattgcgcggagatcgttggattttggtcgcggttttagttcgttgattttcgtttgggtgttcgtttttagcggttcggcgttgaatttcgggaagtgggagttttaggttcgtttcgtgcgggtatgggcgttaatgttatttgggatggttgcgtaaggatatcgcggcggatattgataaggaatcggggaggaacgggggtggggagagattgcgatgggattcgggaagtcgggaagggtcgcgttgaataagtttaaggggtcgggtcgtaaggagtgtcgggtagtataggtttcggtttagtcggagcgttaggttttagggttcgggcgggggttgttgcgttatattaggtagtttgggaacgtaattgttgggtaatcgtggtggtttttcgttattttttacgtttgggcgatttgcgattgacgtattttgggagttgatgtttcgtacgggcggggcg

SEQ ID NO: 32488 - DNA, 993 bp, Artificial Sequence
  chemically treated genomic DNA (Homo sapiens) CpG-island No: 32488
cgccccgcccgtacgaaacatcaactcccaaaatacgtcaatcgcaaatcgcccaaacgtaaaaaataacgaaaaaccaccacgattacccaacaattacgttcccaaactacctaatataacgcaacaacccccgcccgaaccctaaaacctaacgctccgactaaaccgaaacctatactacccgacactccttacgacccgaccccttaaacttattcaacgcgacccttcccgacttcccgaatcccatcgcaatctctccccacccccgttcctccccgattccttatcaatatccgccgcgatatccttacgcaaccatcccaaataacattaacgcccatacccgcacgaaacgaacctaaaactcccacttcccgaaattcaacgccgaaccgctaaaaacgaacacccaaacgaaaatcaacgaactaaaaccgcgaccaaaatccaacgatctccgcgcaatcaaaatccgacaacctctacgcatccgccgtacgcactcccattcgtacgcgtacgcgcactcgccccccccgccccgccccaacaccaatcgcttttttcctacgcccacgacccttcaacgtaatccctcccgccctcccgcgcgcgaacaaaaaaacttcgacgtacgcgcgcccgcccgcctcgcgctctatcgaaaaaaaaaataaacaaaaacgcttacgtcgcgcgaaaaacgaaaacgacgacgacctcgataacgacgacgactacgacgaaaacgattacgctcgcttactttctcgacgtcataacgactaccgaaaacaaataaacgaaaaaaacgaaaacgcgcgcgcgacgacgacgacgacgacgacgacgactaattacttataactcttactaccctcgacccttaatacttcaataataaatatcaactccactccgcaaaaaatcgcgcgtcgatactaacgcaccgaaaacttcccacttacccactcccgaaatcaaaaa

SEQ ID NO: 32489 - DNA, 1335 bp, Artificial Sequence
  chemically treated genomic DNA (Homo sapiens) CpG-island No: 32489
  misc_feature (1124)..(1124): n is either a, c, g or t
ggacggttatacgttggcgcggttgtggggggcgttgtcgtcggatattcggttaagttcgtatttttatttggcgattaatagcgtataggggtcgtggtggatattggggtggtttgagcgggtgtcgggtgttgaggacgtattgttagcgtcgttgtcgtcgtatcgggtgtttatcgggatggcggatcgtttcgggcggacgttgacgtatcggcgtgaggtcgtcggtgatttggtcggggaaattatcggcgtgacggacggtgtcgggcgggagtttcgtttggtgttgattacgtaggcgtagcgtgcggaagaggttcgtattttttcgttatttttttttgatagttttcgtttttttttagttttagcgtttttcgatatattgttcggtatcgaatacggtttcgataggggtattcgtttttcggcggtgtggttgatgtacgattcggtatattcggagagtttgttcgttgcgttattggtgcggtatacgtatacggaagtcggtgaattgttggcggtatatgatcgtagtaatacgtaggtgcgcgtttttacgtatgacgcgtagtattcgggtcggatggtggcgtatcgttacgcgggaaggtcggagatgcgttatcgttacgacgatacggggcgggtggtggagtaattgaattcggtagggttaagttatcgttatttttatgagtaggatcgtattatcgttatcgatagtttgaatcggcgtgaggtgttgtatatagaaggcggggtcgggttgaaacgggtggtgaaaaaagaattggcggacggtagcgttacgcgtagcgggtatacgcggtaggaaggtttacggcgtagacggacgcggcgggacggaggatagagtacggtttgaatgtggtgttcggcgatattacggatattattatatcggacgggcgggagacgaaattttattataacgacgggaattagttgacggcggtggtgttttcggacgggttggagagtcgtcgggaatatgatgaatcgggtaggttggtatcggagatatcgcgtagcggggagatagtacgttatcgttacgatgacgcgtatagtgagttatcggcgacgantacggatgcgacgggtagtattcggtagatatttggagtcgttacgggtagttgttggcgtttatcgattgttcgggttattagattcggttatgaatacgatcgtttcgggtagattaacggcggtttatcgcggaggaaagtattagttttatcggcgttttgatatcggtggcggttaatttcgtgaagacgtacggggcgtaaacgt

SEQ ID NO: 32490 - DNA, 1335 bp, Artificial Sequence
  chemically treated genomic DNA (Homo sapiens) CpG-island No: 32490
  misc_feature (212)..(212): n is either a, c, g or t
acgtttacgccccgtacgtcttcacgaaattaaccgccaccgatatcaaaacgccgataaaactaatactttcctccgcgataaaccgccgttaatctacccgaaacgatcgtattcataaccgaatctaataacccgaacaatcgataaacgccaacaactacccgtaacgactccaaatatctaccgaatactacccgtcgcatccgtantcgtcgccgataactcactatacgcgtcatcgtaacgataacgtactatctccccgctacgcgatatctccgataccaacctacccgattcatcatattcccgacgactctccaacccgtccgaaaacaccaccgccgtcaactaattcccgtcgttataataaaatttcgtctcccgcccgtccgatataataatatccgtaatatcgccgaacaccacattcaaaccgtactctatcctccgtcccgccgcgtccgtctacgccgtaaaccttcctaccgcgtatacccgctacgcgtaacgctaccgtccgccaattcttttttcaccacccgtttcaacccgaccccgccttctatatacaacacctcacgccgattcaaactatcgataacgataatacgatcctactcataaaaataacgataacttaaccctaccgaattcaattactccaccacccgccccgtatcgtcgtaacgataacgcatctccgaccttcccgcgtaacgatacgccaccatccgacccgaatactacgcgtcatacgtaaaaacgcgcacctacgtattactacgatcatataccgccaacaattcaccgacttccgtatacgtataccgcaccaataacgcaacgaacaaactctccgaatataccgaatcgtacatcaaccacaccgccgaaaaacgaatacccctatcgaaaccgtattcgataccgaacaatatatcgaaaaacgctaaaactaaaaaaaaacgaaaactatcaaaaaaaaataacgaaaaaatacgaacctcttccgcacgctacgcctacgtaatcaacaccaaacgaaactcccgcccgacaccgtccgtcacgccgataatttccccgaccaaatcaccgacgacctcacgccgatacgtcaacgtccgcccgaaacgatccgccatcccgataaacacccgatacgacgacaacgacgctaacaatacgtcctcaacacccgacacccgctcaaaccaccccaatatccaccacgacccctatacgctattaatcgccaaataaaaatacgaacttaaccgaatatccgacgacaacgccccccacaaccgcgccaacgtataaccgtcc

SEQ ID NO: 32491 - DNA, 1335 bp, Artificial Sequence
  chemically treated genomic DNA (Homo sapiens) CpG-island No: 32491
  misc_feature (212)..(212): n is either a, c, g or t
gcgtttacgtttcgtgcgtttttacgaggttaatcgttatcggtgttaaagcgtcggtaaagttgatgttttttttcgcggtggatcgtcgttaatttgttcgaagcggtcgtatttataatcgggtttggtagttcgagtagtcggtgaacgttagtaattgttcgtagcggttttaggtatttgtcgggtgttgttcgtcgtattcgtgntcgtcgtcggtaatttattgtgcgcgttatcgtagcggtagcgtattgttttttcgttgcgcgatgttttcgatattagtttgttcggtttattatattttcggcggttttttagttcgttcggggatattatcgtcgttagttggttttcgtcgttatagtaaaatttcgtttttcgttcgttcggtgtggtgatgttcgtgatatcgtcggatattatatttagatcgtattttgtttttcgtttcgtcgcgttcgtttgcgtcgtgagtttttttgtcgcgtatattcgttgcgcgtgacgttgtcgttcgttagttttttttttattattcgttttagttcggtttcgttttttgtatgtagtattttacgtcggtttaggttgtcggtgacggtgatgcggttttgtttataaagatagcggtagtttaattttgtcgggtttagttgttttattattcgtttcgtatcgtcgtagcggtagcgtattttcggttttttcgcgtaacggtgcgttattattcggttcgggtgttgcgcgttatacgtgaaagcgcgtatttgcgtattgttgcggttatatatcgttagtagtttatcggttttcgtatacgtgtatcgtattagtggcgtagcgggtaggtttttcgggtatgtcgggtcgtgtattagttatatcgtcgaaaggcggatatttttgtcggggtcgtattcggtatcgggtagtgtgtcggggaacgttgaggttgagagagggcgggaattgttagaagaagatagcgaagaggtgcgggtttttttcgtacgttgcgtttgcgtggttagtattagacggaattttcgttcggtatcgttcgttacgtcggtgattttttcggttaggttatcggcggttttacgtcggtacgttagcgttcgttcgaagcggttcgttatttcggtaagtattcggtacggcggtagcggcgttggtagtacgtttttagtattcggtattcgtttagattattttagtatttattacggtttttgtgcgttgttggtcgttaggtaaagatgcgggtttaatcggatattcggcggtagcgttttttatagtcgcgttagcgtatggtcgttt

SEQ ID NO: 32492 - DNA, 1335 bp, Artificial Sequence
  chemically treated genomic DNA (Homo sapiens) CpG-island No: 32492
  misc_feature (1124)..(1124): n is either a, c, g or t
aaacgaccatacgctaacgcgactataaaaaacgctaccgccgaatatccgattaaacccgcatctttacctaacgaccaacaacgcacaaaaaccgtaataaatactaaaataatctaaacgaataccgaatactaaaaacgtactaccaacgccgctaccgccgtaccgaatacttaccgaaataacgaaccgcttcgaacgaacgctaacgtaccgacgtaaaaccgccgataacctaaccgaaaaaatcaccgacgtaacgaacgataccgaacgaaaattccgtctaatactaaccacgcaaacgcaacgtacgaaaaaaacccgcacctcttcgctatcttcttctaacaattcccgccctctctcaacctcaacgttccccgacacactacccgataccgaatacgaccccgacaaaaatatccgcctttcgacgatataactaatacacgacccgacatacccgaaaaacctacccgctacgccactaatacgatacacgtatacgaaaaccgataaactactaacgatatataaccgcaacaatacgcaaatacgcgctttcacgtataacgcgcaacacccgaaccgaataataacgcaccgttacgcgaaaaaaccgaaaatacgctaccgctacgacgatacgaaacgaataataaaacaactaaacccgacaaaattaaactaccgctatctttataaacaaaaccgcatcaccgtcaccgacaacctaaaccgacgtaaaatactacatacaaaaaacgaaaccgaactaaaacgaataataaaaaaaaaactaacgaacgacaacgtcacgcgcaacgaatatacgcgacaaaaaaactcacgacgcaaacgaacgcgacgaaacgaaaaacaaaatacgatctaaatataatatccgacgatatcacgaacatcaccacaccgaacgaacgaaaaacgaaattttactataacgacgaaaaccaactaacgacgataatatccccgaacgaactaaaaaaccgccgaaaatataataaaccgaacaaactaatatcgaaaacatcgcgcaacgaaaaaacaatacgctaccgctacgataacgcgcacaataaattaccgacgacgancacgaatacgacgaacaacacccgacaaatacctaaaaccgctacgaacaattactaacgttcaccgactactcgaactaccaaacccgattataaatacgaccgcttcgaacaaattaacgacgatccaccgcgaaaaaaaacatcaactttaccgacgctttaacaccgataacgattaacctcgtaaaaacgcacgaaacgtaaacgc

SEQ ID NO: 32493 - DNA, 610 bp, Artificial Sequence
  chemically treated genomic DNA (Homo sapiens) CpG-island No: 32493
tggcggtaggaattattattagcgcgggaattagcgttagatttagtaacgtttttttataatcgtttaaacggtaattgacgtagtacgcgagaacgttaattaagttgtcgataattagcgataacgtattatttgcggtatcgcgaaagttttttattagcgttagtaataggttgttttaggcgatttttatttgtattagcgttattaaacgtattagtttttgatagtcggtattattaaataatttttggttgattggcgtagttgttagtataaaaattagcgttattagcgtagagaaattaagtattatcgttgatgaagtgtcgattacgcggcgtagttgttgcggattattatggtattgggtaacgtatttggttatatcgttaaagatgttagtttcggtaagtacgtcgagtacggtaattaattggcggaaatttgtcgttagtttaagtttcgtcggattaaatgatatcgatagtaatttatcgaatagtaattcggtattaattttggatagtgtattgggtcgtcggttttattaaggacgttttttgtttaacgataatattagggaaaaagtagtttaaataaagtt

SEQ ID NO: 32494 - DNA, 610 bp, Artificial Sequence
  chemically treated genomic DNA (Homo sapiens) CpG-island No: 32494
aactttatttaaactactttttccctaatattatcgttaaacaaaaaacgtccttaataaaaccgacgacccaatacactatccaaaattaataccgaattactattcgataaattactatcgatatcatttaatccgacgaaacttaaactaacgacaaatttccgccaattaattaccgtactcgacgtacttaccgaaactaacatctttaacgatataaccaaatacgttacccaataccataataatccgcaacaactacgccgcgtaatcgacacttcatcaacgataatacttaatttctctacgctaataacgctaatttttatactaacaactacgccaatcaaccaaaaattatttaataataccgactatcaaaaactaatacgtttaataacgctaatacaaataaaaatcgcctaaaacaacctattactaacgctaataaaaaactttcgcgataccgcaaataatacgttatcgctaattatcgacaacttaattaacgttctcgcgtactacgtcaattaccgtttaaacgattataaaaaaacgttactaaatctaacgctaattcccgcgctaataataattcctaccgcca

SEQ ID NO: 32495 - DNA, 610 bp, Artificial Sequence
  chemically treated genomic DNA (Homo sapiens) CpG-island No: 32495
aattttgtttgaattattttttttttgatattgtcgttgggtaaaaagcgtttttggtgggatcggcggtttagtatattgtttaagattggtgtcgggttattgttcggtaagttgttgtcggtgttatttggttcggcggggtttgggttggcggtaaattttcgttagttgattatcgtgttcggcgtgtttgtcggggttggtatttttaacggtgtaattaaatacgttgtttagtattatgataattcgtaatagttgcgtcgcgtggtcggtattttattagcgatggtatttggtttttttacgttgatggcgttggtttttgtgttggtagttgcgttaattagttagggattgtttggtaatatcgattattaggggttggtgcgtttagtggcgttggtgtaaatggggatcgtttggggtaatttgttattggcgttgatgaaaggttttcgcgatgtcgtaggtaatgcgttatcgttgattgtcggtagtttgattggcgttttcgcgtattacgttagttatcgtttgggcggttatgaaggggcgttgttgggtttggcgttgattttcgcgttggtggtaatttttgtcgtta

SEQ ID NO: 32496 - DNA, 610 bp, Artificial Sequence
  chemically treated genomic DNA (Homo sapiens) CpG-island No: 32496
taacgacaaaaattaccaccaacgcgaaaatcaacgccaaacccaacaacgccccttcataaccgcccaaacgataactaacgtaatacgcgaaaacgccaatcaaactaccgacaatcaacgataacgcattacctacgacatcgcgaaaacctttcatcaacgccaataacaaattaccccaaacgatccccatttacaccaacgccactaaacgcaccaacccctaataatcgatattaccaaacaatccctaactaattaacgcaactaccaacacaaaaaccaacgccatcaacgtaaaaaaaccaaataccatcgctaataaaataccgaccacgcgacgcaactattacgaattatcataatactaaacaacgtatttaattacaccgttaaaaataccaaccccgacaaacacgccgaacacgataatcaactaacgaaaatttaccgccaacccaaaccccgccgaaccaaataacaccgacaacaacttaccgaacaataacccgacaccaatcttaaacaatatactaaaccgccgatcccaccaaaaacgctttttacccaacgacaatatcaaaaaaaaaataattcaaacaaaatt

SEQ ID NO: 32497 - DNA, 816 bp, Artificial Sequence
  chemically treated genomic DNA (Homo sapiens) CpG-island No: 32497
cggttggggtggttggtggttttgggattcggtagaaaacgtttcgtttatgtcgtggttggtggggattgcgttgatgtatttattggcggttattgaataacgcgttagttttaaagcgtggatattattgttggtaattagtgttttttcgttgtgtttgttggggatttttttcgtgcgtttcggcgtgttggtatcggtatacgcgtttgcgtttgattcggcgcgcggtatgtttattttcgtttttatggtgttggtgattggcggttcgttgttgttgtttgtcgcgcgtggatataaagttcgtttacgcgtaaataatgcgttgtggtcgcgggaatttttgttgttagcgaataatgttttgttggtcgttgcgatgttggtggtgttgttggggacgttgttgtcgttggtgtataagtaattgggattgggtagtatttcgattggcgaatcgttttttaatattatgtttatttggttgatggtgtcgtttgcgttattgtttggtgtcggttttttggtgcgttgggggcgggatcgttcgcgtaagattcgtaatttattgattatcgtttttatttttacgttggtgttgtcgttgttgttgtcgtggttgttcgaaagtaaagttgtggcgatgacggtgttcggtttggtaatggtttgttggattgcggtgttggtaattgcggaagttgcgttacgtattttacgcggtacgaaaattatttttagttattgggggatggtggcggtttattttgggttggtagtgataattgttggtattgtttttagttagaa

SEQ ID NO: 32498 - DNA, 816 bp, Artificial Sequence
  chemically treated genomic DNA (Homo sapiens) CpG-island No: 32498
ttctaactaaaaacaataccaacaattatcactaccaacccaaaataaaccgccaccatcccccaataactaaaaataattttcgtaccgcgtaaaatacgtaacgcaacttccgcaattaccaacaccgcaatccaacaaaccattaccaaaccgaacaccgtcatcgccacaactttactttcgaacaaccacgacaacaacaacgacaacaccaacgtaaaaataaaaacgataatcaataaattacgaatcttacgcgaacgatcccgcccccaacgcaccaaaaaaccgacaccaaacaataacgcaaacgacaccatcaaccaaataaacataatattaaaaaacgattcgccaatcgaaatactacccaatcccaattacttatacaccaacgacaacaacgtccccaacaacaccaccaacatcgcaacgaccaacaaaacattattcgctaacaacaaaaattcccgcgaccacaacgcattatttacgcgtaaacgaactttatatccacgcgcgacaaacaacaacaacgaaccgccaatcaccaacaccataaaaacgaaaataaacataccgcgcgccgaatcaaacgcaaacgcgtataccgataccaacacgccgaaacgcacgaaaaaaatccccaacaaacacaacgaaaaaacactaattaccaacaataatatccacgctttaaaactaacgcgttattcaataaccgccaataaatacatcaacgcaatccccaccaaccacgacataaacgaaacgttttctaccgaatcccaaaaccaccaaccaccccaaccg

SEQ ID NO: 32499 - DNA, 816 bp, Artificial Sequence
  chemically treated genomic DNA (Homo sapiens) CpG-island No: 32499
ttttggttaaaggtaatgttaataattgttattgttagtttaaggtgagtcgttattattttttaataattgaaggtggttttcgtgtcgcgtgaaatacgtagcgtagttttcgtaattgttagtatcgtaatttagtaggttattgttaggtcgagtatcgttatcgttataattttgttttcgaatagttacggtaatagtagcgatagtattagcgtagagatgaaggcgataattaataaattgcggattttacgcgggcgatttcgtttttagcgtattagaggatcgatattaagtagtagcgtaaacggtattattagttaggtaaatatggtgttgaagaacggttcgttaatcgaaatattgtttagttttagttgtttatgtattaacggtagtagcgtttttagtaatattattagtatcgtagcgattagtaaaatattgttcgttaatagtaaagattttcgcgattatagcgtattgtttacgcgtgagcgaattttgtgtttacgcgcggtaaatagtagtagcgaatcgttaattattagtattataaaggcgaggataaatatatcgcgcgtcggattagacgtaaacgcgtgtatcgatattagtacgtcggaacgtacgaggaaagtttttaatagatataacgagaaggtattgattgttagtagtaatgtttacgttttgaagttggcgcgttgtttagtgatcgttagtgagtgtattagcgtagtttttattagttacggtataaacgaggcgttttttatcggattttagaattattagttattttagtcg

SEQ ID NO: 32500 - DNA, 816 bp, Artificial Sequence
  chemically treated genomic DNA (Homo sapiens) CpG-island No: 32500
cgactaaaataactaataattctaaaatccgataaaaaacgcctcgtttataccgtaactaataaaaactacgctaatacactcactaacgatcactaaacaacgcgccaacttcaaaacgtaaacattactactaacaatcaataccttctcgttatatctattaaaaactttcctcgtacgttccgacgtactaatatcgatacacgcgtttacgtctaatccgacgcgcgatatatttatcctcgcctttataatactaataattaacgattcgctactactatttaccgcgcgtaaacacaaaattcgctcacgcgtaaacaatacgctataatcgcgaaaatctttactattaacgaacaatattttactaatcgctacgatactaataatattactaaaaacgctactaccgttaatacataaacaactaaaactaaacaatatttcgattaacgaaccgttcttcaacaccatatttacctaactaataataccgtttacgctactacttaatatcgatcctctaatacgctaaaaacgaaatcgcccgcgtaaaatccgcaatttattaattatcgccttcatctctacgctaatactatcgctactattaccgtaactattcgaaaacaaaattataacgataacgatactcgacctaacaataacctactaaattacgatactaacaattacgaaaactacgctacgtatttcacgcgacacgaaaaccaccttcaattattaaaaaataataacgactcaccttaaactaacaataacaattattaacattacctttaaccaaaa

SEQ ID NO: 32501 - DNA, 633 bp, Artificial Sequence
  chemically treated genomic DNA (Homo sapiens) CpG-island No: 32501
tattcgttcgtgacgtcgcgcgtttcggcggcggtgtggggcgagcgtgaagtgcgcgatatgtacggtttgatttcggttggtttgtcggatgaacgtcgtttggtgttgtcggatgattggtcggatgaattttattcgttgcgtaaagatagtatggattatcgttagcgttcggtatcgattatcgatgttgaaatttacgagtttattaacgaattgggcgataagaaaaataacgtcgtgtcgattggttcgttgtacgttatttttgatgaatcgggttattttcgtttgttcgtcgatggcgaaaatattatcgacgtcgattatcgtttgtttacgtttattcgcggttggaaaattggcggaattcggatgggtattacgaagtgattttttcgtttgacgtgttgtcggatttgcggttcggtatagatcgttatatagatggggaaaagcgagggaatcgggtcgtatcggttatgattaggtatcgtagaggaataattggtatttaggataagggcggtatataaacgcgcgtatagggagaataaataggggaaaaagacgcggatttagggaataattggatagtaggatcgtataaatcgttacgacgtagggtgt

SEQ ID NO: 32502 - DNA, 633 bp, Artificial Sequence
  chemically treated genomic DNA (Homo sapiens) CpG-island No: 32502
acaccctacgtcgtaacgatttatacgatcctactatccaattattccctaaatccgcgtctttttcccctatttattctccctatacgcgcgtttatataccgcccttatcctaaataccaattattcctctacgatacctaatcataaccgatacgacccgattccctcgcttttccccatctatataacgatctataccgaaccgcaaatccgacaacacgtcaaacgaaaaaatcacttcgtaatacccatccgaattccgccaattttccaaccgcgaataaacgtaaacaaacgataatcgacgtcgataatattttcgccatcgacgaacaaacgaaaataacccgattcatcaaaaataacgtacaacgaaccaatcgacacgacgttatttttcttatcgcccaattcgttaataaactcgtaaatttcaacatcgataatcgataccgaacgctaacgataatccatactatctttacgcaacgaataaaattcatccgaccaatcatccgacaacaccaaacgacgttcatccgacaaaccaaccgaaatcaaaccgtacatatcgcgcacttcacgctcgccccacaccgccgccgaaacgcgcgacgtcacgaacgaata

SEQ ID NO: 32503 - DNA, 633 bp, Artificial Sequence
  chemically treated genomic DNA (Homo sapiens) CpG-island No: 32503
atattttacgtcgtggcggtttgtgcggttttattgtttagttgttttttggattcgcgttttttttttttgtttgttttttttgtgcgcgcgtttgtatgtcgtttttgttttgagtgttagttgtttttttgcgatgtttggttatagtcgatgcggttcggttttttcgtttttttttatttgtatagcggtttgtgtcgagtcgtagattcggtaatacgttagacgaggaagttatttcgtaatatttattcgggtttcgttagttttttagtcgcggatggacgtagatagacggtagtcggcgtcgataatgttttcgttatcgacgaatagacggaagtggttcggtttattagaagtgacgtgtagcggattaatcggtacgacgttgttttttttgtcgtttagttcgttgatgaattcgtaggttttagtatcggtggtcggtgtcggacgttgacgataatttatgttgtttttacgtagcggataaagtttattcggttagttattcggtagtattagacgacgtttattcggtagattaatcggaattaaatcgtatatatcgcgtattttacgttcgttttatatcgtcgtcggaacgcgcggcgttacggacggata

SEQ ID NO: 32504 - DNA, 633 bp, Artificial Sequence
  chemically treated genomic DNA (Homo sapiens) CpG-island No: 32504
tatccgtccgtaacgccgcgcgttccgacgacgatataaaacgaacgtaaaatacgcgatatatacgatttaattccgattaatctaccgaataaacgtcgtctaatactaccgaataactaaccgaataaactttatccgctacgtaaaaacaacataaattatcgtcaacgtccgacaccgaccaccgatactaaaacctacgaattcatcaacgaactaaacgacaaaaaaaacaacgtcgtaccgattaatccgctacacgtcacttctaataaaccgaaccacttccgtctattcgtcgataacgaaaacattatcgacgccgactaccgtctatctacgtccatccgcgactaaaaaactaacgaaacccgaataaatattacgaaataacttcctcgtctaacgtattaccgaatctacgactcgacacaaaccgctatacaaataaaaaaaaacgaaaaaaccgaaccgcatcgactataaccaaacatcgcaaaaaaacaactaacactcaaaacaaaaacgacatacaaacgcgcgcacaaaaaaaacaaacaaaaaaaaaaaacgcgaatccaaaaaacaactaaacaataaaaccgcacaaaccgccacgacgtaaaatat

SEQ ID NO: 32505 - DNA, 542 bp, Artificial Sequence
  chemically treated genomic DNA (Homo sapiens) CpG-island No: 32505
aacgttttgttttttacggaatagattcggtaaaatgttttcgtaagagatatttattgagtttttagtatcgtaaatggtgaaggttatttttagcgaattgggatcgcgttgtatattattcggtattattatttcgttaacgcgtagacgttgatcgattttcggtatttgttgagttttacgtttgtcgtagagaatttttttcggcgtataaaagagatcgatattcgagcgtagcgtatatagtattagatcgatagttagcgttagttttgttaatacggtataggtaatttataagcggtttttacggcgaatatttatgtagttttttgttgttgcgtagtacgtaaacgcgttttacgcgttcgttgttgcgttacgttacgtagaattgcgcgatgttgtattatcgagtgtacgattaaaattattagcggaataacggttattattatcgttagttagataaaaaaggcgtaatcgtttattgcgaaaaatttattttaggaagtaaatgtaggggttatttacggttt

SEQ ID NO: 32506 - DNA, 542 bp, Artificial Sequence
  chemically treated genomic DNA (Homo sapiens) CpG-island No: 32506
aaaccgtaaataacccctacatttacttcctaaaataaatttttcgcaataaacgattacgccttttttatctaactaacgataataataaccgttattccgctaataattttaatcgtacactcgataatacaacatcgcgcaattctacgtaacgtaacgcaacaacgaacgcgtaaaacgcgtttacgtactacgcaacaacaaaaaactacataaatattcgccgtaaaaaccgcttataaattacctataccgtattaacaaaactaacgctaactatcgatctaatactatatacgctacgctcgaatatcgatctcttttatacgccgaaaaaaattctctacgacaaacgtaaaactcaacaaataccgaaaatcgatcaacgtctacgcgttaacgaaataataataccgaataatatacaacgcgatcccaattcgctaaaaataaccttcaccatttacgatactaaaaactcaataaatatctcttacgaaaacattttaccgaatctattccgtaaaaaacaaaacgtt

SEQ ID NO: 32507 - DNA, 542 bp, Artificial Sequence
  chemically treated genomic DNA (Homo sapiens) CpG-island No: 32507
aggtcgtaaatgatttttgtatttgttttttggaatgaatttttcgtaatgggcggttacgttttttttgtttggttggcggtggtgatgatcgttatttcgttggtggttttggtcgtgtattcggtgatgtaatatcgcgtaattttgcgtggcgtggcgtaatagcgggcgcgtgaggcgcgtttacgtgttgcgtaatagtaggaggttgtatgaatattcgtcgtaaaaatcgtttgtggattgtttgtgtcgtgttggtagggttggcgttgattatcggtttggtgttatatgcgttgcgttcgaatatcgattttttttatacgtcgggggaaattttttacggtaagcgtgaaatttagtaaatgtcggaagtcggttagcgtttgcgcgttggcgggatggtgatgtcgggtagtgtgtagcgcgattttaattcgttgaaagtgatttttattatttacgatgttgaaggtttagtggatgttttttacgaaggtattttgtcggatttgtttcgtgaagggtagggcgtt

SEQ ID NO: 32508 - DNA, 542 bp, Artificial Sequence
  chemically treated genomic DNA (Homo sapiens) CpG-island No: 32508
aacgccctacccttcacgaaacaaatccgacaaaataccttcgtaaaaaacatccactaaaccttcaacatcgtaaataataaaaatcactttcaacgaattaaaatcgcgctacacactacccgacatcaccatcccgccaacgcgcaaacgctaaccgacttccgacatttactaaatttcacgcttaccgtaaaaaatttcccccgacgtataaaaaaaatcgatattcgaacgcaacgcatataacaccaaaccgataatcaacgccaaccctaccaacacgacacaaacaatccacaaacgatttttacgacgaatattcatacaacctcctactattacgcaacacgtaaacgcgcctcacgcgcccgctattacgccacgccacgcaaaattacgcgatattacatcaccgaatacacgaccaaaaccaccaacgaaataacgatcatcaccaccgccaaccaaacaaaaaaaacgtaaccgcccattacgaaaaattcattccaaaaaacaaatacaaaaatcatttacgacct

SEQ ID NO: 32509 - DNA, 1241 bp, Artificial Sequence
  chemically treated genomic DNA (Homo sapiens) CpG-island No: 32509
attttacggatttatcgtttttttttatttagttcggtcgtttcgcgggtggaggaggacgcgggacgttcgggtttttaggcgttgtcgttgcgggttttatggcgtacgtaggtgtttgcggaaaatagcggcgatatcgcggtgagacggcggggttcgcgggagaggagtcgcgggggattcgtttttagttgttcggattcgcggttttcgcgttggtgggagcgttcgggatttatttgttcggttatttgcgttaatagtatttatagcgtcgttaagtttcgttattcgcgcgcgcggggttttatttaggagcgtttcgaggggttaggggttatcggagggttttcggtcggtagcgtgcgagcgggtagggaggattcgatttaggtagagcgcgggaggattttttatagcgatttcgtcgtcgcgtcggggttattattgaagtttcgtgcggcgcggggggcggagtggtagtcgcggcggcgggggcggcgggagcggtgggagagcgcggggcgggtaggggagagaggaggggaggaggtgagggcgggggggttagaggatcgaggaggggagagtgtagggataaagagtagaggggaggaggcgaggttagcggggcgttgaggcggaggcgagcggggagtagagggaaggcgggagatagcgggtagcgttagaggaggaggacgcgggaagatggagttgtttacggtttgtagttcgtgtttttttgttcgcgcggggattatatagttggagaggttgtcgggtatcggcgcgggcgatgtttagtatggattttcggtcggtgcgcgtttttgttttgttttggggttggggattcggcgggattttagttattgtagtggtttcgcgggtttttattttcgggtcgtatcggcgtcgttagaggtcgggatatttgtagttcgcggagtgcggtttggtcgcgtttttgtgttcgggtatagttgtggggatattgggtgcggaaaatcgggcgttaggacgtgggagagtcgcggatttgtttttaaaggcgcgtgtttcgttttggagtttgcggagcgatcggagacggggaggttgaggaggaaatttttttttcgcgttatttgtttcgagatgtggcggcgtttttggtttcgcggttacggttatttttaattggttaggtcgcggaggtcggtgattggttgttgggtgtaatttttagggaggtt

SEQ ID NO: 32510 - DNA, 1241 bp, Artificial Sequence
  chemically treated genomic DNA (Homo sapiens) CpG-island No: 32510
aacctccctaaaaattacacccaacaaccaatcaccgacctccgcgacctaaccaattaaaaataaccgtaaccgcgaaaccaaaaacgccgccacatctcgaaacaaataacgcgaaaaaaaaatttcctcctcaacctccccgtctccgatcgctccgcaaactccaaaacgaaacacgcgcctttaaaaacaaatccgcgactctcccacgtcctaacgcccgattttccgcacccaatatccccacaactatacccgaacacaaaaacgcgaccaaaccgcactccgcgaactacaaatatcccgacctctaacgacgccgatacgacccgaaaataaaaacccgcgaaaccactacaataactaaaatcccgccgaatccccaaccccaaaacaaaacaaaaacgcgcaccgaccgaaaatccatactaaacatcgcccgcgccgatacccgacaacctctccaactatataatccccgcgcgaacaaaaaaacacgaactacaaaccgtaaacaactccatcttcccgcgtcctcctcctctaacgctacccgctatctcccgccttccctctactccccgctcgcctccgcctcaacgccccgctaacctcgcctcctcccctctactctttatccctacactctcccctcctcgatcctctaacccccccgccctcacctcctcccctcctctctcccctacccgccccgcgctctcccaccgctcccgccgcccccgccgccgcgactaccactccgccccccgcgccgcacgaaacttcaataataaccccgacgcgacgacgaaatcgctataaaaaatcctcccgcgctctacctaaatcgaatcctccctacccgctcgcacgctaccgaccgaaaaccctccgataacccctaacccctcgaaacgctcctaaataaaaccccgcgcgcgcgaataacgaaacttaacgacgctataaatactattaacgcaaataaccgaacaaataaatcccgaacgctcccaccaacgcgaaaaccgcgaatccgaacaactaaaaacgaatcccccgcgactcctctcccgcgaaccccgccgtctcaccgcgatatcgccgctattttccgcaaacacctacgtacgccataaaacccgcaacgacaacgcctaaaaacccgaacgtcccgcgtcctcctccacccgcgaaacgaccgaactaaataaaaaaaaacgataaatccgtaaaat

SEQ ID NO: 32511 - DNA, 1241 bp, Artificial Sequence
  chemically treated genomic DNA (Homo sapiens) CpG-island No: 32511
gatttttttagggattgtatttagtagttagttatcggttttcgcggtttggttagttgagggtggtcgtgatcgcggggttaggagcgtcgttatatttcggggtaaatggcgcgggggaagagttttttttttagttttttcgttttcgatcgtttcgtaaattttagagcgaggtacgcgtttttaaaggtaggttcgcggtttttttacgttttggcgttcggtttttcgtatttagtgtttttatagttgtgttcgggtatagaggcgcggttagatcgtatttcgcgggttgtaggtgtttcggtttttggcggcgtcggtgcggttcggaggtgggagttcgcggagttattgtagtagttggagtttcgtcgagtttttagttttaaggtagggtaggagcgcgtatcggtcggaggtttatgttgagtatcgttcgcgtcggtgttcggtagtttttttaattgtgtggttttcgcgcgggtagagaggtacggattgtaggtcgtgggtagttttattttttcgcgttttttttttttggcgttgttcgttgtttttcgttttttttttgtttttcgttcgttttcgttttagcgtttcgttgatttcgtttttttttttttgttttttgtttttgtattttttttttttcggttttttgattttttcgtttttatttttttttttttttttttttttgttcgtttcgcgtttttttatcgttttcgtcgttttcgtcgtcgcggttgttatttcgtttttcgcgtcgtacggagttttagtaataatttcggcgcggcggcggagtcgttgtggggaattttttcgcgttttgtttgggtcgggttttttttgttcgttcgtacgttgtcggtcggggatttttcggtggtttttagtttttcggagcgtttttggatgaagtttcgcgcgcgcggatggcggggtttggcggcgttgtggatgttgttggcgtaggtggtcgagtaggtgagtttcgggcgtttttattagcgcggaaatcgcgggttcggatagttggaggcgagtttttcgcggtttttttttcgcggatttcgtcgttttatcgcgatgtcgtcgttgtttttcgtaggtatttgcgtgcgttatgggattcgtagcggtagcgtttgggagttcgagcgtttcgcgtttttttttattcgcggagcggtcgggttggatggaaaagggcggtaagttcgtgaggt

SEQ ID NO: 32512 - DNA, 1241 bp, Artificial Sequence
  chemically treated genomic DNA (Homo sapiens) CpG-island No: 32512
acctcacgaacttaccgcccttttccatccaacccgaccgctccgcgaataaaaaaaaacgcgaaacgctcgaactcccaaacgctaccgctacgaatcccataacgcacgcaaatacctacgaaaaacaacgacgacatcgcgataaaacgacgaaatccgcgaaaaaaaaaccgcgaaaaactcgcctccaactatccgaacccgcgatttccgcgctaataaaaacgcccgaaactcacctactcgaccacctacgccaacaacatccacaacgccgccaaaccccgccatccgcgcgcgcgaaacttcatccaaaaacgctccgaaaaactaaaaaccaccgaaaaatccccgaccgacaacgtacgaacgaacaaaaaaaacccgacccaaacaaaacgcgaaaaaattccccacaacgactccgccgccgcgccgaaattattactaaaactccgtacgacgcgaaaaacgaaataacaaccgcgacgacgaaaacgacgaaaacgataaaaaaacgcgaaacgaacaaaaaaaaaaaaaaaaaaaaaaataaaaacgaaaaaatcaaaaaaccgaaaaaaaaaaaatacaaaaacaaaaaacaaaaaaaaaaaaacgaaatcaacgaaacgctaaaacgaaaacgaacgaaaaacaaaaaaaaaacgaaaaacaacgaacaacgccaaaaaaaaaaaacgcgaaaaaataaaactacccacgacctacaatccgtacctctctacccgcgcgaaaaccacacaattaaaaaaactaccgaacaccgacgcgaacgatactcaacataaacctccgaccgatacgcgctcctaccctaccttaaaactaaaaactcgacgaaactccaactactacaataactccgcgaactcccacctccgaaccgcaccgacgccgccaaaaaccgaaacacctacaacccgcgaaatacgatctaaccgcgcctctatacccgaacacaactataaaaacactaaatacgaaaaaccgaacgccaaaacgtaaaaaaaccgcgaacctacctttaaaaacgcgtacctcgctctaaaatttacgaaacgatcgaaaacgaaaaaactaaaaaaaaaactcttcccccgcgccatttaccccgaaatataacgacgctcctaaccccgcgatcacgaccaccctcaactaaccaaaccgcgaaaaccgataactaactactaaatacaatccctaaaaaaatc

SEQ ID NO: 32513 - DNA, 953 bp, Artificial Sequence
  chemically treated genomic DNA (Homo sapiens) CpG-island No: 32513
ggcggtttaggaggcggttttgtcgagggattcggagcgggagtcgaggttggagttggagtcggcgtcgatattgcgttttcggtaattttagtgtttattgaggtcgtaggagatgaagtagtttgggtcgagttcgaggaggtcgcggttattttttcgtcgtcgggttcggtcgcgtcgtttttagcgtcggttttgtcgtttttttttttttttttttttattagtatcgcggtgagaggcggtttcgttttttgcgcggcgggttcggcggtttcggtagttatcggcgcgttgtcgttgttttcgtcgtcgtttttagtttcgtcgtcgtttttgtttttcgttatgtttttttttttgaattcgtcggatcgtttcgcgtcgttcgtcgttcgcgtcgtcgtcgtcgtcgtttttagttttagtcgtagtcgtagtaagagcggtagtcgagagttagcgagagagcgaattaacgagagcgcgcgcgtacgcggcgttttcgttttcgcgtcgcgcgtttgaaggagggcggttgcggtacgcgtacgtacgtacggacgttttttcgagggaggcgggaattcggttcgcgggcgcggagcggtttcggattttcgaagttagttttttgcgttagtgtcgcggttttttaattcgaagggagattttttttttaaagttagaggtcgttgacgttgggtagtttttggttggggttggttatgaatttcgatatagcggtggtgtatacggaagggtggtagtcgggacggtttcggtttttgcgagcgtgtttcgggcgttttcgcggaagttttatttgtcgcgtcgttcgatcgtcgggattttttgggtttttgttgtgcgtagattagtcgcgtttttttgggtggtcgtggagtattaaagcggggtttattgtttgtttggttttggtttttttt

SEQ ID NO: 32514 - DNA, 953 bp, Artificial Sequence
  chemically treated genomic DNA (Homo sapiens) CpG-island No: 32514
aaaaaaaaccaaaaccaaacaaacaataaaccccgctttaatactccacgaccacccaaaaaaacgcgactaatctacgcacaacaaaaacccaaaaaatcccgacgatcgaacgacgcgacaaataaaacttccgcgaaaacgcccgaaacacgctcgcaaaaaccgaaaccgtcccgactaccacccttccgtatacaccaccgctatatcgaaattcataaccaaccccaaccaaaaactacccaacgtcaacgacctctaactttaaaaaaaaaatctcccttcgaattaaaaaaccgcgacactaacgcaaaaaactaacttcgaaaatccgaaaccgctccgcgcccgcgaaccgaattcccgcctccctcgaaaaaacgtccgtacgtacgtacgcgtaccgcaaccgccctccttcaaacgcgcgacgcgaaaacgaaaacgccgcgtacgcgcgcgctctcgttaattcgctctctcgctaactctcgactaccgctcttactacgactacgactaaaactaaaaacgacgacgacgacgacgcgaacgacgaacgacgcgaaacgatccgacgaattcaaaaaaaaaaacataacgaaaaacaaaaacgacgacgaaactaaaaacgacgacgaaaacaacgacaacgcgccgataactaccgaaaccgccgaacccgccgcgcaaaaaacgaaaccgcctctcaccgcgatactaataaaaaaaaaaaaaaaaaaaaacgacaaaaccgacgctaaaaacgacgcgaccgaacccgacgacgaaaaaataaccgcgacctcctcgaactcgacccaaactacttcatctcctacgacctcaataaacactaaaattaccgaaaacgcaatatcgacgccgactccaactccaacctcgactcccgctccgaatccctcgacaaaaccgcctcctaaaccgcc

SEQ ID NO: 32515 - DNA, 953 bp, Artificial Sequence
  chemically treated genomic DNA (Homo sapiens) CpG-island No: 32515
aaaaaaaattaaaattaaataaataataagtttcgttttagtgttttacggttatttaaaggaacgcggttggtttacgtatagtagagatttaggaggtttcggcgatcgagcggcgcggtaggtgaaattttcgcggagacgttcgggatacgttcgtagggatcggaatcgtttcggttattattttttcgtatgtattatcgttgtgtcggagtttataattaattttagttaaaggttatttagcgttaacggtttttggttttaaaaaaaaaattttttttcgggttaaagagtcgcggtattgacgtaaggaattggtttcgagggttcgggatcgtttcgcgttcgcgaatcgagttttcgtttttttcgggaggacgttcgtgcgtacgtgcgcgtgtcgtaatcgtttttttttaaacgcgcgacgcgagggcgggggcgtcgcgtgcgcgcgcgttttcgttggttcgttttttcgttagttttcggttgtcgtttttgttgcggttgcggttggggttgggggcggcggcggcggcgacgcgggcggcgggcggcgcggggcggttcggcgggtttaaagaggaaaatatggcggaaaataaaggcggcggcgaggttgagagcggcggcgggggtagcggtagcgcgtcggtaattgtcggggtcgtcgggttcgtcgcgtaggaggcggagtcgttttttatcgcggtgttggtggaggaggaggaggaggaaggcggtagggtcggcgttgagggcggcgcggtcgggttcgacgacgggggggtggtcgcggttttttcgggttcggtttaggttgttttattttttgcggttttagtgggtattggagttgtcgggggcgtagtatcgacgtcggttttagttttagtttcggttttcgtttcgggtttttcggtagggtcgttttttggatcgtt

SEQ ID NO: 32516 - DNA, 953 bp, Artificial Sequence
  chemically treated genomic DNA (Homo sapiens) CpG-island No: 32516
aacgatccaaaaaacgaccctaccgaaaaacccgaaacgaaaaccgaaactaaaactaaaaccgacgtcgatactacgcccccgacaactccaatacccactaaaaccgcaaaaaataaaacaacctaaaccgaacccgaaaaaaccgcgaccacccccccgtcgtcgaacccgaccgcgccgccctcaacgccgaccctaccgccttcctcctcctcctcctccaccaacaccgcgataaaaaacgactccgcctcctacgcgacgaacccgacgaccccgacaattaccgacgcgctaccgctacccccgccgccgctctcaacctcgccgccgcctttattttccgccatattttcctctttaaacccgccgaaccgccccgcgccgcccgccgcccgcgtcgccgccgccgccgcccccaaccccaaccgcaaccgcaacaaaaacgacaaccgaaaactaacgaaaaaacgaaccaacgaaaacgcgcgcgcacgcgacgcccccgccctcgcgtcgcgcgtttaaaaaaaaacgattacgacacgcgcacgtacgcacgaacgtcctcccgaaaaaaacgaaaactcgattcgcgaacgcgaaacgatcccgaaccctcgaaaccaattccttacgtcaataccgcgactctttaacccgaaaaaaaattttttttttaaaaccaaaaaccgttaacgctaaataacctttaactaaaattaattataaactccgacacaacgataatacatacgaaaaaataataaccgaaacgattccgatccctacgaacgtatcccgaacgtctccgcgaaaatttcacctaccgcgccgctcgatcgccgaaacctcctaaatctctactatacgtaaaccaaccgcgttcctttaaataaccgtaaaacactaaaacgaaacttattatttatttaattttaatttttttt

SEQ ID NO: 32517 - DNA, 709 bp, Artificial Sequence
  chemically treated genomic DNA (Homo sapiens) CpG-island No: 32517
cgcggttttagagttcgagttcgcgttcgcgttcgcgtcgtcgtcgttatagttagcgtcgttcgaggttgttttagttttcggggtcggcgtcgttatcgttttattagtcggttttagggtcgtcgttgtcgtcgtcgtttttcgtcgtttttgttcggaaggttaagtttcgttcggagatcggagcggttcgtttatcgtttttgttagtgttaatcgtcggcgtttttattattttcgtttttgttcgggggcgttcgtcgcgcgtttcgttttattgagggtagacgtatcggttgtaggggcgtttttcgtttttttttcgcggtttagcgcgggcgtcgaaatcgttcgattcgttcggttttttcgcggcgcgttagcggtttcgttatgcgggttgagggtacgaagtaagggcgtacgtttagttcgttcgcggtttttttcggtttcggatgtgattgtttggttgcgtcgttttacgtttgacgttcgacgggattgggcgtcggcgggtgaggttattattaggcgtcgaggaggggagcgggaagcgtaggtatgaggttggcgtcggtggtttcgatgttgtttttcggtgatttcgatgttgttttttagtgtttttttttttttttggtttggtggtttcgcgtttgtttttttgggtttttttttttgtgacgtttttttgtgttcgtta

SEQ ID NO: 32518 - DNA, 709 bp, Artificial Sequence
  chemically treated genomic DNA (Homo sapiens) CpG-island No: 32518
taacgaacacaaaaaaacgtcacaaaaaaaaaaacccaaaaaaacaaacgcgaaaccaccaaaccaaaaaaaaaaaaaaacactaaaaaacaacatcgaaatcaccgaaaaacaacatcgaaaccaccgacgccaacctcatacctacgcttcccgctcccctcctcgacgcctaataataacctcacccgccgacgcccaatcccgtcgaacgtcaaacgtaaaacgacgcaaccaaacaatcacatccgaaaccgaaaaaaaccgcgaacgaactaaacgtacgcccttacttcgtaccctcaacccgcataacgaaaccgctaacgcgccgcgaaaaaaccgaacgaatcgaacgatttcgacgcccgcgctaaaccgcgaaaaaaaaacgaaaaacgcccctacaaccgatacgtctaccctcaataaaacgaaacgcgcgacgaacgcccccgaacaaaaacgaaaataataaaaacgccgacgattaacactaacaaaaacgataaacgaaccgctccgatctccgaacgaaacttaaccttccgaacaaaaacgacgaaaaacgacgacgacaacgacgaccctaaaaccgactaataaaacgataacgacgccgaccccgaaaactaaaacaacctcgaacgacgctaactataacgacgacgacgcgaacgcgaacgcgaactcgaactctaaaaccgcg

SEQ ID NO: 32519 - DNA, 709 bp, Artificial Sequence
  chemically treated genomic DNA (Homo sapiens) CpG-island No: 32519
taacggatatagggaaacgttataggaaagggagtttaggagagtagacgcggagttattagattagaaaaaggaaaaagtattggaaaatagtatcgaagttatcggaaagtagtatcgaagttatcggcgttagttttatatttgcgtttttcgttttttttttcggcgtttagtgataattttattcgtcggcgtttaatttcgtcgagcgttaggcgtgaggcggcgtagttaaatagttatattcggggtcgagaggaatcgcgaacgagttgggcgtgcgtttttgtttcgtgtttttaattcgtatggcggagtcgttggcgcgtcgcggagaggtcgggcgagtcgggcggtttcggcgttcgcgttgagtcgcggaggaggggcggaggacgtttttgtagtcggtgcgtttgtttttagtgaggcggggcgcgcggcggacgttttcgggtaggggcgggagtggtggaggcgtcggcggttggtattgataggggcggtgagcgagtcgtttcggttttcgggcgaggtttggtttttcgagtagagacggcgggaagcggcggcggtagcggcggttttagggtcggttggtgaggcgatggcggcgtcggtttcgggggttggggtagtttcgggcggcgttggttgtagcggcggcggcgcgggcgcgggcgcgggttcgggttttggggtcgcg

SEQ ID NO: 32520 - DNA, 709 bp, Artificial Sequence
  chemically treated genomic DNA (Homo sapiens) CpG-island No: 32520
cgcgaccccaaaacccgaacccgcgcccgcgcccgcgccgccgccgctacaaccaacgccgcccgaaactaccccaacccccgaaaccgacgccgccatcgcctcaccaaccgaccctaaaaccgccgctaccgccgccgcttcccgccgtctctactcgaaaaaccaaacctcgcccgaaaaccgaaacgactcgctcaccgcccctatcaataccaaccgccgacgcctccaccactcccgcccctacccgaaaacgtccgccgcgcgccccgcctcactaaaaacaaacgcaccgactacaaaaacgtcctccgcccctcctccgcgactcaacgcgaacgccgaaaccgcccgactcgcccgacctctccgcgacgcgccaacgactccgccatacgaattaaaaacacgaaacaaaaacgcacgcccaactcgttcgcgattcctctcgaccccgaatataactatttaactacgccgcctcacgcctaacgctcgacgaaattaaacgccgacgaataaaattatcactaaacgccgaaaaaaaaaacgaaaaacgcaaatataaaactaacgccgataacttcgatactactttccgataacttcgatactattttccaatactttttcctttttctaatctaataactccgcgtctactctcctaaactccctttcctataacgtttccctatatccgtta

SEQ ID NO: 32521 - DNA, 507 bp, Artificial Sequence
  chemically treated genomic DNA (Homo sapiens) CpG-island No: 32521
attttcgttgttcggtcgttaggtcggtaggtgttcgggtttcgttttttcggttcgttttattttcgcgttcgcgtcgcgtttttttttaagaggtcgggtttgagtgagtttgtgttgagtcgtcgagtagttcgttttttatgtgattttagttttcgttcgtttttttcgttggtgttaaaataatttgatgttttatagtaaggaggtagtttagtttcgcgttcggttgttttcgaggaggtcggagttttcggagacgatgcgtttcgcgtagtcgtttgcgtttgcgggagtcgtgagtatttttcgcgtgggggcgttttcggggtatagtcggggtttttttttaggtgggcgagttcgagcgaggttgggtggtaggaggttagcgttcgcggttcgtagtttagggtttacgaggaagttgtggtttgttgcgtttaagcgtcgtcgtttttgtgttgggcgtgggggttgtagttttgggtggaggtggaaata

SEQ ID NO: 32522 - DNA, 507 bp, Artificial Sequence
  chemically treated genomic DNA (Homo sapiens) CpG-island No: 32522
tatttccacctccacccaaaactacaacccccacgcccaacacaaaaacgacgacgcttaaacgcaacaaaccacaacttcctcgtaaaccctaaactacgaaccgcgaacgctaacctcctaccacccaacctcgctcgaactcgcccacctaaaaaaaaaccccgactataccccgaaaacgcccccacgcgaaaaatactcacgactcccgcaaacgcaaacgactacgcgaaacgcatcgtctccgaaaactccgacctcctcgaaaacaaccgaacgcgaaactaaactacctccttactataaaacatcaaattattttaacaccaacgaaaaaaacgaacgaaaactaaaatcacataaaaaacgaactactcgacgactcaacacaaactcactcaaacccgacctcttaaaaaaaaacgcgacgcgaacgcgaaaataaaacgaaccgaaaaaacgaaacccgaacacctaccgacctaacgaccgaacaacgaaaat

SEQ ID NO: 32523 - DNA, 507 bp, Artificial Sequence
  chemically treated genomic DNA (Homo sapiens) CpG-island No: 32523
tatttttatttttatttagagttgtagtttttacgtttagtataaaagcggcggcgtttggacgtagtaagttatagttttttcgtgagttttgagttgcgggtcgcggacgttgattttttattatttaatttcgttcgagttcgtttatttggagaagggtttcggttgtgtttcggggacgtttttacgcgggaaatatttacggttttcgtaggcgtaggcggttgcgcggggcgtatcgttttcgggggtttcggttttttcgagagtagtcgaacgcggggttgggttatttttttgttgtggggtattagattattttagtattagcggaaggaacggacggaaattgaagttatatggagagcgggttgttcggcgatttagtataggtttatttagattcggttttttagagggaagcgcggcgcgggcgcgggggtggggcgggtcgggggagcggggttcgaatatttgtcggtttagcggtcgagtagcggggat

SEQ ID NO: 32524 - DNA, 507 bp, Artificial Sequence
  chemically treated genomic DNA (Homo sapiens) CpG-island No: 32524
atccccgctactcgaccgctaaaccgacaaatattcgaaccccgctcccccgacccgccccacccccgcgcccgcgccgcgcttccctctaaaaaaccgaatctaaataaacctatactaaatcgccgaacaacccgctctccatataacttcaatttccgtccgttccttccgctaatactaaaataatctaataccccacaacaaaaaaataacccaaccccgcgttcgactactctcgaaaaaaccgaaacccccgaaaacgatacgccccgcgcaaccgcctacgcctacgaaaaccgtaaatatttcccgcgtaaaaacgtccccgaaacacaaccgaaacccttctccaaataaacgaactcgaacgaaattaaataataaaaaatcaacgtccgcgacccgcaactcaaaactcacgaaaaaactataacttactacgtccaaacgccgccgcttttatactaaacgtaaaaactacaactctaaataaaaataaaaata

SEQ ID NO: 32525 - DNA, 611 bp, Artificial Sequence
  chemically treated genomic DNA (Homo sapiens) CpG-island No: 32525
cggttgggagggagggcgggcggcgcgtagatttcggaagtttcgtttcgggaacgttcgtttttgggtagttttttgggtgggaagtgcgattttggcgggcggttgtgacgttgttagcgtttgttcggtggttgttgcgttgtcgtaacgaatagggtttttggttgcgtaggagggacgggggcgcggagttttgggaaattgcgttaggcgttcgaaaggtgaatacgggagtcgcgcgtttttttcgtagtagcggtaaagcggaagttatgttgtagtcggagttcgggttttttttcggagtcgcgtttcggggttcggttgtttcgagttgagcggagtatttttttcgggtgaggggaggagaggatttggcgcgtttttttcgttgtttcgggagtcgtagtcgcggtgtttatgtcgcggagtagttaggttttttcgacgaaaatttgtatttatttgttggcgggacgtttgttttgaaaatggataaagacgtcgtttttcggggtatttttgtttgtttgattttgagagcgtttttttgttttaagacgtgttggatgtttttgtttttcgaattttgatacgtttttgggtat

SEQ ID NO: 32526 - DNA, 611 bp, Artificial Sequence
  chemically treated genomic DNA (Homo sapiens) CpG-island No: 32526
atacccaaaaacgtatcaaaattcgaaaaacaaaaacatccaacacgtcttaaaacaaaaaaacgctctcaaaatcaaacaaacaaaaataccccgaaaaacgacgtctttatccattttcaaaacaaacgtcccgccaacaaataaatacaaattttcgtcgaaaaaacctaactactccgcgacataaacaccgcgactacgactcccgaaacaacgaaaaaaacgcgccaaatcctctcctcccctcacccgaaaaaaatactccgctcaactcgaaacaaccgaaccccgaaacgcgactccgaaaaaaaacccgaactccgactacaacataacttccgctttaccgctactacgaaaaaaacgcgcgactcccgtattcacctttcgaacgcctaacgcaatttcccaaaactccgcgcccccgtccctcctacgcaaccaaaaaccctattcgttacgacaacgcaacaaccaccgaacaaacgctaacaacgtcacaaccgcccgccaaaatcgcacttcccacccaaaaaactacccaaaaacgaacgttcccgaaacgaaacttccgaaatctacgcgccgcccgccctccctcccaaccg

SEQ ID NO: 32527 - DNA, 611 bp, Artificial Sequence
  chemically treated genomic DNA (Homo sapiens) CpG-island No: 32527
atgtttagaagcgtattagaattcggagaataggagtatttaatacgttttgaagtaaaaaggcgtttttagggttaggtaaataggaatatttcggagggcggcgtttttgtttatttttaaggtaaacgtttcgttagtaaataaatgtaggttttcgtcggaggagtttggttgtttcgcggtatgaatatcgcggttgcggttttcggggtagcgaggggaacgcgttaagtttttttttttttttattcggaaaggatgtttcgtttagttcggggtagtcgggtttcgggacgcggtttcgggaggaagttcgggtttcggttgtagtataattttcgttttatcgttgttgcgggggagacgcgcgattttcgtgtttatttttcgggcgtttggcgtagttttttagagtttcgcgttttcgttttttttacgtagttagaaattttattcgttgcggtagcgtagtagttatcggataagcgttagtaacgttataatcgttcgttaaaatcgtattttttatttagaaaattgtttaagggcgaacgttttcggggcgggattttcggggtttgcgcgtcgttcgtttttttttttagtcg

SEQ ID NO: 32528 - DNA, 611 bp, Artificial Sequence
  chemically treated genomic DNA (Homo sapiens) CpG-island No: 32528
cgactaaaaaaaaaaacgaacgacgcgcaaaccccgaaaatcccgccccgaaaacgttcgcccttaaacaattttctaaataaaaaatacgattttaacgaacgattataacgttactaacgcttatccgataactactacgctaccgcaacgaataaaatttctaactacgtaaaaaaaacgaaaacgcgaaactctaaaaaactacgccaaacgcccgaaaaataaacacgaaaatcgcgcgtctcccccgcaacaacgataaaacgaaaattatactacaaccgaaacccgaacttcctcccgaaaccgcgtcccgaaacccgactaccccgaactaaacgaaacatcctttccgaataaaaaaaaaaaaaaacttaacgcgttcccctcgctaccccgaaaaccgcaaccgcgatattcataccgcgaaacaaccaaactcctccgacgaaaacctacatttatttactaacgaaacgtttaccttaaaaataaacaaaaacgccgccctccgaaatattcctatttacctaaccctaaaaacgcctttttacttcaaaacgtattaaatactcctattctccgaattctaatacgcttctaaacat

SEQ ID NO: 32529 - DNA, 989 bp, Artificial Sequence
  chemically treated genomic DNA (Homo sapiens) CpG-island No: 32529
ttttcggtttcggaggatagacgttcgggtttacggtgttataagtggtttttttttcggttttagaggatagacgttcggtttacggtgttatagagtggtttttttttcggttttggaggatagacgttcgggtttacggtgttataagtggtttttttttcggtttcggaggatagacgttcggtttacggtgttatagagtggtttttttttcggttttggaggatagacgttcgggttcgcggtgttatagaggggtttttttttcggttttggaggatagacgttcgggttcgcggtgttatagaggggtttttttttcggttttggaggatagacgttcgggttcgcggtgttagtagagggttttttttttcggttttggaggatagacgttcgggttcgcggtgttagtagaggggtttttttttcggttttggaggatagacgttcgggttcgcggtgttagtagagtggtttttttttcgtttttggaggatagacgttcgagttcgcggtgttagtagagtggtttttttttcgtttttggaggatagacgttcgggttcgcggtgttagtagagtggtttttttttcgtttttggaggatagacgttcgggttcgcggtgttagtagagtggtttttttttcggttttggaggatagacgttcgggttcgcggtgttagtagagtggtttttttttcggttttggaggatagacgttcgggttcgcggtgttatagaggggtttttttttcggttttggaggatagacgttcgggttcgcggtgttatagaggggtttttttttcggttttggaggatagacgttcgggttcgcggtgttagtagaggggtttttttttcggttttggaggatagacgttcgggttcgcggtgttagtagagtggtttttttttcggttttggaggatatacgttcgggttcgtggtgttatagagtggttttttttttgtttttg

SEQ ID NO: 32530 - DNA, 989 bp, Artificial Sequence
  chemically treated genomic DNA (Homo sapiens) CpG-island No: 32530
caaaaacaaaaaaaaaaccactctataacaccacgaacccgaacgtatatcctccaaaaccgaaaaaaaaaccactctactaacaccgcgaacccgaacgtctatcctccaaaaccgaaaaaaaaacccctctactaacaccgcgaacccgaacgtctatcctccaaaaccgaaaaaaaaacccctctataacaccgcgaacccgaacgtctatcctccaaaaccgaaaaaaaaacccctctataacaccgcgaacccgaacgtctatcctccaaaaccgaaaaaaaaaccactctactaacaccgcgaacccgaacgtctatcctccaaaaccgaaaaaaaaaccactctactaacaccgcgaacccgaacgtctatcctccaaaaacgaaaaaaaaaccactctactaacaccgcgaacccgaacgtctatcctccaaaaacgaaaaaaaaaccactctactaacaccgcgaactcgaacgtctatcctccaaaaacgaaaaaaaaaccactctactaacaccgcgaacccgaacgtctatcctccaaaaccgaaaaaaaaacccctctactaacaccgcgaacccgaacgtctatcctccaaaaccgaaaaaaaaaaccctctactaacaccgcgaacccgaacgtctatcctccaaaaccgaaaaaaaaacccctctataacaccgcgaacccgaacgtctatcctccaaaaccgaaaaaaaaacccctctataacaccgcgaacccgaacgtctatcctccaaaaccgaaaaaaaaaccactctataacaccgtaaaccgaacgtctatcctccgaaaccgaaaaaaaaaccacttataacaccgtaaacccgaacgtctatcctccaaaaccgaaaaaaaaaccactctataacaccgtaaaccgaacgtctatcctctaaaaccgaaaaaaaaaccacttataacaccgtaaacccgaacgtctatcctccgaaaccgaaaa

SEQ ID NO: 32531 - DNA, 989 bp, Artificial Sequence
  chemically treated genomic DNA (Homo sapiens) CpG-island No: 32531
tagaggtagaggaagggttattttgtgatattacgagttcggacgtgtgttttttagagtcggaggaagggttattttgttgatatcgcgagttcggacgtttgttttttagagtcggaggaagggtttttttgttgatatcgcgagttcggacgtttgttttttagagtcggaggaagggtttttttgtgatatcgcgagttcggacgtttgttttttagagtcggaggaagggtttttttgtgatatcgcgagttcggacgtttgttttttagagtcggaggaagggttattttgttgatatcgcgagttcggacgtttgttttttagagtcggaggaagggttattttgttgatatcgcgagttcggacgtttgttttttagaggcggaggaagggttattttgttgatatcgcgagttcggacgtttgttttttagaggcggaggaagggttattttgttgatatcgcgagttcggacgtttgttttttagaggcggaggaagggttattttgttgatatcgcgagttcggacgtttgttttttagagtcggaggaagggtttttttgttgatatcgcgagttcggacgtttgttttttagagtcggaggaagggattttttgttgatatcgcgagttcggacgtttgttttttagagtcggaggaagggtttttttgtgatatcgcgagttcggacgtttgttttttagagtcggaggaagggtttttttgtgatatcgcgagttcggacgtttgttttttagagtcggaggaagggttattttgtgatatcgtgagtcggacgtttgtttttcggagtcggaggaagggttatttgtgatatcgtgagttcggacgtttgttttttagagtcggaggaagggttattttgtgatatcgtgagtcggacgtttgttttttggagtcggaggaagggttatttgtgatatcgtgagttcggacgtttgtttttcggagtcggagg

SEQ ID NO: 32532 - DNA, 989 bp, Artificial Sequence
  chemically treated genomic DNA (Homo sapiens) CpG-island No: 32532
cctccgactccgaaaaacaaacgtccgaactcacgatatcacaaataacccttcctccgactccaaaaaacaaacgtccgactcacgatatcacaaaataacccttcctccgactctaaaaaacaaacgtccgaactcacgatatcacaaataacccttcctccgactccgaaaaacaaacgtccgactcacgatatcacaaaataacccttcctccgactctaaaaaacaaacgtccgaactcgcgatatcacaaaaaaacccttcctccgactctaaaaaacaaacgtccgaactcgcgatatcacaaaaaaacccttcctccgactctaaaaaacaaacgtccgaactcgcgatatcaacaaaaaatcccttcctccgactctaaaaaacaaacgtccgaactcgcgatatcaacaaaaaaacccttcctccgactctaaaaaacaaacgtccgaactcgcgatatcaacaaaataacccttcctccgcctctaaaaaacaaacgtccgaactcgcgatatcaacaaaataacccttcctccgcctctaaaaaacaaacgtccgaactcgcgatatcaacaaaataacccttcctccgcctctaaaaaacaaacgtccgaactcgcgatatcaacaaaataacccttcctccgactctaaaaaacaaacgtccgaactcgcgatatcaacaaaataacccttcctccgactctaaaaaacaaacgtccgaactcgcgatatcacaaaaaaacccttcctccgactctaaaaaacaaacgtccgaactcgcgatatcacaaaaaaacccttcctccgactctaaaaaacaaacgtccgaactcgcgatatcaacaaaaaaacccttcctccgactctaaaaaacaaacgtccgaactcgcgatatcaacaaaataacccttcctccgactctaaaaaacacacgtccgaactcgtaatatcacaaaataacccttcctctacctcta

SEQ ID NO: 32533 - DNA, 803 bp, Artificial Sequence
  chemically treated genomic DNA (Homo sapiens) CpG-island No: 32533
gtcggcgtcgaagggcgtgatgttggttttgacggtggttacgtttaggtttattagtattagtttcgcgaaggtggtcggtgagtagtagcgggcggcggcgtcgggattaggcgtcgtgtagttgagtaggcgcgcggaatcgtagagcgcggttcgcgtggcgggcgcggttagtagcgggaaggttagtatgtttagtaggtagagcgttaggtttagtaggatggcgcgcgttcggtttagtcgcgcgtcggttagttagttttcgaacggcgagtttaggtaggtgaggtttatgaagagtagtagcgtttcgttggtttgcgcgtttttttagtagaacggcgtttcgtttaggaatagtattaggttggacgtgatgtcgtagaaagcggcgcgttttagtagtttcgttagtagtacggtttcgtacgtcgcgcgtcggttcgcgaacgttttagtcgtcgtcgcggtcgtcgtcgttcgtcgcgcgtttagtagcggcgttcgttcgttcgtatcgtttttagagttttttatgcgacgtcgttagttgtttcgtttcgtcgtcgggttatttgttttagaatttagggtcgtcgtttttttcgcgagattgtcgggtttgagatgtttttattgggcgggttcgtcgttgtttaacgttttattcgtcggaattttcggtttcgtttcgggtattaggcgaggaggtggtcggtattttggattattgcgtgttttggggagtttgggatttcgtagtttggcggtcgagagtttttgtttgtttttttgag

SEQ ID NO: 32534 - DNA, 803 bp, Artificial Sequence
  chemically treated genomic DNA (Homo sapiens) CpG-island No: 32534
ctcaaaaaaacaaacaaaaactctcgaccgccaaactacgaaatcccaaactccccaaaacacgcaataatccaaaataccgaccacctcctcgcctaatacccgaaacgaaaccgaaaattccgacgaataaaacgttaaacaacgacgaacccgcccaataaaaacatctcaaacccgacaatctcgcgaaaaaaacgacgaccctaaattctaaaacaaataacccgacgacgaaacgaaacaactaacgacgtcgcataaaaaactctaaaaacgatacgaacgaacgaacgccgctactaaacgcgcgacgaacgacgacgaccgcgacgacgactaaaacgttcgcgaaccgacgcgcgacgtacgaaaccgtactactaacgaaactactaaaacgcgccgctttctacgacatcacgtccaacctaatactattcctaaacgaaacgccgttctactaaaaaaacgcgcaaaccaacgaaacgctactactcttcataaacctcacctacctaaactcgccgttcgaaaactaactaaccgacgcgcgactaaaccgaacgcgcgccatcctactaaacctaacgctctacctactaaacatactaaccttcccgctactaaccgcgcccgccacgcgaaccgcgctctacgattccgcgcgcctactcaactacacgacgcctaatcccgacgccgccgcccgctactactcaccgaccaccttcgcgaaactaatactaataaacctaaacgtaaccaccgtcaaaaccaacatcacgcccttcgacgccgac

SEQ ID NO: 32535 - DNA, 803 bp, Artificial Sequence
  chemically treated genomic DNA (Homo sapiens) CpG-island No: 32535
tttaaaaaggtaaataaaggttttcggtcgttaagttgcggaattttaagttttttaagatacgtagtgatttagaatatcggttattttttcgtttagtgttcggggcggggtcggaagtttcggcgagtggggcgttgagtagcggcgagttcgtttaatagggatattttaggttcggtagtttcgcgagaagggcggcggttttgggttttgggataggtgattcggcggcggggcgaggtagttggcggcgtcgtatggagggttttgggggcggtgcgggcgagcgggcgtcgttgttgggcgcgcggcgggcggcggcggtcgcggcggcggttggggcgttcgcgggtcggcgcgcggcgtgcggggtcgtgttgttgacggagttgttggagcgcgtcgttttttacggtattacgtttaatttggtgttatttttgaacggggcgtcgttttgttgggagggcgcgtaggttagcgaggcgttgttgttttttatgggttttatttatttgggttcgtcgttcggaggttggttggtcgacgcgcggttgggtcgggcgcgcgttattttgttgagtttggcgttttatttgttgggtatgttggttttttcgttgttggtcgcgttcgttacgcgagtcgcgttttgcggtttcgcgcgtttgtttaattgtacggcgtttggtttcgacgtcgtcgttcgttgttgtttatcggttattttcgcggggttggtgttggtgggtttgggcgtggttatcgttaaggttaatattacgtttttcggcgtcgat

SEQ ID NO: 32536 - DNA, 803 bp, Artificial Sequence
  chemically treated genomic DNA (Homo sapiens) CpG-island No: 32536
atcgacgccgaaaaacgtaatattaaccttaacgataaccacgcccaaacccaccaacaccaaccccgcgaaaataaccgataaacaacaacgaacgacgacgtcgaaaccaaacgccgtacaattaaacaaacgcgcgaaaccgcaaaacgcgactcgcgtaacgaacgcgaccaacaacgaaaaaaccaacatacccaacaaataaaacgccaaactcaacaaaataacgcgcgcccgacccaaccgcgcgtcgaccaaccaacctccgaacgacgaacccaaataaataaaacccataaaaaacaacaacgcctcgctaacctacgcgccctcccaacaaaacgacgccccgttcaaaaataacaccaaattaaacgtaataccgtaaaaaacgacgcgctccaacaactccgtcaacaacacgaccccgcacgccgcgcgccgacccgcgaacgccccaaccgccgccgcgaccgccgccgcccgccgcgcgcccaacaacgacgcccgctcgcccgcaccgcccccaaaaccctccatacgacgccgccaactacctcgccccgccgccgaatcacctatcccaaaacccaaaaccgccgcccttctcgcgaaactaccgaacctaaaatatccctattaaacgaactcgccgctactcaacgccccactcgccgaaacttccgaccccgccccgaacactaaacgaaaaaataaccgatattctaaatcactacgtatcttaaaaaacttaaaattccgcaacttaacgaccgaaaacctttatttacctttttaaa

SEQ ID NO: 32537 - DNA, 614 bp, Artificial Sequence
  chemically treated genomic DNA (Homo sapiens) CpG-island No: 32537
agcgcgaggttaatgcgtcggtcgtacggagattcggggatacgcgcgttacgtagaaggtatcgattttcgcgcgttcggtaggcggtatcggtttattcgtttgtgcgcgcggttcgggacggtttcggcgcggttggagggggtttggttgagcgtttcgcgttttcgggtttcgcgttttcgtttttcggttttcggtttaggtttcgtaggtttcggcgttttgtatttatcgaacgcgttgggtcgtgatcgcgttgtcggtgtgtggtcgtagtatcgttaggaataggagtcgtatgtcgtcgtcgtcgttcgggttatcgatcggtttcgtcgtcgtcgattaggtttcggggtcggcgtagacgcggacggcgggggagtcggggcggttgggtttgtttcgttcgttttttttcgaggtcgcgttttagttcgtaggtttcggcgttaggcggggagggggacgggaatcgggggtttcgggcggcgcgagttttgggtgcggggtggcgcgggtgtgtttcgtggggtttattattagggtagtcgcggttcgtttttatttggattaggattagcggtgattatagttttttttacgggga

SEQ ID NO: 32538 - DNA, 614 bp, Artificial Sequence
  chemically treated genomic DNA (Homo sapiens) CpG-island No: 32538
tccccgtaaaaaaaactataatcaccgctaatcctaatccaaataaaaacgaaccgcgactaccctaataataaaccccacgaaacacacccgcgccaccccgcacccaaaactcgcgccgcccgaaacccccgattcccgtccccctccccgcctaacgccgaaacctacgaactaaaacgcgacctcgaaaaaaaacgaacgaaacaaacccaaccgccccgactcccccgccgtccgcgtctacgccgaccccgaaacctaatcgacgacgacgaaaccgatcgataacccgaacgacgacgacgacatacgactcctattcctaacgatactacgaccacacaccgacaacgcgatcacgacccaacgcgttcgataaatacaaaacgccgaaacctacgaaacctaaaccgaaaaccgaaaaacgaaaacgcgaaacccgaaaacgcgaaacgctcaaccaaaccccctccaaccgcgccgaaaccgtcccgaaccgcgcgcacaaacgaataaaccgataccgcctaccgaacgcgcgaaaatcgataccttctacgtaacgcgcgtatccccgaatctccgtacgaccgacgcattaacctcgcgct

SEQ ID NO: 32539 - DNA, 614 bp, Artificial Sequence
  chemically treated genomic DNA (Homo sapiens) CpG-island No: 32539
ttttcgtggaagggattgtggttatcgttggttttggtttaggtgggaacggatcgcggttattttggtgatggattttacggggtatattcgcgttatttcgtatttagggttcgcgtcgttcgaggttttcggttttcgttttttttttcgtttggcgtcggaatttgcgagttggggcgcggtttcggggaggggcgggcgggatagatttagtcgtttcggttttttcgtcgttcgcgtttgcgtcggtttcggggtttggtcggcggcggcggggtcggtcgatggttcgggcggcggcggcggtatgcggtttttgtttttggcggtgttgcggttatatatcggtaacgcggttacggtttagcgcgttcggtaggtgtagggcgtcggggtttacgaagtttgggtcgggggtcggggggcggggacgcgggattcggggacgcggggcgtttagttaggttttttttagtcgcgtcggggtcgtttcgagtcgcgcgtataaacggatgggtcggtgtcgtttgtcgggcgcgcgggggtcggtgttttttgcgtggcgcgcgtgttttcgggttttcgtgcggtcggcgtattggtttcgcgtt

SEQ ID NO: 32540 - DNA, 614 bp, Artificial Sequence
  chemically treated genomic DNA (Homo sapiens) CpG-island No: 32540
aacgcgaaaccaatacgccgaccgcacgaaaacccgaaaacacgcgcgccacgcaaaaaacaccgacccccgcgcgcccgacaaacgacaccgacccatccgtttatacgcgcgactcgaaacgaccccgacgcgactaaaaaaaacctaactaaacgccccgcgtccccgaatcccgcgtccccgccccccgacccccgacccaaacttcgtaaaccccgacgccctacacctaccgaacgcgctaaaccgtaaccgcgttaccgatatataaccgcaacaccgccaaaaacaaaaaccgcataccgccgccgccgcccgaaccatcgaccgaccccgccgccgccgaccaaaccccgaaaccgacgcaaacgcgaacgacgaaaaaaccgaaacgactaaatctatcccgcccgcccctccccgaaaccgcgccccaactcgcaaattccgacgccaaacgaaaaaaaaaacgaaaaccgaaaacctcgaacgacgcgaaccctaaatacgaaataacgcgaatataccccgtaaaatccatcaccaaaataaccgcgatccgttcccacctaaaccaaaaccaacgataaccacaatcccttccacgaaaa

SEQ ID NO: 32541 - DNA, 667 bp, Artificial Sequence
  chemically treated genomic DNA (Homo sapiens) CpG-island No: 32541
atttttttcgtcggaggattagtaaattttggtcgtttatgtttatttcgcggtaggcgtgggttttagattcgttttatcgcggtttcgcgttcgttcgtcgtttatttgtttggattttagcggttggtgtttacgtttttagttcggttttcgttttcgtttcgggcgtagtcgtttcgtcgtttttgttcgttttcggtttattcggtttttgttttttttttatttcgcggcgttttcgtttcgatttttatcgtttttcggagttcgcggcggtttttttatttttttacgtcggaattagtttttagtttttttttttcgagtattcggtcggttttattttttgcgttttttttagtacgcgacggattcgtaggtcgcgagatttaggtttttttgttgtcgtcgtcgtcgtcgagattggaggttcggtagtcgtcggtttcgtttttttcggaaatggtttcgggggtatcggttcggttttcggattttggcgtgcgcggtttcgttgttattagtcgcgcgtacgtttagattcgggttttacggtttgtgcgcgtcgtttatcggttaggtagcgggttgtatttagattttttagtgaatgttttaattaggtcgttttggggcggttgtggtatttcgacggttattaatt

SEQ ID NO: 32542 - DNA, 667 bp, Artificial Sequence
  chemically treated genomic DNA (Homo sapiens) CpG-island No: 32542
aattaataaccgtcgaaataccacaaccgccccaaaacgacctaattaaaacattcactaaaaaatctaaatacaacccgctacctaaccgataaacgacgcgcacaaaccgtaaaacccgaatctaaacgtacgcgcgactaataacaacgaaaccgcgcacgccaaaatccgaaaaccgaaccgatacccccgaaaccatttccgaaaaaaacgaaaccgacgactaccgaacctccaatctcgacgacgacgacgacaacaaaaaaacctaaatctcgcgacctacgaatccgtcgcgtactaaaaaaaacgcaaaaaataaaaccgaccgaatactcgaaaaaaaaaaactaaaaactaattccgacgtaaaaaaataaaaaaaccgccgcgaactccgaaaaacgataaaaatcgaaacgaaaacgccgcgaaataaaaaaaaaacaaaaaccgaataaaccgaaaacgaacaaaaacgacgaaacgactacgcccgaaacgaaaacgaaaaccgaactaaaaacgtaaacaccaaccgctaaaatccaaacaaataaacgacgaacgaacgcgaaaccgcgataaaacgaatctaaaacccacgcctaccgcgaaataaacataaacgaccaaaatttactaatcctccgacgaaaaaaat

SEQ ID NO: 32543 - DNA, 667 bp, Artificial Sequence
  chemically treated genomic DNA (Homo sapiens) CpG-island No: 32543
agttggtgatcgtcgggatattatagtcgttttaggacggtttggttgagatatttattggagggtttgggtgtagttcgttgtttggtcggtaggcggcgcgtataggtcgtggggttcgggtttgggcgtgcgcgcggttggtagtagcggggtcgcgtacgttagggttcgggagtcgggtcggtgttttcggagttattttcgggaggggcgaggtcggcggttgtcgggtttttaatttcggcggcggcggcggtaataggggagtttgggtttcgcggtttgcgagttcgtcgcgtgttgagggagacgtaggaggtggagtcggtcgggtgttcgagggaaggagattggaagttggtttcggcgtgaggaggtggaggggtcgtcgcgggtttcggggggcggtgagggtcgggacggaggcgtcgcggggtgaggagaggataggggtcgggtgggtcgagggcgggtagaggcggcggggcggttgcgttcggggcgggggcgggggtcgggttgaaggcgtgggtattagtcgttgaggtttaagtaagtggacggcgggcgggcgcggggtcgcggtggggcgggtttggagtttacgtttgtcgcggggtaggtatgggcggttaggatttgttggtttttcgacgggaggggt

SEQ ID NO: 32544 - DNA, 667 bp, Artificial Sequence
  chemically treated genomic DNA (Homo sapiens) CpG-island No: 32544
acccctcccgtcgaaaaaccaacaaatcctaaccgcccatacctaccccgcgacaaacgtaaactccaaacccgccccaccgcgaccccgcgcccgcccgccgtccacttacttaaacctcaacgactaatacccacgccttcaacccgacccccgcccccgccccgaacgcaaccgccccgccgcctctacccgccctcgacccacccgacccctatcctctcctcaccccgcgacgcctccgtcccgaccctcaccgccccccgaaacccgcgacgacccctccacctcctcacgccgaaaccaacttccaatctccttccctcgaacacccgaccgactccacctcctacgtctccctcaacacgcgacgaactcgcaaaccgcgaaacccaaactcccctattaccgccgccgccgccgaaattaaaaacccgacaaccgccgacctcgcccctcccgaaaataactccgaaaacaccgacccgactcccgaaccctaacgtacgcgaccccgctactaccaaccgcgcgcacgcccaaacccgaaccccacgacctatacgcgccgcctaccgaccaaacaacgaactacacccaaaccctccaataaatatctcaaccaaaccgtcctaaaacgactataatatcccgacgatcaccaact

SEQ ID NO: 32545 - DNA, 721 bp, Artificial Sequence
  chemically treated genomic DNA (Homo sapiens) CpG-island No: 32545
  misc_feature (279)..(279): n is either a, c, g or t
tatgcgtcgtcgtaatcggggttttcgacgcggcgtacgcgaacgtttgatcgtattcggtattcgggttagcgcgtatgtttattttacgatttcgggagtgtgaagttgattttcgtcgtatttcgttatacggttttttcgcgcgcggttatttttttatcgtcgttggtgggaattcggattcgcggatacggggatattttttaattcgggaattttcggaatcgcgtaatgcgcgtatacgtgaatttcggtcgacggggaatcgggggtagntcgttttatgcggaattcgcgtatattcgcgggttttcggaaattatcggtattaacggcgtattcggggtaatttttcgtaattcgataattgttcgattcgttaggttatttggattatttcgcgtgggttttcgtgaaatcggtttgattcgtattagtggagattgtttcgtttggaattttttttcgtcgtgttcgcgggagtcgttaacgtttttattcgcgttaatgtcgtcgtggtacgttaatagtagtttcgtcgcggtatattgttcgtatataatcggtcgttattagagttcgtcgtggtgtgaattgtgcgtagtttttgagcgcggtatttgatcgtattttatcgtcgcgcgagacgacgcggtgattattttttggcgacgatattattatcgcgttcgcggtgtttatattgtagtgcgtacgt

SEQ ID NO: 32546 - DNA, 721 bp, Artificial Sequence
  chemically treated genomic DNA (Homo sapiens) CpG-island No: 32546
  misc_feature (443)..(443): n is either a, c, g or t
acgtacgcactacaatataaacaccgcgaacgcgataataatatcgtcgccaaaaaataatcaccgcgtcgtctcgcgcgacgataaaatacgatcaaataccgcgctcaaaaactacgcacaattcacaccacgacgaactctaataacgaccgattatatacgaacaatataccgcgacgaaactactattaacgtaccacgacgacattaacgcgaataaaaacgttaacgactcccgcgaacacgacgaaaaaaaattccaaacgaaacaatctccactaatacgaatcaaaccgatttcacgaaaacccacgcgaaataatccaaataacctaacgaatcgaacaattatcgaattacgaaaaattaccccgaatacgccgttaataccgataatttccgaaaacccgcgaatatacgcgaattccgcataaaacganctacccccgattccccgtcgaccgaaattcacgtatacgcgcattacgcgattccgaaaattcccgaattaaaaaatatccccgtatccgcgaatccgaattcccaccaacgacgataaaaaaataaccgcgcgcgaaaaaaccgtataacgaaatacgacgaaaatcaacttcacactcccgaaatcgtaaaataaacatacgcgctaacccgaataccgaatacgatcaaacgttcgcgtacgccgcgtcgaaaaccccgattacgacgacgcata

SEQ ID NO: 32547 - DNA, 721 bp, Artificial Sequence
  chemically treated genomic DNA (Homo sapiens) CpG-island No: 32547
  misc_feature (443)..(443): n is either a, c, g or t
gcgtgcgtattgtagtgtggatatcgcggacgcggtagtagtgtcgtcgttagagaataattatcgcgtcgtttcgcgcgacggtagagtgcgattagatgtcgcgtttagaggttgcgtatagtttatattacggcgggttttgatggcgatcggttatgtgcgagtagtatgtcgcgacggaattattgttggcgtgttacggcggtattaacgcgggtgagaacgttgacggttttcgcggatacggcggaggagggttttaagcgagatagtttttattagtgcgggttaggtcggttttacgggggtttacgcggagtggtttagatagtttggcgagtcggataattgtcggattgcgagggattatttcgggtgcgtcgttagtatcggtagttttcgggagttcgcgggtgtgcgcggatttcgtatagggcggnttgttttcggtttttcgtcggtcggaatttacgtgtgcgcgtattgcgcgatttcgggagttttcggattaaggagtattttcgtgttcgcgggttcggatttttattagcggcggtgagggaataatcgcgcgcgagagagtcgtgtagcggggtgcggcgggagttagttttatattttcggggtcgtagggtagatatacgcgttagttcgggtgtcgagtacgattaggcgttcgcgtgcgtcgcgtcgggggtttcggttgcggcggcgtatg

SEQ ID NO: 32548 - DNA, 721 bp, Artificial Sequence
  chemically treated genomic DNA (Homo sapiens) CpG-island No: 32548
  misc_feature (279)..(279): n is either a, c, g or t
catacgccgccgcaaccgaaacccccgacgcgacgcacgcgaacgcctaatcgtactcgacacccgaactaacgcgtatatctaccctacgaccccgaaaatataaaactaactcccgccgcaccccgctacacgactctctcgcgcgcgattattccctcaccgccgctaataaaaatccgaacccgcgaacacgaaaatactccttaatccgaaaactcccgaaatcgcgcaatacgcgcacacgtaaattccgaccgacgaaaaaccgaaaacaanccgccctatacgaaatccgcgcacacccgcgaactcccgaaaactaccgatactaacgacgcacccgaaataatccctcgcaatccgacaattatccgactcgccaaactatctaaaccactccgcgtaaacccccgtaaaaccgacctaacccgcactaataaaaactatctcgcttaaaaccctcctccgccgtatccgcgaaaaccgtcaacgttctcacccgcgttaataccgccgtaacacgccaacaataattccgtcgcgacatactactcgcacataaccgatcgccatcaaaacccgccgtaatataaactatacgcaacctctaaacgcgacatctaatcgcactctaccgtcgcgcgaaacgacgcgataattattctctaacgacgacactactaccgcgtccgcgatatccacactacaatacgcacgc

SEQ ID NO: 32549 - DNA, 538 bp, Artificial Sequence
  chemically treated genomic DNA (Homo sapiens) CpG-island No: 32549
cgggttcgaaatgcggttcggttcgttatggttttggcgcgggggtcgggtattggggttcgttcgtatatgggtaaaaagtataagaagtttaagtcggataattacgtttcgaagggtgagtaggggttcggggtgcggcggtagggttttcggcggttttgcggggttttcgtttttttttagtggtttcgggcgcgttcggggttttttttttttacggtaggtttaggtcggcgaagggggcgtgttttgtcgtagatcgcgttgtttttagtgcggtagcggtattcgaattcgggttttcgtggttcggtgggtttttggtgggaagacgtgaggcgggttcggtagttttgggagcgttcggggcgggcggcgtcgtcgtattttcgggtcggggttcgttatttaataggtgtttcgcggagcgtttaaagtcgtttcgggtttgttgcgttttggcgttttgtatttttagtattttttggagagtttcgattttaatcgacgcgttttttttttttttttttttttt

SEQ ID NO: 32550 - DNA, 538 bp, Artificial Sequence
  chemically treated genomic DNA (Homo sapiens) CpG-island No: 32550
aaaaaaaaaaaaaaaaaaaaaaacgcgtcgattaaaatcgaaactctccaaaaaatactaaaaatacaaaacgccaaaacgcaacaaacccgaaacgactttaaacgctccgcgaaacacctattaaataacgaaccccgacccgaaaatacgacgacgccgcccgccccgaacgctcccaaaactaccgaacccgcctcacgtcttcccaccaaaaacccaccgaaccacgaaaacccgaattcgaataccgctaccgcactaaaaacaacgcgatctacgacaaaacacgcccccttcgccgacctaaacctaccgtaaaaaaaaaaaaccccgaacgcgcccgaaaccactaaaaaaaaacgaaaaccccgcaaaaccgccgaaaaccctaccgccgcaccccgaacccctactcacccttcgaaacgtaattatccgacttaaacttcttatactttttacccatatacgaacgaaccccaatacccgacccccgcgccaaaaccataacgaaccgaaccgcatttcgaacccg

SEQ ID NO: 32551 - DNA, 538 bp, Artificial Sequence
  chemically treated genomic DNA (Homo sapiens) CpG-island No: 32551
aaagaaaagaaaagaaaggaaagcgcgtcgattaaaatcggggttttttagggagtgttaaggatgtagagcgttaaagcgtaataagttcgaggcggttttgggcgtttcgcgaagtatttgttgaatgacggatttcggttcgggggtgcggcggcgtcgttcgtttcgaacgtttttaggattatcgggttcgttttacgtttttttattagagatttatcggattacggggattcgggttcgaatgtcgttgtcgtattgggggtagcgcggtttacggtaggatacgtttttttcgtcggtttgggtttgtcgtgggaaggaaaggtttcgggcgcgttcggaattattgggaaagagcggaagtttcgtagagtcgtcgagggttttgtcgtcgtatttcgggtttttgtttatttttcgagacgtgattgttcgatttgagttttttgtgttttttgtttatgtacgaacgggttttagtgttcggttttcgcgttagggttatgacgggtcgagtcgtatttcggattcg

SEQ ID NO: 32552 - DNA, 538 bp, Artificial Sequence
  chemically treated genomic DNA (Homo sapiens) CpG-island No: 32552
cgaatccgaaatacgactcgacccgtcataaccctaacgcgaaaaccgaacactaaaacccgttcgtacataaacaaaaaacacaaaaaactcaaatcgaacaatcacgtctcgaaaaataaacaaaaacccgaaatacgacgacaaaaccctcgacgactctacgaaacttccgctctttcccaataattccgaacgcgcccgaaacctttccttcccacgacaaacccaaaccgacgaaaaaaacgtatcctaccgtaaaccgcgctacccccaatacgacaacgacattcgaacccgaatccccgtaatccgataaatctctaataaaaaaacgtaaaacgaacccgataatcctaaaaacgttcgaaacgaacgacgccgccgcacccccgaaccgaaatccgtcattcaacaaatacttcgcgaaacgcccaaaaccgcctcgaacttattacgctttaacgctctacatccttaacactccctaaaaaaccccgattttaatcgacgcgctttcctttcttttcttttcttt

SEQ ID NO: 32553 - DNA, 704 bp, Artificial Sequence
  chemically treated genomic DNA (Homo sapiens) CpG-island No: 32553
tagaggcggttttttttatagacgttgtttggaattcgtcgttaagtttttagtaggcggttcgtttggcgttttttagttttcgtataagtagggttacggtttggggtttttaaggtcgtttacgcgggcgcgtttcgtcgagggttagtttgttagcgttttattcgcggttttttattttagacgatcggttttgggcggcgtcgttttaattttacgcgtttagttcgttcgggaaagcgcgcgttatttttttaacggttttatttcggtaggggtgcggttgttttcgaggtttagcgttcgaggttacgtttcgcgttcgttttgggttcgtttcgtgtttttcggagacgtttttcgcgtcgtttttcgtttttcgtttttcgtttttcgtttttcgtcgtcgttatcgcggttagttagcggattagcggtaggagtcgtttttcgacgggtagtagggcgttcggttttcgcgtgtgggttgagcgcggcgacgttgttgtttcgaaattttcgtggattttgagtcggtaagtggttagggaggatgagcgatattgggggacggaagtcgggtttcgtggtgtggaggaggcgggtgggcgtcgttttttaggttcgatttcgggaaagttgaggcgaggaagagaagttttgaggtgggtcgggaaattttttagggtttttttagtatt

SEQ ID NO: 32554 - DNA, 704 bp, Artificial Sequence
  chemically treated genomic DNA (Homo sapiens) CpG-island No: 32554
aatactaaaaaaaccctaaaaaatttcccgacccacctcaaaacttctcttcctcgcctcaactttcccgaaatcgaacctaaaaaacgacgcccacccgcctcctccacaccacgaaacccgacttccgtcccccaatatcgctcatcctccctaaccacttaccgactcaaaatccacgaaaatttcgaaacaacaacgtcgccgcgctcaacccacacgcgaaaaccgaacgccctactacccgtcgaaaaacgactcctaccgctaatccgctaactaaccgcgataacgacgacgaaaaacgaaaaacgaaaaacgaaaaacgaaaaacgacgcgaaaaacgtctccgaaaaacacgaaacgaacccaaaacgaacgcgaaacgtaacctcgaacgctaaacctcgaaaacaaccgcacccctaccgaaataaaaccgttaaaaaaataacgcgcgctttcccgaacgaactaaacgcgtaaaattaaaacgacgccgcccaaaaccgatcgtctaaaataaaaaaccgcgaataaaacgctaacaaactaaccctcgacgaaacgcgcccgcgtaaacgaccttaaaaaccccaaaccgtaaccctacttatacgaaaactaaaaaacgccaaacgaaccgcctactaaaaacttaacgacgaattccaaacaacgtctataaaaaaaaccgcctcta

SEQ ID NO: 32555 - DNA, 704 bp, Artificial Sequence
  chemically treated genomic DNA (Homo sapiens) CpG-island No: 32555
ggtattgaaggggttttaagagatttttcgatttattttagagtttttttttttcgttttaattttttcggggtcgggtttgggagacggcgtttattcgttttttttatattacggggttcgattttcgttttttagtgtcgtttattttttttagttatttatcgatttaaaatttacggggatttcggggtagtagcgtcgtcgcgtttagtttatacgcggaggtcgagcgttttgttgttcgtcggggaacggtttttgtcgttggttcgttggttgatcgcggtggcggcggcggggggcgaggggcggggggcgaggggcggagggcggcgcggaaggcgttttcgaggggtacgaggcgggtttagggcgggcgcggggcgtggtttcgggcgttgagtttcgagagtagtcgtatttttgtcggggtagaatcgttaaaagggtggcgcgcgttttttcgggcgagttgggcgcgtggggttggagcggcgtcgtttagagtcggtcgtttagggtaggaggtcgcgagtgaggcgttgataggttagttttcgacggggcgcgttcgcgtgaacggttttgggggttttagatcgtggttttgtttgtgcgaagattgggaggcgttaggcgggtcgtttgttgggggtttggcggcgggttttaggtagcgtttgtgagggaggtcgtttttg

SEQ ID NO: 32556 - DNA, 704 bp, Artificial Sequence
  chemically treated genomic DNA (Homo sapiens) CpG-island No: 32556
caaaaacgacctccctcacaaacgctacctaaaacccgccgccaaacccccaacaaacgacccgcctaacgcctcccaatcttcgcacaaacaaaaccacgatctaaaacccccaaaaccgttcacgcgaacgcgccccgtcgaaaactaacctatcaacgcctcactcgcgacctcctaccctaaacgaccgactctaaacgacgccgctccaaccccacgcgcccaactcgcccgaaaaaacgcgcgccacccttttaacgattctaccccgacaaaaatacgactactctcgaaactcaacgcccgaaaccacgccccgcgcccgccctaaacccgcctcgtacccctcgaaaacgccttccgcgccgccctccgcccctcgccccccgcccctcgccccccgccgccgccaccgcgatcaaccaacgaaccaacgacaaaaaccgttccccgacgaacaacaaaacgctcgacctccgcgtataaactaaacgcgacgacgctactaccccgaaatccccgtaaattttaaatcgataaataactaaaaaaaataaacgacactaaaaaacgaaaatcgaaccccgtaatataaaaaaaacgaataaacgccgtctcccaaacccgaccccgaaaaaattaaaacgaaaaaaaaaaactctaaaataaatcgaaaaatctcttaaaaccccttcaatacc

SEQ ID NO: 32557 - DNA, 551 bp, Artificial Sequence
  chemically treated genomic DNA (Homo sapiens) CpG-island No: 32557
tttagcgcgagttttcgggaacgttttaacgtttttagtttgtgttttaggaacggggttcggtttttcgttttaatttttaatagtttgtttgtgtttcgggaacgcgttaatatttttggggagcgttttagttataagatattgtgttgagaacgttgttattattcgtagttgtaagtttcggagcggtagtgggaagtatgcgggattattacgaggtgatcgtttttttgggcgagagggggcgttttttagcgttttattttttttttgtttatcgttagtattatttttaatgggtttaatgggatgttagtcgtgtttttggcggggatttcggagtatcgttgtcgagtgttcgacgtttcgaatttgagtagcgtttggcgtaataatattgtttcgttgtggttgcgggatagtcgcgaggtgttttatagttgtagtcgttatcggttcgttattatttttaatttttttgcgttttggttgtagttcgggcgcgatatggatttggggtagttggagtacgagagttgtttggatgg

SEQ ID NO: 32558 - DNA, 551 bp, Artificial Sequence
  chemically treated genomic DNA (Homo sapiens) CpG-island No: 32558
ccatccaaacaactctcgtactccaactaccccaaatccatatcgcgcccgaactacaaccaaaacgcaaaaaaattaaaaataataacgaaccgataacgactacaactataaaacacctcgcgactatcccgcaaccacaacgaaacaatattattacgccaaacgctactcaaattcgaaacgtcgaacactcgacaacgatactccgaaatccccgccaaaaacacgactaacatcccattaaacccattaaaaataatactaacgataaacaaaaaaaaaataaaacgctaaaaaacgccccctctcgcccaaaaaaacgatcacctcgtaataatcccgcatacttcccactaccgctccgaaacttacaactacgaataataacaacgttctcaacacaatatcttataactaaaacgctccccaaaaatattaacgcgttcccgaaacacaaacaaactattaaaaattaaaacgaaaaaccgaaccccgttcctaaaacacaaactaaaaacgttaaaacgttcccgaaaactcgcgctaaa

SEQ ID NO: 32559 - DNA, 551 bp, Artificial Sequence
  chemically treated genomic DNA (Homo sapiens) CpG-island No: 32559
ttatttaggtagttttcgtgttttagttgttttaggtttatgtcgcgttcgggttatagttagagcgtagagaagttggagatggtggcgagtcggtagcggttgtagttgtggggtatttcgcggttgtttcgtagttatagcgggatagtgttgttgcgttaggcgttgtttaggttcggggcgtcgggtattcgatagcggtgtttcggggttttcgttaggaatacgattgatattttattgaatttattggggatgatgttggcgatgagtaggaagaagatgaggcgttgaaaggcgttttttttcgtttaggaaggcgattatttcgtagtagtttcgtatgttttttattgtcgtttcgaaatttgtaattacgggtgatgatagcgtttttagtatagtgttttgtagttggggcgttttttaaggatgttagcgcgttttcggggtataggtaggttgttagaaattggggcgagaagtcgggtttcgtttttgggatataggttgaaggcgttggagcgttttcgggagttcgcgttgag

SEQ ID NO: 32560 - DNA, 551 bp, Artificial Sequence
  chemically treated genomic DNA (Homo sapiens) CpG-island No: 32560
ctcaacgcgaactcccgaaaacgctccaacgccttcaacctatatcccaaaaacgaaacccgacttctcgccccaatttctaacaacctacctataccccgaaaacgcgctaacatccttaaaaaacgccccaactacaaaacactatactaaaaacgctatcatcacccgtaattacaaatttcgaaacgacaataaaaaacatacgaaactactacgaaataatcgccttcctaaacgaaaaaaaacgcctttcaacgcctcatcttcttcctactcatcgccaacatcatccccaataaattcaataaaatatcaatcgtattcctaacgaaaaccccgaaacaccgctatcgaatacccgacgccccgaacctaaacaacgcctaacgcaacaacactatcccgctataactacgaaacaaccgcgaaataccccacaactacaaccgctaccgactcgccaccatctccaacttctctacgctctaactataacccgaacgcgacataaacctaaaacaactaaaacacgaaaactacctaaataa

SEQ ID NO: 32561 - DNA, 655 bp, Artificial Sequence
  chemically treated genomic DNA (Homo sapiens) CpG-island No: 32561
gcgatttcgtgataatgtcggtattcgggtattaattggtttttgcgaatcgtttttcgtttttcgttcggatttcgaagttcggagtcgtttatagtttgaggcgtcgtgtgtcgttttttggtggtcggaggtcgttattgtcgcggttgagggggcgtttcggtgtattcgtagcgcgttttggtcgttttttggtggtcggaggtcgttattgtttttttttagggggcgtttcggtgtattcgtagcgcgttttggtcgttttttggtggtcggaggtcgttattgtcgcggttgagggggcgtttcggtgtattcgtagcgcgttttggtcgatttttggtggtcggaggttgttattgtcgcggttgaaggggcgtgtttcggtgtattcgtagcgcgttttggttgttttttggtggtcggaggtcgttattgtcgcggttgagggggcgtttcggtgtattcgtagcgcgttttgtttcgttatatatatttcgtgttttttaaatattcgtcgtgggttaagtatgggatttacgtggggcggggatatacggcgataaagagttaggttttcgttgttaaggagttttttcgtaatatcgatgtattaaataaaaggtagtaaaagtgtttgggtttttgcgtt

SEQ ID NO: 32562 - DNA, 655 bp, Artificial Sequence
  chemically treated genomic DNA (Homo sapiens) CpG-island No: 32562
aacgcaaaaacccaaacacttttactaccttttatttaatacatcgatattacgaaaaaactccttaacaacgaaaacctaactctttatcgccgtatatccccgccccacgtaaatcccatacttaacccacgacgaatatttaaaaaacacgaaatatatataacgaaacaaaacgcgctacgaatacaccgaaacgccccctcaaccgcgacaataacgacctccgaccaccaaaaaacaaccaaaacgcgctacgaatacaccgaaacacgccccttcaaccgcgacaataacaacctccgaccaccaaaaatcgaccaaaacgcgctacgaatacaccgaaacgccccctcaaccgcgacaataacgacctccgaccaccaaaaaacgaccaaaacgcgctacgaatacaccgaaacgccccctaaaaaaaaacaataacgacctccgaccaccaaaaaacgaccaaaacgcgctacgaatacaccgaaacgccccctcaaccgcgacaataacgacctccgaccaccaaaaaacgacacacgacgcctcaaactataaacgactccgaacttcgaaatccgaacgaaaaacgaaaaacgattcgcaaaaaccaattaatacccgaataccgacattatcacgaaatcgc

SEQ ID NO: 32563 - DNA, 655 bp, Artificial Sequence
  chemically treated genomic DNA (Homo sapiens) CpG-island No: 32563
aacgtaaaaatttaggtatttttattattttttgtttgatgtatcggtgttacgggaaagttttttggtagcgagggtttggttttttatcgtcgtgtgttttcgttttacgtgggttttatgtttagtttacggcgggtgtttgaaaagtacggaatgtatatggcgggatagggcgcgttgcggatatatcgggacgtttttttagtcgcgatagtaacggttttcggttattagggggtagttagggcgcgttgcggatatatcgggatacgtttttttagtcgcgatagtaatagttttcggttattaggggtcggttagggcgcgttgcggatatatcgggacgtttttttagtcgcgatagtaacggttttcggttattagggggcggttagggcgcgttgcggatatatcgggacgttttttggggggggatagtaacggttttcggttattagagggcggttagggcgcgttgcggatatatcgggacgtttttttagtcgcgatagtaacggttttcggttattagggggcggtatacggcgttttaaattgtaaacggtttcgggtttcggaattcgggcggggagcggagagcggttcgtaaaagttagttggtgttcggatgtcggtattgttacgggatcgt

SEQ ID NO: 32564 - DNA, 655 bp, Artificial Sequence
  chemically treated genomic DNA (Homo sapiens) CpG-island No: 32564
acgatcccgtaacaataccgacatccgaacaccaactaacttttacgaaccgctctccgctccccgcccgaattccgaaacccgaaaccgtttacaatttaaaacgccgtataccgccccctaataaccgaaaaccgttactatcgcgactaaaaaaacgtcccgatatatccgcaacgcgccctaaccgccctctaataaccgaaaaccgttactatccccccccaaaaaacgtcccgatatatccgcaacgcgccctaaccgccccctaataaccgaaaaccgttactatcgcgactaaaaaaacgtcccgatatatccgcaacgcgccctaaccgacccctaataaccgaaaactattactatcgcgactaaaaaaacgtatcccgatatatccgcaacgcgccctaactaccccctaataaccgaaaaccgttactatcgcgactaaaaaaacgtcccgatatatccgcaacgcgccctatcccgccatatacattccgtacttttcaaacacccgccgtaaactaaacataaaacccacgtaaaacgaaaacacacgacgataaaaaaccaaaccctcgctaccaaaaaactttcccgtaacaccgatacatcaaacaaaaaataataaaaatacctaaatttttacgtt

SEQ ID NO: 32565 - DNA, 821 bp, Artificial Sequence
  chemically treated genomic DNA (Homo sapiens) CpG-island No: 32565
cgttcgttatttagtatttttgttttagggtcgttagcgggtaattcgttttttgttcgtattttattttcgttcgttaattcgcgttttttgttttgggcgcgtaatttgttttgttcggggtcgtttttgcgtttttcggattttttttcgtcgttgttagcgtaaagtgattgtcgttgtatttattttttttaggatatggtggggaggttggggcgggggaaggggaacggttagattttcgtcgtcgttgttgtcgtcgttattagtaagtttaatattggttgatcggcggtgaggatggagaggatgataatttcggtagtggtagtcgttttgttgacggtgggtagagtaatagtgttgttattttataagaggcggcgaggtagcggcgttaaatcgcgtagagggggacgcgggtattcgttcgtttttagcggcggcggtcgggtttttggcgggtttttttttcggggttgcgcgttcgttcggcgttgatagcggcgtttttgggagtcgggaagttcggtaggaggatttcgcgttcgtcgtttcgtagcgttatttttcgcgtttttttttcgggttttgggtggtcggtgatagtttcggcggtcgagcgcgtgtgtgagggggcggtcgtagggggagtttgcgttttttttttcgggttacgtttttacgagcgggaggaggcggtatcgcgttcggttattcgcgggtgggaaacgggtaggggcgtcggtagtcgtttttttattacggttattgataatttggaggttaaaggaaaattgagtttaaatgtacgtatt

SEQ ID NO: 32566 - DNA, 821 bp, Artificial Sequence
  chemically treated genomic DNA (Homo sapiens) CpG-island No: 32566
aatacgtacatttaaactcaattttcctttaacctccaaattatcaataaccgtaataaaaaaacgactaccgacgcccctacccgtttcccacccgcgaataaccgaacgcgataccgcctcctcccgctcgtaaaaacgtaacccgaaaaaaaaaacgcaaactccccctacgaccgccccctcacacacgcgctcgaccgccgaaactatcaccgaccacccaaaacccgaaaaaaaaacgcgaaaaataacgctacgaaacgacgaacgcgaaatcctcctaccgaacttcccgactcccaaaaacgccgctatcaacgccgaacgaacgcgcaaccccgaaaaaaaaacccgccaaaaacccgaccgccgccgctaaaaacgaacgaatacccgcgtccccctctacgcgatttaacgccgctacctcgccgcctcttataaaataacaacactattactctacccaccgtcaacaaaacgactaccactaccgaaattatcatcctctccatcctcaccgccgatcaaccaatattaaacttactaataacgacgacaacaacgacgacgaaaatctaaccgttccccttcccccgccccaacctccccaccatatcctaaaaaaaataaatacaacgacaatcactttacgctaacaacgacgaaaaaaaatccgaaaaacgcaaaaacgaccccgaacaaaacaaattacgcgcccaaaacaaaaaacgcgaattaacgaacgaaaataaaatacgaacaaaaaacgaattacccgctaacgaccctaaaacaaaaatactaaataacgaacg

SEQ ID NO: 32567 - DNA, 821 bp, Artificial Sequence
  chemically treated genomic DNA (Homo sapiens) CpG-island No: 32567
ggtgcgtgtatttgggtttagtttttttttggtttttaggttgttagtggtcgtagtgggagggcggttgtcggcgtttttgttcgttttttattcgcgggtggtcggacgcggtgtcgttttttttcgttcgtgagggcgtgattcggggaggggggcgtaggttttttttgcgatcgtttttttatatacgcgttcggtcgtcggagttgttatcggttatttagggttcggggagggggcgcggagagtggcgttgcggagcggcgggcgcgggatttttttgtcggatttttcggtttttagggacgtcgttgttaacgtcgagcggacgcgtagtttcgggagaggggttcgttagaggttcggtcgtcgtcgttgggggcgggcgggtgttcgcgtttttttttgcgcgatttggcgtcgttgtttcgtcgttttttgtagggtaatagtattattgttttatttatcgttagtagggcgattgttattgtcgggattattattttttttatttttatcgtcgattagttaatattggatttgttggtggcggcggtagtagcggcggcgggagtttagtcgttttttttttttcgttttagtttttttattatgttttagaaaaggtgagtgtagcgatagttattttgcgttgatagcggcgagagggggttcggagagcgtaggggcggtttcgggtaaggtaggttgcgcgtttagggtagagggcgcgggttggcgagcggaggtgggatgcgggtaggagacgagttgttcgttggcggttttggggtaagggtgttgggtggcgggcg

SEQ ID NO: 32568 - DNA, 821 bp, Artificial Sequence
  chemically treated genomic DNA (Homo sapiens) CpG-island No: 32568
cgcccgccacccaacacccttaccccaaaaccgccaacgaacaactcgtctcctacccgcatcccacctccgctcgccaacccgcgccctctaccctaaacgcgcaacctaccttacccgaaaccgcccctacgctctccgaaccccctctcgccgctatcaacgcaaaataactatcgctacactcaccttttctaaaacataataaaaaaactaaaacgaaaaaaaaaaaacgactaaactcccgccgccgctactaccgccgccaccaacaaatccaatattaactaatcgacgataaaaataaaaaaaataataatcccgacaataacaatcgccctactaacgataaataaaacaataatactattaccctacaaaaaacgacgaaacaacgacgccaaatcgcgcaaaaaaaaacgcgaacacccgcccgcccccaacgacgacgaccgaacctctaacgaacccctctcccgaaactacgcgtccgctcgacgttaacaacgacgtccctaaaaaccgaaaaatccgacaaaaaaatcccgcgcccgccgctccgcaacgccactctccgcgccccctccccgaaccctaaataaccgataacaactccgacgaccgaacgcgtatataaaaaaacgatcgcaaaaaaaacctacgcccccctccccgaatcacgccctcacgaacgaaaaaaaacgacaccgcgtccgaccacccgcgaataaaaaacgaacaaaaacgccgacaaccgccctcccactacgaccactaacaacctaaaaaccaaaaaaaaactaaacccaaatacacgcacc

SEQ ID NO: 32569 - DNA, 700 bp, Artificial Sequence
  chemically treated genomic DNA (Homo sapiens) CpG-island No: 32569
tttcgcgcggggggcgggagggaaaagttttttttttttgtttttcggttgtttatttcgttaggttgttttttttttcgtttttttcgggttcgtcgcgtttttgttttattttcgtcgtgggggggcgtcgaggagggagcgggcgtttgtgcgcggaggcgtgcggggagttggttggggcgttgcggtcgcgatcggttttttcgttttgacggcggtttagacgttcgcggaggcggttcggcggggtaagtcgaggaaggggtcgagagtcgggattttttttttttcgttcgcggcgcgtcgcgcgttttcgcgttttttggcgcgttttcgcgttttcgtgttcgttcgggtagatatttacgtagacgcgaaagtgaaaggggggcgattgggttcggtaggcgggcggtcggcggcgcgcgggtacgcggtaggggatagaggatggatgggtgaattcggatttcgggattttttcgcgttcgttgtttttttgcggagttttttcggagttttacgtttttatttcggttacggagattattacgttaggagatatgtatgcgtgtgtatgtgtgtgcgcgcgtgtttacgcgcgtgtgcgaggtacgtttttgttttagatttttttttcgtatcgttatatatatttttagatggaagattgggggtttgggaggggggagaagtg

SEQ ID NO: 32570 - DNA, 700 bp, Artificial Sequence
  chemically treated genomic DNA (Homo sapiens) CpG-island No: 32570
cacttctcccccctcccaaacccccaatcttccatctaaaaatatatataacgatacgaaaaaaaaatctaaaacaaaaacgtacctcgcacacgcgcgtaaacacgcgcgcacacacatacacacgcatacatatctcctaacgtaataatctccgtaaccgaaataaaaacgtaaaactccgaaaaaactccgcaaaaaaacaacgaacgcgaaaaaatcccgaaatccgaattcacccatccatcctctatcccctaccgcgtacccgcgcgccgccgaccgcccgcctaccgaacccaatcgcccccctttcactttcgcgtctacgtaaatatctacccgaacgaacacgaaaacgcgaaaacgcgccaaaaaacgcgaaaacgcgcgacgcgccgcgaacgaaaaaaaaaaaatcccgactctcgaccccttcctcgacttaccccgccgaaccgcctccgcgaacgtctaaaccgccgtcaaaacgaaaaaaccgatcgcgaccgcaacgccccaaccaactccccgcacgcctccgcgcacaaacgcccgctccctcctcgacgcccccccacgacgaaaataaaacaaaaacgcgacgaacccgaaaaaaacgaaaaaaaaaacaacctaacgaaataaacaaccgaaaaacaaaaaaaaaaaacttttccctcccgccccccgcgcgaaa

SEQ ID NO: 32571 - DNA, 700 bp, Artificial Sequence
  chemically treated genomic DNA (Homo sapiens) CpG-island No: 32571
tatttttttttttttttaaatttttaattttttatttaagggtgtgtgtaacggtgcgggggaagagtttggggtagaagcgtatttcgtatacgcgcgtgaatacgcgcgtatatatatgtatacgtatatatattttttgacgtggtgattttcgtggtcggggtgggggcgtgggatttcggggaggtttcgtagaggggtagcgggcgcgggagaatttcgggattcgggtttatttatttattttttgttttttgtcgcgtgttcgcgcgtcgtcggtcgttcgtttgtcgggtttagtcgttttttttttattttcgcgtttgcgtaggtgtttgttcgagcgggtacgagggcgcgggggcgcgttaggagacgcgggggcgcgcggcgcgtcgcgagcggaggaggaggggtttcggttttcggtttttttttcggtttgtttcgtcgagtcgttttcgcgggcgtttgagtcgtcgttagagcgaggggatcggtcgcgatcgtagcgttttagttagtttttcgtacgttttcgcgtatagacgttcgtttttttttcggcgtttttttacggcgggggtggggtagaggcgcggcgagttcgagaggggcggggagaggagtagtttggcggggtgggtagtcgaggagtaggaaaagaaaatttttttttttcgtttttcgcgcgagg

SEQ ID NO: 32572 - DNA, 700 bp, Artificial Sequence
  chemically treated genomic DNA (Homo sapiens) CpG-island No: 32572
cctcgcgcgaaaaacgaaaaaaaaaaattttcttttcctactcctcgactacccaccccgccaaactactcctctccccgcccctctcgaactcgccgcgcctctaccccacccccgccgtaaaaaaacgccgaaaaaaaaacgaacgtctatacgcgaaaacgtacgaaaaactaactaaaacgctacgatcgcgaccgatcccctcgctctaacgacgactcaaacgcccgcgaaaacgactcgacgaaacaaaccgaaaaaaaaaccgaaaaccgaaacccctcctcctccgctcgcgacgcgccgcgcgcccccgcgtctcctaacgcgcccccgcgccctcgtacccgctcgaacaaacacctacgcaaacgcgaaaataaaaaaaaaacgactaaacccgacaaacgaacgaccgacgacgcgcgaacacgcgacaaaaaacaaaaaataaataaataaacccgaatcccgaaattctcccgcgcccgctacccctctacgaaacctccccgaaatcccacgcccccaccccgaccacgaaaatcaccacgtcaaaaaatatatatacgtatacatatatatacgcgcgtattcacgcgcgtatacgaaatacgcttctaccccaaactcttcccccgcaccgttacacacacccttaaataaaaaattaaaaatttaaaaaaaaaaaaaaata

SEQ ID NO: 32573 - DNA, 1057 bp, Artificial Sequence
  chemically treated genomic DNA (Homo sapiens) CpG-island No: 32573
agagtttcgggacgggtttcgtgggttaggtgttgtttttgagagatgagtaaggatcggttcgggacgttggggaatggagggtaaaggttttggggttagacgaagtcgtttttgcgaaaggggcgttttttttcgtcgtggaagggatttttatttcggggaacgtcgtgcgagtgggatattggcgcgtacggttagggcgcggtttcgttaaggttgagaaggtttttgaggtagggcgtttcggacggggattttcggtttttagttttttcggcgagaggatttcggagtcgcgtatgttttggtcgaggtcgagcggtattggaaggtcggaggatttcgggtagttagtttcgggtttttcgggagttttaatttggagcgttcggtcggggtttttcgcgttcgtgtttcggcgtcggaggtcgtcgggttttttatttgttttgtttatttttagcgcgcggggttcgggtcgtcgtcggcgttttagttcgttcgcgggttttagtgcgatttcgtatatcgttttttttcgcggtcgtttcgcggggttcgtattttttggcgttcgttcggtttcggcgcgtttcggatttcgcgcggcgcgtagggtagtgggggcgcgggtcgcgagttttcggggcggggtcgtcgggcgggggcgcggggcgggggaggaggagggggcgcgagcgcgggggcggcggttggggtagcgtcgggcgtcgcgttcgttttcggtttcgggcgcgttgcgttttggtcgtcgtgttttcgtttgcgtttttgtttgcgtcgtagtcgcgtttttatttttttttagatatttttttcgttttcgaagaggaaggattttttttttttttgttcggttagagatttagggaggcgagggtcggggcgtttttgcgtatatttaaaggggtcgtggttatgggtatcgcgggaggcgttgggggttcgaaggacgagaatttagcgagttgggtttttggggtgtttttggttttttcgtttagcggattatttatttttttatttttaattt

SEQ ID NO: 32574 - DNA, 1057 bp, Artificial Sequence
  chemically treated genomic DNA (Homo sapiens) CpG-island No: 32574
aaattaaaaataaaaaaataaataatccgctaaacgaaaaaaccaaaaacaccccaaaaacccaactcgctaaattctcgtccttcgaacccccaacgcctcccgcgatacccataaccacgacccctttaaatatacgcaaaaacgccccgaccctcgcctccctaaatctctaaccgaacaaaaaaaaaaaaaatccttcctcttcgaaaacgaaaaaaatatctaaaaaaaaataaaaacgcgactacgacgcaaacaaaaacgcaaacgaaaacacgacgaccaaaacgcaacgcgcccgaaaccgaaaacgaacgcgacgcccgacgctaccccaaccgccgcccccgcgctcgcgccccctcctcctcccccgccccgcgcccccgcccgacgaccccgccccgaaaactcgcgacccgcgcccccactaccctacgcgccgcgcgaaatccgaaacgcgccgaaaccgaacgaacgccaaaaaatacgaaccccgcgaaacgaccgcgaaaaaaaacgatatacgaaatcgcactaaaacccgcgaacgaactaaaacgccgacgacgacccgaaccccgcgcgctaaaaataaacaaaacaaataaaaaacccgacgacctccgacgccgaaacacgaacgcgaaaaaccccgaccgaacgctccaaattaaaactcccgaaaaacccgaaactaactacccgaaatcctccgaccttccaataccgctcgacctcgaccaaaacatacgcgactccgaaatcctctcgccgaaaaaactaaaaaccgaaaatccccgtccgaaacgccctacctcaaaaaccttctcaaccttaacgaaaccgcgccctaaccgtacgcgccaatatcccactcgcacgacgttccccgaaataaaaatcccttccacgacgaaaaaaaacgcccctttcgcaaaaacgacttcgtctaaccccaaaacctttaccctccattccccaacgtcccgaaccgatccttactcatctctcaaaaacaacacctaacccacgaaacccgtcccgaaactct

SEQ ID NO: 32575 - DNA, 1057 bp, Artificial Sequence
  chemically treated genomic DNA (Homo sapiens) CpG-island No: 32575
gagttaaaaataaagggatagatggttcgttgggcgaaggagttaggaatattttagaaatttaattcgttgagttttcgtttttcgaatttttagcgtttttcgcggtgtttatggttacggtttttttaaatgtgcgtagggacgtttcggttttcgtttttttgaatttttgatcgagtaggggaaaaaaaaatttttttttttcgggagcggaggaaatgtttaggagggggtggaggcgcggttgcggcgtaggtagaggcgtaggcggaggtacggcggttagagcgtagcgcgttcggagtcgggagcggacgcgacgttcggcgttgttttagtcgtcgttttcgcgttcgcgttttttttttttttttcgtttcgcgttttcgttcggcggtttcgtttcggaggttcgcggttcgcgtttttattgttttgcgcgtcgcgcggagttcgaggcgcgtcggggtcgggcgggcgttagggggtgcgggtttcgcggggcggtcgcggagggaggcggtgtgcggagtcgtattgggattcgcggacggattgaaacgtcgacggcggttcgggtttcgcgcgttgaagatgaatagagtaggtaggaggttcggcgattttcggcgtcgaggtacgagcgcgagggatttcggtcgggcgttttaagttggagttttcggggagttcggggttagttgttcgaaatttttcgattttttagtgtcgttcggtttcggttaaagtatgcgcggtttcggggttttttcgtcgaggaggttgagaatcgggggttttcgttcgaagcgttttgttttagggatttttttagttttggcgaggtcgcgttttggtcgtgcgcgttagtattttattcgtacggcgtttttcggagtgagggttttttttacgacgaagaaagacgtttttttcgtaaaagcgatttcgtttggttttaaaatttttgttttttattttttagcgtttcggatcggtttttgtttattttttaggggtaatatttgatttacggggttcgtttcggagtttt

SEQ ID NO: 32576 - DNA, 1057 bp, Artificial Sequence
  chemically treated genomic DNA (Homo sapiens) CpG-island No: 32576
aaaactccgaaacgaaccccgtaaatcaaatattacccctaaaaaataaacaaaaaccgatccgaaacgctaaaaaataaaaaacaaaaattttaaaaccaaacgaaatcgcttttacgaaaaaaacgtctttcttcgtcgtaaaaaaaaccctcactccgaaaaacgccgtacgaataaaatactaacgcgcacgaccaaaacgcgacctcgccaaaactaaaaaaatccctaaaacaaaacgcttcgaacgaaaacccccgattctcaacctcctcgacgaaaaaaccccgaaaccgcgcatactttaaccgaaaccgaacgacactaaaaaatcgaaaaatttcgaacaactaaccccgaactccccgaaaactccaacttaaaacgcccgaccgaaatccctcgcgctcgtacctcgacgccgaaaatcgccgaacctcctacctactctattcatcttcaacgcgcgaaacccgaaccgccgtcgacgtttcaatccgtccgcgaatcccaatacgactccgcacaccgcctccctccgcgaccgccccgcgaaacccgcaccccctaacgcccgcccgaccccgacgcgcctcgaactccgcgcgacgcgcaaaacaataaaaacgcgaaccgcgaacctccgaaacgaaaccgccgaacgaaaacgcgaaacgaaaaaaaaaaaaaaaacgcgaacgcgaaaacgacgactaaaacaacgccgaacgtcgcgtccgctcccgactccgaacgcgctacgctctaaccgccgtacctccgcctacgcctctacctacgccgcaaccgcgcctccaccccctcctaaacatttcctccgctcccgaaaaaaaaaaatttttttttcccctactcgatcaaaaattcaaaaaaacgaaaaccgaaacgtccctacgcacatttaaaaaaaccgtaaccataaacaccgcgaaaaacgctaaaaattcgaaaaacgaaaactcaacgaattaaatttctaaaatattcctaactccttcgcccaacgaaccatctatccctttatttttaactc

SEQ ID NO: 32577 - DNA, 655 bp, Artificial Sequence
  chemically treated genomic DNA (Homo sapiens) CpG-island No: 32577
gacgttttgggttgggcggtttttaggttcgcgtcgtcgggcggggtttcggcggcggcgcgcgcgtgcgcggttgggggcgcggttttgcgggttgcgcgagttggaggtgcgcgtgagcgagttgggtttgggttacgcgttcgacgagacggtgttgtttcgttattgcgtaggcgtttgcgaggttgtcgcgcgcgtttacgatttcgggttgcgacgattgcgttagcggcggcgtttgcggcgggagcgggtgcgcgcgtagttttgttgtcgttcgacggtttacgaggacgaggtgttttttttggacgcgtatagtcgttattatacggtgtacgagttgtcggcgcgcgagtgcgtttgcgtgtgattttattttattcggtcggcgcggcggttatttttttcgtttcgacggtattattggtcggtttcgcgaaagattgcgcgtgcgtagagtacgtcggcgcggtttcgggattttcgcgataattgtattgagataaagtgtggtaattcgagttggttggtgatttattttcggcgaggggttcgcgtgtgggttacgtcgtcgtttttatcgggaaagcggggattagtggggggggtttagttgtagggtagtgggaggatgttgtttgttttgggg

SEQ ID NO: 32578 - DNA, 655 bp, Artificial Sequence
  chemically treated genomic DNA (Homo sapiens) CpG-island No: 32578
ccccaaaacaaacaacatcctcccactaccctacaactaaaccccccccactaatccccgctttcccgataaaaacgacgacgtaacccacacgcgaacccctcgccgaaaataaatcaccaaccaactcgaattaccacactttatctcaatacaattatcgcgaaaatcccgaaaccgcgccgacgtactctacgcacgcgcaatctttcgcgaaaccgaccaataataccgtcgaaacgaaaaaaataaccgccgcgccgaccgaataaaataaaatcacacgcaaacgcactcgcgcgccgacaactcgtacaccgtataataacgactatacgcgtccaaaaaaaacacctcgtcctcgtaaaccgtcgaacgacaacaaaactacgcgcgcacccgctcccgccgcaaacgccgccgctaacgcaatcgtcgcaacccgaaatcgtaaacgcgcgcgacaacctcgcaaacgcctacgcaataacgaaacaacaccgtctcgtcgaacgcgtaacccaaacccaactcgctcacgcgcacctccaactcgcgcaacccgcaaaaccgcgcccccaaccgcgcacgcgcgcgccgccgccgaaaccccgcccgacgacgcgaacctaaaaaccgcccaacccaaaacgtc

SEQ ID NO: 32579 - DNA, 655 bp, Artificial Sequence
  chemically treated genomic DNA (Homo sapiens) CpG-island No: 32579
ttttaaagtaaatagtatttttttattattttgtagttgggttttttttattggttttcgttttttcggtggagacggcgacgtggtttatacgcgagtttttcgtcgaggatgaattattagttagttcgagttgttatattttattttagtatagttatcgcgagagtttcggggtcgcgtcggcgtgttttacgtacgcgtagtttttcgcggggtcggttagtggtgtcgtcgaggcggggggagtggtcgtcgcgtcggtcgagtgaggtagggttatacgtaggcgtattcgcgcgtcgatagttcgtgtatcgtgtggtagcggttgtgcgcgtttaggaaggatatttcgttttcgtaggtcgtcgggcggtagtagggttgcgcgcgtattcgttttcgtcgtaggcgtcgtcgttggcgtagtcgtcgtagttcgaggtcgtagacgcgcgcggtagtttcgtaggcgtttgcgtagtagcggaatagtatcgtttcgtcggacgcgtagtttaggtttagttcgtttacgcgtatttttagttcgcgtagttcgtaaggtcgcgtttttaatcgcgtacgcgcgcgtcgtcgtcggggtttcgttcgacggcgcggatttgggggtcgtttagtttagggcgtt

SEQ ID NO: 32580 - DNA, 655 bp, Artificial Sequence
  chemically treated genomic DNA (Homo sapiens) CpG-island No: 32580
aacgccctaaactaaacgacccccaaatccgcgccgtcgaacgaaaccccgacgacgacgcgcgcgtacgcgattaaaaacgcgaccttacgaactacgcgaactaaaaatacgcgtaaacgaactaaacctaaactacgcgtccgacgaaacgatactattccgctactacgcaaacgcctacgaaactaccgcgcgcgtctacgacctcgaactacgacgactacgccaacgacgacgcctacgacgaaaacgaatacgcgcgcaaccctactaccgcccgacgacctacgaaaacgaaatatccttcctaaacgcgcacaaccgctaccacacgatacacgaactatcgacgcgcgaatacgcctacgtataaccctacctcactcgaccgacgcgacgaccactccccccgcctcgacgacaccactaaccgaccccgcgaaaaactacgcgtacgtaaaacacgccgacgcgaccccgaaactctcgcgataactatactaaaataaaatataacaactcgaactaactaataattcatcctcgacgaaaaactcgcgtataaaccacgtcgccgtctccaccgaaaaaacgaaaaccaataaaaaaaacccaactacaaaataataaaaaaatactatttactttaaaa

SEQ ID NO: 32581 - DNA, 715 bp, Artificial Sequence
  chemically treated genomic DNA (Homo sapiens) CpG-island No: 32581
gagtcgttgttcggttgcgataggtttagcgtttcggttaggtagtttattgagttagcggtaaatatttcggagtaggaatcgtaggtcggatacgcggaacgtttaatttgatcgttttgggagttagatattttcgggtttgcgttttggattatcgtattaattagatcgagtttgatgatttgatcggaaagtttggttttttcggtttttatcgggtcgtcggaaataaagattatcggaatatttaggcgtagggaagttattagtattttcggggtgattttgtcgtagttagagatgtagattatggcgtcggcgtagtgggcgttgattatatatttaacggaattagcgattagttcgcgagatggtagtgaataaagtattttttcgtggtttatggtaattttattatttatcgtaatggtgttgaattttttggtaacgtcgttagtcgttttaatttgttcggcgattagtttatcgagatcgcgtagatggacgtgattcggtataaattgggtgaacgagtttataatcgcgataatcggtttatcgaaatcggcgtcggttatttcggtggcgcgttatagcgtacgagtattcgttatattacgattatgagtggtggtggcggaacggtatttaggtatattttatttatttttagtgtttgtttcgtaaatgggacggtgcgtgtcgttttatt

SEQ ID NO: 32582 - DNA, 715 bp, Artificial Sequence
  chemically treated genomic DNA (Homo sapiens) CpG-island No: 32582
aataaaacgacacgcaccgtcccatttacgaaacaaacactaaaaataaataaaatatacctaaataccgttccgccaccaccactcataatcgtaatataacgaatactcgtacgctataacgcgccaccgaaataaccgacgccgatttcgataaaccgattatcgcgattataaactcgttcacccaatttataccgaatcacgtccatctacgcgatctcgataaactaatcgccgaacaaattaaaacgactaacgacgttaccaaaaaattcaacaccattacgataaataataaaattaccataaaccacgaaaaaatactttattcactaccatctcgcgaactaatcgctaattccgttaaatatataatcaacgcccactacgccgacgccataatctacatctctaactacgacaaaatcaccccgaaaatactaataacttccctacgcctaaatattccgataatctttatttccgacgacccgataaaaaccgaaaaaaccaaactttccgatcaaatcatcaaactcgatctaattaatacgataatccaaaacgcaaacccgaaaatatctaactcccaaaacgatcaaattaaacgttccgcgtatccgacctacgattcctactccgaaatatttaccgctaactcaataaactacctaaccgaaacgctaaacctatcgcaaccgaacaacgactc

SEQ ID NO: 32583 - DNA, 715 bp, Artificial Sequence
  chemically treated genomic DNA (Homo sapiens) CpG-island No: 32583
aatgggacggtacgtatcgttttatttacgagatagatattgggagtaaataaagtatgtttaagtatcgtttcgttattattatttatggtcgtaatatggcgggtgttcgtgcgttgtggcgcgttatcggaatgatcgacgtcgatttcggtaagtcgattatcgcggttgtgaattcgtttatttaatttgtatcgggttacgtttatttgcgcgatttcggtaaattggtcgtcgaataaattgaagcggttggcggcgttgttaaagagtttaatattattgcggtggatgatgggattgttatgggttacggggggatgttttatttattgttatttcgcgaattgatcgttgatttcgttgagtatatggttaacgtttattgcgtcgacgttatggtttgtatttttaattgcgataaaattatttcggggatgttgatggtttttttgcgtttgaatatttcggtgatttttgttttcggcggttcgatggaggtcgggaaaattaaatttttcgattagattattaagttcgatttggttgatgcgatgatttagggcgtagattcgaaagtatttgatttttagagcgattaggttgaacgtttcgcgtgttcgatttgcggtttttgtttcgggatgtttatcgttaatttaatgaattgtttgatcgaagcgttgggtttgtcgtagtcgggtaacggttt

SEQ ID NO: 32584 - DNA, 715 bp, Artificial Sequence
  chemically treated genomic DNA (Homo sapiens) CpG-island No: 32584
aaaccgttacccgactacgacaaacccaacgcttcgatcaaacaattcattaaattaacgataaacatcccgaaacaaaaaccgcaaatcgaacacgcgaaacgttcaacctaatcgctctaaaaatcaaatactttcgaatctacgccctaaatcatcgcatcaaccaaatcgaacttaataatctaatcgaaaaatttaattttcccgacctccatcgaaccgccgaaaacaaaaatcaccgaaatattcaaacgcaaaaaaaccatcaacatccccgaaataattttatcgcaattaaaaatacaaaccataacgtcgacgcaataaacgttaaccatatactcaacgaaatcaacgatcaattcgcgaaataacaataaataaaacatccccccgtaacccataacaatcccatcatccaccgcaataatattaaactctttaacaacgccgccaaccgcttcaatttattcgacgaccaatttaccgaaatcgcgcaaataaacgtaacccgatacaaattaaataaacgaattcacaaccgcgataatcgacttaccgaaatcgacgtcgatcattccgataacgcgccacaacgcacgaacacccgccatattacgaccataaataataataacgaaacgatacttaaacatactttatttactcccaatatctatctcgtaaataaaacgatacgtaccgtcccatt

SEQ ID NO: 32585 - DNA, 562 bp, Artificial Sequence
  chemically treated genomic DNA (Homo sapiens) CpG-island No: 32585
gggaacgcgtagcgcgaggtttcgggttcgttaagttttcggtatgtagcgcggcgatttcggcgagtattttggcgcgcggagttggtattttggcgttgttggtggcggcggagatagttgtgaagtgtgaggttttttgtttgttggtagttaggggcgacgaggcgggacgttatggaagtgtaagttttttcgggcgcgttttttttcggtcgaggagtttaacggtttgatcgttgagagttgagagtcgagagtcgtggggattgggcgattttcgtacgggagtgagggtagcgggtcggttttgttcgggagggtcgcggggtggtgacggggacgaacgggattttcgttttgttttttcgaattttcgttttttttttacgtcgtgtttggtgcggggtcgagtattttcgtgttcggttgttttttaatgtgtttttttttttttttattcgtttattagcgtttttgggttatagtgcgggggtggagtttagtttggtattcgatttcggatttagaaggttataaaggtttgagtttgttcgttttg

SEQ ID NO: 32586 - DNA, 562 bp, Artificial Sequence
  chemically treated genomic DNA (Homo sapiens) CpG-island No: 32586
caaaacgaacaaactcaaacctttataaccttctaaatccgaaatcgaataccaaactaaactccacccccgcactataacccaaaaacgctaataaacgaataaaaaaaaaaaaaaacacattaaaaaacaaccgaacacgaaaatactcgaccccgcaccaaacacgacgtaaaaaaaaaacgaaaattcgaaaaaacaaaacgaaaatcccgttcgtccccgtcaccaccccgcgaccctcccgaacaaaaccgacccgctaccctcactcccgtacgaaaatcgcccaatccccacgactctcgactctcaactctcaacgatcaaaccgttaaactcctcgaccgaaaaaaaacgcgcccgaaaaaacttacacttccataacgtcccgcctcgtcgcccctaactaccaacaaacaaaaaacctcacacttcacaactatctccgccgccaccaacaacgccaaaataccaactccgcgcgccaaaatactcgccgaaatcgccgcgctacataccgaaaacttaacgaacccgaaacctcgcgctacgcgttccc

SEQ ID NO: 32587 - DNA, 562 bp, Artificial Sequence
  chemically treated genomic DNA (Homo sapiens) CpG-island No: 32587
tagggcggatagatttaggtttttatagttttttaagttcggggtcggatattagattgggttttattttcgtattgtgatttagaaacgttggtaaacgaatgagagaaggagggggtatattgaaaggtagtcggatacggaagtgttcggtttcgtattagatacggcgtggaggggaagcgaaggttcggaagggtaaagcgagagtttcgttcgttttcgttattatttcgcggttttttcggatagggtcggttcgttgtttttattttcgtacgagggtcgtttagtttttacggttttcggtttttagtttttagcggttaaatcgttgggtttttcggtcgaaaagggacgcgttcgagaagatttatatttttatgacgtttcgtttcgtcgtttttagttgttagtagataaagaattttatattttatagttgttttcgtcgttattaatagcgttaaggtgttagtttcgcgcgttaaggtgttcgtcgggatcgtcgcgttgtatgtcgggagtttggcggattcggaatttcgcgttgcgcgttttt

SEQ ID NO: 32588 - DNA, 562 bp, Artificial Sequence
  chemically treated genomic DNA (Homo sapiens) CpG-island No: 32588
aaaaacgcgcaacgcgaaattccgaatccgccaaactcccgacatacaacgcgacgatcccgacgaacaccttaacgcgcgaaactaacaccttaacgctattaataacgacgaaaacaactataaaatataaaattctttatctactaacaactaaaaacgacgaaacgaaacgtcataaaaatataaatcttctcgaacgcgtcccttttcgaccgaaaaacccaacgatttaaccgctaaaaactaaaaaccgaaaaccgtaaaaactaaacgaccctcgtacgaaaataaaaacaacgaaccgaccctatccgaaaaaaccgcgaaataataacgaaaacgaacgaaactctcgctttacccttccgaaccttcgcttcccctccacgccgtatctaatacgaaaccgaacacttccgtatccgactacctttcaatataccccctccttctctcattcgtttaccaacgtttctaaatcacaatacgaaaataaaacccaatctaatatccgaccccgaacttaaaaaactataaaaacctaaatctatccgcccta

SEQ ID NO: 32589 - DNA, 958 bp, Artificial Sequence
  chemically treated genomic DNA (Homo sapiens) CpG-island No: 32589
cgtataacgggtaggatgatggggcgatgagtttaagaagcgtagtcggggtagacgtgggggtaaatgttcgatttcggcgagacgagggttttattttaggggattgcggggttaggacgtggttttagggttgcgagaagggagagaaagggtagaggggagaggtttcggcggtcggggcgaagtcgagttcgggaaatgtcggcgatgggggaaggggcgtgggagtaggggtcggacgggttagattcggggtttcgcgttcgggggcggggttggataatcgggaggtatcgagtagaaggcgataaggggttaagggatgttaggacggggtatagggtcgggtgtgaggagacgagaggggagcggagtcgtagcgagcgtcgcgttttttttatttgggatgagtgaggagtcgtcgcgtcgtttggacggtattttggttttagtcgttggttttatcgttttcggtggggggttattcgggagttcgtttttatcgttaagcgtcggtagttgttagtttggatcggtttcgtagagtagcgtcgtttcgattcgtaatcgaagtcgttttagtagcgtttttcgcggtcgttaatttagcgataatcgttagggttcggggaggtggcgggattatatatttgttacgattggttgagcggacgatgtgtcggttgttttgattcgtgagtttcggtcggttgtttatcgaaggaggcgcggttgggaatggagttgggttcggtaggcgtcgaggggcgggggtttgacgtcgtagtcggttagcgtttttatagtttttttcgtgcgcgttttcgagggggtttttcggtagtcgtaggtttggtcgggtggttgttttagtaatagcgcgcgtggtttggttgtaggggagtcgcgggtaggtggcggtttttatcgtttttatttttaacgtgggtgtttt

SEQ ID NO: 32590 - DNA, 958 bp, Artificial Sequence
  chemically treated genomic DNA (Homo sapiens) CpG-island No: 32590
aaaacacccacgttaaaaataaaaacgataaaaaccgccacctacccgcgactcccctacaaccaaaccacgcgcgctattactaaaacaaccacccgaccaaacctacgactaccgaaaaaccccctcgaaaacgcgcacgaaaaaaactataaaaacgctaaccgactacgacgtcaaacccccgcccctcgacgcctaccgaacccaactccattcccaaccgcgcctccttcgataaacaaccgaccgaaactcacgaatcaaaacaaccgacacatcgtccgctcaaccaatcgtaacaaatatataatcccgccacctccccgaaccctaacgattatcgctaaattaacgaccgcgaaaaacgctactaaaacgacttcgattacgaatcgaaacgacgctactctacgaaaccgatccaaactaacaactaccgacgcttaacgataaaaacgaactcccgaataaccccccaccgaaaacgataaaaccaacgactaaaaccaaaataccgtccaaacgacgcgacgactcctcactcatcccaaataaaaaaaacgcgacgctcgctacgactccgctcccctctcgtctcctcacacccgaccctataccccgtcctaacatcccttaaccccttatcgccttctactcgatacctcccgattatccaaccccgcccccgaacgcgaaaccccgaatctaacccgtccgacccctactcccacgccccttcccccatcgccgacatttcccgaactcgacttcgccccgaccgcagaaaccuctcccctctaccctttctctcccttctcgcaaccctaaaaccacgtcctaaccccgcaatcccctaaaataaaaccctcgtctcgccgaaatcgaacatttacccccacgtctaccccgactacgcttcttaaactcatcgccccatcatcctacccgttatacg

SEQ ID NO: 32591 - DNA, 958 bp, Artificial Sequence
  chemically treated genomic DNA (Homo sapiens) CpG-island No: 32591
gggatatttacgttgggggtgggggcggtgaggatcgttatttgttcgcggtttttttgtagttaggttacgcgcgttgttgttagggtaattattcggttaggtttgcggttgtcgggaagttttttcgggagcgcgtacgggaagggttgtgggggcgttggtcggttgcgacgttagattttcgtttttcggcgtttgtcggatttagttttatttttagtcgcgtttttttcggtgggtagtcggtcggaatttacgaattagagtagtcgatatatcgttcgtttagttaatcgtagtagatgtgtgatttcgttattttttcggattttggcggttgtcgttgagttggcgatcgcgggagacgttgttgaggcggtttcggttgcgggtcggaacggcgttgttttgcggggtcggtttaggttggtagttgtcggcgtttggcggtgagggcgggttttcgagtggttttttatcgaaggcggtgggattagcggttgaggttaggatgtcgtttaggcggcgcggcggttttttatttattttaggtaagggggacgcggcgttcgttgcggtttcgtttttttttcgtttttttatattcggttttgtgtttcgttttggtattttttggttttttgtcgttttttgttcggtgtttttcggttgtttaatttcgttttcgagcgcggagtttcgggtttggttcgttcggtttttgtttttacgtttttttttttatcgtcggtatttttcgggttcggtttcgtttcggtcgtcggggttttttttttttgtttttttttttttttttcgtagttttgggattacgttttagtttcgtagttttttgggatgagattttcgtttcgtcgggatcggatatttgtttttacgtttatttcggttgcgttttttgagtttatcgttttattattttattcgttgtacg

SEQ ID NO: 32592 - DNA, 958 bp, Artificial Sequence
  chemically treated genomic DNA (Homo sapiens) CpG-island No: 32592
cgtacaacgaataaaataataaaacgataaactcaaaaaacgcaaccgaaataaacgtaaaaacaaatatccgatcccgacgaaacgaaaatctcatcccaaaaaactacgaaactaaaacgtaatcccaaaactacgaaaaaaaaaaaaaaaaacaaaaaaaaaaaaccccgacgaccgaaacgaaaccgaacccgaaaaataccgacgataaaaaaaaaaacgtaaaaacaaaaaccgaacgaaccaaacccgaaactccgcgctcgaaaacgaaattaaacaaccgaaaaacaccgaacaaaaaacgacaaaaaaccaaaaaataccaaaacgaaacacaaaaccgaatataaaaaaacgaaaaaaaaacgaaaccgcaacgaacgccgcgtcccccttacctaaaataaataaaaaaccgccgcgccgcctaaacgacatcctaacctcaaccgctaatcccaccgccttcgataaaaaaccactcgaaaacccgccctcaccgccaaacgccgacaactaccaacctaaaccgaccccgcaaaacaacgccgttccgacccgcaaccgaaaccgcctcaacaacgtctcccgcgatcgccaactcaacgacaaccgccaaaatccgaaaaaataacgaaatcacacatctactacgattaactaaacgaacgatatatcgactactctaattcgtaaattccgaccgactacccaccgaaaaaaacgcgactaaaaataaaactaaatccgacaaacgccgaaaaacgaaaatctaacgtcgcaaccgaccaacgcccccacaacccttcccgtacgcgctcccgaaaaaacttcccgacaaccgcaaacctaaccgaataattaccctaacaacaacgcgcgtaacctaactacaaaaaaaccgcgaacaaataacgatcctcaccgcccccacccccaacgtaaatatccc

SEQ ID NO: 32593 - DNA, 805 bp, Artificial Sequence
  chemically treated genomic DNA (Homo sapiens) CpG-island No: 32593
tgcgtgggcgggtatattttattttcgcgcgttttttatattcgtttagggtttcggagttagggtttttttgtttggcgtgggacggtttaaggggtttggaaatgtggtcgggatttttatagcggttttttcggtgcgcgtttttcgttcggtttttttagcgtttagtgtgtttcgagggcgagtagttacgcgtggtcgggattaagcgagtatttaggggttagaatggggcgtttagtattcgttacgtggatagagttagtttcgcgtagcgttgtcgggcggtaggaggcggggggggagggcgcggtttttagttcgtttagtgtatttgtcgcgtagatttcgttataggaggtttcgagatcggattttgtcgttcgtttttgtcgtgatcgcgcggtagttttaggagttcgcgaggtttttggttcggtttaagtttggttgcgtgtttcgttgcgtggaggacgttttcgagagtaagacgttgtcgttggacgttttgggcggcggtcgttcgggttttcgggttgggaggcgagtttgcgcggcgcgcggagattttttaacggtcgtagtaagttttcgagggtagttcggcgtggtttaggttcgggatttttagtaggtagtggtcgcgggatagaggtcgtgggttcgggttcggatttttcgagattttcgtattcggaggacgtcgggcgtggggttttttcgtttttttttgcggggttttttttattcgtaaaggttttgagttttttgggttttgcgattattttttattttcgcgagg

SEQ ID NO: 32594 - DNA, 805 bp, Artificial Sequence
  chemically treated genomic DNA (Homo sapiens) CpG-island No: 32594
cctcgcgaaaataaaaaataatcgcaaaacccaaaaaactcaaaacctttacgaataaaaaaaaccccgcaaaaaaaaacgaaaaaaccccacgcccgacgtcctccgaatacgaaaatctcgaaaaatccgaacccgaacccacgacctctatcccgcgaccactacctactaaaaatcccgaacctaaaccacgccgaactaccctcgaaaacttactacgaccgttaaaaaatctccgcgcgccgcgcaaactcgcctcccaacccgaaaacccgaacgaccgccgcccaaaacgtccaacgacaacgtcttactctcgaaaacgtcctccacgcaacgaaacacgcaaccaaacttaaaccgaaccaaaaacctcgcgaactcctaaaactaccgcgcgatcacgacaaaaacgaacgacaaaatccgatctcgaaacctcctataacgaaatctacgcgacaaatacactaaacgaactaaaaaccgcgccctccccccccgcctcctaccgcccgacaacgctacgcgaaactaactctatccacgtaacgaatactaaacgccccattctaacccctaaatactcgcttaatcccgaccacgcgtaactactcgccctcgaaacacactaaacgctaaaaaaaccgaacgaaaaacgcgcaccgaaaaaaccgctataaaaatcccgaccacatttccaaaccccttaaaccgtcccacgccaaacaaaaaaaccctaactccgaaaccctaaacgaatataaaaaacgcgcgaaaataaaatatacccgcccacgca

SEQ ID NO: 32595 - DNA, 805 bp, Artificial Sequence
  chemically treated genomic DNA (Homo sapiens) CpG-island No: 32595
tttcgcgggggtggggggtggtcgtaggatttagaaggtttaggatttttacggatagggaggatttcgtaggggggagcgggggagttttacgttcggcgtttttcgggtgcgagggtttcggggagttcgagttcgggtttacggtttttgtttcgcggttattatttgttgggggtttcgggtttgggttacgtcgggttgttttcggggatttgttgcggtcgttgaggggttttcgcgcgtcgcgtagattcgttttttaattcgagggttcgggcggtcgtcgtttagagcgtttagcggtagcgttttgttttcgaaggcgttttttacgtagcggaatacgtagttaagtttgggtcgggttagaggtttcgcgggtttttgaggttgtcgcgcggttacggtaggagcgggcgatagaattcggtttcggagttttttgtagcgaggtttgcgcggtaggtgtattgggcggattggaggtcgcgtttttttttttcgttttttgtcgttcggtagcgttgcgcggagttggttttgtttacgtagcgggtgttgaacgttttattttggtttttgggtgttcgtttagtttcggttacgcgtggttgttcgttttcgggatatattgggcgttgggaaggtcgggcggggagcgcgtatcggagaaatcgttgtgggaatttcggttatatttttaggttttttgggtcgttttacgttagataagaaagttttgatttcgaaattttgggcgagtgtggagggcgcgcgggggtggggtgtattcgtttacgta

SEQ ID NO: 32596 - DNA, 805 bp, Artificial Sequence
  chemically treated genomic DNA (Homo sapiens) CpG-island No: 32596
tacgtaaacgaatacaccccacccccgcgcgccctccacactcgcccaaaatttcgaaatcaaaactttcttatctaacgtaaaacgacccaaaaaacctaaaaatataaccgaaattcccacaacgatttctccgatacgcgctccccgcccgaccttcccaacgcccaatatatcccgaaaacgaacaaccacgcgtaaccgaaactaaacgaacacccaaaaaccaaaataaaacgttcaacacccgctacgtaaacaaaaccaactccgcgcaacgctaccgaacgacaaaaaacgaaaaaaaaaaacgcgacctccaatccgcccaatacacctaccgcgcaaacctcgctacaaaaaactccgaaaccgaattctatcgcccgctcctaccgtaaccgcgcgacaacctcaaaaacccgcgaaacctctaacccgacccaaacttaactacgtattccgctacgtaaaaaacgccttcgaaaacaaaacgctaccgctaaacgctctaaacgacgaccgcccgaaccctcgaattaaaaaacgaatctacgcgacgcgcgaaaacccctcaacgaccgcaacaaatccccgaaaacaacccgacgtaacccaaacccgaaacccccaacaaataataaccgcgaaacaaaaaccgtaaacccgaactcgaactccccgaaaccctcgcacccgaaaaacgccgaacgtaaaactcccccgctcccccctacgaaatcctccctatccgtaaaaatcctaaaccttctaaatcctacgaccaccccccacccccgcgaaa

SEQ ID NO: 32597 - DNA, 942 bp, Artificial Sequence
  chemically treated genomic DNA (Homo sapiens) CpG-island No: 32597
gtttattatcgcgtttcggtttttggggagcgcgtgcgtttttttttgtttttttttttttttttttttgttttattcgggttttttttgtttttcgtttttcgcggttagcgtggaatagtttcgcggggttatagtttggcgttcggattttggttcgggttatttgcgaaggagtcggttttggttaaggtgtttttttggacgggtgtggtttttagagcgtcgcggttcggggttgattggttcggaatttcggggttttgggcgtttcgcgttttttgggatttgggtttcgcgttggagggtagcgggggcgcgggcggggtttggtaggacgtggtcggattttttttttcgttttttcggggtgtaaatttcgcgtatattagttggagtaggttgaaatttttatttagcgttcgttcgcgggtttgcgcgggggttcggggtgtagagattagattttgtagcggttttagcgttgggggggttttaaagcgaaggagtggttgagggcgggggcggggttgatgggcggggtgaggcggggttcgggttggggcgggttttatcgggggcggggtttgtcgggggcggagtcggggtgggggcggggtttagcgggggcgggatcggaacggagtcgtgcggtttcgcgcgttcgtagtttgtttttcgtcgtttttacgtacgcgtttcggtttacgcgttttttcgttcgttcgttcgttcgttcgttttcgtttgtgtcgtttttattagagatttttaggagtaggatgtttttttagggtaagaaaagtatttttcggattacggtgagttcggtttcgtttcgttcggcgttttttgttcgtcgttcggagtggggtttggacgtcgggcggatttttttggttttgtgcgtgggtggggggtttttgtttttgcgtttggttt

SEQ ID NO: 32598 - DNA, 942 bp, Artificial Sequence
  chemically treated genomic DNA (Homo sapiens) CpG-island No: 32598
aaaccaaacgcaaaaacaaaaaccccccacccacgcacaaaaccaaaaaaatccgcccgacgtccaaaccccactccgaacgacgaacaaaaaacgccgaacgaaacgaaaccgaactcaccgtaatccgaaaaatacttttcttaccctaaaaaaacatcctactcctaaaaatctctaataaaaacgacacaaacgaaaacgaacgaacgaacgaacgaacgaaaaaacgcgtaaaccgaaacgcgtacgtaaaaacgacgaaaaacaaactacgaacgcgcgaaaccgcacgactccgttccgatcccgcccccgctaaaccccgcccccaccccgactccgcccccgacaaaccccgcccccgataaaacccgccccaacccgaaccccgcctcaccccgcccatcaaccccgcccccgccctcaaccactccttcgctttaaaacccccccaacgctaaaaccgctacaaaatctaatctctacaccccgaacccccgcgcaaacccgcgaacgaacgctaaataaaaatttcaacctactccaactaatatacgcgaaatttacaccccgaaaaaacgaaaaaaaaaatccgaccacgtcctaccaaaccccgcccgcgcccccgctaccctccaacgcgaaacccaaatcccaaaaaacgcgaaacgcccaaaaccccgaaattccgaaccaatcaaccccgaaccgcgacgctctaaaaaccacacccgtccaaaaaaacaccttaaccaaaaccgactccttcgcaaataacccgaaccaaaatccgaacgccaaactataaccccgcgaaactattccacgctaaccgcgaaaaacgaaaaacaaaaaaaacccgaataaaacaaaaaaaaaaaaaaaaaaaaacaaaaaaaaacgcacgcgctccccaaaaaccgaaacgcgataataaac

SEQ ID NO: 32599 - DNA, 942 bp, Artificial Sequence
  chemically treated genomic DNA (Homo sapiens) CpG-island No: 32599
ggattagacgtaaaggtagggattttttatttacgtataagattaggagggttcgttcggcgtttaggttttatttcgggcggcgggtagggggcgtcgggcgaagcgggatcgggtttatcgtgattcgggggatgttttttttgttttggaaggatattttgtttttgggggtttttggtaggggcggtataagcgggggcgggcgggcgggcgggcgggcggggggacgcgtgagtcgggacgcgtgcgtggggacggcgggagatagattgcgagcgcgcggggtcgtacggtttcgtttcggtttcgttttcgttgggtttcgtttttatttcggtttcgttttcggtaggtttcgttttcgatagggttcgttttagttcgagtttcgttttatttcgtttattagtttcgttttcgtttttagttattttttcgttttaaagtttttttagcgttggaatcgttgtagggtttgatttttgtatttcgggttttcgcgtagattcgcggacgagcgttgggtggggattttaatttgttttagttgatgtgcgcggggtttgtatttcggggaggcgagggagagagttcggttacgttttgttaggtttcgttcgcgttttcgttgttttttagcgcggaatttaggttttaggagacgcgaggcgtttaaggtttcgggatttcgagttagttaatttcgggtcgcgacgttttgggaattatattcgtttaggaaggtattttggttaaagtcggttttttcgtagatgattcgggttagggttcgagcgttaggttgtgatttcgcgaggttgttttacgttggtcgcgagagacggagggtaggaggggttcgaataggatagagagagagagagagagagatagaaggaggcgtacgcgttttttagggatcgggacgcggtggtgggt

SEQ ID NO: 32600 - DNA, 942 bp, Artificial Sequence
  chemically treated genomic DNA (Homo sapiens) CpG-island No: 32600
acccaccaccgcgtcccgatccctaaaaaacgcgtacgcctccttctatctctctctctctctctctctatcctattcgaacccctcctaccctccgtctctcgcgaccaacgtaaaacaacctcgcgaaatcacaacctaacgctcgaaccctaacccgaatcatctacgaaaaaaccgactttaaccaaaataccttcctaaacgaatataattcccaaaacgtcgcgacccgaaattaactaactcgaaatcccgaaaccttaaacgcctcgcgtctcctaaaacctaaattccgcgctaaaaaacaacgaaaacgcgaacgaaacctaacaaaacgtaaccgaactctctccctcgcctccccgaaatacaaaccccgcgcacatcaactaaaacaaattaaaatccccacccaacgctcgtccgcgaatctacgcgaaaacccgaaatacaaaaatcaaaccctacaacgattccaacgctaaaaaaactttaaaacgaaaaaataactaaaaacgaaaacgaaactaataaacgaaataaaacgaaactcgaactaaaacgaaccctatcgaaaacgaaacctaccgaaaacgaaaccgaaataaaaacgaaacccaacgaaaacgaaaccgaaacgaaaccgtacgaccccgcgcgctcgcaatctatctcccgccgtccccacgcacgcgtcccgactcacgcgtccccccgcccgcccgcccgcccgcccgcccccgcttataccgcccctaccaaaaacccccaaaaacaaaatatccttccaaaacaaaaaaaacatcccccgaatcacgataaacccgatcccgcttcgcccgacgccccctacccgccgcccgaaataaaacctaaacgccgaacgaaccctcctaatcttatacgtaaataaaaaatccctacctttacgtctaatcc

SEQ ID NO: 32601 - DNA, 795 bp, Artificial Sequence
  chemically treated genomic DNA (Homo sapiens) CpG-island No: 32601
cggcgcgtttttaattttggtgtttacgtcggttaggtagtttttgcggaattggtcgaagagtttttggtttttgaggtggtttacgattatggttacgagttgcgggttttcggcgttcgtattcgcgtcgttcgtttcgttcgcgtcggggttagtttcggggttcggcggcggcggcggtggttgtggttgcggttgcggcgggggaggcggcggcgttttaggaggcggttgcggttgtgggttggtggttatggtggtttgtgtcggggagggtaagggttttgatcggcggacgattttgggaggcggcggttgtattggtttcgtcgtttgagggaagttaacgggatgttgttacggaattagcggatttagagtaatttcggaagtgaaagggaattgggggaaaggaggaaaagacggtgataatattgacgaaagttcggcgacggaggtcgcgaagagttagtttcgatcgtcgtcgggcgtaagcgttttcgcgaggtcgagttgcgtcggaagtggcggcgattgtggcgacggagacgataagattgtgttggtcgcgggttgtggggtttaggttatcggtaggggtttggagtttttggaggttagggtttcgattcgcgcgatatttggggttttaggtttgagcgggggtagtgcgtttttggtttcgttttattcgcgacggtattttaggtttgttttttttgttttagtttttcggagtagtgtatagagatttatagatatttgtaatgcgaattttacgtggatttgttt

SEQ ID NO: 32602 - DNA, 795 bp, Artificial Sequence
  chemically treated genomic DNA (Homo sapiens) CpG-island No: 32602
aaacaaatccacgtaaaattcgcattacaaatatctataaatctctatacactactccgaaaaactaaaacaaaaaaaacaaacctaaaataccgtcgcgaataaaacgaaaccaaaaacgcactacccccgctcaaacctaaaaccccaaatatcgcgcgaatcgaaaccctaacctccaaaaactccaaacccctaccgataacctaaaccccacaacccgcgaccaacacaatcttatcgtctccgtcgccacaatcgccgccacttccgacgcaactcgacctcgcgaaaacgcttacgcccgacgacgatcgaaactaactcttcgcgacctccgtcgccgaactttcgtcaatattatcaccgtcttttcctcctttcccccaattccctttcacttccgaaattactctaaatccgctaattccgtaacaacatcccgttaacttccctcaaacgacgaaaccaatacaaccgccgcctcccaaaatcgtccgccgatcaaaacccttaccctccccgacacaaaccaccataaccaccaacccacaaccgcaaccgcctcctaaaacgccgccgcctcccccgccgcaaccgcaaccacaaccaccgccgccgccgccgaaccccgaaactaaccccgacgcgaacgaaacgaacgacgcgaatacgaacgccgaaaacccgcaactcgtaaccataatcgtaaaccacctcaaaaaccaaaaactcttcgaccaattccgcaaaaactacctaaccgacgtaaacaccaaaattaaaaacgcgccg

SEQ ID NO: 32603 - DNA, 795 bp, Artificial Sequence
  chemically treated genomic DNA (Homo sapiens) CpG-island No: 32603
gagtagatttacgtagggttcgtattataaatgtttatggatttttatgtattgtttcgggaaattggagtaagagaggtaggtttaaaatgtcgtcgcggatgaagcggggttagaaacgtattgttttcgtttagatttagggttttaggtgtcgcgcgggtcgaagttttaatttttagggattttagatttttgtcggtgatttaaattttataattcgcgattagtatagttttgtcgttttcgtcgttatagtcgtcgttattttcggcgtagttcggtttcgcgagggcgtttgcgttcggcgacggtcgaaattggtttttcgcggttttcgtcgtcggattttcgttaatgttgttatcgtttttttttttttttttttagtttttttttattttcggggttgttttggattcgttggtttcgtaataatatttcgttggttttttttaggcggcgggattagtgtagtcgtcgttttttaggatcgttcgtcggttagggtttttgtttttttcggtataggttattatggttattaatttatagtcgtagtcgttttttggggcgtcgtcgtttttttcgtcgtagtcgtagttatagttatcgtcgtcgtcgtcgggtttcggggttggtttcggcgcgggcggggcgggcggcgcgggtgcgggcgtcggggattcgtagttcgtggttatgatcgtgaattattttaagagttaggggtttttcgattagtttcgtagagattgtttggtcgacgtggatattaaggttaggagcgcgtcg

SEQ ID NO: 32604 - DNA, 795 bp, Artificial Sequence
  chemically treated genomic DNA (Homo sapiens) CpG-island No: 32604
cgacgcgctcctaaccttaatatccacgtcgaccaaacaatctctacgaaactaatcgaaaaacccctaactcttaaaataattcacgatcataaccacgaactacgaatccccgacgcccgcacccgcgccgcccgccccgcccgcgccgaaaccaaccccgaaacccgacgacgacgacgataactataactacgactacgacgaaaaaaacgacgacgccccaaaaaacgactacgactataaattaataaccataataacctataccgaaaaaaacaaaaaccctaaccgacgaacgatcctaaaaaacgacgactacactaatcccgccgcctaaaaaaaaccaacgaaatattattacgaaaccaacgaatccaaaacaaccccgaaaataaaaaaaaactaaaaaaaaaaaaaaaaaaacgataacaacattaacgaaaatccgacgacgaaaaccgcgaaaaaccaatttcgaccgtcgccgaacgcaaacgccctcgcgaaaccgaactacgccgaaaataacgacgactataacgacgaaaacgacaaaactatactaatcgcgaattataaaatttaaatcaccgacaaaaatctaaaatccctaaaaattaaaacttcgacccgcgcgacacctaaaaccctaaatctaaacgaaaacaatacgtttctaaccccgcttcatccgcgacgacattttaaacctacctctcttactccaatttcccgaaacaatacataaaaatccataaacatttataatacgaaccctacgtaaatctactc

SEQ ID NO: 32605 - DNA, 686 bp, Artificial Sequence
  chemically treated genomic DNA (Homo sapiens) CpG-island No: 32605
cgaggcgttcgtttttttattttcgtgagtgttgtcgaggggaaaattggggaagtgggttagttcggcggtttttatttatagattttttttcgtttcggtcgttcgttttttttcggagtttaaggcgtttgttttcgttcggtagtgttgtaagagtggttttgtttaggcgtgggtcgggtcggtgtttgcgttaaggcgttgcgttcgtcggttgtttttgtttacgtttggcgtttattttgaggcgtcgttggttttttcgttattttttcggcggggtttttttttttattatggtaatagtgatatttagaggaaaaggttagcgcggcgacggcgtttcggttttcgtagagcggaggttcgggttgcggacggggttgcgcgtattcgtatcgttggacgtcgcggggcgggcggtcgtcgagtttttttcgttcggtttagttttttcgtcgtagtcgcggggtagtttcgagttacggtttcggttggcgggcgggttgcgggtaggattttggcgttcgggttttggtaaggggaaaggatagaaacggcgtatcgggagggattttgttttatcgtttgtatatggtaaagtttttcgtcgagtttttgggttgtacgttgtcgagtaagggcgttttttttatgtttgaggtaggtggagggtgtgtttt

SEQ ID NO: 32606 - DNA, 686 bp, Artificial Sequence
  chemically treated genomic DNA (Homo sapiens) CpG-island No: 32606
aaaacacaccctccacctacctcaaacataaaaaaaacgcccttactcgacaacgtacaacccaaaaactcgacgaaaaactttaccatatacaaacgataaaacaaaatccctcccgatacgccgtttctatcctttccccttaccaaaacccgaacgccaaaatcctacccgcaacccgcccgccaaccgaaaccgtaactcgaaactaccccgcgactacgacgaaaaaactaaaccgaacgaaaaaaactcgacgaccgcccgccccgcgacgtccaacgatacgaatacgcgcaaccccgtccgcaacccgaacctccgctctacgaaaaccgaaacgccgtcgccgcgctaaccttttcctctaaatatcactattaccataataaaaaaaaaaaccccgccgaaaaaataacgaaaaaaccaacgacgcctcaaaataaacgccaaacgtaaacaaaaacaaccgacgaacgcaacgccttaacgcaaacaccgacccgacccacgcctaaacaaaaccactcttacaacactaccgaacgaaaacaaacgccttaaactccgaaaaaaaacgaacgaccgaaacgaaaaaaaatctataaataaaaaccgccgaactaacccacttccccaattttcccctcgacaacactcacgaaaataaaaaaacgaacgcctcg

SEQ ID NO: 32607 - DNA, 686 bp, Artificial Sequence
  chemically treated genomic DNA (Homo sapiens) CpG-island No: 32607
gggatatattttttatttattttaaatatgggagaggcgtttttgttcggtaacgtgtagtttaggagttcggcgagaaattttgttatatataagcggtgaggtagggtttttttcgatgcgtcgtttttgttttttttttttgttagagttcgagcgttaggattttgttcgtagttcgttcgttagtcggggtcgtggttcggggttgtttcgcggttgcggcggaggggttgggtcgggcggggagagttcggcggtcgttcgtttcgcggcgtttagcggtgcgagtgcgcgtagtttcgttcgtagttcgagttttcgttttgcgggagtcggggcgtcgtcgtcgcgttagtttttttttttgaatgttattattattatagtaaagggaagggtttcgtcgagggggtggcgggagggttaacggcgttttaggatgggcgttaagcgtgagtaagggtagtcggcgggcgtagcgttttggcgtagatatcggttcgatttacgtttgggtagggttatttttgtaatattgtcgggcgggagtagacgttttaagtttcgagggagagcgggcggtcggggcgggggagggtttgtggatggaagtcgtcgggttgatttatttttttagtttttttttcggtagtatttacggaggtggaaaggcgggcgtttcg

SEQ ID NO: 32608 - DNA, 686 bp, Artificial Sequence
  chemically treated genomic DNA (Homo sapiens) CpG-island No: 32608
cgaaacgcccgcctttccacctccgtaaatactaccgaaaaaaaaactaaaaaaataaatcaacccgacgacttccatccacaaaccctcccccgccccgaccgcccgctctccctcgaaacttaaaacgtctactcccgcccgacaatattacaaaaataaccctacccaaacgtaaatcgaaccgatatctacgccaaaacgctacgcccgccgactacccttactcacgcttaacgcccatcctaaaacgccgttaaccctcccgccaccccctcgacgaaacccttccctttactataataataataacattcaaaaaaaaaaactaacgcgacgacgacgccccgactcccgcaaaacgaaaactcgaactacgaacgaaactacgcgcactcgcaccgctaaacgccgcgaaacgaacgaccgccgaactctccccgcccgacccaacccctccgccgcaaccgcgaaacaaccccgaaccacgaccccgactaacgaacgaactacgaacaaaatcctaacgctcgaactctaacaaaaaaaaaaaacaaaaacgacgcatcgaaaaaaaccctacctcaccgcttatatataacaaaatttctcgccgaactcctaaactacacgttaccgaacaaaaacgcctctcccatatttaaaataaataaaaaatatatccc

SEQ ID NO: 32609 - DNA, 581 bp, Artificial Sequence
  chemically treated genomic DNA (Homo sapiens) CpG-island No: 32609
gtcgaggcgtcggtcgggagtgtgggagaagagggcgagagaaaggttggggagggggcggagaggtcgaggcgcggagttggtttttaggcggtcgtcgttttttattttttcgtggttttgttttttttttcggagttttttcggtcgttttttgaggggtgttcgtcggggtcgcgcgttcggtcgtcgttttataggttcgcgttcgtcgcgtcgtcgtcgaggtcgtgtgtaatcggtagttgttgtagtcgcgggaggagagtcgggatcgtcgcgaggaattcgggaggaggcggggcgcgcggcggaggaatacgtaggcgtcgttttttttttttttttttttcgggggcgagggggcggtgcggggggaggggaggaaaggggaggcggggggtcgggcgtattttttcgcgtcggcggtcgggttttcgtcggattgcggagagcgaggttgggagagagcgagcgcgacggcggcggcggcggagagaggttttttgttgtttttttatttcgttttttgtatttttttgggattcgggcgggttattatttttttttttcgtttaata

SEQ ID NO: 32610 - DNA, 581 bp, Artificial Sequence
  chemically treated genomic DNA (Homo sapiens) CpG-island No: 32610
tattaaacgaaaaaaaaaaataataacccgcccgaatcccaaaaaaatacaaaaaacgaaataaaaaaacaacaaaaaacctctctccgccgccgccgccgtcgcgctcgctctctcccaacctcgctctccgcaatccgacgaaaacccgaccgccgacgcgaaaaaatacgcccgaccccccgcctcccctttcctcccctccccccgcaccgccccctcgcccccgaaaaaaaaaaaaaaaaaaaacgacgcctacgtattcctccgccgcgcgccccgcctcctcccgaattcctcgcgacgatcccgactctcctcccgcgactacaacaactaccgattacacacgacctcgacgacgacgcgacgaacgcgaacctataaaacgacgaccgaacgcgcgaccccgacgaacacccctcaaaaaacgaccgaaaaaactccgaaaaaaaaaacaaaaccacgaaaaaataaaaaacgacgaccgcctaaaaaccaactccgcgcctcgacctctccgccccctccccaacctttctctcgccctcttctcccacactcccgaccgacgcctcgac

SEQ ID NO: 32611 - DNA, 581 bp, Artificial Sequence
  chemically treated genomic DNA (Homo sapiens) CpG-island No: 32611
tgttgggcgggaggggggggtggtggttcgttcgaattttagaggggtgtagggggcggggtagggaggtaataaagagttttttttcgtcgtcgtcgtcgtcgcgttcgtttttttttagtttcgtttttcgtagttcggcgggggttcggtcgtcggcgcgggggagtgcgttcggtttttcgtttttttttttttttttttttttcgtatcgttttttcgttttcgggggaaggaggggaggagggcggcgtttgcgtgttttttcgtcgcgcgtttcgttttttttcgggtttttcgcggcgatttcgatttttttttcgcggttgtagtagttgtcggttgtatacggtttcggcggcggcgcggcgagcgcgggtttgtggagcggcggtcgggcgcgcggtttcggcgggtattttttagagggcggtcgaggaagtttcgggaggaggagtaggattacgaggaggtgggaggcggcggtcgtttggggattagtttcgcgtttcggttttttcgttttttttttagtttttttttcgttttttttttttatattttcggtcggcgtttcggt

SEQ ID NO: 32612 - DNA, 581 bp, Artificial Sequence
  chemically treated genomic DNA (Homo sapiens) CpG-island No: 32612
accgaaacgccgaccgaaaatataaaaaaaaaaaacgaaaaaaaaactaaaaaaaaaacgaaaaaaccgaaacgcgaaactaatccccaaacgaccgccgcctcccacctcctcgtaatcctactcctcctcccgaaacttcctcgaccgccctctaaaaaatacccgccgaaaccgcgcgcccgaccgccgctccacaaacccgcgctcgccgcgccgccgccgaaaccgtatacaaccgacaactactacaaccgcgaaaaaaaaatcgaaatcgccgcgaaaaacccgaaaaaaaacgaaacgcgcgacgaaaaaacacgcaaacgccgccctcctcccctccttcccccgaaaacgaaaaaacgatacgaaaaaaaaaaaaaaaaaaaaaaacgaaaaaccgaacgcactcccccgcgccgacgaccgaacccccgccgaactacgaaaaacgaaactaaaaaaaaacgaacgcgacgacgacgacgacgaaaaaaaactctttattacctccctaccccgccccctacacccctctaaaattcgaacgaaccaccacccccccctcccgcccaaca

SEQ ID NO: 32613 - DNA, 1047 bp, Artificial Sequence
  chemically treated genomic DNA (Homo sapiens) CpG-island No: 32613
agttcgacgttagcggttcggttggttggggcgtttcgatcgcgcggtttttatttttgttttaattttttcgcgcgtcgagggatggggttcggtgaggcgggtggttcggaagcgtttacgtttcgggggtttttagtatcgagggtagggttcgcggggtttttttgtcgcgcgcgagtgtttagaattttcgttcggtcgtttagaattttcgttcggtcgcgtatttatttgttgttttcgtttttggtttcgcgtatagtcgttcgttttcggggtcgttttcgcgtagtttcgaggttcgtcgcgtgtcggttagtagtcggcgtcgcgttttttgtcgtcgcgtgatcggtttcgttttcgggtcgcgcgattggtcgtcggggtcgatttcgtaggtttttattggttttggggcggggcgcgagtcggtgcgttcgggttatataagttagggcgagggggcggggttttcggggcgcgttatataacgcgcgggttcgggcggaggtcggcgttcggttaattttagtaggtcggcgggcgggtaggggacggggtggtttttagcggttttaggtttgtgtcgcgcgattggagtgttcggttttttggtacggcgtcggggcggagtcgttgaagttagcgtagaaatgatagggttaggaagttgttagttacgtgggggcgggattcgggttttgtggggcggggcgggttcggtttaatttttacgtgagaggcgggcggggaaggagaggggagtgagaggcgggggtagagaggggcgagaggcggagtcggggggtttgagtcggggttagggggaggttggaaatggggacggatgggggcgagaggcggggacgggggggcggatgggagcgggggtgtcgagagacgtggggagcgagaggtaggggcgggggggcgacggtgtcgagggcgggggtagaagagggagggagaggcggggattgggggcgagtaggggcggtttaggttagcgttttggggtcgagttttggagtttgtaggtgg

SEQ ID NO: 32614 - DNA, 1047 bp, Artificial Sequence
  chemically treated genomic DNA (Homo sapiens) CpG-island No: 32614
ccacctacaaactccaaaactcgaccccaaaacgctaacctaaaccgcccctactcgcccccaatccccgcctctccctccctcttctacccccgccctcgacaccgtcgcccccccgcccctacctctcgctccccacgtctctcgacacccccgctcccatccgcccccccgtccccgcctctcgcccccatccgtccccatttccaacctccccctaaccccgactcaaaccccccgactccgcctctcgcccctctctacccccgcctctcactcccctctccttccccgcccgcctctcacgtaaaaattaaaccgaacccgccccgccccacaaaacccgaatcccgcccccacgtaactaacaacttcctaaccctatcatttctacgctaacttcaacgactccgccccgacgccgtaccaaaaaaccgaacactccaatcgcgcgacacaaacctaaaaccgctaaaaaccaccccgtcccctacccgcccgccgacctactaaaattaaccgaacgccgacctccgcccgaacccgcgcgttatataacgcgccccgaaaaccccgccccctcgccctaacttatataacccgaacgcaccgactcgcgccccgccccaaaaccaataaaaacctacgaaatcgaccccgacgaccaatcgcgcgacccgaaaacgaaaccgatcacgcgacgacaaaaaacgcgacgccgactactaaccgacacgcgacgaacctcgaaactacgcgaaaacgaccccgaaaacgaacgactatacgcgaaaccaaaaacgaaaacaacaaataaatacgcgaccgaacgaaaattctaaacgaccgaacgaaaattctaaacactcgcgcgcgacaaaaaaaccccgcgaaccctaccctcgatactaaaaacccccgaaacgtaaacgcttccgaaccacccgcctcaccgaaccccatccctcgacgcgcgaaaaaattaaaacaaaaataaaaaccgcgcgatcgaaacgccccaaccaaccgaaccgctaacgtcgaact

SEQ ID NO: 32615 - DNA, 1047 bp, Artificial Sequence
  chemically treated genomic DNA (Homo sapiens) CpG-island No: 32615
ttatttataaattttaggattcgattttagagcgttggtttgagtcgtttttgttcgtttttagttttcgttttttttttttttttttgttttcgttttcgatatcgtcgttttttcgtttttgtttttcgttttttacgtttttcggtattttcgtttttattcgttttttcgttttcgtttttcgtttttattcgtttttatttttagtttttttttgatttcgatttaagtttttcgatttcgtttttcgtttttttttgttttcgttttttattttttttttttttttcgttcgttttttacgtggaggttgggtcggattcgtttcgttttatagagttcgggtttcgtttttacgtggttggtagttttttggttttattatttttgcgttggttttagcggtttcgtttcggcgtcgtgttagggggtcggatattttagtcgcgcggtataggtttgaggtcgttgagggttatttcgttttttgttcgttcgtcggtttgttgggattggtcgagcgtcggttttcgttcgagttcgcgcgttatgtaacgcgtttcgggggtttcgttttttcgttttggtttatataattcgggcgtatcggttcgcgtttcgttttagggttaatggaggtttgcggagtcggtttcgacgattaatcgcgcggttcgggggcggggtcggttacgcggcggtagggggcgcggcgtcggttgttgatcggtacgcggcgagtttcgagattgcgcgagggcggtttcgggggcgagcggttgtgcgcggggttaagggcgggggtagtaggtgagtgcgcggtcgggcgggagttttgggcgatcgggcgggagttttgggtattcgcgcgcggtagaggagtttcgcgagttttgttttcggtattgggggttttcggagcgtgggcgttttcgagttattcgttttatcgggttttatttttcggcgcgcgggaaagttggggtaggggtgaggatcgcgcggtcggggcgttttagttagtcgggtcgttggcgtcggatt

SEQ ID NO: 32616 - DNA, 1047 bp, Artificial Sequence
  chemically treated genomic DNA (Homo sapiens) CpG-island No: 32616
aatccgacgccaacgacccgactaactaaaacgccccgaccgcgcgatcctcacccctaccccaactttcccgcgcgccgaaaaataaaacccgataaaacgaataactcgaaaacgcccacgctccgaaaacccccaataccgaaaacaaaactcgcgaaactcctctaccgcgcgcgaatacccaaaactcccgcccgatcgcccaaaactcccgcccgaccgcgcactcacctactacccccgcccttaaccccgcgcacaaccgctcgcccccgaaaccgccctcgcgcaatctcgaaactcgccgcgtaccgatcaacaaccgacgccgcgccccctaccgccgcgtaaccgaccccgcccccgaaccgcgcgattaatcgtcgaaaccgactccgcaaacctccattaaccctaaaacgaaacgcgaaccgatacgcccgaattatataaaccaaaacgaaaaaacgaaacccccgaaacgcgttacataacgcgcgaactcgaacgaaaaccgacgctcgaccaatcccaacaaaccgacgaacgaacaaaaaacgaaataaccctcaacgacctcaaacctataccgcgcgactaaaatatccgaccccctaacacgacgccgaaacgaaaccgctaaaaccaacgcaaaaataataaaaccaaaaaactaccaaccacgtaaaaacgaaacccgaactctataaaacgaaacgaatccgacccaacctccacgtaaaaaacgaacgaaaaaaaaaaaaaaaataaaaaacgaaaacaaaaaaaaacgaaaaacgaaatcgaaaaacttaaatcgaaatcaaaaaaaaactaaaaataaaaacgaataaaaacgaaaaacgaaaacgaaaaaacgaataaaaacgaaaataccgaaaaacgtaaaaaacgaaaaacaaaaacgaaaaaacgacgatatcgaaaacgaaaacaaaaaaaaaaaaaaaaaacgaaaactaaaaacgaacaaaaacgactcaaaccaacgctctaaaatcgaatcctaaaatttataaataa

SEQ ID NO: 32617 - DNA, 503 bp, Artificial Sequence
  chemically treated genomic DNA (Homo sapiens) CpG-island No: 32617
aaggttatgaggtgcgggttattatcgtatcgttttattattcgtaatggtaggtgggcgagaattatttcgtttggcgttataaacgagaagagggggtcgttacggtgtggcgttgttcgttgtatgtgttaaaatagtcgagtattttgaaacgtttgttgtatttgggtagttttgtcgttagtagttttttttcgttgatggcgtaacgtcgttggaagtcggatcgtattattggcgtggtgttaacgttgttttgcgcgtcgggaatgcgtttgttggcgaaattttttggtgcgcgtatcgtgttgtatatttaggattacgaagtggacgttatgttggggttgggttttgtcggaaaaggtaaaggcggtaaagtggtatagttggtaacggcgttcgaacgtagcggattgtataacgtcgataacgtttttacgatttcgcgttcgatgatgaataaagttatcgaaaaaggcgtggcggcggaaaacgtt

SEQ ID NO: 32618 - DNA, 503 bp, Artificial Sequence
  chemically treated genomic DNA (Homo sapiens) CpG-island No: 32618
aacgttttccgccgccacgcctttttcgataactttattcatcatcgaacgcgaaatcgtaaaaacgttatcgacgttatacaatccgctacgttcgaacgccgttaccaactataccactttaccgcctttaccttttccgacaaaacccaaccccaacataacgtccacttcgtaatcctaaatatacaacacgatacgcgcaccaaaaaatttcgccaacaaacgcattcccgacgcgcaaaacaacgttaacaccacgccaataatacgatccgacttccaacgacgttacgccatcaacgaaaaaaaactactaacgacaaaactacccaaatacaacaaacgtttcaaaatactcgactattttaacacatacaacgaacaacgccacaccgtaacgaccccctcttctcgtttataacgccaaacgaaataattctcgcccacctaccattacgaataataaaacgatacgataataacccgcacctcataacctt

SEQ ID NO: 32619 - DNA, 503 bp, Artificial Sequence
  chemically treated genomic DNA (Homo sapiens) CpG-island No: 32619
gacgtttttcgtcgttacgtttttttcgatggttttatttattatcgaacgcgaaatcgtggagacgttatcgacgttatgtagttcgttacgttcgaacgtcgttgttagttgtgttattttgtcgtttttgtttttttcggtaaggtttagttttagtatggcgtttatttcgtaattttgaatatgtagtacggtacgcgtattagagagtttcgttagtaggcgtattttcggcgcgtaaaatagcgttggtattacgttaataatgcgattcggtttttagcgacgttgcgttattagcggaaagaaattgttgacggtaaaattgtttagatgtaataggcgttttagggtgttcggttgttttggtatatatagcgggtagcgttatatcgtggcggtttttttttttcgtttgtagcgttaggcggaatagttttcgtttatttgttattgcgggtagtaaggcggtgcggtaatgattcgtattttatgatttt

SEQ ID NO: 32620 - DNA, 503 bp, Artificial Sequence
  chemically treated genomic DNA (Homo sapiens) CpG-island No: 32620
aaaatcataaaatacgaatcattaccgcaccgccttactacccgcaataacaaataaacgaaaactattccgcctaacgctacaaacgaaaaaaaaaaaccgccacgatataacgctacccgctatatataccaaaacaaccgaacaccctaaaacgcctattacatctaaacaattttaccgtcaacaatttctttccgctaataacgcaacgtcgctaaaaaccgaatcgcattattaacgtaataccaacgctattttacgcgccgaaaatacgcctactaacgaaactctctaatacgcgtaccgtactacatattcaaaattacgaaataaacgccatactaaaactaaaccttaccgaaaaaaacaaaaacgacaaaataacacaactaacaacgacgttcgaacgtaacgaactacataacgtcgataacgtctccacgatttcgcgttcgataataaataaaaccatcgaaaaaaacgtaacgacgaaaaacgtc

SEQ ID NO: 32621 - DNA, 595 bp, Artificial Sequence
  chemically treated genomic DNA (Homo sapiens) CpG-island No: 32621
  misc_feature (504)..(504): n is either a, c, g or t
acgcgtttcgtttaaggtcgtaatagcgttagcgtttcgtcgagagttagtttattagatttcgtcggaggtcggcgatcgatatcgatcgtatacgtcggtaaatacggttgttatttaggtttttatcggttgcgcggtacgttatcgcggtattacgtatagagttttcgggcgacgatagacggtcgcgcgtagagacgtagcggtatagttcggaggacgtacgtacgtagttagcgttatattcgagcggcgcgaacgtagcgacgtataatacggtaaggcgcgagggcgggttagcggagggagaggcgagaagataacgattcgtttatagtacgcgagtttagttatttagtatcgtagcggagtagcgagagtatcgacgtagtaggttcgagatataagcggatataaacgtataaggggagttggggacgcggggagcgcggacgagagcgtataggaatacgacgatattcgaagtacgagatttagatngcgtagcgcggcgttgagcgagataatcgtagtaacgtagtaaaagtagttcgagttatatagtattttattttattatttattatattta

SEQ ID NO: 32622 - DNA, 595 bp, Artificial Sequence
  chemically treated genomic DNA (Homo sapiens) CpG-island No: 32622
  misc_feature (92)..(92): n is either a, c, g or t
taaatataataaataataaaataaaatactatataactcgaactacttttactacgttactacgattatctcgctcaacgccgcgctacgcnatctaaatctcgtacttcgaatatcgtcgtattcctatacgctctcgtccgcgctccccgcgtccccaactccccttatacgtttatatccgcttatatctcgaacctactacgtcgatactctcgctactccgctacgatactaaataactaaactcgcgtactataaacgaatcgttatcttctcgcctctccctccgctaacccgccctcgcgccttaccgtattatacgtcgctacgttcgcgccgctcgaatataacgctaactacgtacgtacgtcctccgaactataccgctacgtctctacgcgcgaccgtctatcgtcgcccgaaaactctatacgtaataccgcgataacgtaccgcgcaaccgataaaaacctaaataacaaccgtatttaccgacgtatacgatcgatatcgatcgccgacctccgacgaaatctaataaactaactctcgacgaaacgctaacgctattacgaccttaaacgaaacgcgt

SEQ ID NO: 32623 - DNA, 595 bp, Artificial Sequence
  chemically treated genomic DNA (Homo sapiens) CpG-island No: 32623
  misc_feature (92)..(92): n is either a, c, g or t
tagatgtggtggatggtggaatggagtgttgtgtagttcgggttgtttttgttgcgttgttgcggttgtttcgtttagcgtcgcgttgcgtngtttaggtttcgtgtttcgggtgtcgtcgtgtttttgtgcgttttcgttcgcgtttttcgcgtttttagttttttttgtgcgtttatattcgtttgtgtttcgggtttgttgcgtcggtgttttcgttgtttcgttgcggtgttgggtggttgggttcgcgtgttgtgggcgggtcgttgttttttcgttttttttttcgttggttcgttttcgcgttttgtcgtgttgtgcgtcgttgcgttcgcgtcgttcgggtgtgacgttggttgcgtgcgtacgtttttcgagttgtgtcgttgcgtttttgcgcgcggtcgtttgtcgtcgttcggaggttttgtgcgtgatgtcgcggtggcgtgtcgcgtagtcggtggggatttgagtggtagtcgtgtttgtcggcgtgtgcggtcggtgtcggtcgtcggttttcgacggggtttggtgggttggttttcggcgaggcgttggcgttgttgcggttttgagcgagacgcgt

SEQ ID NO: 32624 - DNA, 595 bp, Artificial Sequence
  chemically treated genomic DNA (Homo sapiens) CpG-island No: 32624
  misc_feature (504)..(504): n is either a, c, g or t
acgcgtctcgctcaaaaccgcaacaacgccaacgcctcgccgaaaaccaacccaccaaaccccgtcgaaaaccgacgaccgacaccgaccgcacacgccgacaaacacgactaccactcaaatccccaccgactacgcgacacgccaccgcgacatcacgcacaaaacctccgaacgacgacaaacgaccgcgcgcaaaaacgcaacgacacaactcgaaaaacgtacgcacgcaaccaacgtcacacccgaacgacgcgaacgcaacgacgcacaacacgacaaaacgcgaaaacgaaccaacgaaaaaaaaaacgaaaaaacaacgacccgcccacaacacgcgaacccaaccacccaacaccgcaacgaaacaacgaaaacaccgacgcaacaaacccgaaacacaaacgaatataaacgcacaaaaaaaactaaaaacgcgaaaaacgcgaacgaaaacgcacaaaaacacgacgacacccgaaacacgaaacctaaacnacgcaacgcgacgctaaacgaaacaaccgcaacaacgcaacaaaaacaacccgaactacacaacactccattccaccatccaccacatcta

SEQ ID NO: 32625 - DNA, 507 bp, Artificial Sequence
  chemically treated genomic DNA (Homo sapiens) CpG-island No: 32625
cgggaacggtattgcgtaaattcggtacgttggtgggtaattaaaatgtcgtcgcgtgggtggttgcggtaattgtttcgcgtattatttcggaatatggtgttgaagttggattttttgtcggatttttaacgttggcgttgtggcggcgatggatatgattaatggcggattttacgtttttattatgtagtagtacggtataaaagaagaagttggggtatttgtgttgatgtcgttggagttcgggtcgtttagtcggcgtttttgtatcgttcgcgtttagtttttcgataattcggtagcggagagtaaacggtgatattgatcgttattaaacggtatatgttatgcgatggcggtagttttttgtacggttatatcgttgatacgggaaattaattttagcggcgcgttcgtagatattttttttggcgttattacgttatataattattttattttatttgtgttttgtattaattgcgttatatcgttgatattaaa

SEQ ID NO: 32626 - DNA, 507 bp, Artificial Sequence
  chemically treated genomic DNA (Homo sapiens) CpG-island No: 32626
tttaatatcaacgatataacgcaattaatacaaaacacaaataaaataaaataattatataacgtaataacgccaaaaaaaatatctacgaacgcgccgctaaaattaatttcccgtatcaacgatataaccgtacaaaaaactaccgccatcgcataacatataccgtttaataacgatcaatatcaccgtttactctccgctaccgaattatcgaaaaactaaacgcgaacgatacaaaaacgccgactaaacgacccgaactccaacgacatcaacacaaataccccaacttcttcttttataccgtactactacataataaaaacgtaaaatccgccattaatcatatccatcgccgccacaacgccaacgttaaaaatccgacaaaaaatccaacttcaacaccatattccgaaataatacgcgaaacaattaccgcaaccacccacgcgacgacattttaattacccaccaacgtaccgaatttacgcaataccgttcccg

SEQ ID NO: 32627 - DNA, 507 bp, Artificial Sequence
  chemically treated genomic DNA (Homo sapiens) CpG-island No: 32627
tttgatattagcgatatagcgtagttgatgtaaaatataggtaaggtggggtggttgtatagcgtgatagcgttagggaaagtgtttgcggacgcgtcgttggagttggtttttcgtgttagcgatgtgatcgtgtaggaggttgtcgttatcgtatggtatatgtcgtttgatgacgattaatattatcgtttatttttcgttgtcgggttatcgaaaagttggacgcggacgatgtaaaagcgtcgattgagcggttcggattttaacgatattaatataaatgttttagtttttttttttgtgtcgtattgttgtatgatggaagcgtaaagttcgttattggttatatttatcgtcgttatagcgttagcgttgaaagttcggtaaagaatttaattttaatattatgtttcggaataatacgcgaggtaattgtcgtaattatttacgcgacggtattttagttatttattagcgtatcggatttacgtagtatcgttttcg

SEQ ID NO: 32628 - DNA, 507 bp, Artificial Sequence
  chemically treated genomic DNA (Homo sapiens) CpG-island No: 32628
cgaaaacgatactacgtaaatccgatacgctaataaataactaaaataccgtcgcgtaaataattacgacaattacctcgcgtattattccgaaacataatattaaaattaaattctttaccgaactttcaacgctaacgctataacgacgataaatataaccaataacgaactttacgcttccatcatacaacaatacgacacaaaaaaaaaaactaaaacatttatattaatatcgttaaaatccgaaccgctcaatcgacgcttttacatcgtccgcgtccaacttttcgataacccgacaacgaaaaataaacgataatattaatcgtcatcaaacgacatataccatacgataacgacaacctcctacacgatcacatcgctaacacgaaaaaccaactccaacgacgcgtccgcaaacactttccctaacgctatcacgctatacaaccaccccaccttacctatattttacatcaactacgctatatcgctaatatcaaa

SEQ ID NO: 32629 - DNA, 643 bp, Artificial Sequence
  chemically treated genomic DNA (Homo sapiens) CpG-island No: 32629
cggtttcggagcggcggagttagttattcggtacggtacgttggtcgtttatttcgcgaggtgtagggagtacgtgggtcgacgcgcggattttagagagcgtagcgtgatttgttgtacggattttcggatgagagatttggggcgggatttgcgatcggggttcgtttttacgttaggagggagggtcggtcggcgggggaagcgtttgcggtggcgttcgttgttttcgttcggttgttcggaaatttttatcggcggcggtgacggttacgttgttttgcgtacgcgtagcgcggtttaggcggtagttcggtgatatcggttttagcgcgtatgtttgtacgtcggggtttgcgcgtcgcggcggggtcgagggcggcgtgcgggttttttagtcgttgtttattttatttaacgtcggtttagattagtaatggtttaacgttatcgtttttttttttagttttttttagtcgcgtagtttttgacgtcgtttttatttcgttcgcggtcgacgggggttttaacgcgtaggcgcggtaattacggcggcggtgtttagtgaggatttgaaatcggtcgcgcgtgcgtatcggcgatacggttcggcgatcgaggtcgcgtttttttttcgtttgcg

SEQ ID NO: 32630 - DNA, 643 bp, Artificial Sequence
  chemically treated genomic DNA (Homo sapiens) CpG-island No: 32630
cgcaaacgaaaaaaaaacgcgacctcgatcgccgaaccgtatcgccgatacgcacgcgcgaccgatttcaaatcctcactaaacaccgccgccgtaattaccgcgcctacgcgttaaaacccccgtcgaccgcgaacgaaataaaaacgacgtcaaaaactacgcgactaaaaaaaactaaaaaaaaaaacgataacgttaaaccattactaatctaaaccgacgttaaataaaataaacaacgactaaaaaacccgcacgccgccctcgaccccgccgcgacgcgcaaaccccgacgtacaaacatacgcgctaaaaccgatatcaccgaactaccgcctaaaccgcgctacgcgtacgcaaaacaacgtaaccgtcaccgccgccgataaaaatttccgaacaaccgaacgaaaacaacgaacgccaccgcaaacgcttcccccgccgaccgaccctccctcctaacgtaaaaacgaaccccgatcgcaaatcccgccccaaatctctcatccgaaaatccgtacaacaaatcacgctacgctctctaaaatccgcgcgtcgacccacgtactccctacacctcgcgaaataaacgaccaacgtaccgtaccgaataactaactccgccgctccgaaaccg

SEQ ID NO: 32631 - DNA, 643 bp, Artificial Sequence
  chemically treated genomic DNA (Homo sapiens) CpG-island No: 32631
cgtaagcgaggaggaagcgcggtttcggtcgtcgggtcgtgtcgtcggtgcgtacgcgcgatcgattttaaatttttattagatatcgtcgtcgtggttatcgcgtttgcgcgttggggttttcgtcggtcgcgggcggggtgaggacggcgttagaagttacgcgattgggaggggttggagggagaggcggtggcgttgagttattattgatttaggtcggcgttgggtggaataggtagcggttggaaggttcgtacgtcgttttcggtttcgtcgcggcgcgtagatttcggcgtgtagatatgcgcgttagggtcggtgttatcgggttgtcgtttgagtcgcgttgcgcgtgcgtagggtagcgtggtcgttatcgtcgtcggtggaagttttcgagtagtcgggcgggggtagcggacgttatcgtaggcgtttttttcgtcggtcggtttttttttttgacgtaagggcgggtttcggtcgtagatttcgttttaggttttttattcgagggttcgtgtagtaggttacgttgcgttttttggggttcgcgcgtcggtttacgtgttttttgtatttcgcggggtgagcggttagcgtgtcgtgtcgggtggttggtttcgtcgtttcggagtcg

SEQ ID NO: 32632 - DNA, 643 bp, Artificial Sequence
  chemically treated genomic DNA (Homo sapiens) CpG-island No: 32632
cgactccgaaacgacgaaaccaaccacccgacacgacacgctaaccgctcaccccgcgaaatacaaaaaacacgtaaaccgacgcgcgaaccccaaaaaacgcaacgtaacctactacacgaaccctcgaataaaaaacctaaaacgaaatctacgaccgaaacccgcccttacgtcaaaaaaaaaaaccgaccgacgaaaaaaacgcctacgataacgtccgctacccccgcccgactactcgaaaacttccaccgacgacgataacgaccacgctaccctacgcacgcgcaacgcgactcaaacgacaacccgataacaccgaccctaacgcgcatatctacacgccgaaatctacgcgccgcgacgaaaccgaaaacgacgtacgaaccttccaaccgctacctattccacccaacgccgacctaaatcaataataactcaacgccaccgcctctccctccaacccctcccaatcgcgtaacttctaacgccgtcctcaccccgcccgcgaccgacgaaaaccccaacgcgcaaacgcgataaccacgacgacgatatctaataaaaatttaaaatcgatcgcgcgtacgcaccgacgacacgacccgacgaccgaaaccgcgcttcctcctcgcttacg

SEQ ID NO: 32633 - DNA, 1221 bp, Artificial Sequence
  chemically treated genomic DNA (Homo sapiens) CpG-island No: 32633
taaggaatcgttttttcgtcgtcgtttcgtaggtttcggtgttcgggaagtttaggaggagtttttggttcgttcgtcgggtttcggtttttatcgtttcgtcgcgttttttattattttcggcgttatttttcgcgtttttcggtcgttgttgttgttggagtcgtcgatttcgcgatcgtcgttttatagtttacgcggtcgcgtacgtagtacgtagaaatcggttcgttacggttagaattttagttttatatttttcgggattttcggtcggaaattaaggttttacgtgttcgggtttggttttttcggggatttttggggatcgtttaggaataagtttaaaagcgtataattcgttttttagaaaagcggcgtgataggaaaatagcgaatagttttaaggggaaaaaaatgttttaggaagtagttataaaggcgttttcgcgcgaagcgtttaggttttttacgcggggtttaaggagtttcgcggatagtttgaagtcgcgcgtgcgtagagcggcgcggggttattgcggtttcggcgtgggtgggggcgtttgtaggttttttttcgcgtaagtgttcgtttcgttttcggggtcgtatttatagtttcggttatttcggagaagtttgatttgagaattttttttgtagagtttcggtagtgcgggatttcggtagtcgttttttcggtagtcgttttttttgttttcgcgtcgtcgttttatatgttgttcgtcgcggtttttggggtatggagtacgttgtttagttttggcgatggtaacggcgacgggggtggcggaggagcgtttgttggtcgcgttcgtttatttgtagtgcgtcgtgggttgcgcggttttcgcgcggaatcgttagacgaatttagtgtacggtcgttacgcgttgtttagttataggtttcgagtgtcggcgcgggtcgtttgggtggtgtaggagttgttttcgttggttttgtcgttttattagtacgttagcgagttcgtttcgcgttttcgtagcgcgtttaattgtatttttttggttatgtttttcgtttattacgggtatcggtaacgttttcggttttcggttttttattttattttcggttcggcgtttttttcgattttttttttattgttcggtgtttttttttcgaagttttttttatttagatgttttttttttgttagatttttcggggcgttt

SEQ ID NO: 32634 - DNA, 1221 bp, Artificial Sequence
  chemically treated genomic DNA (Homo sapiens) CpG-island No: 32634
aaacgccccgaaaaatctaacaaaaaaaaaacatctaaataaaaaaaacttcgaaaaaaaaacaccgaacaataaaaaaaaaatcgaaaaaaacgccgaaccgaaaataaaataaaaaaccgaaaaccgaaaacgttaccgatacccgtaataaacgaaaaacataaccaaaaaaatacaattaaacgcgctacgaaaacgcgaaacgaactcgctaacgtactaataaaacgacaaaaccaacgaaaacaactcctacaccacccaaacgacccgcgccgacactcgaaacctataactaaacaacgcgtaacgaccgtacactaaattcgtctaacgattccgcgcgaaaaccgcgcaacccacgacgcactacaaataaacgaacgcgaccaacaaacgctcctccgccacccccgtcgccgttaccatcgccaaaactaaacaacgtactccataccccaaaaaccgcgacgaacaacatataaaacgacgacgcgaaaacaaaaaaaacgactaccgaaaaaacgactaccgaaatcccgcactaccgaaactctacaaaaaaaattctcaaatcaaacttctccgaaataaccgaaactataaatacgaccccgaaaacgaaacgaacacttacgcgaaaaaaaacctacaaacgcccccacccacgccgaaaccgcaataaccccgcgccgctctacgcacgcgcgacttcaaactatccgcgaaactccttaaaccccgcgtaaaaaacctaaacgcttcgcgcgaaaacgcctttataactacttcctaaaacatttttttccccttaaaactattcgctattttcctatcacgccgcttttctaaaaaacgaattatacgcttttaaacttattcctaaacgatccccaaaaatccccgaaaaaaccaaacccgaacacgtaaaaccttaatttccgaccgaaaatcccgaaaaatataaaactaaaattctaaccgtaacgaaccgatttctacgtactacgtacgcgaccgcgtaaactataaaacgacgatcgcgaaatcgacgactccaacaacaacaacgaccgaaaaacgcgaaaaataacgccgaaaataataaaaaacgcgacgaaacgataaaaaccgaaacccgacgaacgaaccaaaaactcctcctaaacttcccgaacaccgaaacctacgaaacgacgacgaaaaaacgattcctta

SEQ ID NO: 32635 - DNA, 1221 bp, Artificial Sequence
  chemically treated genomic DNA (Homo sapiens) CpG-island No: 32635
ggacgtttcgggggatttggtagggagagggtatttgggtgggggaggtttcggggagagggtatcgggtagtgaggggagggtcggagaggacgtcgggtcgggagtagggtagggggtcgggggtcggggacgttatcgatgttcgtagtggacgaggaatatggttaggaggatgtagttgggcgcgttgcggagacgcggggcggattcgttggcgtattggtagagcggtagggttagcgagggtagtttttgtattatttaggcggttcgcgtcggtattcggagtttgtggttgggtagcgcgtggcggtcgtatattgagttcgtttgacgatttcgcgcgaagatcgcgtagtttacggcgtattgtaggtaggcgagcgcggttagtaggcgttttttcgttattttcgtcgtcgttgttatcgttagggttgggtagcgtgttttatgttttagaggtcgcggcgggtaatatatagggcggcggcgcgggggtaggaggggcggttatcggaggggcggttatcggagtttcgtattgtcgggattttgtagaaagggtttttaagttaggttttttcggggtagtcggggttgtgggtgcggtttcgggggcggggcgagtatttgcgcggggagggatttgtaagcgtttttatttacgtcggggtcgtagtaatttcgcgtcgttttgcgtacgcgcggttttaggttgttcgcggagttttttgagtttcgcgtgggaaatttgggcgtttcgcgcggagacgtttttgtggttgttttttggagtatttttttttttttagagttgttcgttgtttttttgttacgtcgtttttttgaaagacgggttgtgcgtttttgggtttatttttggacggtttttaaaggttttcgaaaggattaggttcggatacgtggggttttggttttcggtcggaagtttcgggaggtgtagggttagagttttggtcgtggcgggtcggtttttgcgtgttgcgtgcgcggtcgcgtgggttatggggcggcggtcgcggggtcggcggttttagtaatagtagcggtcggaggacgcggaggatggcgtcgagggtggtggaaagcgcggcgaggcggtaggagtcgggattcggcgggcgggttaggggttttttttgggtttttcggatatcgaggtttgcgaggcggcggcgagggggcggttttttg

SEQ ID NO: 32636 - DNA, 1221 bp, Artificial Sequence
  chemically treated genomic DNA (Homo sapiens) CpG-island No: 32636
caaaaaaccgccccctcgccgccgcctcgcaaacctcgatatccgaaaaacccaaaaaaaacccctaacccgcccgccgaatcccgactcctaccgcctcgccgcgctttccaccaccctcgacgccatcctccgcgtcctccgaccgctactattactaaaaccgccgaccccgcgaccgccgccccataacccacgcgaccgcgcacgcaacacgcaaaaaccgacccgccacgaccaaaactctaaccctacacctcccgaaacttccgaccgaaaaccaaaaccccacgtatccgaacctaatcctttcgaaaacctttaaaaaccgtccaaaaataaacccaaaaacgcacaacccgtctttcaaaaaaacgacgtaacaaaaaaacaacgaacaactctaaaaaaaaaaaaatactccaaaaaacaaccacaaaaacgtctccgcgcgaaacgcccaaatttcccacgcgaaactcaaaaaactccgcgaacaacctaaaaccgcgcgtacgcaaaacgacgcgaaattactacgaccccgacgtaaataaaaacgcttacaaatccctccccgcgcaaatactcgccccgcccccgaaaccgcacccacaaccccgactaccccgaaaaaacctaacttaaaaaccctttctacaaaatcccgacaatacgaaactccgataaccgcccctccgataaccgcccctcctacccccgcgccgccgccctatatattacccgccgcgacctctaaaacataaaacacgctacccaaccctaacgataacaacgacgacgaaaataacgaaaaaacgcctactaaccgcgctcgcctacctacaatacgccgtaaactacgcgatcttcgcgcgaaatcgtcaaacgaactcaatatacgaccgccacgcgctacccaaccacaaactccgaataccgacgcgaaccgcctaaataatacaaaaactaccctcgctaaccctaccgctctaccaatacgccaacgaatccgccccgcgtctccgcaacgcgcccaactacatcctcctaaccatattcctcgtccactacgaacatcgataacgtccccgacccccgaccccctaccctactcccgacccgacgtcctctccgaccctcccctcactacccgataccctctccccgaaacctcccccacccaaataccctctccctaccaaatcccccgaaacgtcc

SEQ ID NO: 32637 - DNA, 1216 bp, Artificial Sequence
  chemically treated genomic DNA (Homo sapiens) CpG-island No: 32637
agttatcgcgtttcgcgtgcgcgttcgtttgtttcgcgtatttgtcgtggtcgtcgcgcgggtttgatcggttggcgggcgggcggcgcgtataggtggcggcgattgggtaggcggggtttagagggtgacgttacgggtttcggtttcggcggtagaaatagggtagtcgcggcggcggtggtatagtagcgggtagcggcggtttagggagttggagttttaatagtttttagcgagttcgggattcgtcgatagttcgagaaattagtcgaaggacgcggggcggggtcgtcgtcgtcgttacggggtgttttttttttttcgtttaagttcggttatttggtttttttttcggtttcggtcgttttaggtacgcgggcgtagtttttagcgggcgcggggagggtgttatgtcgttggcgtcgttattagtcggtttcgttgtattttattggggttttggcgttcgcggtttcgtattttgttgtagggttcggcgcgggcgtttgtttgtttttattgttcgcgtcgggaaagttaagtttgttcgcggggaagggatcgttgggttagggttcggtagggttatttcggttaaggttaggattcgaggagaggttgggacgtcgaggttcgtggtcggggtttacggtggggatcggagtgattcggttggtacgtcgggcgttacgtagaagcgttcgggtcgagttcgtagttcgcgttcggtttcgaaattttgtaggcgtcgtttttgggtttaggatttcgagcggtttcggcggagttaggcgagcgcggtttttcggttcgggttcggtgtttttggtttcgggttggggcgtcgggtaggtatttttagtatttttttttcgcggttttgcggggaaatttgcgttttttcgttgtagtttaaagggttcgttgcgtttcgtttggttttggttttttcggggttcgtcgtatgtgaggttggggaggaaggaattagggtacgattcgattttaggtagtttgcggcgttgtttgtgcgtagtcggtcgcggtttagagtgagcggttcggggtattcgtttgaacgtgtttagggagtagtgtgttgggggcgtttagcgttcgggttgggggtttggttttaagagagtttgtattgtggatgattttcgttttttttgcgttcgtaaaataaagacgagttttgagttttaggagg

SEQ ID NO: 32638 - DNA, 1216 bp, Artificial Sequence
  chemically treated genomic DNA (Homo sapiens) CpG-island No: 32638
cctcctaaaactcaaaactcgtctttattttacgaacgcaaaaaaaacgaaaatcatccacaatacaaactctcttaaaaccaaacccccaacccgaacgctaaacgcccccaacacactactccctaaacacgttcaaacgaataccccgaaccgctcactctaaaccgcgaccgactacgcacaaacaacgccgcaaactacctaaaatcgaatcgtaccctaattccttcctccccaacctcacatacgacgaaccccgaaaaaaccaaaaccaaacgaaacgcaacgaaccctttaaactacaacgaaaaaacgcaaatttccccgcaaaaccgcgaaaaaaaaatactaaaaatacctacccgacgccccaacccgaaaccaaaaacaccgaacccgaaccgaaaaaccgcgctcgcctaactccgccgaaaccgctcgaaatcctaaacccaaaaacgacgcctacaaaatttcgaaaccgaacgcgaactacgaactcgacccgaacgcttctacgtaacgcccgacgtaccaaccgaatcactccgatccccaccgtaaaccccgaccacgaacctcgacgtcccaacctctcctcgaatcctaaccttaaccgaaataaccctaccgaaccctaacccaacgatcccttccccgcgaacaaacttaactttcccgacgcgaacaataaaaacaaacaaacgcccgcgccgaaccctacaacaaaatacgaaaccgcgaacgccaaaaccccaataaaatacaacgaaaccgactaataacgacgccaacgacataacaccctccccgcgcccgctaaaaactacgcccgcgtacctaaaacgaccgaaaccgaaaaaaaaaccaaataaccgaacttaaacgaaaaaaaaaaaacaccccgtaacgacgacgacgaccccgccccgcgtccttcgactaatttctcgaactatcgacgaatcccgaactcgctaaaaactattaaaactccaactccctaaaccgccgctacccgctactataccaccgccgccgcgactaccctatttctaccgccgaaaccgaaacccgtaacgtcaccctctaaaccccgcctacccaatcgccgccacctatacgcgccgcccgcccgccaaccgatcaaacccgcgcgacgaccacgacaaatacgcgaaacaaacgaacgcgcacgcgaaacgcgataact

SEQ ID NO: 32639 - DNA, 1216 bp, Artificial Sequence
  chemically treated genomic DNA (Homo sapiens) CpG-island No: 32639
ttttttgaaatttagaattcgtttttgttttgcgggcgtaaagagggcggagattatttatagtgtaagtttttttaggattaagtttttagttcgaacgttgaacgtttttaatatattgttttttagatacgtttaagcgggtatttcgggtcgtttattttggatcgcggtcggttacgtataagtagcgtcgtaggttgtttggagtcgggtcgtgttttgatttttttttttttagttttatatgcggcggatttcggggaagttagggttaggcgaagcgtagcgggttttttgggttgtagcgaggagacgtaagttttttcgtaaagtcgcggggaggaggtgttgagaatgtttgttcggcgttttaattcggagttaagggtatcgggttcgggtcgaggggtcgcgttcgtttggtttcgtcggggtcgttcggggttttgaatttaagaacggcgtttgtaggatttcggagtcgggcgcgagttgcgggttcggttcgagcgtttttgcgtggcgttcggcgtgttaatcgggttatttcggtttttatcgtagatttcggttacgagtttcggcgttttagttttttttcgagttttggttttggtcggggtagttttgtcgagttttggtttagcggtttttttttcgcgggtaaatttggttttttcggcgcgggtagtaaggataagtaagcgttcgcgtcgggttttgtagtaagatgcggggtcgcgggcgttaggattttagtggggtgtagcgggatcggttggtggcggcgttagcgatatggtatttttttcgcgttcgttgggagttgcgttcgcgtatttgagacggtcggggtcgaggggaagattaggtggtcggatttgggcgggagggagggagtatttcgtggcggcggcggcgatttcgtttcgcgtttttcggttggtttttcgggttgtcggcgggtttcgggttcgttggaggttgttgaggttttagttttttgagtcgtcgttgttcgttgttgtgttatcgtcgtcgcggttgttttatttttgtcgtcgggatcggagttcgtgacgttattttttgggtttcgtttgtttaatcgtcgttatttgtgcgcgtcgttcgttcgttagtcggttagattcgcgcggcggttacggtaggtgcgcggagtaggcgggcgcgtacgcggggcgcgatgatt

SEQ ID NO: 32640 - DNA, 1216 bp, Artificial Sequence
  chemically treated genomic DNA (Homo sapiens) CpG-island No: 32640
aatcatcgcgccccgcgtacgcgcccgcctactccgcgcacctaccgtaaccgccgcgcgaatctaaccgactaacgaacgaacgacgcgcacaaataacgacgattaaacaaacgaaacccaaaaaataacgtcacgaactccgatcccgacgacaaaaataaaacaaccgcgacgacgataacacaacaacgaacaacgacgactcaaaaaactaaaacctcaacaacctccaacgaacccgaaacccgccgacaacccgaaaaaccaaccgaaaaacgcgaaacgaaatcgccgccgccgccacgaaatactccctccctcccgcccaaatccgaccacctaatcttcccctcgaccccgaccgtctcaaatacgcgaacgcaactcccaacgaacgcgaaaaaaataccatatcgctaacgccgccaccaaccgatcccgctacaccccactaaaatcctaacgcccgcgaccccgcatcttactacaaaacccgacgcgaacgcttacttatccttactacccgcgccgaaaaaaccaaatttacccgcgaaaaaaaaaccgctaaaccaaaactcgacaaaactaccccgaccaaaaccaaaactcgaaaaaaaactaaaacgccgaaactcgtaaccgaaatctacgataaaaaccgaaataacccgattaacacgccgaacgccacgcaaaaacgctcgaaccgaacccgcaactcgcgcccgactccgaaatcctacaaacgccgttcttaaattcaaaaccccgaacgaccccgacgaaaccaaacgaacgcgacccctcgacccgaacccgatacccttaactccgaattaaaacgccgaacaaacattctcaacacctcctccccgcgactttacgaaaaaacttacgtctcctcgctacaacccaaaaaacccgctacgcttcgcctaaccctaacttccccgaaatccgccgcatataaaactaaaaaaaaaaaaatcaaaacacgacccgactccaaacaacctacgacgctacttatacgtaaccgaccgcgatccaaaataaacgacccgaaatacccgcttaaacgtatctaaaaaacaatatattaaaaacgttcaacgttcgaactaaaaacttaatcctaaaaaaacttacactataaataatctccgccctctttacgcccgcaaaacaaaaacgaattctaaatttcaaaaaa

SEQ ID NO: 32641 - DNA, 787 bp, Artificial Sequence
  chemically treated genomic DNA (Homo sapiens) CpG-island No: 32641
ttttttcggacgttcgttagtcgtttttttttttttatttttatatcgggagcgacgtatattttattcgttttttagtttcgtaggttcggttttttaaagagatatatacgggttatcgatttgtcgttagtcgcgtgttttgtagttgttggtttgattttaggtcgggacgggtagagcggaatattgttcggcgggtttaggtcgatcgtgtttgtggttttcggaataataaattttcggttttagtgatgtgggttagatcggatttggagaggcggtatcggatttttttcgtaattcgtttgggtcgggggagcgtgattcggtcgttatcgtgttatagttggcgattgataaatagtaggcgacgtcgggagaatttttcgagatattcgagatattagttttttcgtttcgcggttttgtaggatttgttcgtcggagtttcggagttcgcggtagtcgtagggttttttttttaggtttttgggttttgaggtaacgcggtcgcgttgttttcgggtttttcgttttattcgttttttttttttttattttttttcgtttttttttttttttgttcgtttatttcgattttttagtaagtatggaagtttagcgaggcgggggattgttcggaggtcgagttttcggtagtttttttcgttttttttttcgttgtgttttcggggttttatttttatttcggcgcggcgttttgtttttattcgaagtttttaaggcggtattttttttttttgtgtggtttttggggttttag

SEQ ID NO: 32642 - DNA, 787 bp, Artificial Sequence
  chemically treated genomic DNA (Homo sapiens) CpG-island No: 32642
ctaaaaccccaaaaaccacacaaaaaaaaaaaataccgccttaaaaacttcgaataaaaacaaaacgccgcgccgaaataaaaataaaaccccgaaaacacaacgaaaaaaaaaacgaaaaaaactaccgaaaactcgacctccgaacaatcccccgcctcgctaaacttccatacttactaaaaaatcgaaataaacgaacaaaaaaaaaaaaaaacgaaaaaaaataaaaaaaaaaaaaacgaataaaacgaaaaacccgaaaacaacgcgaccgcgttacctcaaaacccaaaaacctaaaaaaaaaaccctacgactaccgcgaactccgaaactccgacgaacaaatcctacaaaaccgcgaaacgaaaaaactaatatctcgaatatctcgaaaaattctcccgacgtcgcctactatttatcaatcgccaactataacacgataacgaccgaatcacgctcccccgacccaaacgaattacgaaaaaaatccgataccgcctctccaaatccgatctaacccacatcactaaaaccgaaaatttattattccgaaaaccacaaacacgatcgacctaaacccgccgaacaatattccgctctacccgtcccgacctaaaatcaaaccaacaactacaaaacacgcgactaacgacaaatcgataacccgtatatatctctttaaaaaaccgaacctacgaaactaaaaaacgaataaaatatacgtcgctcccgatataaaaataaaaaaaaaaaaacgactaacgaacgtccgaaaaaa

SEQ ID NO: 32643 - DNA, 787 bp, Artificial Sequence
  chemically treated genomic DNA (Homo sapiens) CpG-island No: 32643
ttaaggttttaagaattatataggagaggggagtgtcgttttggagatttcgggtgggggtagagcgtcgcgtcgaggtggaggtaggatttcgagggtatagcgggaaggaaggcggaggaggttgtcgggagttcggttttcgagtaatttttcgtttcgttgggtttttatgtttgttaaagggtcgagatgaacgggtaagggagagagagggcgaggaaaaataaaaaagagaggggcgagtgggacgaggggttcgggagtagcgcggtcgcgttattttagagtttagaggtttgggggaggggttttacggttgtcgcggatttcggggtttcggcgggtaggttttgtagggtcgcggagcgagaaggttgatgtttcgggtgtttcggggagttttttcgacgtcgtttgttgtttgttagtcgttagttgtgatacggtagcggtcgggttacgttttttcggtttaggcgggttgcgggaggggttcggtgtcgtttttttaggttcggtttggtttatattattggggtcgggggtttattgtttcggagattataggtacggtcggtttggattcgtcgggtagtgtttcgttttgttcgtttcggtttggggttaagttaatagttgtaaggtacgcgattggcggtagatcggtggttcgtgtgtgtttttttaaggggtcgggtttgcgaagttgaggggcgggtggggtgtgcgtcgttttcggtgtgagggtgagagggagagagcggttggcgggcgttcgagggag

SEQ ID NO: 32644 - DNA, 787 bp, Artificial Sequence
  chemically treated genomic DNA (Homo sapiens) CpG-island No: 32644
ctccctcgaacgcccgccaaccgctctctccctctcaccctcacaccgaaaacgacgcacaccccacccgcccctcaacttcgcaaacccgaccccttaaaaaaacacacacgaaccaccgatctaccgccaatcgcgtaccttacaactattaacttaaccccaaaccgaaacgaacaaaacgaaacactacccgacgaatccaaaccgaccgtacctataatctccgaaacaataaacccccgaccccaataatataaaccaaaccgaacctaaaaaaacgacaccgaacccctcccgcaacccgcctaaaccgaaaaaacgtaacccgaccgctaccgtatcacaactaacgactaacaaacaacaaacgacgtcgaaaaaactccccgaaacacccgaaacatcaaccttctcgctccgcgaccctacaaaacctacccgccgaaaccccgaaatccgcgacaaccgtaaaacccctcccccaaacctctaaactctaaaataacgcgaccgcgctactcccgaacccctcgtcccactcgcccctctcttttttatttttcctcgccctctctctcccttacccgttcatctcgaccctttaacaaacataaaaacccaacgaaacgaaaaattactcgaaaaccgaactcccgacaacctcctccgccttccttcccgctataccctcgaaatcctacctccacctcgacgcgacgctctacccccacccgaaatctccaaaacgacactcccctctcctatataattcttaaaaccttaa

SEQ ID NO: 32645 - DNA, 862 bp, Artificial Sequence
  chemically treated genomic DNA (Homo sapiens) CpG-island No: 32645
cgtgtttggtcgggaatatgtcggtatttttaggtgttgtttattgaggttaggtggtacggcgtttttagttatttgggaggaatgtagcgatgtcggcgtttgttatttaggaggcggtagcgttttttttacgggggtttcggaggtcgggtgaatcgtagcgcgaggggtttaggaagcggcggggcgcggcgtatttatttgttggttttaggagcgcgattgtcgtcgagtatttgtcggtcgtttcggcgaattgttcgtttcggaatagttcgttgttttggttttttaggtcggtagggtttttcgcgttttgttcgtcgttcggatgttcggtggcgtcgtcgttcgtcgtcgtcgtcgtagaggttcgtcgtgggtttcgtttgttcgcgtcggttttcggggtttggtttcgttgcggcgcgttttttgtcggtcgtttgtcgttttcggttttgttagttagttttttttggatgttgtttatgacgtacggttgggcggcgcgcgcggttttcgtcggtttcgcgggttttgtgaggaagtggatgcgggaagtgagggtttgtattatcgggagtagttgtcgcggaggtcgcggaggtcgcgggggtgtaggacgcggagggcgggttttagggaagtcggttcgggtatcgtttttgcgggcggagtttgtgttgtcggatttttagagttagtcggtttagttcgttttttcgaggttttttgcggttttttgaggattcggttttcgggtttcggttagaaacgtattttgtttttaattgtttaagcgttgaagggtttgtggttgaaaatcggtattttagagttattttttttattaagt

SEQ ID NO: 32646 - DNA, 862 bp, Artificial Sequence
  chemically treated genomic DNA (Homo sapiens) CpG-island No: 32646
acttaataaaaaaaataactctaaaataccgattttcaaccacaaacccttcaacgcttaaacaattaaaaacaaaatacgtttctaaccgaaacccgaaaaccgaatcctcaaaaaaccgcaaaaaacctcgaaaaaacgaactaaaccgactaactctaaaaatccgacaacacaaactccgcccgcaaaaacgatacccgaaccgacttccctaaaacccgccctccgcgtcctacacccccgcgacctccgcgacctccgcgacaactactcccgataatacaaaccctcacttcccgcatccacttcctcacaaaacccgcgaaaccgacgaaaaccgcgcgcgccgcccaaccgtacgtcataaacaacatccaaaaaaaactaactaacaaaaccgaaaacgacaaacgaccgacaaaaaacgcgccgcaacgaaaccaaaccccgaaaaccgacgcgaacaaacgaaacccacgacgaacctctacgacgacgacgacgaacgacgacgccaccgaacatccgaacgacgaacaaaacgcgaaaaaccctaccgacctaaaaaaccaaaacaacgaactattccgaaacgaacaattcgccgaaacgaccgacaaatactcgacgacaatcgcgctcctaaaaccaacaaataaatacgccgcgccccgccgcttcctaaacccctcgcgctacgattcacccgacctccgaaacccccgtaaaaaaaacgctaccgcctcctaaataacaaacgccgacatcgctacattcctcccaaataactaaaaacgccgtaccacctaacctcaataaacaacacctaaaaataccgacatattcccgaccaaacacg

SEQ ID NO: 32647 - DNA, 862 bp, Artificial Sequence
  chemically treated genomic DNA (Homo sapiens) CpG-island No: 32647
atttgatgaaggggatggttttgagatgtcggtttttagttataggttttttagcgtttaaatagttagagatagggtacgtttttggtcgaaattcgggagtcgagtttttaggaagtcgtagggggtttcgagggagcggattgggtcgattggttttagaggttcggtagtataggtttcgttcgtaggggcggtgttcgagtcggtttttttagagttcgtttttcgcgttttgtattttcgcggttttcgcggttttcgcggtaattgttttcggtgatgtaaatttttatttttcgtatttatttttttatagagttcgcggagtcggcgggagtcgcgcgcgtcgtttagtcgtgcgttatgggtaatatttagaagaagttgattggtaaagtcgaaggcggtaagcggtcggtaaggggcgcgtcgtagcggggttagatttcggaggtcggcgcggataagcggagtttacggcgggtttttgcggcggcggcggcgggcggcggcgttatcgggtattcgggcggcgggtagggcgcggagaattttgtcggtttgaagagttagggtaacgagttgtttcgaagcgggtagttcgtcgaggcggtcggtaagtattcggcggtaatcgcgtttttggagttagtaggtaggtgcgtcgcgtttcgtcgttttttgggtttttcgcgttgcggtttattcgattttcggggttttcgtgggagaggcgttgtcgttttttgaatgataggcgtcggtatcgttgtattttttttaggtgattaagagcgtcgtgttatttgattttagtgagtagtatttgggaatgtcggtatgttttcggttaggtacg

SEQ ID NO: 32648 - DNA, 862 bp, Artificial Sequence
  chemically treated genomic DNA (Homo sapiens) CpG-island No: 32648
cgtacctaaccgaaaacataccgacattcccaaatactactcactaaaatcaaataacacgacgctcttaatcacctaaaaaaaatacaacgataccgacgcctatcattcaaaaaacgacaacgcctctcccacgaaaaccccgaaaatcgaataaaccgcaacgcgaaaaacccaaaaaacgacgaaacgcgacgcacctacctactaactccaaaaacgcgattaccgccgaatacttaccgaccgcctcgacgaactacccgcttcgaaacaactcgttaccctaactcttcaaaccgacaaaattctccgcgccctacccgccgcccgaatacccgataacgccgccgcccgccgccgccgccgcaaaaacccgccgtaaactccgcttatccgcgccgacctccgaaatctaaccccgctacgacgcgccccttaccgaccgcttaccgccttcgactttaccaatcaacttcttctaaatattacccataacgcacgactaaacgacgcgcgcgactcccgccgactccgcgaactctataaaaaaataaatacgaaaaataaaaatttacatcaccgaaaacaattaccgcgaaaaccgcgaaaaccgcgaaaatacaaaacgcgaaaaacgaactctaaaaaaaccgactcgaacaccgcccctacgaacgaaacctatactaccgaacctctaaaaccaatcgacccaatccgctccctcgaaaccccctacgacttcctaaaaactcgactcccgaatttcgaccaaaaacgtaccctatctctaactatttaaacgctaaaaaacctataactaaaaaccgacatctcaaaaccatccccttcatcaaat

SEQ ID NO: 32649 - DNA, 650 bp, Artificial Sequence
  chemically treated genomic DNA (Homo sapiens) CpG-island No: 32649
cgacgagagaaggagcgggatcggaagaggaagcgaaagagttgcggtaaaaagggaagggagtaaaggttaaggtcgagagggtcgagggtcggggcggcgattaagtttatttagaggtggtttgtaaggagtcgtaggagtcgtcggggttggtcgtttataaggtggaggtgaatgagtacgagtcggttagtaaggcgtaaagaggaggaataggtaggagttgaaggggagtttcgcgtagcggaaagggaggaagttcgggcgttgttgaatttcggggtcgggattagcggaaggtacgagagttggaggttaacgtgaaggggtcgcggatagatttgtcgaattaggcggagggcgcgataattcggaacgtttagcgtttgttttaggggtttgaggcgtagggagaagcgcgggagcggcggcggcggcgtcgttagcgggaggagcgcggggcggacgaggtggagaagaagcggcggcgttaaaatttaagtaggaagaaggcggttagtttttcgcgttttttgtattgggttcgtaaggggacgatttcgtttaggatttggagcgcgtcggtttcgtgggggcgttcgagggtttttttttttttttattttaggtttagcgtgtttttggtt

SEQ ID NO: 32650 - DNA, 650 bp, Artificial Sequence
  chemically treated genomic DNA (Homo sapiens) CpG-island No: 32650
aaccaaaaacacgctaaacctaaaataaaaaaaaaaaaaaaccctcgaacgcccccacgaaaccgacgcgctccaaatcctaaacgaaatcgtccccttacgaacccaatacaaaaaacgcgaaaaactaaccgccttcttcctacttaaattttaacgccgccgcttcttctccacctcgtccgccccgcgctcctcccgctaacgacgccgccgccgccgctcccgcgcttctccctacgcctcaaacccctaaaacaaacgctaaacgttccgaattatcgcgccctccgcctaattcgacaaatctatccgcgaccccttcacgttaacctccaactctcgtaccttccgctaatcccgaccccgaaattcaacaacgcccgaacttcctccctttccgctacgcgaaactccccttcaactcctacctattcctcctctttacgccttactaaccgactcgtactcattcacctccaccttataaacgaccaaccccgacgactcctacgactccttacaaaccacctctaaataaacttaatcgccgccccgaccctcgaccctctcgaccttaacctttactcccttccctttttaccgcaactctttcgcttcctcttccgatcccgctccttctctcgtcg

SEQ ID NO: 32651 - DNA, 650 bp, Artificial Sequence
  chemically treated genomic DNA (Homo sapiens) CpG-island No: 32651
ggttagggatacgttgggtttggggtgggggaaggggggagttttcgggcgtttttacgaggtcggcgcgttttaggttttggacgggatcgtttttttgcgggtttagtgtagggagcgcggggagttggtcgttttttttttgtttaggttttggcgtcgtcgttttttttttatttcgttcgtttcgcgtttttttcgttggcggcgtcgtcgtcgtcgttttcgcgtttttttttgcgttttaagtttttagggtaggcgttaggcgtttcggattgtcgcgtttttcgtttggttcggtaggtttgttcgcggtttttttacgttggtttttagttttcgtgtttttcgttggtttcggtttcggagtttagtagcgttcggatttttttttttttcgttgcgcgaggtttttttttagtttttgtttgttttttttttttgcgttttgttggtcggttcgtgtttatttatttttattttgtggacgattagtttcgacggtttttgcggttttttgtaggttatttttgggtgggtttgatcgtcgtttcggttttcggttttttcggttttggtttttgtttttttttttttttgtcgtagttttttcgttttttttttcggtttcgttttttttttcgtcg

SEQ ID NO: 32652 - DNA, 650 bp, Artificial Sequence
  chemically treated genomic DNA (Homo sapiens) CpG-island No: 32652
cgacgaaaaaaaaaacgaaaccgaaaaaaaaaacgaaaaaactacgacaaaaaaaaaaaaaaacaaaaaccaaaaccgaaaaaaccgaaaaccgaaacgacgatcaaacccacccaaaaataacctacaaaaaaccgcaaaaaccgtcgaaactaatcgtccacaaaataaaaataaataaacacgaaccgaccaacaaaacgcaaaaaaaaaaaacaaacaaaaactaaaaaaaaacctcgcgcaacgaaaaaaaaaaaaatccgaacgctactaaactccgaaaccgaaaccaacgaaaaacacgaaaactaaaaaccaacgtaaaaaaaccgcgaacaaacctaccgaaccaaacgaaaaacgcgacaatccgaaacgcctaacgcctaccctaaaaacttaaaacgcaaaaaaaaacgcgaaaacgacgacgacgacgccgccaacgaaaaaaacgcgaaacgaacgaaataaaaaaaaaacgacgacgccaaaacctaaacaaaaaaaaaacgaccaactccccgcgctccctacactaaacccgcaaaaaaacgatcccgtccaaaacctaaaacgcgccgacctcgtaaaaacgcccgaaaactccccccttcccccaccccaaacccaacgtatccctaacc

SEQ ID NO: 32653 - DNA, 539 bp, Artificial Sequence
  chemically treated genomic DNA (Homo sapiens) CpG-island No: 32653
  misc_feature (521)..(523): n is either a, c, g or t
  misc_feature (526)..(526): n is either a, c, g or t
  misc_feature (534)..(534): n is either a, c, g or t
agagtatcgtcgatgaatttttagttttgttaaaatagtaggcgtaaaattggtagtcgggttatttatttgatttcgtaattattatgggtattttaatcgattgcgtttacgtcgattcggtttatagttttattcgggaaggcgaaagtaaagggtaattgttgttggatggtcgtaacgtcgggttggttgtcgttatcggttcgattatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgatttttttcgcgcgtatcgtatgagtcgacgtttgaaagtcggtttcgttttcgttaataattataacgacggcgatatgatcgtgtcgtttggcggttataagtagagcggtaacggtcgcgataaatttttgtatgtttttgaaaaatttattgannnatntggagaanatttt

SEQ ID NO: 32654 - DNA, 539 bp, Artificial Sequence
  chemically treated genomic DNA (Homo sapiens) CpG-island No: 32654
  misc_feature (6)..(6): n is either a, c, g or t
  misc_feature (14)..(14): n is either a, c, g or t
  misc_feature (17)..(19): n is either a, c, g or t
aaaatnttctccanatnnntcaataaatttttcaaaaacatacaaaaatttatcgcgaccgttaccgctctacttataaccgccaaacgacacgatcatatcgccgtcgttataattattaacgaaaacgaaaccgactttcaaacgtcgactcatacgatacgcgcgaaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaataatcgaaccgataacgacaaccaacccgacgttacgaccatccaacaacaattaccctttactttcgccttcccgaataaaactataaaccgaatcgacgtaaacgcaatcgattaaaatacccataataattacgaaatcaaataaataacccgactaccaattttacgcctactattttaacaaaactaaaaattcatcgacgatactct

SEQ ID NO: 32655 - DNA, 539 bp, Artificial Sequence
  chemically treated genomic DNA (Homo sapiens) CpG-island No: 32655
  misc_feature (6)..(6): n is either a, c, g or t
  misc_feature (14)..(14): n is either a, c, g or t
  misc_feature (17)..(19): n is either a, c, g or t
ggggtnttttttangtnnnttagtgaattttttaagggtatgtagggatttgtcgcgatcgttgtcgttttgtttatagtcgttaaacggtacggttatatcgtcgtcgttgtagttattgacgaagacggaatcggtttttaggcgtcggtttatgcggtgcgcgcgggagaggtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatggtcgggtcgatggcggtagttagttcggcgttacggttatttaataatagttgttttttgttttcgttttttcgaataaagttatggatcgagtcggcgtgggcgtagtcgattaaggtgtttatggtggttgcgggattaagtggatggttcggttgttagttttgcgtttgttgttttaatagggttaagaatttatcggcgatgtttt

SEQ ID NO: 32656 - DNA, 539 bp, Artificial Sequence
  chemically treated genomic DNA (Homo sapiens) CpG-island No: 32656
  misc_feature (521)..(523): n is either a, c, g or t
  misc_feature (526)..(526): n is either a, c, g or t
  misc_feature (534)..(534): n is either a, c, g or t
aaaacatcgccgataaattcttaaccctattaaaacaacaaacgcaaaactaacaaccgaaccatccacttaatcccgcaaccaccataaacaccttaatcgactacgcccacgccgactcgatccataactttattcgaaaaaacgaaaacaaaaaacaactattattaaataaccgtaacgccgaactaactaccgccatcgacccgaccatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgacctctcccgcgcgcaccgcataaaccgacgcctaaaaaccgattccgtcttcgtcaataactacaacgacgacgatataaccgtaccgtttaacgactataaacaaaacgacaacgatcgcgacaaatccctacatacccttaaaaaattcactaannnacntaaaaaanacccc

SEQ ID NO: 32657 - DNA, 528 bp, Artificial Sequence
  chemically treated genomic DNA (Homo sapiens) CpG-island No: 32657
gtggcgtttttttcggattcggggttgggagggtggcggtgagattattttcggtcggaggttttgattcgggcggaatacgtttgtaaagtcgttcgagtttcggtggttcgtttttttcggcgttttcgtttttatcggagacgtttaggtcgatttttttatttttattagtcgatagttttcgggaataaagtgtatagagagttttttttttcgttttattatgttcgtcgtttttacgtcgtagttttagcggtcgttattttttttaatttaggatcgacgcgggttttagtttagacgttttcggttcgttttttttaggtttagaacgatttcgttcgtcgttttcggttttcgttgttatagtcgcgttcgttgattggttacgtttcgtcgacgttttagaaagagggcgggtacgcgcggtttgtttttagtttacgcgtcgatgtttaaagcgatatataaaagaaaggttttgattttaggtagtgaatttaggttttgtttcggagattttat

SEQ ID NO: 32658 - DNA, 528 bp, Artificial Sequence
  chemically treated genomic DNA (Homo sapiens) CpG-island No: 32658
ataaaatctccgaaacaaaacctaaattcactacctaaaatcaaaacctttcttttatatatcgctttaaacatcgacgcgtaaactaaaaacaaaccgcgcgtacccgccctctttctaaaacgtcgacgaaacgtaaccaatcaacgaacgcgactataacaacgaaaaccgaaaacgacgaacgaaatcgttctaaacctaaaaaaaacgaaccgaaaacgtctaaactaaaacccgcgtcgatcctaaattaaaaaaaataacgaccgctaaaactacgacgtaaaaacgacgaacataataaaacgaaaaaaaaaactctctatacactttattcccgaaaactatcgactaataaaaataaaaaaatcgacctaaacgtctccgataaaaacgaaaacgccgaaaaaaacgaaccaccgaaactcgaacgactttacaaacgtattccgcccgaatcaaaacctccgaccgaaaataatctcaccgccaccctcccaaccccgaatccgaaaaaaacgccac

SEQ ID NO: 32659 - DNA, 528 bp, Artificial Sequence
  chemically treated genomic DNA (Homo sapiens) CpG-island No: 32659
ataaaattttcgaaataaaatttgaatttattgtttaaggttagggttttttttttgtgtgtcgttttaagtatcggcgcgtgggttgggggtagatcgcgcgtattcgttttttttttggggcgtcggcggagcgtggttaattaacgggcgcggttatggtagcggaagtcggaagcggcgagcggggtcgttttgggtttaggggaggcgggtcgagggcgtttgagttgaggttcgcgtcgattttgggttggaggaggtggcggtcgttgaggttgcggcgtgaagacggcgggtatggtggggcgggagaaagagttttttatatattttgttttcgggagttgtcggttggtggaggtgagggagtcggtttgggcgttttcggtgggagcgggggcgtcgagggggacgagttatcggggttcgggcggttttgtaggcgtatttcgttcgggttagagttttcggtcgggagtggttttatcgttatttttttagtttcggattcgaggggggcgttat

SEQ ID NO: 32660 - DNA, 528 bp, Artificial Sequence
  chemically treated genomic DNA (Homo sapiens) CpG-island No: 32660
ataacgcccccctcgaatccgaaactaaaaaaataacgataaaaccactcccgaccgaaaactctaacccgaacgaaatacgcctacaaaaccgcccgaaccccgataactcgtccccctcgacgcccccgctcccaccgaaaacgcccaaaccgactccctcacctccaccaaccgacaactcccgaaaacaaaatatataaaaaactctttctcccgccccaccatacccgccgtcttcacgccgcaacctcaacgaccgccacctcctccaacccaaaatcgacgcgaacctcaactcaaacgccctcgacccgcctcccctaaacccaaaacgaccccgctcgccgcttccgacttccgctaccataaccgcgcccgttaattaaccacgctccgccgacgccccaaaaaaaaaacgaatacgcgcgatctacccccaacccacgcgccgatacttaaaacgacacacaaaaaaaaaaccctaaccttaaacaataaattcaaattttatttcgaaaattttat

SEQ ID NO: 32661 - DNA, 584 bp, Artificial Sequence
  chemically treated genomic DNA (Homo sapiens) CpG-island No: 32661
cgcggggagcggggtcgggtaggagagtaggcggggaagttttgtttgtcgtagtttcgacggtggcgggaggcgagtgagttattgtaggtataggcgtcggtttagttagcgcgtttttttttcgttttttggaagtttcgcggttattttgggtaggtagagttcgtgtcggtttttttttcgcggtggtcgagtgcgggagtgcgtcgagttttttcggtagtatagttaggttgttttggaggtatttttagtagtagcggttttgcgttttcgtcgtcgcgtagttcgttttcgtttgggtttttgtcgttgtagttgcgggtatcggcggtttttgttcgggattgtttttcgattcgtcgtttttttcgggcgttttacgggagtcgttgttcgggagtttattgtaagttgcgtcggcggttttggttgttgtatttgttggtttttttttcggttttttttcgcgtcgtcgtcgtttgggttgttgttggggcggtttttttcggcgcgcgtttcgcggggagtagggcgtagttttttttgtattgggggcggtcgcgggcggttcgcggggt

SEQ ID NO: 32662 - DNA, 584 bp, Artificial Sequence
  chemically treated genomic DNA (Homo sapiens) CpG-island No: 32662
accccgcgaaccgcccgcgaccgcccccaatacaaaaaaaactacgccctactccccgcgaaacgcgcgccgaaaaaaaccgccccaacaacaacccaaacgacgacgacgcgaaaaaaaaccgaaaaaaaaaccaacaaatacaacaaccaaaaccgccgacgcaacttacaataaactcccgaacaacgactcccgtaaaacgcccgaaaaaaacgacgaatcgaaaaacaatcccgaacaaaaaccgccgatacccgcaactacaacgacaaaaacccaaacgaaaacgaactacgcgacgacgaaaacgcaaaaccgctactactaaaaatacctccaaaacaacctaactatactaccgaaaaaactcgacgcactcccgcactcgaccaccgcgaaaaaaaaaccgacacgaactctacctacccaaaataaccgcgaaacttccaaaaaacgaaaaaaaaacgcgctaactaaaccgacgcctatacctacaataactcactcgcctcccgccaccgtcgaaactacgacaaacaaaacttccccgcctactctcctacccgaccccgctccccgcg

SEQ ID NO: 32663 - DNA, 584 bp, Artificial Sequence
  chemically treated genomic DNA (Homo sapiens) CpG-island No: 32663
atttcgcgagtcgttcgcggtcgtttttagtgtagggggagttgcgttttgtttttcgcgaggcgcgcgtcggggggagtcgttttagtagtagtttaggcggcggcggcgcgagaaggagtcggaggaggagttagtaggtgtagtagttagagtcgtcgacgtagtttgtaatggattttcgggtagcgattttcgtagggcgttcgggaagggcggcggatcgaagggtagtttcggatagaggtcgtcggtgttcgtagttgtagcggtaggggtttaggcgagagcgagttgcgcggcggcgaagacgtagggtcgttgttgttgggaatgtttttagaataatttggttgtattgtcgggagagttcggcgtattttcgtattcggttatcgcggaggagaagtcggtacgggttttgtttgtttaggatgatcgcggggtttttagggagcgggaagaaggcgcgttagttgagtcggcgtttgtgtttgtagtggtttattcgtttttcgttatcgtcgaggttgcgataagtagggttttttcgtttgtttttttgttcggtttcgtttttcgcg

SEQ ID NO: 32664 - DNA, 584 bp, Artificial Sequence
  chemically treated genomic DNA (Homo sapiens) CpG-island No: 32664
cgcgaaaaacgaaaccgaacaaaaaaacaaacgaaaaaaccctacttatcgcaacctcgacgataacgaaaaacgaataaaccactacaaacacaaacgccgactcaactaacgcgccttcttcccgctccctaaaaaccccgcgatcatcctaaacaaacaaaacccgtaccgacttctcctccgcgataaccgaatacgaaaatacgccgaactctcccgacaatacaaccaaattattctaaaaacattcccaacaacaacgaccctacgtcttcgccgccgcgcaactcgctctcgcctaaacccctaccgctacaactacgaacaccgacgacctctatccgaaactacccttcgatccgccgcccttcccgaacgccctacgaaaatcgctacccgaaaatccattacaaactacgtcgacgactctaactactacacctactaactcctcctccgactccttctcgcgccgccgccgcctaaactactactaaaacgactccccccgacgcgcgcctcgcgaaaaacaaaacgcaactccccctacactaaaaacgaccgcgaacgactcgcgaaat

SEQ ID NO: 32665 - DNA, 881 bp, Artificial Sequence
  chemically treated genomic DNA (Homo sapiens) CpG-island No: 32665
agaacggcggcgcggcggacgttgttgcggtaggacgtgttcgattttttagtttatataagggagcgtatcgtttaagtggttcgcggttcgttcgatcgagcgcgtcgttgtcggtttttgcgttaacgcgtacgcgcggtcgttattcgggtgttggcggttgttgttgtaggttgcgttagggtggcggatcgggggaggggttagcggtttattgtgcgtagcgttgcgcggcgtcggcggtcgtcgaggtttgggtggaagttggcgttgttgtcgtcgttttgtagtttattcgttgtttcggtagcgcgttgtttttttaagatggttgtcgttatcggtgcggtggtagtttcggtcgtttcgggttaggcggaaggtaaaaagattatcgatttgcgggttatcgatttgaagttcgagttgaagcggcggaatttagatattatcggagttaagatcgtgtttatttttcgatttaagtaggtgaggttcggcgaggatcggaaaggatcgggaaggggaatttaggtcgcgtttcggcgtttcgttttcgtcgtagttttcggttgttcgtagtcgttgggatttgcggaacggtatggtagggaggttaggggcggttttcgcgagcgtggaggacggggattttttcgcggtgttttcgtttcgcgtttcgggtcgggtcgggtttgcgagggatcggttatcgtagtttagcgtgttttcgttttttcgggacgttttcgttaggttgcgagggttgcggtcggtcggcgcggttttttaagggcgatcgcggagatttgggaggcgttggttttttagtttttagttatggtgagcgtgtgtattttttggttttagagggaatg

SEQ ID NO: 32666 - DNA, 881 bp, Artificial Sequence
  chemically treated genomic DNA (Homo sapiens) CpG-island No: 32666
cattccctctaaaaccaaaaaatacacacgctcaccataactaaaaactaaaaaaccaacgcctcccaaatctccgcgatcgcccttaaaaaaccgcgccgaccgaccgcaaccctcgcaacctaacgaaaacgtcccgaaaaaacgaaaacacgctaaactacgataaccgatccctcgcaaacccgacccgacccgaaacgcgaaacgaaaacaccgcgaaaaaatccccgtcctccacgctcgcgaaaaccgcccctaacctccctaccataccgttccgcaaatcccaacgactacgaacaaccgaaaactacgacgaaaacgaaacgccgaaacgcgacctaaattccccttcccgatcctttccgatcctcgccgaacctcacctacttaaatcgaaaaataaacacgatcttaactccgataatatctaaattccgccgcttcaactcgaacttcaaatcgataacccgcaaatcgataatctttttaccttccgcctaacccgaaacgaccgaaactaccaccgcaccgataacgacaaccatcttaaaaaaacaacgcgctaccgaaacaacgaataaactacaaaacgacgacaacaacgccaacttccacccaaacctcgacgaccgccgacgccgcgcaacgctacgcacaataaaccgctaacccctcccccgatccgccaccctaacgcaacctacaacaacaaccgccaacacccgaataacgaccgcgcgtacgcgttaacgcaaaaaccgacaacgacgcgctcgatcgaacgaaccgcgaaccacttaaacgatacgctcccttatataaactaaaaaatcgaacacgtcctaccgcaacaacgtccgccgcgccgccgttct

SEQ ID NO: 32667 - DNA, 881 bp, Artificial Sequence
  chemically treated genomic DNA (Homo sapiens) CpG-island No: 32667
tattttttttgaggttaagaaatgtatacgtttattatggttaaaggttggggagttagcgttttttaggttttcgcgatcgtttttgggaggtcgcgtcggtcggtcgtaattttcgtagtttggcggggacgtttcggggaggcggaggtacgttgggttgcggtggtcggtttttcgtaggttcggttcggttcggggcgcggggcgggggtatcgcggaagggttttcgttttttacgttcgcgggagtcgtttttggtttttttattatgtcgtttcgtaggttttagcggttgcgggtagtcggaggttgcggcggaagcggggcgtcgaggcgcggtttaagttttttttttcggtttttttcggttttcgtcgggttttatttgtttgagtcgggagatgagtacggttttgatttcggtgatgtttaagtttcgtcgttttagttcggattttagatcgatgattcgtagatcggtgatttttttatttttcgtttgattcgaggcggtcgaggttgttatcgtatcggtagcggtagttattttagaagagtagcgcgttgtcgaggtagcgagtgggttgtagggcggcggtagtagcgttaatttttatttaggtttcggcggtcgtcggcgtcgcgtagcgttgcgtataatgagtcgttggtttttttttcggttcgttattttagcgtaatttgtagtagtagtcgttagtattcggatgacggtcgcgcgtgcgcgttggcgtagggatcggtagcggcgcgttcggtcgagcgggtcgcgggttatttgggcggtgcgtttttttgtgtggattgggaggtcgggtacgttttatcgtagtaacgttcgtcgcgtcgtcgtttt

SEQ ID NO: 32668 - DNA, 881 bp, Artificial Sequence
  chemically treated genomic DNA (Homo sapiens) CpG-island No: 32668
aaaacgacgacgcgacgaacgttactacgataaaacgtacccgacctcccaatccacacaaaaaaacgcaccgcccaaataacccgcgacccgctcgaccgaacgcgccgctaccgatccctacgccaacgcgcacgcgcgaccgtcatccgaatactaacgactactactacaaattacgctaaaataacgaaccgaaaaaaaaaccaacgactcattatacgcaacgctacgcgacgccgacgaccgccgaaacctaaataaaaattaacgctactaccgccgccctacaacccactcgctacctcgacaacgcgctactcttctaaaataactaccgctaccgatacgataacaacctcgaccgcctcgaatcaaacgaaaaataaaaaaatcaccgatctacgaatcatcgatctaaaatccgaactaaaacgacgaaacttaaacatcaccgaaatcaaaaccgtactcatctcccgactcaaacaaataaaacccgacgaaaaccgaaaaaaaccgaaaaaaaaaacttaaaccgcgcctcgacgccccgcttccgccgcaacctccgactacccgcaaccgctaaaacctacgaaacgacataataaaaaaaccaaaaacgactcccgcgaacgtaaaaaacgaaaacccttccgcgatacccccgccccgcgccccgaaccgaaccgaacctacgaaaaaccgaccaccgcaacccaacgtacctccgcctccccgaaacgtccccgccaaactacgaaaattacgaccgaccgacgcgacctcccaaaaacgatcgcgaaaacctaaaaaacgctaactccccaacctttaaccataataaacgtatacatttcttaacctcaaaaaaaata

SEQ ID NO: 32669 - DNA, 710 bp, Artificial Sequence
  chemically treated genomic DNA (Homo sapiens) CpG-island No: 32669
tgcgtagcgcggggcgcgttttcgaaggtgttcgtcgggggagtgtgggcgtgcgtacgtgcggcggcgatggtcgcgggtcgggtggtcgcggtgtaggtttcgtgttttttatttttttcgtttcggtgttgattggttcggcgtcgtgacgggtcggttttcgttcggggcggcggcggcggcggcgggcgcgggtgttcgcgtgtgcgttgggagtcgcgtgtgcgtcggggtgtgcgttcggtcgggtgtgcggagagcgagggagcgcgttttttttcgacgcgcgggtcgtcgcggttaagttcgagggtgcgtggcgttttcgttcgttcggttcggttatggttttcgttcggggtcgtttgttttttgcgttttgggtcgttacggtcgcggcggcggcggttatttgcgtgttcgcggcgcgcggcgaaggtgagcggcggcggcggggcggggtaggggcggtcgaggggcgcggggcgcggcgcgcgttgtttgcggtttaattttttttgtatggattttgagttttaaggcggtcgggatttttcggttcggggggcggggtggtatcgcggaagagattcgggattaagggatagagcggtggagatgggaattcgcgagtttgaggaagacggataggtatcggggattgggggatagtgggaaaggataggagataggattgagggatgtgt

SEQ ID NO: 32670 - DNA, 710 bp, Artificial Sequence
  chemically treated genomic DNA (Homo sapiens) CpG-island No: 32670
acacatccctcaatcctatctcctatcctttcccactatcccccaatccccgatacctatccgtcttcctcaaactcgcgaattcccatctccaccgctctatcccttaatcccgaatctcttccgcgataccaccccgccccccgaaccgaaaaatcccgaccgccttaaaactcaaaatccatacaaaaaaaattaaaccgcaaacaacgcgcgccgcgccccgcgcccctcgaccgcccctaccccgccccgccgccgccgctcaccttcgccgcgcgccgcgaacacgcaaataaccgccgccgccgcgaccgtaacgacccaaaacgcaaaaaacaaacgaccccgaacgaaaaccataaccgaaccgaacgaacgaaaacgccacgcaccctcgaacttaaccgcgacgacccgcgcgtcgaaaaaaaacgcgctccctcgctctccgcacacccgaccgaacgcacaccccgacgcacacgcgactcccaacgcacacgcgaacacccgcgcccgccgccgccgccgccgccccgaacgaaaaccgacccgtcacgacgccgaaccaatcaacaccgaaacgaaaaaaataaaaaacacgaaacctacaccgcgaccacccgacccgcgaccatcgccgccgcacgtacgcacgcccacactcccccgacgaacaccttcgaaaacgcgccccgcgctacgca

SEQ ID NO: 32671 - DNA, 710 bp, Artificial Sequence
  chemically treated genomic DNA (Homo sapiens) CpG-island No: 32671
gtatattttttagttttgttttttgtttttttttattgttttttagttttcggtatttgttcgttttttttaagttcgcgggtttttatttttatcgttttgttttttaatttcgggtttttttcgcggtgttatttcgtttttcgggtcgagggatttcggtcgttttggagtttagggtttatgtaaaggaagttgagtcgtaggtagcgcgcgtcgcgtttcgcgtttttcggtcgtttttgtttcgtttcgtcgtcgtcgtttattttcgtcgcgcgtcgcggatacgtaggtggtcgtcgtcgtcgcggtcgtgacgatttagagcgtagggggtaggcggtttcgggcgggggttatggtcgggtcgggcgggcgggggcgttacgtattttcgggtttggtcgcggcggttcgcgcgtcgggagggagcgcgttttttcgtttttcgtatattcggtcgggcgtatatttcggcgtatacgcggtttttagcgtatacgcgggtattcgcgttcgtcgtcgtcgtcgtcgtttcgggcgggggtcggttcgttacggcgtcgagttaattagtatcgaggcggggggggtgggggatacggagtttgtatcgcggttattcggttcgcggttatcgtcgtcgtacgtgcgtacgtttatattttttcggcgggtattttcgggggcgcgtttcgcgttgcgta

SEQ ID NO: 32672 - DNA, 710 bp, Artificial Sequence
  chemically treated genomic DNA (Homo sapiens) CpG-island No: 32672
tacgcaacgcgaaacgcgcccccgaaaatacccgccgaaaaaatataaacgtacgcacgtacgacgacgataaccgcgaaccgaataaccgcgatacaaactccgtatcccccaccccccccgcctcgatactaattaactcgacgccgtaacgaaccgacccccgcccgaaacgacgacgacgacgacgaacgcgaatacccgcgtatacgctaaaaaccgcgtatacgccgaaatatacgcccgaccgaatatacgaaaaacgaaaaaacgcgctccctcccgacgcgcgaaccgccgcgaccaaacccgaaaatacgtaacgcccccgcccgcccgacccgaccataacccccgcccgaaaccgcctaccccctacgctctaaatcgtcacgaccgcgacgacgacgaccacctacgtatccgcgacgcgcgacgaaaataaacgacgacgacgaaacgaaacaaaaacgaccgaaaaacgcgaaacgcgacgcgcgctacctacgactcaacttcctttacataaaccctaaactccaaaacgaccgaaatccctcgacccgaaaaacgaaataacaccgcgaaaaaaacccgaaattaaaaaacaaaacgataaaaataaaaacccgcgaacttaaaaaaaacgaacaaataccgaaaactaaaaaacaataaaaaaaaacaaaaaacaaaactaaaaaatatac

SEQ ID NO: 32673 - DNA, 711 bp, Artificial Sequence
  chemically treated genomic DNA (Homo sapiens) CpG-island No: 32673
gggttagagattgggaacggtaatgtcggttagacgggttcgagcgtttcgggagttttagttttttttcggttgcggggtcgttgtttttgttttcgggtcgttacggagttttgagggagggggcgggcgagcgggggttttggggcggttagggcgttgggagggaggattgggcggtggggatcggaggggagggagggttttggaggcggagaggagggacgggttgggagagggttcggattaggggcggcgggtatcgtaggagtttcgcgcggttgtagcgcgggcgggagcggggacgcgatgtcgtcgtcgtcgtttttttgcgggtcggggttgcgttttcggggttgagtcgtcgttagagtcgatagtcgagtagtcgttgggcgttttcgcggcgtaggaggatgggttgcggcgggagtcgggcggatgttatcgagtttcgttattacgagagttggattcgggagatagaatttatttggtttatttatatcgattcggacgcgtcgtttagcgtcgtcgtttcggatagcggtttcgaagcgggcggtttgtattcgggtaagtggtcgggtttttgtagattttcgttcgttcgttatttcgggcgttttggttcgggtattgagagaggagtcggttttttgaggaattgatggcgcggcgggggtggttgggaggaagtagaggtaggat

SEQ ID NO: 32674 - DNA, 711 bp, Artificial Sequence
  chemically treated genomic DNA (Homo sapiens) CpG-island No: 32674
atcctacctctacttcctcccaaccacccccgccgcgccatcaattcctcaaaaaaccgactcctctctcaatacccgaaccaaaacgcccgaaataacgaacgaacgaaaatctacaaaaacccgaccacttacccgaatacaaaccgcccgcttcgaaaccgctatccgaaacgacgacgctaaacgacgcgtccgaatcgatataaataaaccaaataaattctatctcccgaatccaactctcgtaataacgaaactcgataacatccgcccgactcccgccgcaacccatcctcctacgccgcgaaaacgcccaacgactactcgactatcgactctaacgacgactcaaccccgaaaacgcaaccccgacccgcaaaaaaacgacgacgacgacatcgcgtccccgctcccgcccgcgctacaaccgcgcgaaactcctacgatacccgccgcccctaatccgaaccctctcccaacccgtccctcctctccgcctccaaaaccctccctcccctccgatccccaccgcccaatcctccctcccaacgccctaaccgccccaaaacccccgctcgcccgccccctccctcaaaactccgtaacgacccgaaaacaaaaacaacgaccccgcaaccgaaaaaaaactaaaactcccgaaacgctcgaacccgtctaaccgacattaccgttcccaatctctaaccc

SEQ ID NO: 32675 - DNA, 711 bp, Artificial Sequence
  chemically treated genomic DNA (Homo sapiens) CpG-island No: 32675
gttttgtttttgtttttttttagttattttcgtcgcgttattaattttttagggaatcggttttttttttagtgttcgggttaaggcgttcggggtagcgggcgggcgagggtttgtaggggttcggttatttattcgagtgtaggtcgttcgtttcggggtcgttgttcggggcggcggcgttgggcggcgcgttcgagtcggtgtaggtgagttaggtggattttgtttttcgggtttagttttcgtagtagcggggttcgatggtattcgttcggttttcgtcgtagtttatttttttgcgtcgcgggagcgtttagcggttgttcggttgtcggttttggcggcggtttagtttcggaggcgtagtttcggttcgtaaggaggcggcggcggcgatatcgcgttttcgttttcgttcgcgttgtagtcgcgcggagtttttgcggtgttcgtcgtttttagttcgggtttttttttagttcgtttttttttttcgtttttaaggttttttttttttttcggtttttatcgtttagtttttttttttagcgttttggtcgttttaaggttttcgttcgttcgtttttttttttagggtttcgtgacggttcgggagtaggagtagcggtttcgtagtcggaggagggttggggttttcgaggcgttcggattcgtttggtcggtattatcgtttttagtttttggttt

SEQ ID NO: 32676 - DNA, 711 bp, Artificial Sequence
  chemically treated genomic DNA (Homo sapiens) CpG-island No: 32676
aaaccaaaaactaaaaacgataataccgaccaaacgaatccgaacgcctcgaaaaccccaaccctcctccgactacgaaaccgctactcctactcccgaaccgtcacgaaaccctaaaaaaaaaaacgaacgaacgaaaaccttaaaacgaccaaaacgctaaaaaaaaaaactaaacgataaaaaccgaaaaaaaaaaaaaaccttaaaaacgaaaaaaaaaaacgaactaaaaaaaaacccgaactaaaaacgacgaacaccgcaaaaactccgcgcgactacaacgcgaacgaaaacgaaaacgcgatatcgccgccgccgcctccttacgaaccgaaactacgcctccgaaactaaaccgccgccaaaaccgacaaccgaacaaccgctaaacgctcccgcgacgcaaaaaaataaactacgacgaaaaccgaacgaataccatcgaaccccgctactacgaaaactaaacccgaaaaacaaaatccacctaactcacctacaccgactcgaacgcgccgcccaacgccgccgccccgaacaacgaccccgaaacgaacgacctacactcgaataaataaccgaacccctacaaaccctcgcccgcccgctaccccgaacgccttaacccgaacactaaaaaaaaaaccgattccctaaaaaattaataacgcgacgaaaataactaaaaaaaaacaaaaacaaaac

SEQ ID NO: 32677 - DNA, 566 bp, Artificial Sequence
  chemically treated genomic DNA (Homo sapiens) CpG-island No: 32677
cgtgtgttagcggtagttcgggttttagggagtcggcgttgggggtgggaggaggagggaagatataaggggttagaaggcgaggagatttataatcgcgggcggggggtttaggcggcggtggaggggagaaggatgttgagttcgcgcgttcgttcgtttgtttttttcgggtcgcgcgtcggtatttacgttgaggggagagagcgagttgtcggggagcggagggggggttaggtcgatattgtcgtcgtcgttgttagagtcgtcgtttttttttttagtttcgtttttttataagttagttcgggttcgttagtcgtatcgtcgcgttcgggtttagtattgcgggtagcgtagtttgatgacgttacggatagcgtcgcgtttcggttttttttcggtcgggtttcggtttcgggaaaggtagttgaggtttggttcgttttattttttaatttgggaggtttaggggcgtttgcgcggaaaagtcgttcggaaaaggttgtaaaagtaaaagtaattatttttttttttggttttgaggaagagaaattaatataaaa

SEQ ID NO: 32678 - DNA, 566 bp, Artificial Sequence
  chemically treated genomic DNA (Homo sapiens) CpG-island No: 32678
ttttatattaatttctcttcctcaaaaccaaaaaaaaaaataattacttttacttttacaaccttttccgaacgacttttccgcgcaaacgcccctaaacctcccaaattaaaaaataaaacgaaccaaacctcaactacctttcccgaaaccgaaacccgaccgaaaaaaaaccgaaacgcgacgctatccgtaacgtcatcaaactacgctacccgcaatactaaacccgaacgcgacgatacgactaacgaacccgaactaacttataaaaaaacgaaactaaaaaaaaaaacgacgactctaacaacgacgacgacaatatcgacctaaccccccctccgctccccgacaactcgctctctcccctcaacgtaaataccgacgcgcgacccgaaaaaaacaaacgaacgaacgcgcgaactcaacatccttctcccctccaccgccgcctaaaccccccgcccgcgattataaatctcctcgccttctaaccccttatatcttccctcctcctcccacccccaacgccgactccctaaaacccgaactaccgctaacacacg

SEQ ID NO: 32679 - DNA, 566 bp, Artificial Sequence
  chemically treated genomic DNA (Homo sapiens) CpG-island No: 32679
ttttgtattggttttttttttttagagttaaaggaggagatagttatttttgtttttgtagtttttttcgggcggttttttcgcgtaggcgtttttggattttttaggttgagaggtggagcgggttaaattttagttgtttttttcggggtcgggattcggtcgggggaggatcgaggcgcggcgttgttcgtgacgttattaggttgcgttgttcgtagtattggattcgagcgcgacggtgcggttggcggattcgggttggtttgtggggaaacgaaattgagggaggaggcggcggttttggtagcggcggcgatagtgtcggtttgatttttttttcgtttttcggtagttcgttttttttttttagcgtgagtgtcgacgcgcggttcggggggagtaagcgggcgggcgcgcgggtttagtattttttttttttttatcgtcgtttgggtttttcgttcgcggttatgggttttttcgttttttggttttttatgtttttttttttttttttatttttaacgtcggttttttggagttcgagttgtcgttgatatacg

SEQ ID NO: 32680 - DNA, 566 bp, Artificial Sequence
  chemically treated genomic DNA (Homo sapiens) CpG-island No: 32680
cgtatatcaacgacaactcgaactccaaaaaaccgacgttaaaaataaaaaaaaaaaaaaaaacataaaaaaccaaaaaacgaaaaaacccataaccgcgaacgaaaaacccaaacgacgataaaaaaaaaaaaaatactaaacccgcgcgcccgcccgcttactccccccgaaccgcgcgtcgacactcacgctaaaaaaaaaaaacgaactaccgaaaaacgaaaaaaaaatcaaaccgacactatcgccgccgctaccaaaaccgccgcctcctccctcaatttcgtttccccacaaaccaacccgaatccgccaaccgcaccgtcgcgctcgaatccaatactacgaacaacgcaacctaataacgtcacgaacaacgccgcgcctcgatcctcccccgaccgaatcccgaccccgaaaaaaacaactaaaatttaacccgctccacctctcaacctaaaaaatccaaaaacgcctacgcgaaaaaaccgcccgaaaaaaactacaaaaacaaaaataactatctcctcctttaactctaaaaaaaaaaaaccaatacaaaa

SEQ ID NO: 32681 - DNA, 692 bp, Artificial Sequence
  chemically treated genomic DNA (Homo sapiens) CpG-island No: 32681
gtcgtcgtcgtttttcggttatttcggttttagtcgtcgtcgtggtcgtcgttgtcgttgttagggatttttagttttagatatttgtttcgttgagaagtcgttgttagtagcgtttttaagattttattttaattgtagtcgtttttttcgtcgggttcggggtacgtttttagtttcggattttttttttggttttcggcggttgttagttttagtttttttagtagaatcggtcgtgttcgttttagtttttatcggttaatcgtcgtcgtcgtcgtcgttagggtagtaattgttttaggtagttttcggtcggtcggtttcgtttcgttcgtttagtttagatttcgttttcgttttcgttttcgtttcgtcgttcggtttttttttgttcgtcggtttcgttttcgcgtttttttttttttttatcgcgttttttcgtagtatttcgtgtttgggcgtgtgcggtcgtttgggattcgttgtcggcgcggcggggagatttgtttcggggcggcgtgggggtttcgttttttttaggggaggcggagaacggggcgggggttgcgtttttacgttttcgagtttacgcgagtcgttgtttttatttttttcgttattattgggttttgattttttttttgttttttaggtcggagggattcgtcggttgttggtgtcgtatttgt

SEQ ID NO: 32682 - DNA, 692 bp, Artificial Sequence
  chemically treated genomic DNA (Homo sapiens) CpG-island No: 32682
acaaatacgacaccaacaaccgacgaatccctccgacctaaaaaacaaaaaaaaaatcaaaacccaataataacgaaaaaaataaaaacaacgactcgcgtaaactcgaaaacgtaaaaacgcaacccccgccccgttctccgcctcccctaaaaaaaacgaaacccccacgccgccccgaaacaaatctccccgccgcgccgacaacgaatcccaaacgaccgcacacgcccaaacacgaaatactacgaaaaaacgcgataaaaaaaaaaaaaaacgcgaaaacgaaaccgacgaacaaaaaaaaaccgaacgacgaaacgaaaacgaaaacgaaaacgaaatctaaactaaacgaacgaaacgaaaccgaccgaccgaaaactacctaaaacaattactaccctaacgacgacgacgacgacgattaaccgataaaaactaaaacgaacacgaccgattctactaaaaaaactaaaactaacaaccgccgaaaaccaaaaaaaaaatccgaaactaaaaacgtaccccgaacccgacgaaaaaaacgactacaattaaaataaaatcttaaaaacgctactaacaacgacttctcaacgaaacaaatatctaaaactaaaaatccctaacaacgacaacgacgaccacgacgacgactaaaaccgaaataaccgaaaaacgacgacgac

SEQ ID NO: 32683 - DNA, 692 bp, Artificial Sequence
  chemically treated genomic DNA (Homo sapiens) CpG-island No: 32683
gtagatacggtattaatagtcggcgagttttttcggtttggaagataaaggaaggattagggtttagtggtgacggggagggtgggggtaacgattcgcgtgagttcggagacgtgagaacgtagttttcgtttcgtttttcgttttttttgagaaaggcggggtttttacgtcgtttcgagataggttttttcgtcgcgtcggtagcgggttttaggcggtcgtatacgtttaggtacgggatgttgcgggagagcgcggtgggggaggggaaggacgcggaggcggagtcggcgggtaaagaaaggtcgagcggcggggcgggggcgggggcgggggcggggtttgggttgggcgggcggggcggagtcggtcggtcgggggttgtttgagatagttattgttttgacggcggcggcggcggcggttggtcggtgggggttggggcgagtacgatcgattttgttgggaaagttggaattggtagtcgtcgggggttaagaggaggattcggagttgggagcgtgtttcgggttcggcggaggaggcggttgtagttggagtggagttttgggagcgttgttggtagcgattttttagcgaagtaagtgtttgagattgagagtttttaatagcggtagcggcggttacggcggcggttggggtcgaggtaatcggggggcggcggcggt

SEQ ID NO: 32684 - DNA, 692 bp, Artificial Sequence
  chemically treated genomic DNA (Homo sapiens) CpG-island No: 32684
accgccgccgccccccgattacctcgaccccaaccgccgccgtaaccgccgctaccgctattaaaaactctcaatctcaaacacttacttcgctaaaaaatcgctaccaacaacgctcccaaaactccactccaactacaaccgcctcctccgccgaacccgaaacacgctcccaactccgaatcctcctcttaacccccgacgactaccaattccaactttcccaacaaaatcgatcgtactcgccccaacccccaccgaccaaccgccgccgccgccgccgtcaaaacaataactatctcaaacaacccccgaccgaccgactccgccccgcccgcccaacccaaaccccgcccccgcccccgcccccgccccgccgctcgacctttctttacccgccgactccgcctccgcgtccttcccctcccccaccgcgctctcccgcaacatcccgtacctaaacgtatacgaccgcctaaaacccgctaccgacgcgacgaaaaaacctatctcgaaacgacgtaaaaaccccgcctttctcaaaaaaaacgaaaaacgaaacgaaaactacgttctcacgtctccgaactcacgcgaatcgttacccccaccctccccgtcaccactaaaccctaatccttcctttatcttccaaaccgaaaaaactcgccgactattaataccgtatctac

SEQ ID NO: 32685 - DNA, 740 bp, Artificial Sequence
  chemically treated genomic DNA (Homo sapiens) CpG-island No: 32685
  misc_feature (364)..(365): n is either a, c, g or t
atttcgttgtttggcggggtgggtggcggcgttcgggacggcgaggtgattgtaggcggcggggtcggagtcgggtttggcgcgattttggcgggttttcgaggttggtggagtggcgggcggggtcgagttggaggttggtggtgcgttgtttatttcgggagcggggtcgggtttttgagtaacgacgggtttggaagagttttgcggcggtggcggcggttgttgttgttgatgcggttgtggatgcggcggcggttgatgcggtggcggttgttgcggcggtggttgttgcggtggtggttgttgttgttgttggtgtggaggcggtggcgggatcggaggtttagggtcgttttggcgnngttaggatttatggggtcgcgattttgattgaggtttatgcgggcggcggagaacggaagtcgtggaggtcgtcgcggcgtcgttttttttacgtttgtggaagttattatcgttatcgttacgatttcggaatcgatttcgagatatgtttgtggttaaggggcggtcgaggtaaaagcgaagaagacgtttaggaaacgtggaggttattttgttttttataaaatggcggatgatataggcggcgtcgtttttgttttcgttttatataggttagttggtacggtttcgtttattttacgatcgatagttttaatagttaattgtaattattatgtttgatgatattaagttgcgaatttttgattattttt

SEQ ID NO: 32686 - DNA, 740 bp, Artificial Sequence
  chemically treated genomic DNA (Homo sapiens) CpG-island No: 32686
  misc_feature (376)..(377): n is either a, c, g or t
aaaaataatcaaaaattcgcaacttaatatcatcaaacataataattacaattaactattaaaactatcgatcgtaaaataaacgaaaccgtaccaactaacctatataaaacgaaaacaaaaacgacgccgcctatatcatccgccattttataaaaaacaaaataacctccacgtttcctaaacgtcttcttcgcttttacctcgaccgccccttaaccacaaacatatctcgaaatcgattccgaaatcgtaacgataacgataataacttccacaaacgtaaaaaaaacgacgccgcgacgacctccacgacttccgttctccgccgcccgcataaacctcaatcaaaatcgcgaccccataaatcctaacnncgccaaaacgaccctaaacctccgatcccgccaccgcctccacaccaacaacaacaacaaccaccaccgcaacaaccaccgccgcaacaaccgccaccgcatcaaccgccgccgcatccacaaccgcatcaacaacaacaaccgccgccaccgccgcaaaactcttccaaacccgtcgttactcaaaaacccgaccccgctcccgaaataaacaacgcaccaccaacctccaactcgaccccgcccgccactccaccaacctcgaaaacccgccaaaatcgcgccaaacccgactccgaccccgccgcctacaatcacctcgccgtcccgaacgccgccacccaccccgccaaacaacgaaat

SEQ ID NO: 32687 - DNA, 740 bp, Artificial Sequence
  chemically treated genomic DNA (Homo sapiens) CpG-island No: 32687
  misc_feature (376)..(377): n is either a, c, g or t
aggaatgattagaggttcgtaatttagtgttattaagtatagtaattgtaattggttattggagttgtcgatcgtggagtaggcggggtcgtgttagttggtttatataagacgaggataaaggcggcgtcgtttgtgttattcgttattttgtgagaagtaaggtggtttttacgttttttgagcgtttttttcgtttttgtttcgatcgttttttgattatagatatgtttcgggatcggtttcggagtcgtggcggtggcggtggtggtttttataggcgtggaggaggcggcgtcgcggcggtttttacgattttcgtttttcgtcgttcgtatgggttttaattagaatcgcggttttatgggttttggtnncgttagagcggttttaagttttcgatttcgttatcgtttttatattaatagtagtaatagttattatcgtagtagttatcgtcgtagtagtcgttatcgtattagtcgtcgtcgtatttatagtcgtattagtagtagtagtcgtcgttatcgtcgtaggatttttttaagttcgtcgttgtttagggattcggtttcgttttcggagtaggtagcgtattattagtttttagttcggtttcgttcgttattttattaatttcgggggttcgttagggtcgcgttaggttcgatttcgatttcgtcgtttgtagttatttcgtcgtttcgggcgtcgttatttatttcgttaagtagcggggt

SEQ ID NO: 32688 - DNA, 740 bp, Artificial Sequence
  chemically treated genomic DNA (Homo sapiens) CpG-island No: 32688
  misc_feature (364)..(365): n is either a, c, g or t
accccgctacttaacgaaataaataacgacgcccgaaacgacgaaataactacaaacgacgaaatcgaaatcgaacctaacgcgaccctaacgaacccccgaaattaataaaataacgaacgaaaccgaactaaaaactaataatacgctacctactccgaaaacgaaaccgaatccctaaacaacgacgaacttaaaaaaatcctacgacgataacgacgactactactactaatacgactataaatacgacgacgactaatacgataacgactactacgacgataactactacgataataactattactactattaatataaaaacgataacgaaatcgaaaacttaaaaccgctctaacgnnaccaaaacccataaaaccgcgattctaattaaaacccatacgaacgacgaaaaacgaaaatcgtaaaaaccgccgcgacgccgcctcctccacgcctataaaaaccaccaccgccaccgccacgactccgaaaccgatcccgaaacatatctataatcaaaaaacgatcgaaacaaaaacgaaaaaaacgctcaaaaaacgtaaaaaccaccttacttctcacaaaataacgaataacacaaacgacgccgcctttatcctcgtcttatataaaccaactaacacgaccccgcctactccacgatcgacaactccaataaccaattacaattactatacttaataacactaaattacgaacctctaatcattcct

SEQ ID NO: 32689 - DNA, 1375 bp, Artificial Sequence
  chemically treated genomic DNA (Homo sapiens) CpG-island No: 32689
ttttcgttttggattcgatttgtagggcgtaaagttttttgtattgaggcgtttttagggcgttcgtttttcgcgtttatattttttaggtaaaaaggtagcggattaagtaggggtgtttggaaggcgttcgttgtttgtttgattgcgtggttttatttggttcgcgtgtattagtttttttggcgggggatttttttcggatttcggttagcgttaattaggtcgcgcggtatttgtttttagttttggttatttggaggggcgatgaggttttacgttcggagtagggtagttttcggagcgtcggggaggcgcggagtttacgtgtgtcgttttagtcgttgggttcggaaggacgcgttgcgatttcgtggagtcgaacgcgggagtcgttgttcgagcggacgtgtttagtcgcggtaacgggtcggggttttatcgtgtaggggagcgagcggaggggcggggcggggcgcgggcgggttgaggagtcgtcgggttcgggtttcgcgcggggatgtgtttggttatcgcgtattttcgagggcgttttaatattcgggtaagcgcgtttcggttgtttttttttgtttatcgcgtcgtttttagcgtacgagttttttattgggtttgggtttgcgttttggtttttttttttcgcgttaggggtttttcgtttcgaggggcgcggcgattcgggggtattttcggtttcgtggtagatcgcgggtggcgtagttcgcgtttcggggtcggatttgtcgggtttttgttttcgggtcgtgcgaacgttttatttagcgtgtttgtagcgattcgtttttttgcgtttttagtcgggtcggattttacgcggattcgttgttgttgttgcgtttcgcgtcgtcgttattcggggagtatgaggtcggggtaggggattcgggtagggtgggggtcgatcgcggggtttgttgggttaatgcgtcgtcgtcggttagtgagttcggattcgtgtcggtaattgtgggtagttttgagatcggggttcggtttgttggtgattttttcgaagttttataaaataaagagggcgaagtgttttcgcggcgcggcgtgggtatgtaggcggtagggtttgtgggagtcggcgtttcggttagcgagtttggggttaggatagcgggggtaggacggagaagtcggacgtgttcgtgggtcgtcggtgtttttgttttcgaggttttagagcgggcgattcgatatcgattttagagggttttgcgcgtttaaggcgcggttatacggaagttttcgtttcgcggtttagagggggtttggttaagtagagagtagagcgggtaagtagaaggtagtgtggggacgaggttcg

SEQ ID NO: 32690 - DNA, 1375 bp, Artificial Sequence
  chemically treated genomic DNA (Homo sapiens) CpG-island No: 32690
cgaacctcgtccccacactaccttctacttacccgctctactctctacttaaccaaaccccctctaaaccgcgaaacgaaaacttccgtataaccgcgccttaaacgcgcaaaaccctctaaaatcgatatcgaatcgcccgctctaaaacctcgaaaacaaaaacaccgacgacccacgaacacgtccgacttctccgtcctacccccgctatcctaaccccaaactcgctaaccgaaacgccgactcccacaaaccctaccgcctacatacccacgccgcgccgcgaaaacacttcgccctctttattttataaaacttcgaaaaaatcaccaacaaaccgaaccccgatctcaaaactacccacaattaccgacacgaatccgaactcactaaccgacgacgacgcattaacccaacaaaccccgcgatcgacccccaccctacccgaatcccctaccccgacctcatactccccgaataacgacgacgcgaaacgcaacaacaacaacgaatccgcgtaaaatccgacccgactaaaaacgcaaaaaaacgaatcgctacaaacacgctaaataaaacgttcgcacgacccgaaaacaaaaacccgacaaatccgaccccgaaacgcgaactacgccacccgcgatctaccacgaaaccgaaaatacccccgaatcgccgcgcccctcgaaacgaaaaacccctaacgcgaaaaaaaaaaaccaaaacgcaaacccaaacccaataaaaaactcgtacgctaaaaacgacgcgataaacaaaaaaaaacaaccgaaacgcgcttacccgaatattaaaacgccctcgaaaatacgcgataaccaaacacatccccgcgcgaaacccgaacccgacgactcctcaacccgcccgcgccccgccccgcccctccgctcgctcccctacacgataaaaccccgacccgttaccgcgactaaacacgtccgctcgaacaacgactcccgcgttcgactccacgaaatcgcaacgcgtccttccgaacccaacgactaaaacgacacacgtaaactccgcgcctccccgacgctccgaaaactaccctactccgaacgtaaaacctcatcgcccctccaaataaccaaaactaaaaacaaataccgcgcgacctaattaacgctaaccgaaatccgaaaaaaatcccccgccaaaaaaactaatacacgcgaaccaaataaaaccacgcaatcaaacaaacaacgaacgccttccaaacacccctacttaatccgctacctttttacctaaaaaatataaacgcgaaaaacgaacgccctaaaaacgcctcaatacaaaaaactttacgccctacaaatcgaatccaaaacgaaaa

SEQ ID NO: 32691 - DNA, 1375 bp, Artificial Sequence
  chemically treated genomic DNA (Homo sapiens) CpG-island No: 32691
cgggtttcgtttttatattgttttttgtttgttcgttttgttttttgtttggttaggttttttttgggtcgcggggcggaggttttcgtgtggtcgcgttttgagcgcgtagggttttttggaatcggtgtcgggtcgttcgttttggggtttcgggagtaaggatatcgacggtttacgggtacgttcggttttttcgttttattttcgttgttttggttttagattcgttggtcgagacgtcggtttttataggttttgtcgtttgtatgtttacgtcgcgtcgcgaaggtatttcgttttttttattttgtaaaatttcggaaaaattattagtaaatcgagtttcggttttaaggttgtttatagttgtcggtacgaattcggatttattgatcgacggcggcgtattggtttagtagatttcgcggtcggtttttattttattcgggttttttgtttcggttttatgtttttcgggtggcggcggcgcgaggcgtagtagtagtagcgggttcgcgtgaggttcggttcggttgaaagcgtagagaagcgggtcgttgtagatacgttgagtagagcgttcgtacggttcgggggtagggattcggtaagttcggtttcgaggcgcgagttacgttattcgcggtttgttacgaggtcggagatgttttcgagtcgtcgcgtttttcggagcgagaggtttttggcgcggagagggagagttagggcgtagatttagatttagtggggaattcgtacgttgaaggcggcgcggtgggtagagggaggtagtcggggcgcgtttattcgggtgttgaggcgttttcgaaagtacgcggtggttagatatattttcgcgcggagttcgagttcggcggttttttagttcgttcgcgtttcgtttcgttttttcgttcgtttttttgtacgatgaggtttcgattcgttatcgcggttgagtacgttcgttcgggtagcgattttcgcgttcggttttacggggtcgtagcgcgttttttcgggtttagcggttggggcggtatacgtgagtttcgcgttttttcggcgtttcgaggattgttttgtttcgggcgtggagttttatcgtttttttaggtggttagggttgggggtaggtatcgcgcgatttgattggcgttggtcggagttcggggagaatttttcgttagagaggttgatgtacgcgggttaagtgaagttacgtagttaaataggtaacgggcgttttttaaatatttttgtttagttcgttgtttttttgtttaagaaatgtaaacgcgggaggcgggcgttttgggaacgttttagtataggggattttgcgttttatagatcgggtttaggacggaaa

SEQ ID NO: 32692 - DNA, 1375 bp, Artificial Sequence
  chemically treated genomic DNA (Homo sapiens) CpG-island No: 32692
tttccgtcctaaacccgatctataaaacgcaaaatcccctatactaaaacgttcccaaaacgcccgcctcccgcgtttacatttcttaaacaaaaaaacaacgaactaaacaaaaatatttaaaaaacgcccgttacctatttaactacgtaacttcacttaacccgcgtacatcaacctctctaacgaaaaattctccccgaactccgaccaacgccaatcaaatcgcgcgatacctacccccaaccctaaccacctaaaaaaacgataaaactccacgcccgaaacaaaacaatcctcgaaacgccgaaaaaacgcgaaactcacgtataccgccccaaccgctaaacccgaaaaaacgcgctacgaccccgtaaaaccgaacgcgaaaatcgctacccgaacgaacgtactcaaccgcgataacgaatcgaaacctcatcgtacaaaaaaacgaacgaaaaaacgaaacgaaacgcgaacgaactaaaaaaccgccgaactcgaactccgcgcgaaaatatatctaaccaccgcgtactttcgaaaacgcctcaacacccgaataaacgcgccccgactacctccctctacccaccgcgccgccttcaacgtacgaattccccactaaatctaaatctacgccctaactctccctctccgcgccaaaaacctctcgctccgaaaaacgcgacgactcgaaaacatctccgacctcgtaacaaaccgcgaataacgtaactcgcgcctcgaaaccgaacttaccgaatccctacccccgaaccgtacgaacgctctactcaacgtatctacaacgacccgcttctctacgctttcaaccgaaccgaacctcacgcgaacccgctactactactacgcctcgcgccgccgccacccgaaaaacataaaaccgaaacaaaaaacccgaataaaataaaaaccgaccgcgaaatctactaaaccaatacgccgccgtcgatcaataaatccgaattcgtaccgacaactataaacaaccttaaaaccgaaactcgatttactaataatttttccgaaattttacaaaataaaaaaaacgaaataccttcgcgacgcgacgtaaacatacaaacgacaaaacctataaaaaccgacgtctcgaccaacgaatctaaaaccaaaacaacgaaaataaaacgaaaaaaccgaacgtacccgtaaaccgtcgatatccttactcccgaaaccccaaaacgaacgacccgacaccgattccaaaaaaccctacgcgctcaaaacgcgaccacacgaaaacctccgccccgcgacccaaaaaaaacctaaccaaacaaaaaacaaaacgaacaaacaaaaaacaatataaaaacgaaacccg

SEQ ID NO: 32693 - DNA, 906 bp, Artificial Sequence
  chemically treated genomic DNA (Homo sapiens) CpG-island No: 32693
aagttacgggtttcgggtttggcgggtcgcggtatttttcgcgcgttttcgcgtttaggttggtttttgcgtttttgtttcgggtgtttcgtagtagtcgggttaggttgggtgcgggtttgggttttgcgagtcgagttagtgcggtgaggcgtttaggcgcgttgcggttcggtttagttttgcgcgtcgttatgttggtttttttttttttcgttttttttttttcgggcggcggggcgtttcggttttcggaagcggtacgggaggcgatcgtgttcgtcgttggtaggttagggttggcggcggcgtattttgtttgttttaaacgaaggagcggagggaggggtcgcgcggagcgtgtttaaggtgaaagggttgtcgtgtagttaggtagaggcgaggaaggtttttttatcgtcgttatcgttcgtttgtttcgtcggtaataggttttttcgggacgggaggggtcgtagcgcgcgtagttcgtagcgttgaacgtcgtcgaaattttttggtcggtcgagttttcgtagtcgcgattcggttttttttcgttcgagtttttcgagttttttcgaattttcgttggattttttttttttggtcggcgtcgttcgattcgtttttttattttagagggaattttttgcgtcgcggttgtgaggtatttttatttcggtttgaaatgtatcgtagttttgaaggaaatttatttttattttacgtagatttattcgtaacgttgtttgaatacgtttcgttgtttatagaaatttttgtttaaattagacgcgtggattatttaagacgaaatttatattcgattttagtttcgttagtttttgtcgaaattattttaaattcgttgaaattaatttttagttgttcgaattttttttt

SEQ ID NO: 32694 - DNA, 906 bp, Artificial Sequence
  chemically treated genomic DNA (Homo sapiens) CpG-island No: 32694
aaaaaaaaattcgaacaactaaaaattaatttcaacgaatttaaaataatttcgacaaaaactaacgaaactaaaatcgaatataaatttcgtcttaaataatccacgcgtctaatttaaacaaaaatttctataaacaacgaaacgtattcaaacaacgttacgaataaatctacgtaaaataaaaataaatttccttcaaaactacgatacatttcaaaccgaaataaaaatacctcacaaccgcgacgcaaaaaattccctctaaaataaaaaaacgaatcgaacgacgccgaccaaaaaaaaaaaatccaacgaaaattcgaaaaaactcgaaaaactcgaacgaaaaaaaaccgaatcgcgactacgaaaactcgaccgaccaaaaaatttcgacgacgttcaacgctacgaactacgcgcgctacgacccctcccgtcccgaaaaaacctattaccgacgaaacaaacgaacgataacgacgataaaaaaaccttcctcgcctctacctaactacacgacaaccctttcaccttaaacacgctccgcgcgacccctccctccgctccttcgtttaaaacaaacaaaatacgccgccgccaaccctaacctaccaacgacgaacacgatcgcctcccgtaccgcttccgaaaaccgaaacgccccgccgcccgaaaaaaaaaaaacgaaaaaaaaaaaaaccaacataacgacgcgcaaaactaaaccgaaccgcaacgcgcctaaacgcctcaccgcactaactcgactcgcaaaacccaaacccgcacccaacctaacccgactactacgaaacacccgaaacaaaaacgcaaaaaccaacctaaacgcgaaaacgcgcgaaaaataccgcgacccgccaaacccgaaacccgtaactt

SEQ ID NO: 32695 - DNA, 906 bp, Artificial Sequence
  chemically treated genomic DNA (Homo sapiens) CpG-island No: 32695
gaaggaaaattcggatagttgggaattaattttaacgggtttagggtgatttcggtaagggttggcggggttagggtcgagtgtgaatttcgttttgggtggtttacgcgtttggtttgggtaggaatttttgtgggtagcgaggcgtatttaggtagcgttgcgggtgaatttgcgtgggatgagggtggattttttttaggattgcggtgtattttaggtcggggtggaggtgttttatagtcgcggcgtagggaattttttttaggatgggggagcgggtcgggcggcgtcggttagggaggggaagtttaacgggggttcggagaggttcgggggattcggacggagagaagtcgggtcgcggttgcggaggttcggtcggttaagggatttcggcgacgtttagcgttgcgagttgcgcgcgttgcggtttttttcgtttcgggggaatttgttgtcggcgaaataggcgggcggtggcgacgatggagaagtttttttcgtttttgtttggttgtacggtagtttttttattttaggtacgtttcgcgcggttttttttttcgttttttcgtttaaaataaatagaatacgtcgtcgttaattttagtttgttaacggcgagtacggtcgtttttcgtgtcgttttcgggagtcgaggcgtttcgtcgttcggggaggaggaggcggagggggaggaggttaatatggcggcgcgtagggttgggtcgggtcgtagcgcgtttgagcgttttatcgtattagttcggttcgtaggatttaagttcgtatttagtttggttcggttgttgcggagtattcggggtaggaacgtaggggttaatttgggcgcggaggcgcgcggagggtgtcgcggttcgttaggttcgggattcgtagttt

SEQ ID NO: 32696 - DNA, 906 bp, Artificial Sequence
  chemically treated genomic DNA (Homo sapiens) CpG-island No: 32696
aaactacgaatcccgaacctaacgaaccgcgacaccctccgcgcgcctccgcgcccaaattaacccctacgttcctaccccgaatactccgcaacaaccgaaccaaactaaatacgaacttaaatcctacgaaccgaactaatacgataaaacgctcaaacgcgctacgacccgacccaaccctacgcgccgccatattaacctcctccccctccgcctcctcctccccgaacgacgaaacgcctcgactcccgaaaacgacacgaaaaacgaccgtactcgccgttaacaaactaaaattaacgacgacgtattctatttattttaaacgaaaaaacgaaaaaaaaaaccgcgcgaaacgtacctaaaataaaaaaactaccgtacaaccaaacaaaaacgaaaaaaacttctccatcgtcgccaccgcccgcctatttcgccgacaacaaattcccccgaaacgaaaaaaaccgcaacgcgcgcaactcgcaacgctaaacgtcgccgaaatcccttaaccgaccgaacctccgcaaccgcgacccgacttctctccgtccgaatcccccgaacctctccgaacccccgttaaacttcccctccctaaccgacgccgcccgacccgctcccccatcctaaaaaaaattccctacgccgcgactataaaacacctccaccccgacctaaaatacaccgcaatcctaaaaaaaatccaccctcatcccacgcaaattcacccgcaacgctacctaaatacgcctcgctacccacaaaaattcctacccaaaccaaacgcgtaaaccacccaaaacgaaattcacactcgaccctaaccccgccaacccttaccgaaatcaccctaaacccgttaaaattaattcccaactatccgaattttccttc

SEQ ID NO: 32697 - DNA, 524 bp, Artificial Sequence
  chemically treated genomic DNA (Homo sapiens) CpG-island No: 32697
tgatcgtgtgtgtatatatcgtatgtagatatttatgtgaattcgtgttcgggtaagacgtatgatcgtgtgtgtatatatcgcgtgtagatatttatgtgaattcgtgttcgtgtaagacgtatgatcgtgtgtgtatatatcgcgtgtagatatttatgtgaattcgtgttcgtgtaagacgtatgatcgtgtgtgtatatatcgcgtgtagatatttatgtgaattcgtgttcgtgtaagacgtatgatcgtgtgtgtatatattacgtgtagatatttatgtgaattcgtgttcggataagacgtatgatcgtgtgtgtatatatcgcgtgtagatatttacgtgaattcgtgttcgtgtaagatgtatgatcgtgtgtgtatatatcgtatgtagatatttttgtgaattcgtgttcgtgtaagacgtatgatcgtgtgtgtatatatcgtatgtagatatttttgtgaattcgtgttcgtgtaagatatatgatcgtgtgtgtatatatcgtatgtag

SEQ ID NO: 32698 - DNA, 524 bp, Artificial Sequence
  chemically treated genomic DNA (Homo sapiens) CpG-island No: 32698
ctacatacgatatatacacacacgatcatatatcttacacgaacacgaattcacaaaaatatctacatacgatatatacacacacgatcatacgtcttacacgaacacgaattcacaaaaatatctacatacgatatatacacacacgatcatacatcttacacgaacacgaattcacgtaaatatctacacgcgatatatacacacacgatcatacgtcttatccgaacacgaattcacataaatatctacacgtaatatatacacacacgatcatacgtcttacacgaacacgaattcacataaatatctacacgcgatatatacacacacgatcatacgtcttacacgaacacgaattcacataaatatctacacgcgatatatacacacacgatcatacgtcttacacgaacacgaattcacataaatatctacacgcgatatatacacacacgatcatacgtcttacccgaacacgaattcacataaatatctacatacgatatatacacacacgatca

SEQ ID NO: 32699 - DNA, 524 bp, Artificial Sequence
  chemically treated genomic DNA (Homo sapiens) CpG-island No: 32699
ttgtatgcgatgtgtgtatatacgattatgtgttttatacgggtacgagtttataaggatatttgtatgcgatgtgtgtatatacgattatgcgttttatacgggtacgagtttataaggatatttgtatgcgatgtgtgtatatacgattatgtattttatacgggtacgagtttacgtggatatttgtacgcgatgtgtgtatatacgattatgcgttttattcgggtacgagtttatatggatatttgtacgtgatgtgtgtatatacgattatgcgttttatacgggtacgagtttatatggatatttgtacgcgatgtgtgtatatacgattatgcgttttatacgggtacgagtttatatggatatttgtacgcgatgtgtgtatatacgattatgcgttttatacgggtacgagtttatatggatatttgtacgcgatgtgtgtatatacgattatgcgttttattcgggtacgagtttatatggatatttgtatgcgatgtgtgtatatacgatta

SEQ ID NO: 32700 - DNA, 524 bp, Artificial Sequence
  chemically treated genomic DNA (Homo sapiens) CpG-island No: 32700
taatcgtatatacacacatcgcatacaaatatccatataaactcgtacccgaataaaacgcataatcgtatatacacacatcgcgtacaaatatccatataaactcgtacccgtataaaacgcataatcgtatatacacacatcgcgtacaaatatccatataaactcgtacccgtataaaacgcataatcgtatatacacacatcgcgtacaaatatccatataaactcgtacccgtataaaacgcataatcgtatatacacacatcacgtacaaatatccatataaactcgtacccgaataaaacgcataatcgtatatacacacatcgcgtacaaatatccacgtaaactcgtacccgtataaaatacataatcgtatatacacacatcgcatacaaatatccttataaactcgtacccgtataaaacgcataatcgtatatacacacatcgcatacaaatatccttataaactcgtacccgtataaaacacataatcgtatatacacacatcgcatacaa

SEQ ID NO: 32701 - DNA, 623 bp, Artificial Sequence
  chemically treated genomic DNA (Homo sapiens) CpG-island No: 32701
  misc_feature (44)..(44): n is either a, c, g or t
  misc_feature (513)..(513): n is either a, c, g or t
gcgcgttagtaaaaacgttagggacggggttttcgcgtttgtangtgaagttgggcgttttcggggtttgagtttttgagggtcgggtttagcgcgtgggttgttggatggcggaattttaggcggagtcggagtttttgttgggcgtggttcgcggcggtggcggcgattggcggcggggttgattatttatcgtagtatttaagtcggttttggtgagtcgttcggatttggggaggggattggttcgggaggattagggtcgcgcgtgggggtttcgttgttttagtatttcgttttttgtcgggcgcgttttattaggttcgagttcgagcggggttcgggcgttcggggttgttaggcgagtcggtgttttgagggcgagtgggttgcgttttgcggattcggatcgaggttagggtagagttggggtttttttcgtgtcgcgttttgatttcgattagtttggcgaagaggttttcgtttatttttggtaagtttcgagagaatcgnttatttgcggtaggtatttttcgtgtgtacgggcggcgttagatattatatttttcgattgtcgtcgtaatgagggtcgtttaattgatttagagaaggtagtattttga

SEQ ID NO: 32702 - DNA, 623 bp, Artificial Sequence
  chemically treated genomic DNA (Homo sapiens) CpG-island No: 32702
  misc_feature (111)..(111): n is either a, c, g or t
  misc_feature (580)..(580): n is either a, c, g or t
tcaaaatactaccttctctaaatcaattaaacgaccctcattacgacgacaatcgaaaaatataatatctaacgccgcccgtacacacgaaaaatacctaccgcaaataancgattctctcgaaacttaccaaaaataaacgaaaacctcttcgccaaactaatcgaaatcaaaacgcgacacgaaaaaaaccccaactctaccctaacctcgatccgaatccgcaaaacgcaacccactcgccctcaaaacaccgactcgcctaacaaccccgaacgcccgaaccccgctcgaactcgaacctaataaaacgcgcccgacaaaaaacgaaatactaaaacaacgaaacccccacgcgcgaccctaatcctcccgaaccaatcccctccccaaatccgaacgactcaccaaaaccgacttaaatactacgataaataatcaaccccgccgccaatcgccgccaccgccgcgaaccacgcccaacaaaaactccgactccgcctaaaattccgccatccaacaacccacgcgctaaacccgaccctcaaaaactcaaaccccgaaaacgcccaacttcacntacaaacgcgaaaaccccgtccctaacgtttttactaacgcgc

SEQ ID NO: 32703 - DNA, 623 bp, Artificial Sequence
  chemically treated genomic DNA (Homo sapiens) CpG-island No: 32703
  misc_feature (111)..(111): n is either a, c, g or t
  misc_feature (580)..(580): n is either a, c, g or t
ttaaagtgttgttttttttgagttaattaggcgatttttattacggcgatagtcgggaagtatggtgtttggcgtcgttcgtgtatacggagggtgtttgtcgtaggtggncggttttttcggggtttgttaagaatgagcgagggttttttcgttaagttggtcgggattaggacgcgatacggaagagattttagttttgttttgatttcggttcgggttcgtaggacgtagtttattcgtttttagaatatcggttcgtttggtaatttcgggcgttcgggtttcgttcggattcgaatttggtggggcgcgttcggtagaaagcggggtgttgggatagcgggatttttacgcgcgattttggttttttcgggttagttttttttttaggttcgggcggtttattagggtcgatttggatgttgcggtaagtggttagtttcgtcgttagtcgtcgttatcgtcgcgggttacgtttagtaggggtttcgatttcgtttggggtttcgttatttagtagtttacgcgttggattcgatttttagaagtttaagtttcgaaggcgtttagttttatntgtaggcgcggagatttcgtttttggcgtttttgttgacgcgt

SEQ ID NO: 32704 - DNA, 623 bp, Artificial Sequence
  chemically treated genomic DNA (Homo sapiens) CpG-island No: 32704
  misc_feature (44)..(44): n is either a, c, g or t
  misc_feature (513)..(513): n is either a, c, g or t
acgcgtcaacaaaaacgccaaaaacgaaatctccgcgcctacanataaaactaaacgccttcgaaacttaaacttctaaaaatcgaatccaacgcgtaaactactaaataacgaaaccccaaacgaaatcgaaacccctactaaacgtaacccgcgacgataacgacgactaacgacgaaactaaccacttaccgcaacatccaaatcgaccctaataaaccgcccgaacctaaaaaaaaaactaacccgaaaaaaccaaaatcgcgcgtaaaaatcccgctatcccaacaccccgctttctaccgaacgcgccccaccaaattcgaatccgaacgaaacccgaacgcccgaaattaccaaacgaaccgatattctaaaaacgaataaactacgtcctacgaacccgaaccgaaatcaaaacaaaactaaaatctcttccgtatcgcgtcctaatcccgaccaacttaacgaaaaaaccctcgctcattcttaacaaaccccgaaaaaaccgnccacctacgacaaacaccctccgtatacacgaacgacgccaaacaccatacttcccgactatcgccgtaataaaaatcgcctaattaactcaaaaaaaacaacactttaa

SEQ ID NO: 32705 - DNA, 679 bp, Artificial Sequence
  chemically treated genomic DNA (Homo sapiens) CpG-island No: 32705
  misc_feature (384)..(384): n is either a, c, g or t
tcgcgttttcgggtagtgaatagaagcgtcggtttcggagttgttcgaggaggttcgggagtaaggtcgggtagggaacgcgagatttcggcgtcgacgtttcgtagtgggtttttgggatatttatcggtgcgggacgaaggtaggtgcgcggcggcggggttatttgtacgggtgaagttggagggcgcggtgagaagtgatgagggttagtgaagagggcgacgacgcggacgggtattaggatagggcggcgataggcgaggttgaggttggttttttgttcggatagatttcgagtcggttttcgttcgtcggtcggttttcgtcgagttttcggtattgcggcgtgtacgttacggttacggagcgttcgaaggcggngtgtagtcggggtcgcggtaggtcgtcgggcgcgcgtttcgggagggagcgtgtttcgggagagggcgcggaattttcgggttcgtcgttcgcggcgtagagtttttggggcgagggtaggcgtttgtagcgtagagaggggttgtttttggataagtcgggagtttttgttttttttatggcgaaacggttttttttgtcgcggtagttgtttttagtttcggtaaagtaggttttgttcggttggatattgtgattgtgtagtttattaatagcgagaattagtttaagtagg

SEQ ID NO: 32706 - DNA, 679 bp, Artificial Sequence
  chemically treated genomic DNA (Homo sapiens) CpG-island No: 32706
  misc_feature (296)..(296): n is either a, c, g or t
cctacttaaactaattctcgctattaataaactacacaatcacaatatccaaccgaacaaaacctactttaccgaaactaaaaacaactaccgcgacaaaaaaaaccgtttcgccataaaaaaaacaaaaactcccgacttatccaaaaacaacccctctctacgctacaaacgcctaccctcgccccaaaaactctacgccgcgaacgacgaacccgaaaattccgcgccctctcccgaaacacgctccctcccgaaacgcgcgcccgacgacctaccgcgaccccgactacacnccgccttcgaacgctccgtaaccgtaacgtacacgccgcaataccgaaaactcgacgaaaaccgaccgacgaacgaaaaccgactcgaaatctatccgaacaaaaaaccaacctcaacctcgcctatcgccgccctatcctaatacccgtccgcgtcgtcgccctcttcactaaccctcatcacttctcaccgcgccctccaacttcacccgtacaaataaccccgccgccgcgcacctaccttcgtcccgcaccgataaatatcccaaaaacccactacgaaacgtcgacgccgaaatctcgcgttccctacccgaccttactcccgaacctcctcgaacaactccgaaaccgacgcttctattcactacccgaaaacgcga

SEQ ID NO: 32707 - DNA, 679 bp, Artificial Sequence
  chemically treated genomic DNA (Homo sapiens) CpG-island No: 32707
  misc_feature (296)..(296): n is either a, c, g or t
tttgtttgaattgattttcgttgttggtagattgtatagttatagtatttagtcggataggatttgttttgtcgggattggaaataattatcgcggtaaaagaggtcgtttcgttatgggaagaataagaattttcggtttgtttaggggtagtttttttttgcgttgtaggcgtttattttcgttttagaggttttgcgtcgcgggcggcgagttcgggggtttcgcgttttttttcgaggtacgttttttttcggagcgcgcgttcgacggtttgtcgcggtttcggttgtatntcgttttcgggcgtttcgtagtcgtgacgtgtacgtcgtagtgtcggggattcggcgggggtcggtcggcgggcggagatcgattcgggatttgttcgagtaggaagttagttttagtttcgtttgtcgtcgttttgttttggtgttcgttcgcgtcgtcgttttttttattggtttttattattttttatcgcgttttttagttttattcgtataggtagtttcgtcgtcgcgtatttgttttcgtttcgtatcggtgagtgttttagagatttattgcggggcgtcggcgtcggggtttcgcgttttttgttcggttttgttttcgggttttttcgagtagtttcggggtcgacgtttttgtttattgttcgaggacgcgg

SEQ ID NO: 32708 - DNA, 679 bp, Artificial Sequence
  chemically treated genomic DNA (Homo sapiens) CpG-island No: 32708
  misc_feature (384)..(384): n is either a, c, g or t
ccgcgtcctcgaacaataaacaaaaacgtcgaccccgaaactactcgaaaaaacccgaaaacaaaaccgaacaaaaaacgcgaaaccccgacgccgacgccccgcaataaatctctaaaacactcaccgatacgaaacgaaaacaaatacgcgacgacgaaactacctatacgaataaaactaaaaaacgcgataaaaaataataaaaaccaataaaaaaaacgacgacgcgaacgaacaccaaaacaaaacgacgacaaacgaaactaaaactaacttcctactcgaacaaatcccgaatcgatctccgcccgccgaccgacccccgccgaatccccgacactacgacgtacacgtcacgactacgaaacgcccgaaaacganatacaaccgaaaccgcgacaaaccgtcgaacgcgcgctccgaaaaaaaacgtacctcgaaaaaaaacgcgaaacccccgaactcgccgcccgcgacgcaaaacctctaaaacgaaaataaacgcctacaacgcaaaaaaaaactacccctaaacaaaccgaaaattcttattcttcccataacgaaacgacctcttttaccgcgataattatttccaatcccgacaaaacaaatcctatccgactaaatactataactatacaatctaccaacaacgaaaatcaattcaaacaaa

SEQ ID NO: 32709 - DNA, 570 bp, Artificial Sequence
  chemically treated genomic DNA (Homo sapiens) CpG-island No: 32709
tcgcgggttagagttcgcggttaagttcgcgttcgtttataaagttttcgtttttttttcggttttcgtttcgtcgtgcgttgtaggtcgcggcgttgggggcgttttcgattttcgaggcgttgaggcggcggtttttcgagtttcgtttttttcgatttttagacgggcggtagcggcggcggaggcggcggcggcggcggcggcgagttgagtattaaaagggcgtttattttttcgggcgagttgtagtacgatcgtttttcgcgggcggtcggggttcgcgtcgtagttgtcgtcgcgtttcggtttaggttgtcgcgagaggcggcggtacggttttcgcgcggtcggtgcggcgtttttcggtcgtttcgcgtatagttcgcgtttcggttatggggttgggttgattcggggttcggttaagttgaggcggcggcgttcggtcgtgcgtttagtttgtaggcgtttggtttttacgatgatgaagaagaagaagtttaagtttaaggtggatttcgagttcgaggagttttttttagtgtttttcgttaatggggttttttt

SEQ ID NO: 32710 - DNA, 570 bp, Artificial Sequence
  chemically treated genomic DNA (Homo sapiens) CpG-island No: 32710
aaaaaaaccccattaacgaaaaacactaaaaaaaactcctcgaactcgaaatccaccttaaacttaaacttcttcttcttcatcatcgtaaaaaccaaacgcctacaaactaaacgcacgaccgaacgccgccgcctcaacttaaccgaaccccgaatcaacccaaccccataaccgaaacgcgaactatacgcgaaacgaccgaaaaacgccgcaccgaccgcgcgaaaaccgtaccgccgcctctcgcgacaacctaaaccgaaacgcgacgacaactacgacgcgaaccccgaccgcccgcgaaaaacgatcgtactacaactcgcccgaaaaaataaacgcccttttaatactcaactcgccgccgccgccgccgccgcctccgccgccgctaccgcccgtctaaaaatcgaaaaaaacgaaactcgaaaaaccgccgcctcaacgcctcgaaaatcgaaaacgcccccaacgccgcgacctacaacgcacgacgaaacgaaaaccgaaaaaaaaacgaaaactttataaacgaacgcgaacttaaccgcgaactctaacccgcga

SEQ ID NO: 32711 - DNA, 570 bp, Artificial Sequence
  chemically treated genomic DNA (Homo sapiens) CpG-island No: 32711
aagaggattttattgacgaagggtattgaggagagtttttcgagttcgaagtttattttaaatttaaatttttttttttttattatcgtgagagttaggcgtttgtaagttgggcgtacggtcgggcgtcgtcgttttagtttggtcgagtttcggattagtttagttttatggtcggggcgcgagttgtgcgcggggcggtcggggggcgtcgtatcggtcgcgcggaggtcgtgtcgtcgtttttcgcggtagtttgggtcggaacgcggcggtagttgcggcgcggatttcgatcgttcgcggggagcggtcgtgttgtagttcgttcggggaggtgagcgtttttttggtgtttagttcgtcgtcgtcgtcgtcgtcgttttcgtcgtcgttgtcgttcgtttgggagtcgggagaggcgaggttcgaggaatcgtcgttttagcgtttcgggggtcgggggcgtttttagcgtcgcggtttgtagcgtacggcggggcggaagtcggagggagggcggggattttgtgggcgggcgcgggtttggtcgcggattttaattcgcga

SEQ ID NO: 32712 - DNA, 570 bp, Artificial Sequence
  chemically treated genomic DNA (Homo sapiens) CpG-island No: 32712
tcgcgaattaaaatccgcgaccaaacccgcgcccgcccacaaaatccccgccctccctccgacttccgccccgccgtacgctacaaaccgcgacgctaaaaacgcccccgacccccgaaacgctaaaacgacgattcctcgaacctcgcctctcccgactcccaaacgaacgacaacgacgacgaaaacgacgacgacgacgacgacgaactaaacaccaaaaaaacgctcacctccccgaacgaactacaacacgaccgctccccgcgaacgatcgaaatccgcgccgcaactaccgccgcgttccgacccaaactaccgcgaaaaacgacgacacgacctccgcgcgaccgatacgacgccccccgaccgccccgcgcacaactcgcgccccgaccataaaactaaactaatccgaaactcgaccaaactaaaacgacgacgcccgaccgtacgcccaacttacaaacgcctaactctcacgataataaaaaaaaaaaaatttaaatttaaaataaacttcgaactcgaaaaactctcctcaatacccttcgtcaataaaatcctctt

SEQ ID NO: 32713 - DNA, 560 bp, Artificial Sequence
  chemically treated genomic DNA (Homo sapiens) CpG-island No: 32713
  misc_feature (220)..(221): n is either a, c, g or t
  misc_feature (444)..(444): n is either a, c, g or t
tcgcgtggagttttgttgttttttttgtcgtttttcgttggttaggatcgtttttaggtttttgttacgtttcgggagcgttacgaatttaatagtcgtttaagtcgtttttcggttcgcggtttgcggacgcgttcggagttgggggttttcgttaatagttgtcgtatcgtgtcgcgtcgtagtcgtacgttagcggggttaacggcgcggtaggtannggggttttcgttaaggttcggaagaggattttgaaaatggtttttgggtatgcgttatagcggtcgttacgagacgtaaaatcgacgttttggaattgagagtttagagggacggagttcggcgtattatgaggttttcggggtttaaggtcgatcgtgagagcgtacgaggttggcgagttcgcgtgaggtcgagcgcgggtgcggcgcggcgtacggcggntacgttacgtagcgagtcgtgcgtgcgcggcgttagggcggtttgagttgaggagttggcgttttcgacgattttgtatttcggttgggtaattgtttacgtagatgatggagcga

SEQ ID NO: 32714 - DNA, 560 bp, Artificial Sequence
  chemically treated genomic DNA (Homo sapiens) CpG-island No: 32714
  misc_feature (117)..(117): n is either a, c, g or t
  misc_feature (340)..(341): n is either a, c, g or t
tcgctccatcatctacgtaaacaattacccaaccgaaatacaaaatcgtcgaaaacgccaactcctcaactcaaaccgccctaacgccgcgcacgcacgactcgctacgtaacgtanccgccgtacgccgcgccgcacccgcgctcgacctcacgcgaactcgccaacctcgtacgctctcacgatcgaccttaaaccccgaaaacctcataatacgccgaactccgtccctctaaactctcaattccaaaacgtcgattttacgtctcgtaacgaccgctataacgcatacccaaaaaccattttcaaaatcctcttccgaaccttaacgaaaaccccnntacctaccgcgccgttaaccccgctaacgtacgactacgacgcgacacgatacgacaactattaacgaaaacccccaactccgaacgcgtccgcaaaccgcgaaccgaaaaacgacttaaacgactattaaattcgtaacgctcccgaaacgtaacaaaaacctaaaaacgatcctaaccaacgaaaaacgacaaaaaaaacaacaaaactccacgcga

SEQ ID NO: 32715 - DNA, 560 bp, Artificial Sequence
  chemically treated genomic DNA (Homo sapiens) CpG-island No: 32715
  misc_feature (117)..(117): n is either a, c, g or t
  misc_feature (340)..(341): n is either a, c, g or t
tcgttttattatttgcgtaagtagttgtttaatcgaaatataaagtcgtcgggagcgttagttttttaatttaggtcgttttgacgtcgcgtacgtacggttcgttgcgtgacgtantcgtcgtacgtcgcgtcgtattcgcgttcggttttacgcgggttcgttaatttcgtgcgtttttacggtcggttttgggtttcgggagttttatggtgcgtcgagtttcgtttttttaggtttttagttttaaggcgtcggttttgcgtttcgtaacggtcgttgtggcgtatgtttagaagttatttttaaggttttttttcgaattttggcgaggattttnntgtttgtcgcgtcgttgatttcgttagcgtgcggttgcgacgcggtacggtacggtagttgttggcgaaggtttttaatttcgagcgcgttcgtagatcgcgagtcggaaggcggtttgggcggttgttgagttcgtggcgttttcgaggcgtggtaaaggtttaaaaacggttttggttagcggaaggcggtaagaggagtagtaaggttttacgcga

SEQ ID NO: 32716 - DNA, 560 bp, Artificial Sequence
  chemically treated genomic DNA (Homo sapiens) CpG-island No: 32716
  misc_feature (220)..(221): n is either a, c, g or t
  misc_feature (444)..(444): n is either a, c, g or t
tcgcgtaaaaccttactactcctcttaccgccttccgctaaccaaaaccgtttttaaacctttaccacgcctcgaaaacgccacgaactcaacaaccgcccaaaccgccttccgactcgcgatctacgaacgcgctcgaaattaaaaaccttcgccaacaactaccgtaccgtaccgcgtcgcaaccgcacgctaacgaaatcaacgacgcgacaaacannaaaatcctcgccaaaattcgaaaaaaaaccttaaaaataacttctaaacatacgccacaacgaccgttacgaaacgcaaaaccgacgccttaaaactaaaaacctaaaaaaacgaaactcgacgcaccataaaactcccgaaacccaaaaccgaccgtaaaaacgcacgaaattaacgaacccgcgtaaaaccgaacgcgaatacgacgcgacgtacgacgantacgtcacgcaacgaaccgtacgtacgcgacgtcaaaacgacctaaattaaaaaactaacgctcccgacgactttatatttcgattaaacaactacttacgcaaataataaaacga

SEQ ID NO: 32717 - DNA, 545 bp, Artificial Sequence
  chemically treated genomic DNA (Homo sapiens) CpG-island No: 32717
  misc_feature (176)..(176): n is either a, c, g or t
gacgaagcgcgagaagtgattcgtggtagttagacgttgttgcgtggtgtgaaaattgggcgtaagaagtcgatgttcggttgacgaaagaagcgtagacgttgggcgttcggttgattaatttgacgggaatcgtgttgtatattaattttgggcgagttttataggcggaagtngggtggaagtcgttgcgtaggttatgcgttcgttagtgattttcgagtatgatttggacgacgtcggacgcggatatcggtatcgggcgttggtagttgtatgtgtcgtattacggaggcggaagatgtttgtatcgttaataataatgcggcggcggtgttattgatgttggcggttattgtatgcggaaaagaggtggtggtatttcgcggcgaattggtggagattcgcggcgcgtttcgtaatttcgatgttatgcgttaggtagggtgtattttatacgaatagggagtattaatcgtacgtacgtatatgattatcgttaggcggtgaatgaaaatatcgtattgttgatgagagtatatagt

SEQ ID NO: 32718 - DNA, 545 bp, Artificial Sequence
  chemically treated genomic DNA (Homo sapiens) CpG-island No: 32718
  misc_feature (370)..(370): n is either a, c, g or t
actatatactctcatcaacaatacgatattttcattcaccgcctaacgataatcatatacgtacgtacgattaatactccctattcgtataaaatacaccctacctaacgcataacatcgaaattacgaaacgcgccgcgaatctccaccaattcgccgcgaaataccaccacctcttttccgcatacaataaccgccaacatcaataacaccgccgccgcattattattaacgatacaaacatcttccgcctccgtaatacgacacatacaactaccaacgcccgataccgatatccgcgtccgacgtcgtccaaatcatactcgaaaatcactaacgaacgcataacctacgcaacgacttccacccnacttccgcctataaaactcgcccaaaattaatatacaacacgattcccgtcaaattaatcaaccgaacgcccaacgtctacgcttctttcgtcaaccgaacatcgacttcttacgcccaattttcacaccacgcaacaacgtctaactaccacgaatcacttctcgcgcttcgtc

SEQ ID NO: 32719 - DNA, 545 bp, Artificial Sequence
  chemically treated genomic DNA (Homo sapiens) CpG-island No: 32719
  misc_feature (370)..(370): n is either a, c, g or t
gttatgtatttttattaatagtgcggtatttttatttatcgtttgacgataattatgtgcgtgcgtgcggttggtgttttttattcgtgtagggtgtattttgtttgacgtataatatcgggattacgaaacgcgtcgcgaatttttattagttcgtcgcgagatattattatttttttttcgtatgtagtggtcgttaatattaataatatcgtcgtcgtattgttattgacgatataggtatttttcgttttcgtaatacggtatatgtagttgttagcgttcgatgtcgatgttcgcgttcggcgtcgtttagattatattcgagggttattggcgaacgtatagtttgcgtaacggtttttatttngttttcgtttgtaaagttcgtttaaggttggtatgtagtacggttttcgttaggttgattagtcggacgtttagcgtttgcgtttttttcgttaatcgggtatcgattttttgcgtttagtttttatattacgtagtagcgtttggttgttacgaattatttttcgcgtttcgtt

SEQ ID NO: 32720 - DNA, 545 bp, Artificial Sequence
  chemically treated genomic DNA (Homo sapiens) CpG-island No: 32720
  misc_feature (176)..(176): n is either a, c, g or t
aacgaaacgcgaaaaataattcgtaacaaccaaacgctactacgtaatataaaaactaaacgcaaaaaatcgatacccgattaacgaaaaaaacgcaaacgctaaacgtccgactaatcaacctaacgaaaaccgtactacataccaaccttaaacgaactttacaaacgaaaacnaaataaaaaccgttacgcaaactatacgttcgccaataaccctcgaatataatctaaacgacgccgaacgcgaacatcgacatcgaacgctaacaactacatataccgtattacgaaaacgaaaaatacctatatcgtcaataacaatacgacgacgatattattaatattaacgaccactacatacgaaaaaaaaataataatatctcgcgacgaactaataaaaattcgcgacgcgtttcgtaatcccgatattatacgtcaaacaaaatacaccctacacgaataaaaaacaccaaccgcacgcacgcacataattatcgtcaaacgataaataaaaataccgcactattaataaaaatacataac

SEQ ID NO: 32721 - DNA, 535 bp, Artificial Sequence
  chemically treated genomic DNA (Homo sapiens) CpG-island No: 32721
gcgggcgattttcgggttttcgtagaatttaatttttagcggtaacggagcgttaagtttttcgcgggcgattttcgggttttcgtagaatttaatttttagcggtaacggagcgttaagtttttcgcgggcgattttcgggttttcgtagaatttaatttttagcggtaacggagcgttaagtttttcgcgggcgattttcgggttttcgtagaatttaatttttagcggtaacggagcgttaagtttttcgcgggcgattttcgggttttcgtagaatttaatttttagcggtaacggagcgttaagtttttcgcgggcgattttcgggttttcgtagaatttaatttttagcggtaacggagcgttaagtttttcgcgggcgattttcgggttttcgtagaatttaatttttagcggtaacggagcgttaagtttttcgcgggcgattttcgggttttcgtagaagtatatttgttttttttttttatatttgatttttttaagggcgggttgttatttttattgtgtagtt

SEQ ID NO: 32722 - DNA, 535 bp, Artificial Sequence
  chemically treated genomic DNA (Homo sapiens) CpG-island No: 32722
aactacacaataaaaataacaacccgcccttaaaaaaatcaaatataaaaaaaaaaaacaaatatacttctacgaaaacccgaaaatcgcccgcgaaaaacttaacgctccgttaccgctaaaaattaaattctacgaaaacccgaaaatcgcccgcgaaaaacttaacgctccgttaccgctaaaaattaaattctacgaaaacccgaaaatcgcccgcgaaaaacttaacgctccgttaccgctaaaaattaaattctacgaaaacccgaaaatcgcccgcgaaaaacttaacgctccgttaccgctaaaaattaaattctacgaaaacccgaaaatcgcccgcgaaaaacttaacgctccgttaccgctaaaaattaaattctacgaaaacccgaaaatcgcccgcgaaaaacttaacgctccgttaccgctaaaaattaaattctacgaaaacccgaaaatcgcccgcgaaaaacttaacgctccgttaccgctaaaaattaaattctacgaaaacccgaaaatcgcccgc

SEQ ID NO: 32723 - DNA, 535 bp, Artificial Sequence
  chemically treated genomic DNA (Homo sapiens) CpG-island No: 32723
agttgtatagtggaggtaatagttcgtttttgaaggagttaagtgtgggaggaggaagtaaatgtgtttttgcggggattcggaaatcgttcgcggggggtttagcgtttcgttatcgttgagggttggattttgcggggattcggaaatcgttcgcggggggtttagcgtttcgttatcgttgagggttggattttgcggggattcggaaatcgttcgcggggggtttagcgtttcgttatcgttgagggttggattttgcggggattcggaaatcgttcgcggggggtttagcgtttcgttatcgttgagggttggattttgcggggattcggaaatcgttcgcggggggtttagcgtttcgttatcgttgagggttggattttgcggggattcggaaatcgttcgcggggggtttagcgtttcgttatcgttgagggttggattttgcggggattcggaaatcgttcgcggggggtttagcgtttcgttatcgttgagggttggattttgcggggattcggaaatcgttcgt

SEQ ID NO: 32724 - DNA, 535 bp, Artificial Sequence
  chemically treated genomic DNA (Homo sapiens) CpG-island No: 32724
acgaacgatttccgaatccccgcaaaatccaaccctcaacgataacgaaacgctaaaccccccgcgaacgatttccgaatccccgcaaaatccaaccctcaacgataacgaaacgctaaaccccccgcgaacgatttccgaatccccgcaaaatccaaccctcaacgataacgaaacgctaaaccccccgcgaacgatttccgaatccccgcaaaatccaaccctcaacgataacgaaacgctaaaccccccgcgaacgatttccgaatccccgcaaaatccaaccctcaacgataacgaaacgctaaaccccccgcgaacgatttccgaatccccgcaaaatccaaccctcaacgataacgaaacgctaaaccccccgcgaacgatttccgaatccccgcaaaatccaaccctcaacgataacgaaacgctaaaccccccgcgaacgatttccgaatccccgcaaaaacacatttacttcctcctcccacacttaactccttcaaaaacgaactattacctccactatacaact

SEQ ID NO: 32725 - DNA, 506 bp, Artificial Sequence
  chemically treated genomic DNA (Homo sapiens) CpG-island No: 32725
taagttaggtgttcgcggtgcggttgcggttggcgtcggttcgagttcgggagttgttgtttagcgagcggggaaagttcgtttatttcggttagcgcgcgcgggagataggatcgagtcgggcgataggggtagtcgttcggaggggcgcggggagtggggtagggtcgggtcgtatttgaaatcgcggggcggtttcggtttagttcggcggacgaatttcgggagattttttacgttttcgggcgggaggggtagtttttcgtcgtcggtttcgttttttttttcggtagcgtttagtagttttacggcgttgtttggggcgttttttcgcgggtgggtttaggcgattcgcggtagtagcggttttcgttttttattttttttttttttcgggttttcgtcgttcgcggacgttaatcggtcgggttcggagggattttttatggattttttttgtttttttcgcgttgagattagattagagtagttaggtgttagagatt

SEQ ID NO: 32726 - DNA, 506 bp, Artificial Sequence
  chemically treated genomic DNA (Homo sapiens) CpG-island No: 32726
aatctctaacacctaactactctaatctaatctcaacgcgaaaaaaacaaaaaaaatccataaaaaatccctccgaacccgaccgattaacgtccgcgaacgacgaaaacccgaaaaaaaaaaaaaataaaaaacgaaaaccgctactaccgcgaatcgcctaaacccacccgcgaaaaaacgccccaaacaacgccgtaaaactactaaacgctaccgaaaaaaaaaacgaaaccgacgacgaaaaactacccctcccgcccgaaaacgtaaaaaatctcccgaaattcgtccgccgaactaaaccgaaaccgccccgcgatttcaaatacgacccgaccctaccccactccccgcgcccctccgaacgactacccctatcgcccgactcgatcctatctcccgcgcgcgctaaccgaaataaacgaactttccccgctcgctaaacaacaactcccgaactcgaaccgacgccaaccgcaaccgcaccgcgaacacctaactta

SEQ ID NO: 32727 - DNA, 506 bp, Artificial Sequence
  chemically treated genomic DNA (Homo sapiens) CpG-island No: 32727
agtttttggtatttggttgttttgatttggttttagcgcggagggagtagagggagtttatggaggattttttcgagttcgatcggttggcgttcgcggacggcgggagttcggaggaggaggaggatggggagcgggagtcgttgttatcgcggatcgtttgggtttattcgcggagaggcgttttaggtagcgtcgtgaggttgttggacgttgtcggggaggagggcgaggtcggcgacgaggagttgtttttttcgttcggggacgtggggggtttttcggagttcgttcgtcgagttggatcggagtcgtttcgcggttttaggtgcgattcggttttgttttatttttcgcgttttttcgggcggttgtttttgtcgttcggttcggttttgtttttcgcgcgcgttggtcgaggtggacgggtttttttcgttcgttgggtagtagttttcgagttcggatcggcgttagtcgtagtcgtatcgcgggtatttagtttg

SEQ ID NO: 32728 - DNA, 506 bp, Artificial Sequence
  chemically treated genomic DNA (Homo sapiens) CpG-island No: 32728
caaactaaatacccgcgatacgactacgactaacgccgatccgaactcgaaaactactacccaacgaacgaaaaaaacccgtccacctcgaccaacgcgcgcgaaaaacaaaaccgaaccgaacgacaaaaacaaccgcccgaaaaaacgcgaaaaataaaacaaaaccgaatcgcacctaaaaccgcgaaacgactccgatccaactcgacgaacgaactccgaaaaaccccccacgtccccgaacgaaaaaaacaactcctcgtcgccgacctcgccctcctccccgacaacgtccaacaacctcacgacgctacctaaaacgcctctccgcgaataaacccaaacgatccgcgataacaacgactcccgctccccatcctcctcctcctccgaactcccgccgtccgcgaacgccaaccgatcgaactcgaaaaaatcctccataaactccctctactccctccgcgctaaaaccaaatcaaaacaaccaaataccaaaaact

SEQ ID NO: 32729 - DNA, 560 bp, Artificial Sequence
  chemically treated genomic DNA (Homo sapiens) CpG-island No: 32729
gaatattattttaagtttgcgatcgcgcggtattattttcgttttttttttttttttatttcgttttttttatttttttcgggagtttttgggagtcgggtcgtcgtgtgcgtaagcgtgtttagtttttttttcgtttttaattcgggttcgggttttcgttttttttgtaggcggattcgttcgtttttaggtcggattcgcgttcgggatagggattcggtcgagtcgagtcgtcgcgttagcgttgcgtcgtcggtcggtgcgtttagcggatcggagttgcgcgcggaatcgtgttgtttcgtttcgttttattcgtgagggtgagtacgcggcggcggtgcgcgggggttcgcggggcggggcggggcggggagtcgcggggttttcggtcgtttgattttagtcggcgtcgcgtttttcggaggggggtcgggttttgtacgtgggcgtagcgcgggtcggggtggggttgttatagttttgcggagttgtttttcggggtttttttttttggattagattttcgcgggaagtcggatttttttcgttttttt

SEQ ID NO: 32730 - DNA, 560 bp, Artificial Sequence
  chemically treated genomic DNA (Homo sapiens) CpG-island No: 32730
aaaaaaacgaaaaaaatccgacttcccgcgaaaatctaatccaaaaaaaaaaaccccgaaaaacaactccgcaaaactataacaaccccaccccgacccgcgctacgcccacgtacaaaacccgacccccctccgaaaaacgcgacgccgactaaaatcaaacgaccgaaaaccccgcgactccccgccccgccccgccccgcgaacccccgcgcaccgccgccgcgtactcaccctcacgaataaaacgaaacgaaacaacacgattccgcgcgcaactccgatccgctaaacgcaccgaccgacgacgcaacgctaacgcgacgactcgactcgaccgaatccctatcccgaacgcgaatccgacctaaaaacgaacgaatccgcctacaaaaaaaacgaaaacccgaacccgaattaaaaacgaaaaaaaaactaaacacgcttacgcacacgacgacccgactcccaaaaactcccgaaaaaaataaaaaaaacgaaataaaaaaaaaaaaaaaacgaaaataataccgcgcgatcgcaaacttaaaataatattc

SEQ ID NO: 32731 - DNA, 560 bp, Artificial Sequence
  chemically treated genomic DNA (Homo sapiens) CpG-island No: 32731
aagggagcggagaggattcggtttttcgcgaaaatttggtttagggaaagggatttcggaaagtagtttcgtagggttgtggtagttttatttcgattcgcgttgcgtttacgtgtagggttcgattttttttcgggaggcgcggcgtcggttggggttaggcggtcgaggatttcgcggtttttcgtttcgtttcgtttcgcgggttttcgcgtatcgtcgtcgcgtatttatttttacgggtggagcggggcggggtagtacggtttcgcgcgtagtttcgattcgttaggcgtatcgatcggcggcgtagcgttggcgcgacggttcgattcggtcgggtttttgtttcgggcgcgggttcggtttgggagcgggcgagttcgtttgtaggggaggcggggattcgggttcgggttgggggcggggaaggggttggatacgtttgcgtatacggcggttcgatttttaggagttttcgggaggggtagaaagggcggggtggaggagggggaagggcgggggtgatgtcgcgcggtcgtaggtttgggatggtgttt

SEQ ID NO: 32732 - DNA, 560 bp, Artificial Sequence
  chemically treated genomic DNA (Homo sapiens) CpG-island No: 32732
aaacaccatcccaaacctacgaccgcgcgacatcacccccgcccttccccctcctccaccccgccctttctacccctcccgaaaactcctaaaaatcgaaccgccgtatacgcaaacgtatccaaccccttccccgcccccaacccgaacccgaatccccgcctcccctacaaacgaactcgcccgctcccaaaccgaacccgcgcccgaaacaaaaacccgaccgaatcgaaccgtcgcgccaacgctacgccgccgatcgatacgcctaacgaatcgaaactacgcgcgaaaccgtactaccccgccccgctccacccgtaaaaataaatacgcgacgacgatacgcgaaaacccgcgaaacgaaacgaaacgaaaaaccgcgaaatcctcgaccgcctaaccccaaccgacgccgcgcctcccgaaaaaaaatcgaaccctacacgtaaacgcaacgcgaatcgaaataaaactaccacaaccctacgaaactactttccgaaatccctttccctaaaccaaattttcgcgaaaaaccgaatcctctccgctccctt

SEQ ID NO: 32733 - DNA, 604 bp, Artificial Sequence
  chemically treated genomic DNA (Homo sapiens) CpG-island No: 32733
ggttagagttgagatattagaggcgggggtcgttattaagttgcggggtagtttgaaggggacgagaaaacgaagcggagttcgggttacgcgtgagtggttagtgtgaggtgggcggggagggtgggaggaggcgcggaatagagtcgaaggggattatggatcgggttaggaaagaagagtttggagttttgattttacggggacggtatttgtagtagtacggaacgaattaacgcgttaacgggttcggtgtatgagtcgttaacgttttggaagtattagagtataagttcgtttttggagaaaatggtgaagaagtcgagtatggcggtagcggtagaggagttggggtcggcgtcgggaatttaggtcgcgttcgtcgtcgttttttgttgcgttaagcgcgggatacgttatattagtggtttcggaaatcggtttaatcgtattttcgtttagaacgtcgggtgttttttttattttcgttcgggggcgcgtaggattgacgtatcgtaaggttagttaatggcgggtgggagcgggtttgggtggggttttaggagaggttacggggagacggttatttagagtattgggcggg

SEQ ID NO: 32734 - DNA, 604 bp, Artificial Sequence
  chemically treated genomic DNA (Homo sapiens) CpG-island No: 32734
cccgcccaatactctaaataaccgtctccccgtaacctctcctaaaaccccacccaaacccgctcccacccgccattaactaaccttacgatacgtcaatcctacgcgcccccgaacgaaaataaaaaaaacacccgacgttctaaacgaaaatacgattaaaccgatttccgaaaccactaatataacgtatcccgcgcttaacgcaacaaaaaacgacgacgaacgcgacctaaattcccgacgccgaccccaactcctctaccgctaccgccatactcgacttcttcaccattttctccaaaaacgaacttatactctaatacttccaaaacgttaacgactcatacaccgaacccgttaacgcgttaattcgttccgtactactacaaataccgtccccgtaaaatcaaaactccaaactcttctttcctaacccgatccataatccccttcgactctattccgcgcctcctcccaccctccccgcccacctcacactaaccactcacgcgtaacccgaactccgcttcgttttctcgtccccttcaaactaccccgcaacttaataacgacccccgcctctaatatctcaactctaacc

SEQ ID NO: 32735 - DNA, 604 bp, Artificial Sequence
  chemically treated genomic DNA (Homo sapiens) CpG-island No: 32735
ttcgtttaatgttttaggtggtcgttttttcgtgattttttttggagttttatttaggttcgtttttattcgttattggttggttttgcgatacgttagttttgcgcgttttcgggcggagatggggagggtattcggcgttttgagcggaagtacggttgagtcgattttcggggttattggtgtgacgtgtttcgcgtttggcgtagtaggaagcggcggcgaacgcggtttgaattttcggcgtcggttttagtttttttgtcgttgtcgttatgttcgatttttttattattttttttaagggcgggtttgtgttttggtgtttttagggcgttagcgatttatgtatcggattcgttaacgcgttgattcgtttcgtgttgttgtaggtatcgttttcgtgggattagaattttaggttttttttttttgattcgatttatggtttttttcgattttatttcgcgtttttttttatttttttcgtttattttatattgattatttacgcgtaattcggatttcgtttcgttttttcgttttttttagattatttcgtaatttaatgacggttttcgtttttggtgttttaattttagtt

SEQ ID NO: 32736 - DNA, 604 bp, Artificial Sequence
  chemically treated genomic DNA (Homo sapiens) CpG-island No: 32736
aactaaaattaaaacaccaaaaacgaaaaccgtcattaaattacgaaataatctaaaaaaaacgaaaaaacgaaacgaaatccgaattacgcgtaaataatcaatataaaataaacgaaaaaaataaaaaaaaacgcgaaataaaatcgaaaaaaaccataaatcgaatcaaaaaaaaaaaacctaaaattctaatcccacgaaaacgatacctacaacaacacgaaacgaatcaacgcgttaacgaatccgatacataaatcgctaacgccctaaaaacaccaaaacacaaacccgcccttaaaaaaaataataaaaaaatcgaacataacgacaacgacaaaaaaactaaaaccgacgccgaaaattcaaaccgcgttcgccgccgcttcctactacgccaaacgcgaaacacgtcacaccaataaccccgaaaatcgactcaaccgtacttccgctcaaaacgccgaataccctccccatctccgcccgaaaacgcgcaaaactaacgtatcgcaaaaccaaccaataacgaataaaaacgaacctaaataaaactccaaaaaaaatcacgaaaaaacgaccacctaaaacattaaacgaa

SEQ ID NO: 32737 - DNA, 718 bp, Artificial Sequence
  chemically treated genomic DNA (Homo sapiens) CpG-island No: 32737
ttataacgtattgagcgttaggtttttttagcgaggtaagcgaaaggggagtcgtttcgcgcgagtttttttgcgatagaaaaggtgatatttttttcggagggtttttttatgtcgtttgcgtgttgcgggtgttagaaaggtgaagaagggaagcggatgtgtcgttagtagggtaaggtcggatcggaggcggcgcgtatttttgcggttttcggtggggtcgggattttggggtttaggtcggtcgcgtttcgtcgtttattttacggagtttcgtcgcgtttttcggtttttcgcgatttcgtttcgggtttatttgcgcgcgggtttagttgcgatgagggttgcgcggattgcgcgggtttcgcggggaagagtagcgcgtaggtttcgtttttcggaagcgtcgttcgtcgtattgttttttttacgtcgttaggtttagtttagattcgggagattttcgggtataattcggttgcgggagacgcgggacggggtagtttttgtgtttattgcggttcgagtttttgttagtttggtttttgtatgatttcgggttttcgtttttttcgtttgcgttggggcggttcgtagtaattcggagaggagttcgtggttagggtttttcggcgtttatcgtgataatttgaaatttgggttttgttttaggcgggggagaaggaaaaaaaaatattttatttcgtttatttaa

SEQ ID NO: 32738 - DNA, 718 bp, Artificial Sequence
  chemically treated genomic DNA (Homo sapiens) CpG-island No: 32738
ttaaataaacgaaataaaatatttttttttccttctcccccgcctaaaacaaaacccaaatttcaaattatcacgataaacgccgaaaaaccctaaccacgaactcctctccgaattactacgaaccgccccaacgcaaacgaaaaaaacgaaaacccgaaatcatacaaaaaccaaactaacaaaaactcgaaccgcaataaacacaaaaactaccccgtcccgcgtctcccgcaaccgaattatacccgaaaatctcccgaatctaaactaaacctaacgacgtaaaaaaaacaatacgacgaacgacgcttccgaaaaacgaaacctacgcgctactcttccccgcgaaacccgcgcaatccgcgcaaccctcatcgcaactaaacccgcgcgcaaataaacccgaaacgaaatcgcgaaaaaccgaaaaacgcgacgaaactccgtaaaataaacgacgaaacgcgaccgacctaaaccccaaaatcccgaccccaccgaaaaccgcaaaaatacgcgccgcctccgatccgaccttaccctactaacgacacatccgcttcccttcttcacctttctaacacccgcaacacgcaaacgacataaaaaaaccctccgaaaaaaatatcaccttttctatcgcaaaaaaactcgcgcgaaacgactcccctttcgcttacctcgctaaaaaaacctaacgctcaatacgttataa

SEQ ID NO: 32739 - DNA, 718 bp, Artificial Sequence
  chemically treated genomic DNA (Homo sapiens) CpG-island No: 32739
ttaaatgggcggaatagggtgtttttttttttttttttttcgtttagaataaaatttaggttttaggttgttacggtgggcgtcgggggattttggttacgggttttttttcgagttgttgcggatcgttttaacgtaagcggagaggacgggagttcggagttatgtagaagttaggttggtaggggttcgggtcgtagtggatataggggttgtttcgtttcgcgtttttcgtagtcggattgtgttcgagagtttttcgggtttggattgggtttggcggcgtgggaggggtagtgcggcgggcggcgttttcggagagcggggtttgcgcgttgttttttttcgcggagttcgcgtagttcgcgtagtttttatcgtaattgggttcgcgcgtaggtgagttcggggcggggtcgcgggggatcgggaggcgcggcggggtttcgtggggtgggcgacggagcgcggtcggtttgggttttagagtttcggttttatcgagagtcgtaggggtgcgcgtcgttttcggttcggttttgttttgttggcggtatattcgttttttttttttatttttttggtattcgtaatacgtaagcggtatgaaagggtttttcgaggagaatgttattttttttgtcgtaaagaagttcgcgcggggcggtttttttttcgtttgtttcgttggaagagtttggcgtttagtgcgttgtgg

SEQ ID NO: 32740 - DNA, 718 bp, Artificial Sequence
  chemically treated genomic DNA (Homo sapiens) CpG-island No: 32740
ccacaacgcactaaacgccaaactcttccaacgaaacaaacgaaaaaaaaaccgccccgcgcgaacttctttacgacaaaaaaaataacattctcctcgaaaaaccctttcataccgcttacgtattacgaataccaaaaaaataaaaaaaaaaaacgaatataccgccaacaaaacaaaaccgaaccgaaaacgacgcgcacccctacgactctcgataaaaccgaaactctaaaacccaaaccgaccgcgctccgtcgcccaccccacgaaaccccgccgcgcctcccgatcccccgcgaccccgccccgaactcacctacgcgcgaacccaattacgataaaaactacgcgaactacgcgaactccgcgaaaaaaaacaacgcgcaaaccccgctctccgaaaacgccgcccgccgcactacccctcccacgccgccaaacccaatccaaacccgaaaaactctcgaacacaatccgactacgaaaaacgcgaaacgaaacaacccctatatccactacgacccgaacccctaccaacctaacttctacataactccgaactcccgtcctctccgcttacgttaaaacgatccgcaacaactcgaaaaaaaacccgtaaccaaaatcccccgacgcccaccgtaacaacctaaaacctaaattttattctaaacgaaaaaaaaaaaaaaaaaaacaccctattccgcccatttaa

SEQ ID NO: 32741 - DNA, 511 bp, Artificial Sequence
  chemically treated genomic DNA (Homo sapiens) CpG-island No: 32741
gttttcgaggtttttttaataaacgcgtattttagtttcgattcggtatagaacgattcggggaattatcgtcgaggtcgagtcgagacgagagatattattataagtaatttattttttatttcgggttttataaaggggacgaatttttttggttagttcggagtcgcgtatgagtaagaaggagcggagttaggcgtgttgtttttatttcgttcggaattataatttttagaagcgttttggtatcgttagatttcggtttttcgtaggtgggagtatttatggtgaggttgggagaatcggtcgatcgaagagtttcgttcgtttcgcgagagtatgaggtagtattttttgtgtttaatttttagggtaagggagggagggagtagcggagacgcggatcggagttagggttcgttttcgcgttttgtttgtataagtttttgtggtatagtgtttagggttgttgagtttaatttaaattatttcggtgtaagatacgttaaaa

SEQ ID NO: 32742 - DNA, 511 bp, Artificial Sequence
  chemically treated genomic DNA (Homo sapiens) CpG-island No: 32742
ttttaacgtatcttacaccgaaataatttaaattaaactcaacaaccctaaacactataccacaaaaacttatacaaacaaaacgcgaaaacgaaccctaactccgatccgcgtctccgctactccctccctcccttaccctaaaaattaaacacaaaaaatactacctcatactctcgcgaaacgaacgaaactcttcgatcgaccgattctcccaacctcaccataaatactcccacctacgaaaaaccgaaatctaacgataccaaaacgcttctaaaaattataattccgaacgaaataaaaacaacacgcctaactccgctccttcttactcatacgcgactccgaactaaccaaaaaaattcgtcccctttataaaacccgaaataaaaaataaattacttataataatatctctcgtctcgactcgacctcgacgataattccccgaatcgttctataccgaatcgaaactaaaatacgcgtttattaaaaaaacctcgaaaac

SEQ ID NO: 32743 - DNA, 511 bp, Artificial Sequence
  chemically treated genomic DNA (Homo sapiens) CpG-island No: 32743
ttttaacgtattttatatcggagtaatttgggttgaatttagtagttttaagtattgtgttataggaatttgtgtagataaagcgcggggacggattttgatttcggttcgcgttttcgttgtttttttttttttttgttttgaggattagatataggagatgttgttttatattttcgcgagacggacggagtttttcgatcggtcgatttttttaattttattatgggtgtttttatttgcggagaatcggagtttggcgatgttaaggcgtttttgggaattgtagtttcgggcggaatgagagtagtacgtttggtttcgtttttttttatttatgcgcgatttcgagttggttaaagaagttcgttttttttgtgaggttcgggatgggaggtgagttgtttgtggtgatgtttttcgtttcggttcggtttcggcggtagtttttcgggtcgttttgtgtcgagtcggggttagagtgcgcgtttgttaaaggggtttcgagggt

SEQ ID NO: 32744 - DNA, 511 bp, Artificial Sequence
  chemically treated genomic DNA (Homo sapiens) CpG-island No: 32744
accctcgaaacccctttaacaaacgcgcactctaaccccgactcgacacaaaacgacccgaaaaactaccgccgaaaccgaaccgaaacgaaaaacatcaccacaaacaactcacctcccatcccgaacctcacaaaaaaaacgaacttctttaaccaactcgaaatcgcgcataaataaaaaaaaacgaaaccaaacgtactactctcattccgcccgaaactacaattcccaaaaacgccttaacatcgccaaactccgattctccgcaaataaaaacacccataataaaattaaaaaaatcgaccgatcgaaaaactccgtccgtctcgcgaaaatataaaacaacatctcctatatctaatcctcaaaacaaaaaaaaaaaaaaacaacgaaaacgcgaaccgaaatcaaaatccgtccccgcgctttatctacacaaattcctataacacaatacttaaaactactaaattcaacccaaattactccgatataaaatacgttaaaa

SEQ ID NO: 32745 - DNA, 797 bp, Artificial Sequence
  chemically treated genomic DNA (Homo sapiens) CpG-island No: 32745
ttcgatggcgcgggtgattaggttcgcgtaggataggtttttttaggcgtttcgtcgcgacgaatattttttcggttgttcggagtttttagtcgttttcggttgcggcggtggtagcggttgttgaggttgtagtagcgtttgtgtattttcgtttagttcgttcgtcgcggtggttggtttagattcggggttttgtttttcgggtgttagtattcggatcgagtttttaaggagtagttcggagattagcgtgcggttttcgtcgtcgtcgtcgatcgttatggtcgagtcggttcgtttttcgtcgttttcgtcgtttttatcgttttttttttcggggattatggagtcggcggtcgtttttttcgagggtttggtagggttcgtttggagtttcggtttttgtaggggttacgtataggatcgcggacggttttggggttcgaatttcgggtttagttttatttcgagcggagaaagcggggtcggggaagtcggtgtttttgttattttcgtcgttcgttcggtcgcggttggggttttcgcgtttttttttcgcgtcggggcggggtgtagcgggggagggacgtggacgtcgcgaaggtttcggttttcgggcgtcgtcgtcgtcgtcgtcgtttggggaagtacgagagaagagagaaggagagttggttattttcggtcggagtttcgttttcggcgagttttcgttcgttgtcgttattttttagttttgtcgcgttcgttttttaggaataggagattatattttttaataatattttttgttt

SEQ ID NO: 32746 - DNA, 797 bp, Artificial Sequence
  chemically treated genomic DNA (Homo sapiens) CpG-island No: 32746
aaacaaaaaatattattaaaaaatataatctcctattcctaaaaaacgaacgcgacaaaactaaaaaataacgacaacgaacgaaaactcgccgaaaacgaaactccgaccgaaaataaccaactctccttctctcttctctcgtacttccccaaacgacgacgacgacgacgacgcccgaaaaccgaaaccttcgcgacgtccacgtccctcccccgctacaccccgccccgacgcgaaaaaaaaacgcgaaaaccccaaccgcgaccgaacgaacgacgaaaataacaaaaacaccgacttccccgaccccgctttctccgctcgaaataaaactaaacccgaaattcgaaccccaaaaccgtccgcgatcctatacgtaacccctacaaaaaccgaaactccaaacgaaccctaccaaaccctcgaaaaaaacgaccgccgactccataatccccgaaaaaaaaaacgataaaaacgacgaaaacgacgaaaaacgaaccgactcgaccataacgatcgacgacgacgacgaaaaccgcacgctaatctccgaactactccttaaaaactcgatccgaatactaacacccgaaaaacaaaaccccgaatctaaaccaaccaccgcgacgaacgaactaaacgaaaatacacaaacgctactacaacctcaacaaccgctaccaccgccgcaaccgaaaacgactaaaaactccgaacaaccgaaaaaatattcgtcgcgacgaaacgcctaaaaaaacctatcctacgcgaacctaatcacccgcgccatcgaa

SEQ ID NO: 32747 - DNA, 797 bp, Artificial Sequence
  chemically treated genomic DNA (Homo sapiens) CpG-island No: 32747
aaataaaaagtgttattaagaagtatggttttttgtttttgggaggcgggcgcggtaagattgggaggtggcggtagcgggcgaggattcgtcgaggacggggtttcggtcggggataattaatttttttttttttttttttcgtgtttttttaggcggcggcggcggcggcggcgttcgggagtcggagttttcgcggcgtttacgtttttttttcgttgtatttcgtttcggcgcgagaggagagcgcgagaattttagtcgcggtcgggcgggcggcgaagatggtagaggtatcggttttttcggtttcgtttttttcgttcgaagtggagttggattcggagttcgagttttagagtcgttcgcgattttgtacgtggtttttgtaaaggtcggagttttaagcgagttttgttaagttttcgggggagacggtcgtcgattttatgattttcgaggaggaggacgatgaagacgacgaggacggcgggggacgggtcggttcggttatggcgatcggcggcggcggcgggagtcgtacgttggttttcgggttgttttttgaggattcggttcgggtgttggtattcggagggtaagatttcgggtttgggttagttatcgcggcgggcgggttgagcgggggtatataggcgttgttgtagttttagtaatcgttgttatcgtcgtagtcgggggcggttgggggtttcgggtagtcgaggaaatgttcgtcgcggcggaacgtttggggaaatttgttttacgcggatttgattattcgcgttatcgag

SEQ ID NO: 32748 - DNA, 797 bp, Artificial Sequence
  chemically treated genomic DNA (Homo sapiens) CpG-island No: 32748
ctcgataacgcgaataatcaaatccgcgtaaaacaaatttccccaaacgttccgccgcgacgaacatttcctcgactacccgaaacccccaaccgcccccgactacgacgataacaacgattactaaaactacaacaacgcctatatacccccgctcaacccgcccgccgcgataactaacccaaacccgaaatcttaccctccgaataccaacacccgaaccgaatcctcaaaaaacaacccgaaaaccaacgtacgactcccgccgccgccgccgatcgccataaccgaaccgacccgtcccccgccgtcctcgtcgtcttcatcgtcctcctcctcgaaaatcataaaatcgacgaccgtctcccccgaaaacttaacaaaactcgcttaaaactccgacctttacaaaaaccacgtacaaaatcgcgaacgactctaaaactcgaactccgaatccaactccacttcgaacgaaaaaaacgaaaccgaaaaaaccgatacctctaccatcttcgccgcccgcccgaccgcgactaaaattctcgcgctctcctctcgcgccgaaacgaaatacaacgaaaaaaaaacgtaaacgccgcgaaaactccgactcccgaacgccgccgccgccgccgccgcctaaaaaaacacgaaaaaaaaaaaaaaaaaaattaattatccccgaccgaaaccccgtcctcgacgaatcctcgcccgctaccgccacctcccaatcttaccgcgcccgcctcccaaaaacaaaaaaccatacttcttaataacactttttattt

SEQ ID NO: 32749 - DNA, 688 bp, Artificial Sequence
  chemically treated genomic DNA (Homo sapiens) CpG-island No: 32749
tttgttgttacggtacgcgaatcgattttacgtagcgatggttacgagttgtttaagatcggttcgcgcgtttaggttcgcgttggtcgttttttcggttttagcgtcgggtgtttcgttttttaaggtcggcggcggtatggcggttaggtagatttgggtacggacgggtgtcgcgttttgtaggtaatttttcgtcgtttcgtcgttagtatttttttgggtaagagttgggtttcgatagtagtttagtttaattttttgttttgttaacgagggaaattgcggcggtttcgcgtttagtacgttcggtaggtcggagagagcggcgaggttttcggtgagcgaagagttaatcgcggcggagcgatagatcgcggagttgtacgttgtcgtttgcgcggtgagatttttttttgttcgtttcgtttcgtcgcggtcgtttcgggttcggcgcgtttgcgtatttcgggttttttcggattcggaggtcgttcggtagaggtaaaggttgttggatatcggtgcggttttgtttcgggcgatattcgcgtacgtatacgaatttttagtttcgatattttcgcgggaaatttgtgtttgttttgagtatgagtgtgatttgtttttcgattagcgttcgagttaaatttcggtcgtagtgtgggatttattattatttttttgt

SEQ ID NO: 32750 - DNA, 688 bp, Artificial Sequence
  chemically treated genomic DNA (Homo sapiens) CpG-island No: 32750
acaaaaaaataataataaatcccacactacgaccgaaatttaactcgaacgctaatcgaaaaacaaatcacactcatactcaaaacaaacacaaatttcccgcgaaaatatcgaaactaaaaattcgtatacgtacgcgaatatcgcccgaaacaaaaccgcaccgatatccaacaacctttacctctaccgaacgacctccgaatccgaaaaaacccgaaatacgcaaacgcgccgaacccgaaacgaccgcgacgaaacgaaacgaacaaaaaaaaatctcaccgcgcaaacgacaacgtacaactccgcgatctatcgctccgccgcgattaactcttcgctcaccgaaaacctcgccgctctctccgacctaccgaacgtactaaacgcgaaaccgccgcaatttccctcgttaacaaaacaaaaaattaaactaaactactatcgaaacccaactcttacccaaaaaaatactaacgacgaaacgacgaaaaattacctacaaaacgcgacacccgtccgtacccaaatctacctaaccgccataccgccgccgaccttaaaaaacgaaacacccgacgctaaaaccgaaaaaacgaccaacgcgaacctaaacgcgcgaaccgatcttaaacaactcgtaaccatcgctacgtaaaatcgattcgcgtaccgtaacaacaaa

SEQ ID NO: 32751 - DNA, 688 bp, Artificial Sequence
  chemically treated genomic DNA (Homo sapiens) CpG-island No: 32751
ataaaagagtggtagtgggttttatattgcgatcggagtttagttcggacgttgatcggaaaataaattatatttatatttaagatagatataggtttttcgcgaaaatgtcggggttggaagttcgtgtgcgtgcgcgaatgtcgttcgaggtaggatcgtatcggtatttagtaatttttgtttttgtcgggcggttttcgggttcggagaggttcgggatgcgtaggcgcgtcgagttcggggcggtcgcggcggggcggggcgggtaggagggagttttatcgcgtaggcggtagcgtgtagtttcgcgatttgtcgtttcgtcgcggttaatttttcgtttatcgaaggtttcgtcgtttttttcggtttatcgggcgtgttgggcgcggagtcgtcgtagtttttttcgttagtagggtagagggttaagttgagttgttgtcggaatttagtttttatttagagaggtgttggcggcggggcggcggaaggttgtttgtagagcgcggtattcgttcgtgtttagatttgtttggtcgttatgtcgtcgtcggttttgggaggcggagtattcggcgttggggtcggaggggcgattaacgcgggtttgggcgcgcgagtcggttttgggtagttcgtggttatcgttgcgtggggtcggttcgcgtgtcgtggtagtagg

SEQ ID NO: 32752 - DNA, 688 bp, Artificial Sequence
  chemically treated genomic DNA (Homo sapiens) CpG-island No: 32752
cctactaccacgacacgcgaaccgaccccacgcaacgataaccacgaactacccaaaaccgactcgcgcgcccaaacccgcgttaatcgcccctccgaccccaacgccgaatactccgcctcccaaaaccgacgacgacataacgaccaaacaaatctaaacacgaacgaataccgcgctctacaaacaaccttccgccgccccgccgccaacacctctctaaataaaaactaaattccgacaacaactcaacttaaccctctaccctactaacgaaaaaaactacgacgactccgcgcccaacacgcccgataaaccgaaaaaaacgacgaaaccttcgataaacgaaaaattaaccgcgacgaaacgacaaatcgcgaaactacacgctaccgcctacgcgataaaactccctcctacccgccccgccccgccgcgaccgccccgaactcgacgcgcctacgcatcccgaacctctccgaacccgaaaaccgcccgacaaaaacaaaaattactaaataccgatacgatcctacctcgaacgacattcgcgcacgcacacgaacttccaaccccgacattttcgcgaaaaacctatatctatcttaaatataaatataatttattttccgatcaacgtccgaactaaactccgatcgcaatataaaacccactaccactcttttat

SEQ ID NO: 32753 - DNA, 1047 bp, Artificial Sequence
  chemically treated genomic DNA (Homo sapiens) CpG-island No: 32753
ttacgttagatagcgtaatagtttgatttagcgtgattttgtaggtcggataaggcgtttatgtcgtattcgatattaacgtttgatgcgacgtttaacgcgttttattaggtttacgttagatagcgtaatagtttgatttagcgtgattttgtaggtcggataaggcgtttacgtcgtattcgatattaacgtttgatgcgacgtttgtcgcgttttattaggtttacgttagatagcgtaatagtttgatttagcgtgattttgtaggtcggataaggcgtttatgtcgtattcgatattaacgtttgatgcgacgtttaacgcgttttattaggtttacgttagatagcgtaatagtttgatttagcgtgattttgtaggtcggataaggcgttcgcgtcgtattcgatattaatgtttgatgcgacgtttgtcgcgttttattaggtttataattattgtcgatttgtaggtttgataaggtatttgtgtcgtattcggtaattaatgtttgatgcgacgttgtcgcgttttattaggtttataattgttgtcgatttgtaggtcggataaggtatttgtgtcgtattcggtaattaatgtttgatgcgacgttgtcgcgttttattaggtttataattattgtcgatttgtaggtcggataaggtatttgtgtcgtattcggtaattaatgtttgatgcgacgttgtcgcgttttattaggtttataattgttgtcgattcgtaggtcggataaggcgttcgcgtcgtattcggcgttgttgttaaattttagtgtcgtaataatgtcggatgcgatgtttgcgtattttattcgatttatagtgatttaaacgatgtttaatcgtaggtcggataaggcgttcgcgtcgtattcggtattgttgttaaattttagtgtcgtaataatgtcggatgcgatatttgcgtattttatttcgatcgatagtgatttaaacgatgtttaattgtaggtcggataaagcgttcgcgtcggaatttcgggggtaattttggttttgg

SEQ ID NO: 32754 - DNA, 1047 bp, Artificial Sequence
  chemically treated genomic DNA (Homo sapiens) CpG-island No: 32754
ccaaaaccaaaattacccccgaaattccgacgcgaacgctttatccgacctacaattaaacatcgtttaaatcactatcgatcgaaataaaatacgcaaatatcgcatccgacattattacgacactaaaatttaacaacaataccgaatacgacgcgaacgccttatccgacctacgattaaacatcgtttaaatcactataaatcgaataaaatacgcaaacatcgcatccgacattattacgacactaaaatttaacaacaacgccgaatacgacgcgaacgccttatccgacctacgaatcgacaacaattataaacctaataaaacgcgacaacgtcgcatcaaacattaattaccgaatacgacacaaataccttatccgacctacaaatcgacaataattataaacctaataaaacgcgacaacgtcgcatcaaacattaattaccgaatacgacacaaataccttatccgacctacaaatcgacaacaattataaacctaataaaacgcgacaacgtcgcatcaaacattaattaccgaatacgacacaaataccttatcaaacctacaaatcgacaataattataaacctaataaaacgcgacaaacgtcgcatcaaacattaatatcgaatacgacgcgaacgccttatccgacctacaaaatcacgctaaatcaaactattacgctatctaacgtaaacctaataaaacgcgttaaacgtcgcatcaaacgttaatatcgaatacgacataaacgccttatccgacctacaaaatcacgctaaatcaaactattacgctatctaacgtaaacctaataaaacgcgacaaacgtcgcatcaaacgttaatatcgaatacgacgtaaacgccttatccgacctacaaaatcacgctaaatcaaactattacgctatctaacgtaaacctaataaaacgcgttaaacgtcgcatcaaacgttaatatcgaatacgacataaacgccttatccgacctacaaaatcacgctaaatcaaactattacgctatctaacgtaa

SEQ ID NO: 32755 - DNA, 1047 bp, Artificial Sequence
  chemically treated genomic DNA (Homo sapiens) CpG-island No: 32755
ttaaaattaaagttgttttcgggatttcggcgcgagcgttttattcggtttatagttgggtatcgtttgagttattgtcggtcggaataagatgcgtaagtatcgtattcgatattattgcggtattggagtttggtaatagtgtcggatgcggcgcgagcgttttattcggtttacggttgggtatcgtttgagttattgtaggtcggataagatgcgtaagtatcgtattcgatattattgcggtattggagtttggtaatagcgtcggatgcggcgcgagcgttttattcggtttacgggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattcggtttataggtcggtaatagttgtaggtttgataagacgcgatagcgtcgtattaggtattgattgtcggatgcggtataagtgttttattaggtttataggtcggtaatagttgtaggtttgataagacgcggtaagcgtcgtattaggtattgatgtcggatgcggcgcgagcgttttattcggtttataaaattacgttaaattaggttattgcgttgtttggcgtaggtttgataagacgcgttaagcgtcgtattaggcgttgatgtcggatgcggtataaacgttttattcgatttataaaattacgttaaattaggttattgcgttgtttggcgtaggtttgataagacgcggtaagcgtcgtattaggcgttgatgtcggatgcggcgtaaacgttttattcgatttataaaattacgttaaattaggttattgcgttgtttggcgtaggtttgataagacgcgttaagcgtcgtattaggcgttgatgtcggatgcggtataaacgttttattcgatttataaaattacgttaaattaggttattgcgttgtttggcgtag

SEQ ID NO: 32756 - DNA, 1047 bp, Artificial Sequence
  chemically treated genomic DNA (Homo sapiens) CpG-island No: 32756
ctacgccaaacaacgcaataacctaatttaacgtaattttataaatcgaataaaacgtttataccgcatccgacatcaacgcctaatacgacgcttaacgcgtcttatcaaacctacgccaaacaacgcaataacctaatttaacgtaattttataaatcgaataaaacgtttacgccgcatccgacatcaacgcctaatacgacgcttaccgcgtcttatcaaacctacgccaaacaacgcaataacctaatttaacgtaattttataaatcgaataaaacgtttataccgcatccgacatcaacgcctaatacgacgcttaacgcgtcttatcaaacctacgccaaacaacgcaataacctaatttaacgtaattttataaaccgaataaaacgctcgcgccgcatccgacatcaatacctaatacgacgcttaccgcgtcttatcaaacctacaactattaccgacctataaacctaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacctataaaccgaataaaacacttataccgcatccgacaatcaatacctaatacgacgctatcgcgtcttatcaaacctacaactattaccgacccgtaaaccgaataaaacgctcgcgccgcatccgacgctattaccaaactccaataccgcaataatatcgaatacgatacttacgcatcttatccgacctacaataactcaaacgatacccaaccgtaaaccgaataaaacgctcgcgccgcatccgacactattaccaaactccaataccgcaataatatcgaatacgatacttacgcatcttattccgaccgacaataactcaaacgatacccaactataaaccgaataaaacgctcgcgccgaaatcccgaaaacaactttaattttaa

SEQ ID NO: 32757 - DNA, 1591 bp, Artificial Sequence
  chemically treated genomic DNA (Homo sapiens) CpG-island No: 32757
gaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgatatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcgggttgacgcgtagtatggaatacgatgttgtcggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaatcgtagagcggtggtagtatgacgaacgtggttggttgatagatattagttatattagcgaagggtatcgggtggcggtgtattataggtatgatgagaaaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttgtgaacgataacggcgaatttattcgtatttagaagtcgcgttagaattcgagtattagtaaagattatcgggagggtagtt

SEQ ID NO: 32758 - DNA, 1591 bp, Artificial Sequence
  chemically treated genomic DNA (Homo sapiens) CpG-island No: 32758
aactaccctcccgataatctttactaatactcgaattctaacgcgacttctaaatacgaataaattcgccgttatcgttcacaaatataatcgcgatcaaacaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctttctcatcatacctataatacaccgccacccgatacccttcgctaatataactaatatctatcaaccaaccacgttcgtcatactaccaccgctctacgatttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtccgacaacatcgtattccatactacgcgtcaacccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaatatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttc

SEQ ID NO: 32759 - DNA, 1591 bp, Artificial Sequence
  chemically treated genomic DNA (Homo sapiens) CpG-island No: 32759
ggttattttttcggtggtttttattgatattcgggttttggcgcggtttttagatgcgaatgagttcgtcgttgtcgtttataggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttttttattatatttgtaatgtatcgttattcggtgtttttcgttgatatggttgatgtttgttagttagttacgttcgttatattgttatcgttttgcggttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttcggtagtatcgtattttatattgcgcgttagttcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggatattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggatttt

SEQ ID NO: 32760 - DNA, 1591 bp, Artificial Sequence
  chemically treated genomic DNA (Homo sapiens) CpG-island No: 32760
aaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataatatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgaactaacgcgcaatataaaatacgatactaccgaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaaccgcaaaacgataacaatataacgaacgtaactaactaacaaacatcaaccatatcaacgaaaaacaccgaataacgatacattacaaatataataaaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactatctaaccgcgattacacctataaacgacaacgacgaactcattcgcatctaaaaaccgcgccaaaacccgaatatcaataaaaaccaccgaaaaaataacc

SEQ ID NO: 32761 - DNA, 932 bp, Artificial Sequence
  chemically treated genomic DNA (Homo sapiens) CpG-island No: 32761
cgggtcggtttattagtagttgaagattttttttaatgttgagggtaaaaagaggattggagatcgcgttcgaacgaatcggttttcggtatcgcgtttttattttatttttggttattatatttatatattttcgcgttcgtttcgcgcgtttttattatttcgttatttttttaaatatgatacgggttttttttttagttaaaggtcgtatttttttttttgggttggaatatcggattttcgtgttttggtaattggaaacggaagtcggtcgttcgttgtttttcggtaattttaaagtttttttttttagtttcgtattaatagttcgtttcgttagcgtttaatagtttggacgatcgtaggggaaagtaagtcggtcggatgagaaagtatagagatcggaaatgtgtttgtttttttttgttttaagttcggagttagcgttttttgtggttcggaagggaagtgacgttgttgttgggaagatggcgatcgcggcgattattttatcggtagttacggttatagtagcggttttcggcgaggtggaggatgaagggtttttggcgtcgttgtttcgggatcgttttttcgaggtttagtggcgcgagcggttcgatgtgggtcgttattttcgggagttgagcggttcggggttggagcggttgcggcgcgagttcgagcgtttggcggaggagcgggcgtagttgttgtagtagacgcgcgatttggttttcgttaattataagatttttattcgcggcgtcgagtgtatcgagcgtatttatcgtttgtttggcgacgtggaggcgtcgttcggtcgtttgttcgatcgtttgtttagtttttagtagagttgtaggtgcgacgcgtttggcgttaaaggggttttataattgtaaaagttgatatttacgatggtagaa

SEQ ID NO: 32762 - DNA, 932 bp, Artificial Sequence
  chemically treated genomic DNA (Homo sapiens) CpG-island No: 32762
ttctaccatcgtaaatatcaacttttacaattataaaacccctttaacgccaaacgcgtcgcacctacaactctactaaaaactaaacaaacgatcgaacaaacgaccgaacgacgcctccacgtcgccaaacaaacgataaatacgctcgatacactcgacgccgcgaataaaaatcttataattaacgaaaaccaaatcgcgcgtctactacaacaactacgcccgctcctccgccaaacgctcgaactcgcgccgcaaccgctccaaccccgaaccgctcaactcccgaaaataacgacccacatcgaaccgctcgcgccactaaacctcgaaaaaacgatcccgaaacaacgacgccaaaaacccttcatcctccacctcgccgaaaaccgctactataaccgtaactaccgataaaataatcgccgcgatcgccatcttcccaacaacaacgtcacttcccttccgaaccacaaaaaacgctaactccgaacttaaaacaaaaaaaaacaaacacatttccgatctctatactttctcatccgaccgacttactttcccctacgatcgtccaaactattaaacgctaacgaaacgaactattaatacgaaactaaaaaaaaaaactttaaaattaccgaaaaacaacgaacgaccgacttccgtttccaattaccaaaacacgaaaatccgatattccaacccaaaaaaaaaaatacgacctttaactaaaaaaaaaacccgtatcatatttaaaaaaataacgaaataataaaaacgcgcgaaacgaacgcgaaaatatataaatataataaccaaaaataaaataaaaacgcgataccgaaaaccgattcgttcgaacgcgatctccaatcctctttttaccctcaacattaaaaaaaatcttcaactactaataaaccgacccg

SEQ ID NO: 32763 - DNA, 932 bp, Artificial Sequence
  chemically treated genomic DNA (Homo sapiens) CpG-island No: 32763
ttttattatcgtaaatgttagtttttatagttataaaatttttttagcgttaggcgcgtcgtatttgtagttttgttggaagttgggtaaacggtcgagtaggcggtcgagcgacgtttttacgtcgttaaataggcggtggatgcgttcggtgtattcggcgtcgcggatgaaggttttgtagttagcgaaggttaagtcgcgcgtttgttgtagtagttgcgttcgttttttcgttaggcgttcgggttcgcgtcgtagtcgttttagtttcgagtcgtttaattttcggaggtagcggtttatatcgggtcgttcgcgttattgggtttcggggaagcggtttcggaatagcgacgttaggagttttttattttttatttcgtcgagagtcgttgttgtggtcgtggttatcgatgggatagtcgtcgcggtcgttatttttttagtaataacgttatttttttttcggattataaggggcgttgatttcgaatttaggataggaagaaataggtatattttcggtttttatgtttttttattcggtcggtttgtttttttttgcggtcgtttagattattgggcgttagcgagacgaattattggtacggggttagagaggaaggttttgggattgtcggggagtagcgagcgatcgattttcgtttttagttattaaggtacgaggattcggtgttttaatttagggggaaaaatgcggtttttgattgaagaggagattcgtgttatgtttgagaagatagcgaaatagtaggagcgcgcggggcggacgcgggagtgtgtgggtgtggtggttaagggtggagtgggggcgcggtgtcggagatcggttcgttcgggcgcggtttttagttttttttttgtttttagtattggggagaatttttaattgttggtggatcggttcg

SEQ ID NO: 32764 - DNA, 932 bp, Artificial Sequence
  chemically treated genomic DNA (Homo sapiens) CpG-island No: 32764
cgaaccgatccaccaacaattaaaaattctccccaatactaaaaacaaaaaaaaaactaaaaaccgcgcccgaacgaaccgatctccgacaccgcgcccccactccacccttaaccaccacacccacacactcccgcgtccgccccgcgcgctcctactatttcgctatcttctcaaacataacacgaatctcctcttcaatcaaaaaccgcatttttccccctaaattaaaacaccgaatcctcgtaccttaataactaaaaacgaaaatcgatcgctcgctactccccgacaatcccaaaaccttcctctctaaccccgtaccaataattcgtctcgctaacgcccaataatctaaacgaccgcaaaaaaaaacaaaccgaccgaataaaaaaacataaaaaccgaaaatatacctatttcttcctatcctaaattcgaaatcaacgccccttataatccgaaaaaaaaataacgttattactaaaaaaataacgaccgcgacgactatcccatcgataaccacgaccacaacaacgactctcgacgaaataaaaaataaaaaactcctaacgtcgctattccgaaaccgcttccccgaaacccaataacgcgaacgacccgatataaaccgctacctccgaaaattaaacgactcgaaactaaaacgactacgacgcgaacccgaacgcctaacgaaaaaacgaacgcaactactacaacaaacgcgcgacttaaccttcgctaactacaaaaccttcatccgcgacgccgaatacaccgaacgcatccaccgcctatttaacgacgtaaaaacgtcgctcgaccgcctactcgaccgtttacccaacttccaacaaaactacaaatacgacgcgcctaacgctaaaaaaattttataactataaaaactaacatttacgataataaaa

SEQ ID NO: 32765 - DNA, 1108 bp, Artificial Sequence
  chemically treated genomic DNA (Homo sapiens) CpG-island No: 32765
gcgagcggagacgtaggtcgaatcgtttagcgtggggttttagtcggcgttttttgtttttagaacgcggtgcgtgaggttttcggcgcggggtggttaggattgtttcgttttggaaggttcggggcgggttcgggaggcgggaaggcgttttcgggaggagagcggaagggggcggtgtttattgttagtttaagtaggaaggcggggatttagtcgcggtttcgttgtgtgttggtcgacggcgtttttcggcgtgtttcgcgttgcggtcggaaggggcgggtcgggttattgttaagggggtcgttatggttcggttgtggggcgcgttgagtttttggttattgtgggcggtcgtgtcgtggggcggggcggtagtcgtcggtgttcgggtttgtagttttacggtcgtttcggacggcgtcgagggttcggcgttgcggcgtttttattggcgttatttgaggcgtttggtgttgggttttttcgaatcgtcgttttcgtacgtgtgttaagtcggggattcggtgttgcgcggcgtggcggtttcggtggagcgggcgtagttaggcgggttcgagttgtagcggttgacgtaacggttggtttaggtgatgcggcggcggcgttgcgtgggtttaagcgcgtcgtagttgggggtgtcgcggtaggtgttggcgttggagtttttcgaggcgttgtgtcgggagtgttcgtttcgttagcgcgcgtttcgttaaatggagtttttttttttgcgcgtgttcgtgaattttagtttgcgagtgtttgatagtcgtttggttatttttttcgagggttgcgagagcgtcgtcggttttttggtttgcgtgtttcgtttttaggcggtgtagattttaggtgcgggcggcggggatcggggttgttggagtagcgcgcgcgttttttttgttcgatttcgcgagagcgtagaagtggtcgcggtttatacgtcggatttttcgtaggagcgaagtgggatgcgggagcggagaggttttaggacggatagaagtttttgtggggtagagttcgtttagataggacgtaggggcgaggagaggttttttagtttcgttgttat

SEQ ID NO: 32766 - DNA, 1108 bp, Artificial Sequence
  chemically treated genomic DNA (Homo sapiens) CpG-island No: 32766
ataacaacgaaactaaaaaacctctcctcgcccctacgtcctatctaaacgaactctaccccacaaaaacttctatccgtcctaaaacctctccgctcccgcatcccacttcgctcctacgaaaaatccgacgtataaaccgcgaccacttctacgctctcgcgaaatcgaacaaaaaaaacgcgcgcgctactccaacaaccccgatccccgccgcccgcacctaaaatctacaccgcctaaaaacgaaacacgcaaaccaaaaaaccgacgacgctctcgcaaccctcgaaaaaaataaccaaacgactatcaaacactcgcaaactaaaattcacgaacacgcgcaaaaaaaaaaactccatttaacgaaacgcgcgctaacgaaacgaacactcccgacacaacgcctcgaaaaactccaacgccaacacctaccgcgacacccccaactacgacgcgcttaaacccacgcaacgccgccgccgcatcacctaaaccaaccgttacgtcaaccgctacaactcgaacccgcctaactacgcccgctccaccgaaaccgccacgccgcgcaacaccgaatccccgacttaacacacgtacgaaaacgacgattcgaaaaaacccaacaccaaacgcctcaaataacgccaataaaaacgccgcaacgccgaaccctcgacgccgtccgaaacgaccgtaaaactacaaacccgaacaccgacgactaccgccccgccccacgacacgaccgcccacaataaccaaaaactcaacgcgccccacaaccgaaccataacgacccccttaacaataacccgacccgccccttccgaccgcaacgcgaaacacgccgaaaaacgccgtcgaccaacacacaacgaaaccgcgactaaatccccgccttcctacttaaactaacaataaacaccgcccccttccgctctcctcccgaaaacgccttcccgcctcccgaacccgccccgaaccttccaaaacgaaacaatcctaaccaccccgcgccgaaaacctcacgcaccgcgttctaaaaacaaaaaacgccgactaaaaccccacgctaaacgattcgacctacgtctccgctcgc

SEQ ID NO: 32767 - DNA, 1108 bp, Artificial Sequence
  chemically treated genomic DNA (Homo sapiens) CpG-island No: 32767
gtaatagcggaattaggggattttttttcgtttttgcgttttatttgagcgggttttattttataggagtttttattcgttttgaggttttttcgttttcgtattttatttcgtttttgcgggaggttcggcgtatgaatcgcgattatttttgcgttttcgcggagtcgggtagaagagacgcgcgcgttgttttagtagtttcggttttcgtcgttcgtatttgagatttgtatcgtttggaagcggggtacgtaggttaggaagtcggcgacgttttcgtagttttcgggaaaggtgattaggcggttgttaagtattcgtaggttggggtttacgaatacgcgtagggggaagggttttatttggcggagcgcgcgttggcggggcgggtattttcgatatagcgtttcggggagttttagcgttagtatttgtcgcggtatttttagttgcggcgcgtttaggtttacgtagcgtcgtcgtcgtattatttggattagtcgttgcgttagtcgttgtagttcgggttcgtttagttgcgttcgttttatcggggtcgttacgtcgcgtagtatcgggttttcgatttggtatacgtgcgagaacggcggttcgggaggatttagtattagacgttttaggtggcgttaataggagcgtcgtagcgtcgggttttcgacgtcgttcggggcggtcgtggagttgtaagttcggatatcgacggttgtcgtttcgttttacggtacggtcgtttatagtggttaaagatttagcgcgttttatagtcgggttatggcggtttttttaatagtgattcggttcgtttttttcggtcgtagcgcggggtacgtcgggaagcgtcgtcggttagtatatagcgaagtcgcgattggattttcgtttttttgtttagattggtagtgagtatcgttttttttcgtttttttttcgggagcgttttttcgtttttcgaattcgtttcggattttttagggcgaggtagttttggttatttcgcgtcgggaattttacgtatcgcgttttggaggtaggggacgtcggttagggttttacgttgggcggttcggtttgcgttttcgttcgt

SEQ ID NO: 32768 - DNA, 1108 bp, Artificial Sequence
  chemically treated genomic DNA (Homo sapiens) CpG-island No: 32768
acgaacgaaaacgcaaaccgaaccgcccaacgtaaaaccctaaccgacgtcccctacctccaaaacgcgatacgtaaaattcccgacgcgaaataaccaaaactacctcgccctaaaaaatccgaaacgaattcgaaaaacgaaaaaacgctcccgaaaaaaaaacgaaaaaaaacgatactcactaccaatctaaacaaaaaaacgaaaatccaatcgcgacttcgctatatactaaccgacgacgcttcccgacgtaccccgcgctacgaccgaaaaaaacgaaccgaatcactattaaaaaaaccgccataacccgactataaaacgcgctaaatctttaaccactataaacgaccgtaccgtaaaacgaaacgacaaccgtcgatatccgaacttacaactccacgaccgccccgaacgacgtcgaaaacccgacgctacgacgctcctattaacgccacctaaaacgtctaatactaaatcctcccgaaccgccgttctcgcacgtataccaaatcgaaaacccgatactacgcgacgtaacgaccccgataaaacgaacgcaactaaacgaacccgaactacaacgactaacgcaacgactaatccaaataatacgacgacgacgctacgtaaacctaaacgcgccgcaactaaaaataccgcgacaaatactaacgctaaaactccccgaaacgctatatcgaaaatacccgccccgccaacgcgcgctccgccaaataaaacccttccccctacgcgtattcgtaaaccccaacctacgaatacttaacaaccgcctaatcacctttcccgaaaactacgaaaacgtcgccgacttcctaacctacgtaccccgcttccaaacgatacaaatctcaaatacgaacgacgaaaaccgaaactactaaaacaacgcgcgcgtctcttctacccgactccgcgaaaacgcaaaaataatcgcgattcatacgccgaacctcccgcaaaaacgaaataaaatacgaaaacgaaaaaacctcaaaacgaataaaaactcctataaaataaaacccgctcaaataaaacgcaaaaacgaaaaaaaatcccctaattccgctattac

SEQ ID NO: 32769 - DNA, 659 bp, Artificial Sequence
  chemically treated genomic DNA (Homo sapiens) CpG-island No: 32769
cgttttaatttttttttttcggttcggtttttatttttgtatgatgtttcggatttgtttgaagttttcgtatcggttatttcgaaaggttcgtagcgtttcgtggaagtagaatttgagtatttagcgattgattgttttttttagtcgtgtttttttcgcgtcgcgtttcgtcgggttttttagtttcggttcgtggcgttttcgtcgggttcgttcgtattgcgggatcgttttcgttttggtttaagtttttggttttcgttttgttgttcgtcgttattttcgttttttttcgttatcgtgttcgatcgtcgcgcgtttttttcgttttttcggtcggtcgttttttcggttgtgacgtcgttgggttacgtacgacgttcgggtcggaagcggggttcgtcgtttcggttttcgcggttatgatagaaatagcgtttcgagtcgttcgcgggtttttgggagggaaaggatcggagggttcggttttttttttagacgtcgtagttttcgatgtgtcggtcgtaatgttttttggggtttgaagtttatatcgtttaggtcggtgaattcggcgggttttgtagttaatttcgtttcgaatttatagaaaatagttattatgttagggacgcggaatagtgtattagagattg

SEQ ID NO: 32770 - DNA, 659 bp, Artificial Sequence
  chemically treated genomic DNA (Homo sapiens) CpG-island No: 32770
caatctctaatacactattccgcgtccctaacataataactattttctataaattcgaaacgaaattaactacaaaacccgccgaattcaccgacctaaacgatataaacttcaaaccccaaaaaacattacgaccgacacatcgaaaactacgacgtctaaaaaaaaaaccgaaccctccgatcctttccctcccaaaaacccgcgaacgactcgaaacgctatttctatcataaccgcgaaaaccgaaacgacgaaccccgcttccgacccgaacgtcgtacgtaacccaacgacgtcacaaccgaaaaaacgaccgaccgaaaaaacgaaaaaaacgcgcgacgatcgaacacgataacgaaaaaaaacgaaaataacgacgaacaacaaaacgaaaaccaaaaacttaaaccaaaacgaaaacgatcccgcaatacgaacgaacccgacgaaaacgccacgaaccgaaactaaaaaacccgacgaaacgcgacgcgaaaaaaacacgactaaaaaaaacaatcaatcgctaaatactcaaattctacttccacgaaacgctacgaacctttcgaaataaccgatacgaaaacttcaaacaaatccgaaacatcatacaaaaataaaaaccgaaccgaaaaaaaaaaattaaaacg

SEQ ID NO: 32771 - DNA, 659 bp, Artificial Sequence
  chemically treated genomic DNA (Homo sapiens) CpG-island No: 32771
tagtttttaatatattgtttcgcgtttttagtatagtagttgttttttgtaaattcggagcgaagttgattgtaaaattcgtcgggtttatcggtttgggcggtgtggattttaagttttaggaggtattgcggtcggtatatcgggaattacggcgtttgagaagggggtcgggtttttcggtttttttttttttagaagttcgcgggcggttcggaacgttgtttttattatggtcgcgggagtcgggacggcgggtttcgttttcggttcgggcgtcgtgcgtgatttagcggcgttatagtcgaggaagcggtcggtcgggagggcggggagggcgcgcggcgatcggatacgatggcgggaggaggcgggagtagcgacggatagtagggcgagggttaaaggtttaggttaggacgggggcgatttcgtagtacgggcgggttcggcgggggcgttacgagtcggggttggggggttcggcggagcgcggcgcgggggaggtacggttggaagaggtagttaatcgttgggtgtttaagttttatttttacgaggcgttgcgggtttttcggggtagtcggtacggggattttagatagattcgggatattatgtaggggtgagggtcgggtcgggggaggggggttggagcg

SEQ ID NO: 32772 - DNA, 659 bp, Artificial Sequence
  chemically treated genomic DNA (Homo sapiens) CpG-island No: 32772
cgctccaacccccctcccccgacccgaccctcacccctacataatatcccgaatctatctaaaatccccgtaccgactaccccgaaaaacccgcaacgcctcgtaaaaataaaacttaaacacccaacgattaactacctcttccaaccgtacctcccccgcgccgcgctccgccgaaccccccaaccccgactcgtaacgcccccgccgaacccgcccgtactacgaaatcgcccccgtcctaacctaaacctttaaccctcgccctactatccgtcgctactcccgcctcctcccgccatcgtatccgatcgccgcgcgccctccccgccctcccgaccgaccgcttcctcgactataacgccgctaaatcacgcacgacgcccgaaccgaaaacgaaacccgccgtcccgactcccgcgaccataataaaaacaacgttccgaaccgcccgcgaacttctaaaaaaaaaaaaaccgaaaaacccgacccccttctcaaacgccgtaattcccgatataccgaccgcaatacctcctaaaacttaaaatccacaccgcccaaaccgataaacccgacgaattttacaatcaacttcgctccgaatttacaaaaaacaactactatactaaaaacgcgaaacaatatattaaaaacta

SEQ ID NO: 32773 - DNA, 944 bp, Artificial Sequence
  chemically treated genomic DNA (Homo sapiens) CpG-island No: 32773
gtcgcggtcgtggacgggtcggaggcggcgtcgttcgcgtcgttgcgtgcggtgtggtgcgaggcgggtgcgtcgggcggtcgcggcgcggcgggattatggagtttagagcgtagtttcggcgtcggcggcgggatcgcggatcggtgagtgagggttgcggtcgtttcggtttttcgttgtaggttgttgtggttttttcggtttcgggtcgggcggttgtcgggggaggggcggttttacggcgaattgaagttgttgtatcgtcgcgcgtttcggtcgggcggcggggtttattgcgggttgcggcgtcgtttcgcgtttatttttgtagttcggtcgtattttttcggtcggttttcgcgttggtaggggtttttcgtcgttacggcgcggttaggcggtttttttttttcgcgttttcgggttttcggttttttgtcgttcggtgcgcgttttttggattcgggatagttattcgtttttttcgtcgtaagtggcgttcgggttttcgttcgcgttttacgtacgacgtttcgggtcgtttcgcgttcgggattttcgtattcgtttagtgtttgcgcgttttcgttggttttggtttagtttcgcgtgtttttcggttttattcggtttttttcgttttggtttgtgtttttttggtgttcgcgtgcgtgttggttgcgggcgttttttttttcgaggttgcggtgtcgcgtggttttcggtttcggagattaggtcggatttttggagtgtaggggaggaggtggggcggttcgcgagtgcgggggatcgcgcgtacggagtcgcggcgcgcggggtattattttcgggggtttttattcgcgcgtttgggttttagcgagggtagaagtttttttttagtttgtggtgttgacgtgtaatggcgattgttttttgatttggtttttttgtaaggg

SEQ ID NO: 32774 - DNA, 944 bp, Artificial Sequence
  chemically treated genomic DNA (Homo sapiens) CpG-island No: 32774
cccttacaaaaaaaccaaatcaaaaaacaatcgccattacacgtcaacaccacaaactaaaaaaaaacttctaccctcgctaaaacccaaacgcgcgaataaaaacccccgaaaataataccccgcgcgccgcgactccgtacgcgcgatcccccgcactcgcgaaccgccccacctcctcccctacactccaaaaatccgacctaatctccgaaaccgaaaaccacgcgacaccgcaacctcgaaaaaaaaaacgcccgcaaccaacacgcacgcgaacaccaaaaaaacacaaaccaaaacgaaaaaaaccgaataaaaccgaaaaacacgcgaaactaaaccaaaaccaacgaaaacgcgcaaacactaaacgaatacgaaaatcccgaacgcgaaacgacccgaaacgtcgtacgtaaaacgcgaacgaaaacccgaacgccacttacgacgaaaaaaacgaataactatcccgaatccaaaaaacgcgcaccgaacgacaaaaaaccgaaaacccgaaaacgcgaaaaaaaaaaaccgcctaaccgcgccgtaacgacgaaaaacccctaccaacgcgaaaaccgaccgaaaaaatacgaccgaactacaaaaataaacgcgaaacgacgccgcaacccgcaataaaccccgccgcccgaccgaaacgcgcgacgatacaacaacttcaattcgccgtaaaaccgcccctcccccgacaaccgcccgacccgaaaccgaaaaaaccacaacaacctacaacgaaaaaccgaaacgaccgcaaccctcactcaccgatccgcgatcccgccgccgacgccgaaactacgctctaaactccataatcccgccgcgccgcgaccgcccgacgcacccgcctcgcaccacaccgcacgcaacgacgcgaacgacgccgcctccgacccgtccacgaccgcgac

SEQ ID NO: 32775 - DNA, 944 bp, Artificial Sequence
  chemically treated genomic DNA (Homo sapiens) CpG-island No: 32775
tttttgtagaggggttaaattaagaagtaatcgttattgtacgttagtattataaattgagaggaagtttttgttttcgttaaagtttaggcgcgcgggtaaagattttcggggatgatatttcgcgcgtcgcggtttcgtgcgcgcggtttttcgtattcgcgggtcgttttatttttttttttgtattttaagagttcggtttggttttcgaggtcgggagttacgcggtatcgtagtttcgagggagaggacgttcgtaattaatacgtacgcgggtattaagagggtataggttagggcggggagggtcgaatggggtcggggggtacgcggagttggattagaattagcgagggcgcgtagatattgaacggatgcgaaggtttcggacgcggagcggttcggggcgtcgtgcgtggggcgcgagcggaggttcgggcgttatttacggcggggagggcgggtggttgtttcgagtttagggagcgcgtatcggacggtaaagggtcggaggttcggaggcgcgggagagaagggtcgtttggtcgcgtcgtgacggcgagaagtttttgttagcgcgggagtcggtcgggaggatgcggtcgggttgtagggataggcgcgaggcggcgtcgtagttcgtagtgggtttcgtcgttcggtcggagcgcgcggcgatgtagtaattttagttcgtcgtggggtcgtttttttttcgatagtcgttcggttcggagtcgagagggttatagtagtttatagcggagagtcggggcgatcgtagtttttatttatcggttcgcggtttcgtcgtcggcgtcggggttgcgttttgagttttatggtttcgtcgcgtcgcggtcgttcggcgtattcgtttcgtattatatcgtacgtagcggcgcgagcgacgtcgttttcggttcgtttacggtcgcggt

SEQ ID NO: 32776 - DNA, 944 bp, Artificial Sequence
  chemically treated genomic DNA (Homo sapiens) CpG-island No: 32776
accgcgaccgtaaacgaaccgaaaacgacgtcgctcgcgccgctacgtacgatataatacgaaacgaatacgccgaacgaccgcgacgcgacgaaaccataaaactcaaaacgcaaccccgacgccgacgacgaaaccgcgaaccgataaataaaaactacgatcgccccgactctccgctataaactactataaccctctcgactccgaaccgaacgactatcgaaaaaaaaacgaccccacgacgaactaaaattactacatcgccgcgcgctccgaccgaacgacgaaacccactacgaactacgacgccgcctcgcgcctatccctacaacccgaccgcatcctcccgaccgactcccgcgctaacaaaaacttctcgccgtcacgacgcgaccaaacgacccttctctcccgcgcctccgaacctccgaccctttaccgtccgatacgcgctccctaaactcgaaacaaccacccgccctccccgccgtaaataacgcccgaacctccgctcgcgccccacgcacgacgccccgaaccgctccgcgtccgaaaccttcgcatccgttcaatatctacgcgccctcgctaattctaatccaactccgcgtaccccccgaccccattcgaccctccccgccctaacctataccctcttaatacccgcgtacgtattaattacgaacgtcctctccctcgaaactacgataccgcgtaactcccgacctcgaaaaccaaaccgaactcttaaaatacaaaaaaaaaaataaaacgacccgcgaatacgaaaaaccgcgcgcacgaaaccgcgacgcgcgaaatatcatccccgaaaatctttacccgcgcgcctaaactttaacgaaaacaaaaacttcctctcaatttataatactaacgtacaataacgattacttcttaatttaacccctctacaaaaa

SEQ ID NO: 32777 - DNA, 797 bp, Artificial Sequence
  chemically treated genomic DNA (Homo sapiens) CpG-island No: 32777
ggcgtcgttgttgttgttattggttaaggtcgcggcgatcgacgtatagtagaggtagtatagttggagcgtttgtaagagaaaaggtgatatcgcgcgtgaggggcgcggcggggttggcgtcgggcgttttttgttattcgttttcggagtttcgttcggcggtatttgttttggttacgcgttttagtttcgttaggtttttcggcgggttcgaattcgtagtcgggaaggtatacgcgagtaggagggcgtattttatggttaggtgcggacgcggcggttgcgggtggttagacgcggtaggcggagcgtacgggcggcgcgtatttttttcgcggtttcggagttcggcgttttaggtgcggttttaggtgagagtcgtcgtcgtttatatcgtagcgggggcgcgttgggattttttttttttcggtcgtttgcgcgtttttttttttttcggcgcgggtttgtcgagttgtagtttgcggtattttagagggtacggggggttttttgggtcgggattggagcgtaaacggttgggagattgtcggtgtttgttcgttcgtttgtgcgtttgtttgtgtcggtgtgagcgtttgaggcgatggggaagatagcgttagttggtttttttagcgcgtcggagtcgagcgttcgtttttttatcgcgcggtgattggcgattagcggttttcgggttcgttcgagttttcgggttggtgtaagggcgtgggattttcggttttagttttgagggagggggcgaagggggcggggaggttgggtgggagtga

SEQ ID NO: 32778 - DNA, 797 bp, Artificial Sequence
  chemically treated genomic DNA (Homo sapiens) CpG-island No: 32778
tcactcccacccaacctccccgcccccttcgccccctccctcaaaactaaaaccgaaaatcccacgcccttacaccaacccgaaaactcgaacgaacccgaaaaccgctaatcgccaatcaccgcgcgataaaaaaacgaacgctcgactccgacgcgctaaaaaaaccaactaacgctatcttccccatcgcctcaaacgctcacaccgacacaaacaaacgcacaaacgaacgaacaaacaccgacaatctcccaaccgtttacgctccaatcccgacccaaaaaaccccccgtaccctctaaaataccgcaaactacaactcgacaaacccgcgccgaaaaaaaaaaaaacgcgcaaacgaccgaaaaaaaaaaaatcccaacgcgcccccgctacgatataaacgacgacgactctcacctaaaaccgcacctaaaacgccgaactccgaaaccgcgaaaaaaatacgcgccgcccgtacgctccgcctaccgcgtctaaccacccgcaaccgccgcgtccgcacctaaccataaaatacgccctcctactcgcgtataccttcccgactacgaattcgaacccgccgaaaaacctaacgaaactaaaacgcgtaaccaaaacaaataccgccgaacgaaactccgaaaacgaataacaaaaaacgcccgacgccaaccccgccgcgcccctcacgcgcgatatcaccttttctcttacaaacgctccaactatactacctctactatacgtcgatcgccgcgaccttaaccaataacaacaacaacgacgcc

SEQ ID NO: 32779 - DNA, 797 bp, Artificial Sequence
  chemically treated genomic DNA (Homo sapiens) CpG-island No: 32779
ttatttttatttagttttttcgtttttttcgtttttttttttagagttggagtcgggaattttacgtttttgtattagttcgggggttcggacgagttcgggagtcgttggtcgttaattatcgcgcggtggagaggcgggcgttcggtttcggcgcgttgggggagttagttggcgttgttttttttatcgttttagacgtttatatcgatatagatagacgtatagacgggcgggtagatatcgatagttttttaatcgtttgcgttttagtttcggtttagggagtttttcgtattttttggggtgtcgtaaattgtagttcggtaggttcgcgtcgggagaagggagggcgcgtaggcggtcggaggaggggaggttttagcgcgttttcgttgcgatgtgaacggcggcggtttttatttggagtcgtatttggggcgtcgagtttcggggtcgcggaaagaatgcgcgtcgttcgtgcgtttcgtttgtcgcgtttggttattcgtagtcgtcgcgttcgtatttgattatggagtgcgtttttttgttcgcgtgtgttttttcggttgcgggttcgggttcgtcgaggggtttggcgggattggggcgcgtggttaaggtaggtgtcgtcgagcggagtttcgagagcgggtggtagggggcgttcgacgttagtttcgtcgcgttttttacgcgcgatgttatttttttttttgtaggcgttttagttgtgttgtttttgttgtgcgtcggtcgtcgcggttttagttagtgatagtagtagcggcgtt

SEQ ID NO: 32780 - DNA, 797 bp, Artificial Sequence
  chemically treated genomic DNA (Homo sapiens) CpG-island No: 32780
aacgccgctactactatcactaactaaaaccgcgacgaccgacgcacaacaaaaacaacacaactaaaacgcctacaaaaaaaaaaataacatcgcgcgtaaaaaacgcgacgaaactaacgtcgaacgccccctaccacccgctctcgaaactccgctcgacgacacctaccttaaccacgcgccccaatcccgccaaacccctcgacgaacccgaacccgcaaccgaaaaaacacacgcgaacaaaaaaacgcactccataatcaaatacgaacgcgacgactacgaataaccaaacgcgacaaacgaaacgcacgaacgacgcgcattctttccgcgaccccgaaactcgacgccccaaatacgactccaaataaaaaccgccgccgttcacatcgcaacgaaaacgcgctaaaacctcccctcctccgaccgcctacgcgccctcccttctcccgacgcgaacctaccgaactacaatttacgacaccccaaaaaatacgaaaaactccctaaaccgaaactaaaacgcaaacgattaaaaaactatcgatatctacccgcccgtctatacgtctatctatatcgatataaacgtctaaaacgataaaaaaaacaacgccaactaactcccccaacgcgccgaaaccgaacgcccgcctctccaccgcgcgataattaacgaccaacgactcccgaactcgtccgaacccccgaactaatacaaaaacgtaaaattcccgactccaactctaaaaaaaaaaacgaaaaaaacgaaaaaactaaataaaaataa

SEQ ID NO: 32781 - DNA, 597 bp, Artificial Sequence
  chemically treated genomic DNA (Homo sapiens) CpG-island No: 32781
tttcgcgtagttggtacgtttcggatggttttttcgcggcgggggttggttaagttttcgcgcgttgcgtttgcgttcgtttcgagagcgtgtttttggtatcggacgcgcgcgttttttttttttttttcgcgtttttaacgtgtggcggttcgcgattttcggtaattcggagaaggtttatagagcggtttgcgttagcgagtgagtattcgtcgtttgcgtatagtttcgtttatttttttttgttttttttttttttttagcgggttcgcggttcgttatttttcgggaggggcgtttttcgacgttaaggtaggtttttttcgacgtcggggcggttttttttgatgtcggggtgtgtttttcgcgacgcgggggtgggtttcggacgtcggggttggttttgtcgaagtcgggggtgggttttttcggacgtcgaagtgggttcgggatgcggggttgggattttttcgatttcggggcggatttcggacgtcgggatcggttattattggtgtcgggttgggtttttttagatgtcggggttgggttttttttaaggttgaggtgggttcgggacgcgggttgggtttt

SEQ ID NO: 32782 - DNA, 597 bp, Artificial Sequence
  chemically treated genomic DNA (Homo sapiens) CpG-island No: 32782
aaaacccaacccgcgtcccgaacccacctcaaccttaaaaaaaacccaaccccgacatctaaaaaaacccaacccgacaccaataataaccgatcccgacgtccgaaatccgccccgaaatcgaaaaaatcccaaccccgcatcccgaacccacttcgacgtccgaaaaaacccacccccgacttcgacaaaaccaaccccgacgtccgaaacccacccccgcgtcgcgaaaaacacaccccgacatcaaaaaaaaccgccccgacgtcgaaaaaaacctaccttaacgtcgaaaaacgcccctcccgaaaaataacgaaccgcgaacccgctaaaaaaaaaaaaaaaacaaaaaaaaataaacgaaactatacgcaaacgacgaatactcactcgctaacgcaaaccgctctataaaccttctccgaattaccgaaaatcgcgaaccgccacacgttaaaaacgcgaaaaaaaaaaaaaaaacgcgcgcgtccgataccaaaaacacgctctcgaaacgaacgcaaacgcaacgcgcgaaaacttaaccaacccccgccgcgaaaaaaccatccgaaacgtaccaactacgcgaaa

SEQ ID NO: 32783 - DNA, 597 bp, Artificial Sequence
  chemically treated genomic DNA (Homo sapiens) CpG-island No: 32783
gagatttaattcgcgtttcgaatttattttaattttgggaaggatttagtttcggtatttggagaagtttaattcggtattagtaatggtcggtttcggcgttcggaattcgtttcggaatcgggagggttttagtttcgtatttcgagtttatttcggcgttcggagggatttattttcgatttcggtaaggttagtttcggcgttcggagtttattttcgcgtcgcgagagatatatttcggtattaggaagggtcgtttcggcgtcgggagaggtttattttggcgtcgggaagcgtttttttcggagagtagcgggtcgcggattcgttgaggaagaaaaggaggtagggaggggtgggcggagttgtgcgtaggcggcgggtatttattcgttggcgtaggtcgttttgtagatttttttcgggttgtcgggggtcgcgagtcgttatacgttgggagcgcggggggagggggaggggcgcgcgcgttcgatgttagagatacgttttcggggcgggcgtaggcgtagcgcgcggagatttaattaattttcgtcgcgggggagttattcgggacgtattaattgcgcggga

SEQ ID NO: 32784 - DNA, 597 bp, Artificial Sequence
  chemically treated genomic DNA (Homo sapiens) CpG-island No: 32784
tcccgcgcaattaatacgtcccgaataactcccccgcgacgaaaattaattaaatctccgcgcgctacgcctacgcccgccccgaaaacgtatctctaacatcgaacgcgcgcgcccctccccctccccccgcgctcccaacgtataacgactcgcgacccccgacaacccgaaaaaaatctacaaaacgacctacgccaacgaataaatacccgccgcctacgcacaactccgcccacccctccctacctccttttcttcctcaacgaatccgcgacccgctactctccgaaaaaaacgcttcccgacgccaaaataaacctctcccgacgccgaaacgacccttcctaataccgaaatatatctctcgcgacgcgaaaataaactccgaacgccgaaactaaccttaccgaaatcgaaaataaatccctccgaacgccgaaataaactcgaaatacgaaactaaaaccctcccgattccgaaacgaattccgaacgccgaaaccgaccattactaataccgaattaaacttctccaaataccgaaactaaatccttcccaaaattaaaataaattcgaaacgcgaattaaatctc

SEQ ID NO: 32785 - DNA, 639 bp, Artificial Sequence
  chemically treated genomic DNA (Homo sapiens) CpG-island No: 32785
tttcgaatttacggtatacgttttgaggtattagaggtagtaaagtaaaataagcgcggggtttcgtacggtagcgcgggtgtagcgtttaaatttcgcgagatttgttggttgggttaagtattatttattaaatttcgcgatatttaggcgtttgagaggttttttatcggtgagggtttgcggggaagatggagtatttcgcgtcggttacggtgtaggtcgcggacggcggagcggtcgggttttatagtagttcggagttgttggagggttaggagtcggacggggtgcgttttgatcgcgagagggcgcgtcgtttgtgggaagtcgtgttcggtgtttagtcggtgggtagagaggaaggtgagtcgggggttttggaggtagaaagtttttcgttcgttgcgcggttcgcggggaattgcggaagcgtcgacggttatattttttggttcgtttttttgcgtgttgcgtttcgggatttttagatttgtgttttttattcgggcgcgggtattttaagaatcgggtttttagcgcgttgagggtgaagggtcgtttacgtttaggttttgggttttttttttttttttttattatttattatagcgtagttttttttatattcgaggattg

SEQ ID NO: 32786 - DNA, 639 bp, Artificial Sequence
  chemically treated genomic DNA (Homo sapiens) CpG-island No: 32786
caatcctcgaatataaaaaaaactacgctataataaataataaaaaaaaaaaaaaaaaacccaaaacctaaacgtaaacgacccttcaccctcaacgcgctaaaaacccgattcttaaaatacccgcgcccgaataaaaaacacaaatctaaaaatcccgaaacgcaacacgcaaaaaaacgaaccaaaaaatataaccgtcgacgcttccgcaattccccgcgaaccgcgcaacgaacgaaaaactttctacctccaaaacccccgactcaccttcctctctacccaccgactaaacaccgaacacgacttcccacaaacgacgcgccctctcgcgatcaaaacgcaccccgtccgactcctaaccctccaacaactccgaactactataaaacccgaccgctccgccgtccgcgacctacaccgtaaccgacgcgaaatactccatcttccccgcaaaccctcaccgataaaaaacctctcaaacgcctaaatatcgcgaaatttaataaataatacttaacccaaccaacaaatctcgcgaaatttaaacgctacacccgcgctaccgtacgaaaccccgcgcttattttactttactacctctaatacctcaaaacgtataccgtaaattcgaaa

SEQ ID NO: 32787 - DNA, 639 bp, Artificial Sequence
  chemically treated genomic DNA (Homo sapiens) CpG-island No: 32787
tagttttcgaatgtgggaaaaattgcgttgtagtgaatgatgaaggaggaggaggaaaatttagggtttgagcgtgagcggttttttatttttagcgcgttgggggttcgatttttggggtgttcgcgttcggatggggagtataagtttgggggtttcggggcgtagtacgtaaggaggcgggttagggggtgtgatcgtcggcgttttcgtagtttttcgcgagtcgcgtagcgggcgaggggttttttgtttttaaagttttcgatttatttttttttttatttatcggttgggtatcggatacggttttttataggcggcgcgttttttcgcggttaaagcgtatttcgttcggtttttggttttttagtaatttcgagttgttgtaaggttcggtcgtttcgtcgttcgcggtttgtatcgtggtcggcgcgggatattttatttttttcgtaaatttttatcggtagagagttttttaggcgtttaggtatcgcgagatttggtgggtggtatttggtttagttaataaatttcgcgaggtttgggcgttgtattcgcgttgtcgtgcgggatttcgcgtttattttgttttgttatttttggtattttagagcgtgtgtcgtggattcggaa

SEQ ID NO: 32788 - DNA, 639 bp, Artificial Sequence
  chemically treated genomic DNA (Homo sapiens) CpG-island No: 32788
ttccgaatccacgacacacgctctaaaataccaaaaataacaaaacaaaataaacgcgaaatcccgcacgacaacgcgaatacaacgcccaaacctcgcgaaatttattaactaaaccaaataccacccaccaaatctcgcgatacctaaacgcctaaaaaactctctaccgataaaaatttacgaaaaaaataaaatatcccgcgccgaccacgatacaaaccgcgaacgacgaaacgaccgaaccttacaacaactcgaaattactaaaaaaccaaaaaccgaacgaaatacgctttaaccgcgaaaaaacgcgccgcctataaaaaaccgtatccgatacccaaccgataaataaaaaaaaaaataaatcgaaaactttaaaaacaaaaaacccctcgcccgctacgcgactcgcgaaaaactacgaaaacgccgacgatcacaccccctaacccgcctccttacgtactacgccccgaaacccccaaacttatactccccatccgaacgcgaacaccccaaaaatcgaacccccaacgcgctaaaaataaaaaaccgctcacgctcaaaccctaaattttcctcctcctccttcatcattcactacaacgcaatttttcccacattcgaaaacta

SEQ ID NO: 32789 - DNA, 1134 bp, Artificial Sequence
  chemically treated genomic DNA (Homo sapiens) CpG-island No: 32789
attttttcggaacgcgttgggaggtttttttattttcgttttttttcgggcgtacggagattttcggttttagggagcgtttatcgattcggatgacgtggggtatttcgcgcgagttcgggatttagaaggcgtatacgaggagttcggtttagtatttttaaattagatttcggaggcgtcgttagggagcggttatcgttgggcgtcgtcgagcgtgttcggggcgcggtcgtggcgggttttttggggcggtagttttaggcgcgggcgcgtagtagtttcgaaggcgtcgtttggtttagtcgttcggttttcgagcgtcgttgtaagtgggggggcgtttcgcggcgtcgcgtatattttattggggggtcgtttcgtcggcgttcgtttcgtttggttgtcgtttacgggttgttcgcgagcgaggtttttgggtttcgttcggatttcgttcggattcggtttcggtttcgattcgcgtcggttcggttttcgcgcgggtttttatttgtttcggttgtcgggttttggcgggcgggttgtacgcgttttcggtcgttttttttttagtcgtcgtcgatgttatcgttcgggttcgtataaagtttcggagtggagttgtacgcgcgtatatttttttttttagtttttttttttgcgttttgtttttcgtttttcgcgtcgttcgtcgttcgcgtttttttcgcgtattttttcgcgtatatatattttatatttatatttgtcgaggcgtatattcgcgcgtttatatttgcgcggggggcggggaaggggattttggttttattgtagggggacgttcggagaacgaggatttttttcgttttttagacgtttttattcgtttcgtcggttttagttttttttattgcgagggtacggagttcgggagttaggcgtggagcgcgagagttggtatcgcgagttgggagacggcggtagtttagcggtcggattagttggaggagacgcgttcgtcgggagtagcgagatcgggagttcgtcgtttgcggagtttggtttcgcggtttttacgcggcgggcgttggttggacggcggtggtagcgggagattgattcgggaatcggtttttttttttaatttta

SEQ ID NO: 32790 - DNA, 1134 bp, Artificial Sequence
  chemically treated genomic DNA (Homo sapiens) CpG-island No: 32790
taaaattaaaaaaaaaaaccgattcccgaatcaatctcccgctaccaccgccgtccaaccaacgcccgccgcgtaaaaaccgcgaaaccaaactccgcaaacgacgaactcccgatctcgctactcccgacgaacgcgtctcctccaactaatccgaccgctaaactaccgccgtctcccaactcgcgataccaactctcgcgctccacgcctaactcccgaactccgtaccctcgcaataaaaaaaactaaaaccgacgaaacgaataaaaacgtctaaaaaacgaaaaaaatcctcgttctccgaacgtccccctacaataaaaccaaaatccccttccccgccccccgcgcaaatataaacgcgcgaatatacgcctcgacaaatataaatataaaatatatatacgcgaaaaaatacgcgaaaaaaacgcgaacgacgaacgacgcgaaaaacgaaaaacaaaacgcaaaaaaaaaaactaaaaaaaaaaatatacgcgcgtacaactccactccgaaactttatacgaacccgaacgataacatcgacgacgactaaaaaaaaaacgaccgaaaacgcgtacaacccgcccgccaaaacccgacaaccgaaacaaataaaaacccgcgcgaaaaccgaaccgacgcgaatcgaaaccgaaaccgaatccgaacgaaatccgaacgaaacccaaaaacctcgctcgcgaacaacccgtaaacgacaaccaaacgaaacgaacgccgacgaaacgaccccccaataaaatatacgcgacgccgcgaaacgcccccccacttacaacgacgctcgaaaaccgaacgactaaaccaaacgacgccttcgaaactactacgcgcccgcgcctaaaactaccgccccaaaaaacccgccacgaccgcgccccgaacacgctcgacgacgcccaacgataaccgctccctaacgacgcctccgaaatctaatttaaaaatactaaaccgaactcctcgtatacgccttctaaatcccgaactcgcgcgaaataccccacgtcatccgaatcgataaacgctccctaaaaccgaaaatctccgtacgcccgaaaaaaaacgaaaataaaaaaacctcccaacgcgttccgaaaaaat

SEQ ID NO: 32791 - DNA, 1134 bp, Artificial Sequence
  chemically treated genomic DNA (Homo sapiens) CpG-island No: 32791
tggggttggggagggaagtcggttttcgggttagtttttcgttgttatcgtcgtttagttagcgttcgtcgcgtgggagtcgcgaggttaggtttcgtagacggcgggttttcggtttcgttgttttcggcgggcgcgttttttttagttggttcggtcgttgggttgtcgtcgttttttagttcgcggtgttagttttcgcgttttacgtttggttttcgggtttcgtgttttcgtagtagaagggattggggtcggcggggcgggtggggacgtttgggaagcgaggagagttttcgtttttcgggcgtttttttataatggggttagggttttttttttcgtttttcgcgtaggtgtgagcgcgcgagtgtgcgtttcggtaagtgtgagtgtgaagtgtgtgtgcgcgggggagtgcgcggagggagcgcgggcggcgggcggcgcgggaggcgggaggtagggcgtaggggagggggttgggagggagagtgtgcgcgcgtgtaattttatttcggggttttgtgcgagttcgggcgatagtatcggcggcggttggaggaggagcggtcggagacgcgtgtagttcgttcgttagagttcggtagtcggggtaggtgggagttcgcgcgggagtcgagtcgacgcgagtcggagtcggagtcgagttcgagcggagttcgggcggagtttaggagtttcgttcgcgggtagttcgtgggcggtagttaggcggggcgggcgtcggcggggcggttttttagtaagatgtgcgcggcgtcgcggggcgtttttttatttgtagcggcgttcgggagtcgggcggttgggttaggcggcgttttcggggttgttgcgcgttcgcgtttagagttgtcgttttagggagttcgttacggtcgcgtttcgggtacgttcggcggcgtttaacgatgatcgttttttggcggcgttttcggagtttggtttgggaatattgggtcgggtttttcgtgtgcgttttttggatttcggattcgcgcgggatgttttacgttattcggatcggtaagcgttttttggagtcgggggttttcgtgcgttcgggagggggcgggaatgagggggttttttaacgcgtttcggagagat

SEQ ID NO: 32792 - DNA, 1134 bp, Artificial Sequence
  chemically treated genomic DNA (Homo sapiens) CpG-island No: 32792
atctctccgaaacgcgttaaaaaaccccctcattcccgccccctcccgaacgcacgaaaacccccgactccaaaaaacgcttaccgatccgaataacgtaaaacatcccgcgcgaatccgaaatccaaaaaacgcacacgaaaaacccgacccaatattcccaaaccaaactccgaaaacgccgccaaaaaacgatcatcgttaaacgccgccgaacgtacccgaaacgcgaccgtaacgaactccctaaaacgacaactctaaacgcgaacgcgcaacaaccccgaaaacgccgcctaacccaaccgcccgactcccgaacgccgctacaaataaaaaaacgccccgcgacgccgcgcacatcttactaaaaaaccgccccgccgacgcccgccccgcctaactaccgcccacgaactacccgcgaacgaaactcctaaactccgcccgaactccgctcgaactcgactccgactccgactcgcgtcgactcgactcccgcgcgaactcccacctaccccgactaccgaactctaacgaacgaactacacgcgtctccgaccgctcctcctccaaccgccgccgatactatcgcccgaactcgcacaaaaccccgaaataaaattacacgcgcgcacactctccctcccaaccccctcccctacgccctacctcccgcctcccgcgccgcccgccgcccgcgctccctccgcgcactcccccgcgcacacacacttcacactcacacttaccgaaacgcacactcgcgcgctcacacctacgcgaaaaacgaaaaaaaaaaccctaaccccattataaaaaaacgcccgaaaaacgaaaactctcctcgcttcccaaacgtccccacccgccccgccgaccccaatcccttctactacgaaaacacgaaacccgaaaaccaaacgtaaaacgcgaaaactaacaccgcgaactaaaaaacgacgacaacccaacgaccgaaccaactaaaaaaaacgcgcccgccgaaaacaacgaaaccgaaaacccgccgtctacgaaacctaacctcgcgactcccacgcgacgaacgctaactaaacgacgataacaacgaaaaactaacccgaaaaccgacttccctccccaacccca

SEQ ID NO: 32793 - DNA, 568 bp, Artificial Sequence
  chemically treated genomic DNA (Homo sapiens) CpG-island No: 32793
atggcgtagcgtacgtacggttttgagtgttaacgaaatttgaagggcgagagttcggggagtttcggtcgcgacggttacggcgatttttttatattagggatagcgggggtcgggtttcgtcgttttttttttgaggttgtgggtaagttcggatattcgttttgagggtgtcggcgtcgtcgtcgtcgcgtttttttttttcgggtgttattggttggtttcggttttttatttagtttcgggagtcgcggcggcgacgataacggtagtaggtgaattgtgcgttaagggcgtttgcgcggtttacgtggagtttatagaggttaattacggagtatcggatgggataagtataatgtcgggtttcgtatatgcgcgttcggtcggtcgttttcgaattcgttgtattggaggacgtaaggttcggttttgtttgatttcgttgcgtgcggagatcgtcgtcgcggtttagaatcggagcgtgggttagtttgaatattattttgatttttatttgggttttggttttgcgaaattagacggggagagtgttgtttttatcgat

SEQ ID NO: 32794 - DNA, 568 bp, Artificial Sequence
  chemically treated genomic DNA (Homo sapiens) CpG-island No: 32794
atcgataaaaacaacactctccccgtctaatttcgcaaaaccaaaacccaaataaaaatcaaaataatattcaaactaacccacgctccgattctaaaccgcgacgacgatctccgcacgcaacgaaatcaaacaaaaccgaaccttacgtcctccaatacaacgaattcgaaaacgaccgaccgaacgcgcatatacgaaacccgacattatacttatcccatccgatactccgtaattaacctctataaactccacgtaaaccgcgcaaacgcccttaacgcacaattcacctactaccgttatcgtcgccgccgcgactcccgaaactaaataaaaaaccgaaaccaaccaataacacccgaaaaaaaaaaacgcgacgacgacgacgccgacaccctcaaaacgaatatccgaacttacccacaacctcaaaaaaaaaacgacgaaacccgacccccgctatccctaatataaaaaaatcgccgtaaccgtcgcgaccgaaactccccgaactctcgcccttcaaatttcgttaacactcaaaaccgtacgtacgctacgccat

SEQ ID NO: 32795 - DNA, 568 bp, Artificial Sequence
  chemically treated genomic DNA (Homo sapiens) CpG-island No: 32795
atcgatagaagtagtatttttttcgtttgatttcgtagggttaaagtttaggtgagagttagggtagtgtttagattagtttacgtttcggttttgagtcgcgacggcggttttcgtacgtaacgaaattaggtaggatcgaattttgcgttttttagtgtagcgagttcggaagcgatcggtcgagcgcgtatgtgcgggattcgatattgtgtttgttttattcggtgtttcgtagttagtttttgtgagttttacgtaggtcgcgtaagcgtttttggcgtatagtttatttgttgtcgttgtcgtcgtcgtcgcggttttcggggttggatggggggtcgaggttagttagtggtattcggaagaaagagacgcggcggcggcgacgtcgatatttttaggacgagtgttcggatttgtttatagttttaaggaggagacggcgaggttcggttttcgttgtttttggtgtaaagaagtcgtcgtagtcgtcgcggtcgggatttttcgggttttcgttttttaggtttcgttgatatttaggatcgtacgtacgttgcgttat

SEQ ID NO: 32796 - DNA, 568 bp, Artificial Sequence
  chemically treated genomic DNA (Homo sapiens) CpG-island No: 32796
ataacgcaacgtacgtacgatcctaaatatcaacgaaacctaaaaaacgaaaacccgaaaaatcccgaccgcgacgactacgacgacttctttacaccaaaaacaacgaaaaccgaacctcgccgtctcctccttaaaactataaacaaatccgaacactcgtcctaaaaatatcgacgtcgccgccgccgcgtctctttcttccgaataccactaactaacctcgaccccccatccaaccccgaaaaccgcgacgacgacgacaacgacaacaaataaactatacgccaaaaacgcttacgcgacctacgtaaaactcacaaaaactaactacgaaacaccgaataaaacaaacacaatatcgaatcccgcacatacgcgctcgaccgatcgcttccgaactcgctacactaaaaaacgcaaaattcgatcctacctaatttcgttacgtacgaaaaccgccgtcgcgactcaaaaccgaaacgtaaactaatctaaacactaccctaactctcacctaaactttaaccctacgaaatcaaacgaaaaaaatactacttctatcgat

SEQ ID NO: 32797 - DNA, 1000 bp, Artificial Sequence
  chemically treated genomic DNA (Homo sapiens) CpG-island No: 32797
gttttgatatcgttttttgggggtgttcgttttgggatagaatcgtagtgtggcgtttaaggaggaagagaaggcgtttagggtattcgaaacggagggatagttgtttaatttaattttttttatagtgggaataatacgtattttttttttagcgcggtggaagggtgagcgttagaaattagacgggatgtttgagaacgtcgtaggtagggggcgattttagttcgggagttcgtcgcgggtcggttagtttttagggaagttcggttttttagtcgaggtcggaggcggcgcggattttacgggattgcggaggtcgggaaaaaggtttttaatttttcgttttttgtttttatcgggttggcgggaggagcggtttttatttgtgttagggcgcgcgttgcgattgcgtcgttgttcgggaagggtcgaagagttgttcgttcgttcggcgttcgttggggttatgggcgaggggcgtagttggacgatttagttttgggttttcggttaggcgggcggggatggacgcggcggttttcggtattggtagtcggttagtcggttaggtcgatgtgttttttgcgtcgcggttgagatagcgggaatcggtttcgggaggagtcgtagtttgagcggtcgattgaggaggcgaaggatgggcggggttatagggtcgacgatttatttattcggaagtagttgtggtcgcgattgttcgggagtggcgtttgtcgcggttcgggtttgtatttcgttgggtaaagtattcggggttgttatacggcgagttgagttttgggtcggcgggtgaggttttttaagcggcgatgtttttggttttttgtttcgttattgcgagtcgttagggttaagttggagggagggcggcgaggcgcggttgtcggtagggcggggttttgggttgttggcggggcggaggtcggaggcggttttgggcgggtggtttttttgggttttacggtttttgtttagg

SEQ ID NO: 32798 - DNA, 1000 bp, Artificial Sequence
  chemically treated genomic DNA (Homo sapiens) CpG-island No: 32798
cctaaacaaaaaccgtaaaacccaaaaaaaccacccgcccaaaaccgcctccgacctccgccccgccaacaacccaaaaccccgccctaccgacaaccgcgcctcgccgccctccctccaacttaaccctaacgactcgcaataacgaaacaaaaaaccaaaaacatcgccgcttaaaaaacctcacccgccgacccaaaactcaactcgccgtataacaaccccgaatactttacccaacgaaatacaaacccgaaccgcgacaaacgccactcccgaacaatcgcgaccacaactacttccgaataaataaatcgtcgaccctataaccccgcccatccttcgcctcctcaatcgaccgctcaaactacgactcctcccgaaaccgattcccgctatctcaaccgcgacgcaaaaaacacatcgacctaaccgactaaccgactaccaataccgaaaaccgccgcgtccatccccgcccgcctaaccgaaaacccaaaactaaatcgtccaactacgcccctcgcccataaccccaacgaacgccgaacgaacgaacaactcttcgacccttcccgaacaacgacgcaatcgcaacgcgcgccctaacacaaataaaaaccgctcctcccgccaacccgataaaaacaaaaaacgaaaaattaaaaacctttttcccgacctccgcaatcccgtaaaatccgcgccgcctccgacctcgactaaaaaaccgaacttccctaaaaactaaccgacccgcgacgaactcccgaactaaaatcgccccctacctacgacgttctcaaacatcccgtctaatttctaacgctcacccttccaccgcgctaaaaaaaaaatacgtattattcccactataaaaaaaattaaattaaacaactatccctccgtttcgaataccctaaacgccttctcttcctccttaaacgccacactacgattctatcccaaaacgaacacccccaaaaaacgatatcaaaac

SEQ ID NO: 32799 - DNA, 1000 bp, Artificial Sequence
  chemically treated genomic DNA (Homo sapiens) CpG-island No: 32799
tttgggtaggaatcgtgggatttagagaagttattcgtttaaggtcgttttcggttttcgtttcgttagtagtttagggtttcgttttatcggtagtcgcgtttcgtcgttttttttttagtttggttttaacggttcgtaatggcggaatagggagttaggggtatcgtcgtttggggaattttattcgtcggtttagggtttagttcgtcgtgtgatagtttcgggtattttgtttagcggggtgtaagttcggatcgcggtaagcgttattttcgggtagtcgcggttataattgttttcgggtgagtgggtcgtcgattttgtggtttcgtttatttttcgtttttttagtcggtcgtttaggttgcggtttttttcggggtcggttttcgttgttttagtcgcggcgtagagggtatatcggtttgatcgattagtcggttgttagtgtcgggagtcgtcgcgtttattttcgttcgtttggtcggggatttaggattgagtcgtttagttgcgtttttcgtttatagttttagcgggcgtcgggcgggcgagtagtttttcggtttttttcggatagcgacgtagtcgtagcgcgcgttttaatataggtaagggtcgtttttttcgttagttcggtgggagtagggagcggggagttgggaatttttttttcggttttcgtagtttcgtgggattcgcgtcgttttcgatttcggttagggggtcgggtttttttggggattggtcggttcgcggcgggttttcgggttggggtcgttttttgtttgcggcgtttttagatatttcgtttgatttttaacgtttatttttttatcgcgttggggaaaaggtacgtgttatttttattgtgggagaaattaaattgggtagttgttttttcgtttcgggtgttttaggcgttttttttttttttttagacgttatattacggttttgttttaggacgagtatttttagggaacggtgttaggat

SEQ ID NO: 32800 - DNA, 1000 bp, Artificial Sequence
  chemically treated genomic DNA (Homo sapiens) CpG-island No: 32800
atcctaacaccgttccctaaaaatactcgtcctaaaacaaaaccgtaatataacgtctaaaaaaaaaaaaaaaacgcctaaaacacccgaaacgaaaaaacaactacccaatttaatttctcccacaataaaaataacacgtaccttttccccaacgcgataaaaaaataaacgttaaaaatcaaacgaaatatctaaaaacgccgcaaacaaaaaacgaccccaacccgaaaacccgccgcgaaccgaccaatccccaaaaaaacccgaccccctaaccgaaatcgaaaacgacgcgaatcccacgaaactacgaaaaccgaaaaaaaaattcccaactccccgctccctactcccaccgaactaacgaaaaaaacgacccttacctatattaaaacgcgcgctacgactacgtcgctatccgaaaaaaaccgaaaaactactcgcccgcccgacgcccgctaaaactataaacgaaaaacgcaactaaacgactcaatcctaaatccccgaccaaacgaacgaaaataaacgcgacgactcccgacactaacaaccgactaatcgatcaaaccgatataccctctacgccgcgactaaaacaacgaaaaccgaccccgaaaaaaaccgcaacctaaacgaccgactaaaaaaacgaaaaataaacgaaaccacaaaatcgacgacccactcacccgaaaacaattataaccgcgactacccgaaaataacgcttaccgcgatccgaacttacaccccgctaaacaaaatacccgaaactatcacacgacgaactaaaccctaaaccgacgaataaaattccccaaacgacgatacccctaactccctattccgccattacgaaccgttaaaaccaaactaaaaaaaaaacgacgaaacgcgactaccgataaaacgaaaccctaaactactaacgaaacgaaaaccgaaaacgaccttaaacgaataacttctctaaatcccacgattcctacccaaa

SEQ ID NO: 32801 - DNA, 1528 bp, Artificial Sequence
  chemically treated genomic DNA (Homo sapiens) CpG-island No: 32801
ggcgcgggaattcgatcgagagttcgttaagtagcgggattttattagtagttgcgcgtttgcgtatcggggtcgagcgcgcgagcgtttttttttcgtttgtagttttttatttcgtcgttcggttcgcgcgtttgcgcgtcggttgggaggaatttagttttttcgttttggtaggcgggaggacgcgcgcgcgttcgcggcgagggggaggtagtgcggcggcgggagtcgggtcgcgcgcgttagtgggaagcgttcggttgttatagcgttagtttcgtcgtagtcgttgtcgttcgtgtttcgttcgttttttttttcgttttttcgttcgtttttgttcgggcgtatgcgttgtcggagcgcgagggtcggtttcgggtgtgtggtggcggtagagttgagttgcgaggttcgagagttagaatttgggggagagggatggtttttgtacgggggggagtcggaggagtcgtcgtcgttgtcgacgttatcgtcgtagtcgtcgtcgtcgtcgtttcggtattcgtttttcggcgttgacggtttcgtacgaagtcggcgagggggagttagtagcggcggtcgtcggtacgtcgtttagtatggttcgggaaattaggtatttttgggtgggtaatttattcgagaacgtgcgggaagagaagattatcgagtattttaaacggtgagtgatacgaggttcgcggtcgcgttcgtttttcgggcgtcgtttttcgtttcggttcgttgtcggtttttttcggagcgcggagttggtgaggaggatttcggttcggatttacgggcgttgtgggatttcgttagtcgttcggttcgcgtcgcggcgttgggtttcgggtgtcggcggtgcgggcggttaagtcgcgtcgttttcgaagagttcgcggggtttcggcggtcgcgttcgtgacgagggaggtgatcgaggttcggtttttacgtagtcggcgtttcggggttgttttcgcgttagttcgggagtcggtgggagatgcgttgggcggcggggtcgcgtttttgcgcgtagtgttcggttcggagtagtcgggattcgagttcgttcgatagtcgggttcggcgtcgttattttaagttgttttgcgggcgttcggtaatgtttgatttcgggagggtttcgtgcgaagggaaaggcggtgcgaaaatagaagtcgtagtaggtattgtggtcgcgtcgcggattcggagagattatttaggattttttcggaggatttgtagttttgaaatttattgggaatggtaaacgtttttcgtttttgcggggttgggtggagagtggtgtgaaataagttggtgcgttcgtttgggttttttcgttttcggcggaggagatcgcgtttgataggaggttgttagtttcggcgttcgtagtttcgggtcgtatttttaggtcgttttaagattttggtgttttttatttttgaattttcgaattaaacggtaaaatattttaaattttttacgatgagaagatgtagtt

SEQ ID NO: 32802 - DNA, 1528 bp, Artificial Sequence
  chemically treated genomic DNA (Homo sapiens) CpG-island No: 32802
aactacatcttctcatcgtaaaaaatttaaaatattttaccgtttaattcgaaaattcaaaaataaaaaacaccaaaatcttaaaacgacctaaaaatacgacccgaaactacgaacgccgaaactaacaacctcctatcaaacgcgatctcctccgccgaaaacgaaaaaacccaaacgaacgcaccaacttatttcacaccactctccacccaaccccgcaaaaacgaaaaacgtttaccattcccaataaatttcaaaactacaaatcctccgaaaaaatcctaaataatctctccgaatccgcgacgcgaccacaatacctactacgacttctattttcgcaccgcctttcccttcgcacgaaaccctcccgaaatcaaacattaccgaacgcccgcaaaacaacttaaaataacgacgccgaacccgactatcgaacgaactcgaatcccgactactccgaaccgaacactacgcgcaaaaacgcgaccccgccgcccaacgcatctcccaccgactcccgaactaacgcgaaaacaaccccgaaacgccgactacgtaaaaaccgaacctcgatcacctccctcgtcacgaacgcgaccgccgaaaccccgcgaactcttcgaaaacgacgcgacttaaccgcccgcaccgccgacacccgaaacccaacgccgcgacgcgaaccgaacgactaacgaaatcccacaacgcccgtaaatccgaaccgaaatcctcctcaccaactccgcgctccgaaaaaaaccgacaacgaaccgaaacgaaaaacgacgcccgaaaaacgaacgcgaccgcgaacctcgtatcactcaccgtttaaaatactcgataatcttctcttcccgcacgttctcgaataaattacccacccaaaaatacctaatttcccgaaccatactaaacgacgtaccgacgaccgccgctactaactccccctcgccgacttcgtacgaaaccgtcaacgccgaaaaacgaataccgaaacgacgacgacgacgactacgacgataacgtcgacaacgacgacgactcctccgactcccccccgtacaaaaaccatccctctcccccaaattctaactctcgaacctcgcaactcaactctaccgccaccacacacccgaaaccgaccctcgcgctccgacaacgcatacgcccgaacaaaaacgaacgaaaaaacgaaaaaaaaaacgaacgaaacacgaacgacaacgactacgacgaaactaacgctataacaaccgaacgcttcccactaacgcgcgcgacccgactcccgccgccgcactacctccccctcgccgcgaacgcgcgcgcgtcctcccgcctaccaaaacgaaaaaactaaattcctcccaaccgacgcgcaaacgcgcgaaccgaacgacgaaataaaaaactacaaacgaaaaaaaaacgctcgcgcgctcgaccccgatacgcaaacgcgcaactactaataaaatcccgctacttaacgaactctcgatcgaattcccgcgcc

SEQ ID NO: 32803 - DNA, 1528 bp, Artificial Sequence
  chemically treated genomic DNA (Homo sapiens) CpG-island No: 32803
agttatatttttttatcgtaaaaggtttggaatgttttatcgtttgattcgggaatttaggggtggggggtattagggttttagggcggtttgggagtgcgattcgaggttacgggcgtcggggttagtaattttttgttagacgcggtttttttcgtcggggacgaggaagtttaaacgggcgtattaatttattttatattattttttatttagtttcgtaaaaacgagaaacgtttgttatttttagtgagttttaaggttgtaaatttttcggagaggttttagatggttttttcgggttcgcgacgcgattatagtatttattgcgatttttgttttcgtatcgttttttttttcgtacggaattttttcgaagttagatattgtcgagcgttcgtagagtagtttggagtggcggcgtcggattcggttgtcgggcgggttcgggtttcggttgtttcgggtcgggtattgcgcgtaaggacgcgatttcgtcgtttagcgtattttttatcgattttcgggttgacgcgagggtagtttcggggcgtcggttgcgtggaggtcgagtttcggttatttttttcgttacggacgcggtcgtcggggtttcgcgggtttttcgaaggcggcgcggtttggtcgttcgtatcgtcgatattcgaggtttaacgtcgcgacgcgggtcgagcggttgacgaggttttatagcgttcgtgggttcgggtcggagttttttttattagtttcgcgtttcgggaggggtcggtaacgggtcggggcgggaagcggcgttcgaggagcgagcgcggtcgcgggtttcgtgttatttatcgtttgaaatgttcgatgatttttttttttcgtacgttttcgggtaagttgtttatttagagatgtttggtttttcggattatgttgggcggcgtgtcggcgatcgtcgttgttggttttttttcgtcggtttcgtacgagatcgttagcgtcgggaggcgggtgtcggggcggcggcggcggcggttgcggcggtggcgtcggtagcggcggcggttttttcggttttttttcgtgtagagattattttttttttttaggttttgattttcgggtttcgtagtttagttttgtcgttattatatattcgaagtcgattttcgcgtttcggtagcgtatgcgttcgggtaggggcgggcgggggagcgggaggaggggcgagcgggatacgggcggtagcgattacgacggagttggcgttgtggtagtcggacgttttttattggcgcgcgcggttcgattttcgtcgtcgtattgtttttttttcgtcgcgggcgcgcgcgcgttttttcgtttgttaaggcggagaagttgagttttttttagtcggcgcgtaggcgcgcggatcgggcgacgaagtgagggattataggcggggaaggaacgttcgcgcgttcggtttcggtgcgtaggcgcgtagttgttagtggagtttcgttgtttggcgggttttcggtcgggttttcgcgtt

SEQ ID NO: 32804 - DNA, 1528 bp, Artificial Sequence
  chemically treated genomic DNA (Homo sapiens) CpG-island No: 32804
aacgcgaaaacccgaccgaaaacccgccaaacaacgaaactccactaacaactacgcgcctacgcaccgaaaccgaacgcgcgaacgttccttccccgcctataatccctcacttcgtcgcccgatccgcgcgcctacgcgccgactaaaaaaaactcaacttctccgccttaacaaacgaaaaaacgcgcgcgcgcccgcgacgaaaaaaaaacaatacgacgacgaaaatcgaaccgcgcgcgccaataaaaaacgtccgactaccacaacgccaactccgtcgtaatcgctaccgcccgtatcccgctcgcccctcctcccgctcccccgcccgcccctacccgaacgcatacgctaccgaaacgcgaaaatcgacttcgaatatataataacgacaaaactaaactacgaaacccgaaaatcaaaacctaaaaaaaaaaaataatctctacacgaaaaaaaaccgaaaaaaccgccgccgctaccgacgccaccgccgcaaccgccgccgccgccgccccgacacccgcctcccgacgctaacgatctcgtacgaaaccgacgaaaaaaaaccaacaacgacgatcgccgacacgccgcccaacataatccgaaaaaccaaacatctctaaataaacaacttacccgaaaacgtacgaaaaaaaaaaatcatcgaacatttcaaacgataaataacacgaaacccgcgaccgcgctcgctcctcgaacgccgcttcccgccccgacccgttaccgacccctcccgaaacgcgaaactaataaaaaaaactccgacccgaacccacgaacgctataaaacctcgtcaaccgctcgacccgcgtcgcgacgttaaacctcgaatatcgacgatacgaacgaccaaaccgcgccgccttcgaaaaacccgcgaaaccccgacgaccgcgtccgtaacgaaaaaaataaccgaaactcgacctccacgcaaccgacgccccgaaactaccctcgcgtcaacccgaaaatcgataaaaaatacgctaaacgacgaaatcgcgtccttacgcgcaatacccgacccgaaacaaccgaaacccgaacccgcccgacaaccgaatccgacgccgccactccaaactactctacgaacgctcgacaatatctaacttcgaaaaaattccgtacgaaaaaaaaaacgatacgaaaacaaaaatcgcaataaatactataatcgcgtcgcgaacccgaaaaaaccatctaaaacctctccgaaaaatttacaaccttaaaactcactaaaaataacaaacgtttctcgtttttacgaaactaaataaaaaataatataaaataaattaatacgcccgtttaaacttcctcgtccccgacgaaaaaaaccgcgtctaacaaaaaattactaaccccgacgcccgtaacctcgaatcgcactcccaaaccgccctaaaaccctaataccccccacccctaaattcccgaatcaaacgataaaacattccaaaccttttacgataaaaaaatataact

SEQ ID NO: 32805 - DNA, 621 bp, Artificial Sequence
  chemically treated genomic DNA (Homo sapiens) CpG-island No: 32805
tttgcggatttttcggtcgcgttttaaggtttatacgtcgcgtggtagttcggatgtagttcggtttcgaggcggtcggcggtcgagattggggtttcgagtcgagaagcgaagaataaagcggtcgcgttagttcgtcgtttcgagggatagttcgggcgcgttcgtcgtttcgtttatatttcgtttttcggtcgcgcgaaatggcggcggtcgtattataaaatggtagtcgttcggtcgcggagaagtatttgttaaatttcgtgattttttttttttgttttgtttcgttagcgttaacgtcgtttttttcgtttaggcgtttcggtttttttacgtcgtttcgtttaggggtaatagggttcggagttcgttaataacgcggcgtttttgtgcgggcgtacgttatttttatttagttatacgggttttttttcggggggtttttttttaaaggggtaatcgttggaagaaacggagtatcgtcgttcgggacgttttttaggttcggggttattacggtttttttaattcgtagcgttagcgttaggttattaaagtgaagatgggtggtgaaaggattatagagttcgatagaagagaaaatttaggaaaaat

SEQ ID NO: 32806 - DNA, 621 bp, Artificial Sequence
  chemically treated genomic DNA (Homo sapiens) CpG-island No: 32806
atttttcctaaattttctcttctatcgaactctataatcctttcaccacccatcttcactttaataacctaacgctaacgctacgaattaaaaaaaccgtaataaccccgaacctaaaaaacgtcccgaacgacgatactccgtttcttccaacgattacccctttaaaaaaaaaccccccgaaaaaaaacccgtataactaaataaaaataacgtacgcccgcacaaaaacgccgcgttattaacgaactccgaaccctattacccctaaacgaaacgacgtaaaaaaaccgaaacgcctaaacgaaaaaaacgacgttaacgctaacgaaacaaaacaaaaaaaaaaaatcacgaaatttaacaaatacttctccgcgaccgaacgactaccattttataatacgaccgccgccatttcgcgcgaccgaaaaacgaaatataaacgaaacgacgaacgcgcccgaactatccctcgaaacgacgaactaacgcgaccgctttattcttcgcttctcgactcgaaaccccaatctcgaccgccgaccgcctcgaaaccgaactacatccgaactaccacgcgacgtataaaccttaaaacgcgaccgaaaaatccgcaaa

SEQ ID NO: 32807 - DNA, 621 bp, Artificial Sequence
  chemically treated genomic DNA (Homo sapiens) CpG-island No: 32807
attttttttaggtttttttttttatcgggttttgtggtttttttattatttatttttattttggtggtttgacgttaacgttgcgagttggggaaatcgtagtaatttcgggtttgaggggcgtttcgggcggcggtgtttcgttttttttagcggttgtttttttaagaaaaagtttttcggagaggggttcgtgtggttgagtaaaggtggcgtgcgttcgtataaaggcgtcgcgttgttggcgggtttcggattttgttgtttttgggcggggcggcgtgggaagatcggggcgtttgggcggggagaacgacgttggcgttagcggggtagggtagggggagggagttacgggatttagtaggtgttttttcgcgatcgagcgattgttattttgtggtgcggtcgtcgttatttcgcgcggtcgaggggcggggtgtgggcggagcggcgggcgcgttcgggttgtttttcggggcggcgggttaacgcggtcgttttgtttttcgtttttcggttcgaggttttagtttcgatcgtcgatcgtttcggaatcgggttgtattcgagttgttacgcggcgtgtgaattttgaagcgcggtcggggaattcgtaag

SEQ ID NO: 32808 - DNA, 621 bp, Artificial Sequence
  chemically treated genomic DNA (Homo sapiens) CpG-island No: 32808
cttacgaattccccgaccgcgcttcaaaattcacacgccgcgtaacaactcgaatacaacccgattccgaaacgatcgacgatcgaaactaaaacctcgaaccgaaaaacgaaaaacaaaacgaccgcgttaacccgccgccccgaaaaacaacccgaacgcgcccgccgctccgcccacaccccgcccctcgaccgcgcgaaataacgacgaccgcaccacaaaataacaatcgctcgatcgcgaaaaaacacctactaaatcccgtaactccctccccctaccctaccccgctaacgccaacgtcgttctccccgcccaaacgccccgatcttcccacgccgccccgcccaaaaacaacaaaatccgaaacccgccaacaacgcgacgcctttatacgaacgcacgccacctttactcaaccacacgaacccctctccgaaaaactttttcttaaaaaaacaaccgctaaaaaaaacgaaacaccgccgcccgaaacgcccctcaaacccgaaattactacgatttccccaactcgcaacgttaacgtcaaaccaccaaaataaaaataaataataaaaaaaccacaaaacccgataaaaaaaaaaacctaaaaaaaat

SEQ ID NO: 32809 - DNA, 706 bp, Artificial Sequence
  chemically treated genomic DNA (Homo sapiens) CpG-island No: 32809
ggttggggggtaggtaggggtcgttttcgcggggcgggaatttcgcgtttttttttttcgagttttattttttatggtaaagcggcgcggggcggcggggcggagggagtcgagggggcggggagggcggacgggcggaggggacgggaggtttagcggtttcgggtttcgttggttcgggcgtcggatcggagtcgtcggggcgcgggcggtttaggtaagcgggtcgggtgggtgggggtcgcgttttttcgtttttgttttcggtgtatataggtgatagcgtcggtagtgttcggtcggagtttgttcggtcgttagtcgggattttcggcgcggcgtttttggaggggtttgcgggtggggggtgcggtttttacgttttttgcgttttagttttttggttttttttttcggagtcggggagtcggtaggttcggggcgagggtttagtgaggtcggcggagggtcgagttttagttcgggagcgggagtcggggattcggcgcgtagggcggaagttttcgtataaaaggtcggagtttcgtatatggatcgaattaaagtttcggcggcgtttagcggtgatttcggcggtcgttttgttcggttgtttgcggagggtttcgcgttttcggagttcgggggcgttttaggtttttttttttagttagggttaggtaaggggagggacgggtttcggggt

SEQ ID NO: 32810 - DNA, 706 bp, Artificial Sequence
  chemically treated genomic DNA (Homo sapiens) CpG-island No: 32810
accccgaaacccgtccctccccttacctaaccctaactaaaaaaaaaaacctaaaacgcccccgaactccgaaaacgcgaaaccctccgcaaacaaccgaacaaaacgaccgccgaaatcaccgctaaacgccgccgaaactttaattcgatccatatacgaaactccgaccttttatacgaaaacttccgccctacgcgccgaatccccgactcccgctcccgaactaaaactcgaccctccgccgacctcactaaaccctcgccccgaacctaccgactccccgactccgaaaaaaaaaaccaaaaaactaaaacgcaaaaaacgtaaaaaccgcaccccccacccgcaaacccctccaaaaacgccgcgccgaaaatcccgactaacgaccgaacaaactccgaccgaacactaccgacgctatcacctatatacaccgaaaacaaaaacgaaaaaacgcgacccccacccacccgacccgcttacctaaaccgcccgcgccccgacgactccgatccgacgcccgaaccaacgaaacccgaaaccgctaaacctcccgtcccctccgcccgtccgccctccccgccccctcgactccctccgccccgccgccccgcgccgctttaccataaaaaataaaactcgaaaaaaaaaaacgcgaaattcccgccccgcgaaaacgacccctacctaccccccaacc

SEQ ID NO: 32811 - DNA, 706 bp, Artificial Sequence
  chemically treated genomic DNA (Homo sapiens) CpG-island No: 32811
gtttcgggattcgtttttttttttgtttgattttggttaggaaaaggggtttggagcgttttcgggtttcggaaacgcgggatttttcgtaggtagtcgagtagggcggtcgtcggggttatcgttgggcgtcgtcggagttttaattcgatttatgtgcgggatttcggttttttgtgcgggagttttcgttttgcgcgtcgggttttcggttttcgttttcgggttgggattcggtttttcgtcggttttattgagttttcgtttcggatttgtcgatttttcgatttcggggagagagattaagagattgggacgtaaagggcgtgaggatcgtattttttattcgtaggtttttttaggggcgtcgcgtcgggggtttcggttggcgatcgagtaggtttcggtcgagtattgtcggcgttgttatttgtgtgtatcggggatagggacggagggacgcgatttttatttattcggttcgtttatttgggtcgttcgcgtttcggcggtttcgattcgacgttcgagttagcggagttcggagtcgttgggtttttcgtttttttcgttcgttcgtttttttcgttttttcggtttttttcgtttcgtcgtttcgcgtcgttttattataaaaggtgaggttcggggggagggggcgcgggattttcgtttcgcggaagcggtttttatttgttttttaatt

SEQ ID NO: 32812 - DNA, 706 bp, Artificial Sequence
  chemically treated genomic DNA (Homo sapiens) CpG-island No: 32812
aattaaaaaacaaataaaaaccgcttccgcgaaacgaaaatcccgcgccccctccccccgaacctcaccttttataataaaacgacgcgaaacgacgaaacgaaaaaaaccgaaaaaacgaaaaaaacgaacgaacgaaaaaaacgaaaaacccaacgactccgaactccgctaactcgaacgtcgaatcgaaaccgccgaaacgcgaacgacccaaataaacgaaccgaataaataaaaatcgcgtccctccgtccctatccccgatacacacaaataacaacgccgacaatactcgaccgaaacctactcgatcgccaaccgaaacccccgacgcgacgcccctaaaaaaacctacgaataaaaaatacgatcctcacgccctttacgtcccaatctcttaatctctctccccgaaatcgaaaaatcgacaaatccgaaacgaaaactcaataaaaccgacgaaaaaccgaatcccaacccgaaaacgaaaaccgaaaacccgacgcgcaaaacgaaaactcccgcacaaaaaaccgaaatcccgcacataaatcgaattaaaactccgacgacgcccaacgataaccccgacgaccgccctactcgactacctacgaaaaatcccgcgtttccgaaacccgaaaacgctccaaaccccttttcctaaccaaaatcaaacaaaaaaaaaaacgaatcccgaaac

SEQ ID NO: 32813 - DNA, 517 bp, Artificial Sequence
  chemically treated genomic DNA (Homo sapiens) CpG-island No: 32813
aaagttacgaatttcgtttttcgttttttttgtttaattttgtagcgttttttttattagaaaatttacgaatttcgttttttattagtatggttcggtttttatttggtttatgttcgtattgataaaaagtaaattggggtcgtcgcggggtcgtacggaagcggagggtattagtcggtggttatggcggtttcgaaagaagtttagaaaggcggtttttacggtcgaggttttggttgtagggggtttcgatgagagcggtcgatggttgaggtttcgttatgcgggcgattttcgaatggttcgtcgtagttttcgggttgtagttgttattgacgttgttatcgtagtttcgggtagtgattttacgtggttaaagagtgacgagggaaggaagttaggcgttttttatagcggtttttggcggtaggaggatttagggggcggtttttgtcgtcggggtggaagcgatcgattgggtcgttggtagagtttagtatagcgttcggtatat

SEQ ID NO: 32814 - DNA, 517 bp, Artificial Sequence
  chemically treated genomic DNA (Homo sapiens) CpG-island No: 32814
atataccgaacgctatactaaactctaccaacgacccaatcgatcgcttccaccccgacgacaaaaaccgccccctaaatcctcctaccgccaaaaaccgctataaaaaacgcctaacttccttccctcgtcactctttaaccacgtaaaatcactacccgaaactacgataacaacgtcaataacaactacaacccgaaaactacgacgaaccattcgaaaatcgcccgcataacgaaacctcaaccatcgaccgctctcatcgaaaccccctacaaccaaaacctcgaccgtaaaaaccgcctttctaaacttctttcgaaaccgccataaccaccgactaataccctccgcttccgtacgaccccgcgacgaccccaatttactttttatcaatacgaacataaaccaaataaaaaccgaaccatactaataaaaaacgaaattcgtaaattttctaataaaaaaaacgctacaaaattaaacaaaaaaaacgaaaaacgaaattcgtaacttt

SEQ ID NO: 32815 - DNA, 517 bp, Artificial Sequence
  chemically treated genomic DNA (Homo sapiens) CpG-island No: 32815
atgtgtcgggcgttgtgttagattttgttagcgatttaatcgatcgtttttatttcggcggtagaggtcgttttttgagtttttttatcgttaggggtcgttgtaggaaacgtttggtttttttttttcgttattttttgattacgtaaagttattgttcggagttacgatggtagcgttagtggtagttgtagttcggaggttgcggcgggttattcgaaggtcgttcgtatggcggggttttagttatcggtcgtttttatcggagttttttgtagttaaggtttcggtcgtgagggtcgtttttttgaatttttttcgggatcgttatggttatcggttggtgtttttcgttttcgtgcggtttcgcggcgattttagtttgttttttgttaatgcgggtatgaattaggtgagggtcgaattatattgatagggagcggagttcgtgagttttttggtgagaaagacgttgtaggattgggtaaaagaagcgagaggcggagttcgtagtttt

SEQ ID NO: 32816 - DNA, 517 bp, Artificial Sequence
  chemically treated genomic DNA (Homo sapiens) CpG-island No: 32816
aaaactacgaactccgcctctcgcttcttttacccaatcctacaacgtctttctcaccaaaaaactcacgaactccgctccctatcaatataattcgaccctcacctaattcatacccgcattaacaaaaaacaaactaaaatcgccgcgaaaccgcacgaaaacgaaaaacaccaaccgataaccataacgatcccgaaaaaaattcaaaaaaacgaccctcacgaccgaaaccttaactacaaaaaactccgataaaaacgaccgataactaaaaccccgccatacgaacgaccttcgaataacccgccgcaacctccgaactacaactaccactaacgctaccatcgtaactccgaacaataactttacgtaatcaaaaaataacgaaaaaaaaaaaccaaacgtttcctacaacgacccctaacgataaaaaaactcaaaaaacgacctctaccgccgaaataaaaacgatcgattaaatcgctaacaaaatctaacacaacgcccgacacat

SEQ ID NO: 32817 - DNA, 736 bp, Artificial Sequence
  chemically treated genomic DNA (Homo sapiens) CpG-island No: 32817
gtagcgagcggtagcgttgggtttttgtttcgttttcggcgcgtttttttagtgttgggttgggttgggttgggttgggtcgggtcggttcgcgttcggcggtagtttcgggtgcgtcgtaggagtgagcgcgtgtacggggtggggcgcggagggtcggtttttttttagtcgcggtgtttttcgtattttcgttcgcggggattgtggggtgcggttttttcgtcgttattcgttgttgtaggtttagagtcggggattggattttagatagttaggagattttttcgtttcggttcgtaattcgtgtcggggattttcggtagtcgcgtcgcgtagcgtcgcgtttcgtttcgtttcgtaggtttcgttttcgtatttcgtcggcgttcgtttttcgcgtcgttttttatatttggcgatcgtcgtagtttcgcgcgtttattggtcgcgagttggcggcgtggggggcgggttcgggtcgggtcggggcggggaaggaaggtggcggcggttcggcgcggggggaggggggtgttgattcggatgtttatttttgggtattcggggaagtggaagcgtcgggttttgttgcgggggggagagttattgacgtcgggatcgggatcgtcgtcgtcgtcgttattatggtaaaggtcgtacggtttttttttcggttcgggggttttttcggagttcgcgtttttttttttttgtttatttttggtttgggacg

SEQ ID NO: 32818 - DNA, 736 bp, Artificial Sequence
  chemically treated genomic DNA (Homo sapiens) CpG-island No: 32818
cgtcccaaaccaaaaataaacaaaaaaaaaaaaacgcgaactccgaaaaaacccccgaaccgaaaaaaaaaccgtacgacctttaccataataacgacgacgacgacgatcccgatcccgacgtcaataactctcccccccgcaacaaaacccgacgcttccacttccccgaatacccaaaaataaacatccgaatcaacacccccctccccccgcgccgaaccgccgccaccttccttccccgccccgacccgacccgaacccgccccccacgccgccaactcgcgaccaataaacgcgcgaaactacgacgatcgccaaatataaaaaacgacgcgaaaaacgaacgccgacgaaatacgaaaacgaaacctacgaaacgaaacgaaacgcgacgctacgcgacgcgactaccgaaaatccccgacacgaattacgaaccgaaacgaaaaaatctcctaactatctaaaatccaatccccgactctaaacctacaacaacgaataacgacgaaaaaaccgcaccccacaatccccgcgaacgaaaatacgaaaaacaccgcgactaaaaaaaaaccgaccctccgcgccccaccccgtacacgcgctcactcctacgacgcacccgaaactaccgccgaacgcgaaccgacccgacccaacccaacccaacccaacccaacactaaaaaaacgcgccgaaaacgaaacaaaaacccaacgctaccgctcgctac

SEQ ID NO: 32819 - DNA, 736 bp, Artificial Sequence
  chemically treated genomic DNA (Homo sapiens) CpG-island No: 32819
cgttttaggttagggatgggtagggggagggggacgcgagtttcggaggggttttcgggtcggggagggggtcgtgcggtttttattatggtggcggcggcggcggcggtttcggtttcggcgttagtggttttttttttcgtagtagggttcggcgtttttattttttcgggtgtttaggagtgaatattcgggttagtattttttttttttcgcgtcgggtcgtcgttatttttttttttcgtttcggttcggttcgggttcgttttttacgtcgttagttcgcggttaatgagcgcgcggggttgcggcgatcgttaagtatggagagcggcgcgagaggcgggcgtcgacggggtgcgggggcggggtttgcgaggcggggcggggcgcggcgttgcgcggcgcggttgtcgggagttttcggtacgggttgcgggtcggggcggaaaggttttttggttgtttgaggtttagttttcgattttgggtttgtagtagcgagtggcggcgagggaatcgtattttatagttttcgcgggcggggatgcggaaggtatcgcggttgggaggggatcggtttttcgcgttttatttcgtgtacgcgtttatttttgcggcgtattcggaattgtcgtcgagcgcggatcggttcggtttagtttaatttagtttaatttagtattgggggagcgcgtcgggagcggggtaggagtttagcgttgtcgttcgttat

SEQ ID NO: 32820 - DNA, 736 bp, Artificial Sequence
  chemically treated genomic DNA (Homo sapiens) CpG-island No: 32820
ataacgaacgacaacgctaaactcctaccccgctcccgacgcgctcccccaatactaaattaaactaaattaaactaaaccgaaccgatccgcgctcgacgacaattccgaatacgccgcaaaaataaacgcgtacacgaaataaaacgcgaaaaaccgatcccctcccaaccgcgataccttccgcatccccgcccgcgaaaactataaaatacgattccctcgccgccactcgctactacaaacccaaaatcgaaaactaaacctcaaacaaccaaaaaacctttccgccccgacccgcaacccgtaccgaaaactcccgacaaccgcgccgcgcaacgccgcgccccgccccgcctcgcaaaccccgcccccgcaccccgtcgacgcccgcctctcgcgccgctctccatacttaacgatcgccgcaaccccgcgcgctcattaaccgcgaactaacgacgtaaaaaacgaacccgaaccgaaccgaaacgaaaaaaaaaaataacgacgacccgacgcgaaaaaaaaaaaatactaacccgaatattcactcctaaacacccgaaaaaataaaaacgccgaaccctactacgaaaaaaaaaaccactaacgccgaaaccgaaaccgccgccgccgccgccaccataataaaaaccgcacgaccccctccccgacccgaaaacccctccgaaactcgcgtccccctccccctacccatccctaacctaaaacg

SEQ ID NO: 32821 - DNA, 759 bp, Artificial Sequence
  chemically treated genomic DNA (Homo sapiens) CpG-island No: 32821
gggtcgtgatttcgagagcgtggaagcgtcgagagttcgggtcggggaggtgcgggggaggggggagtcgagttcgagcggggggcggtcgggaaatcgagagttcgttttcggtttttttagttcgttttcgtagcgaaattttagagtcgggcgttcgttttaagtggagataaagagtcgcggagtaggcggtaaagtcgtcggcgggcgtcggggtcgggcggcgggcgcgggttttgtgcgtttagggttcggcgggtagcggtcggtcgttttttttgggttgcgtcgagcgcgttaatgtttgggattgcgcggatatcgtcggttttttagtaggttcggcgcggggtttcgaggtcgggggttttttttggggcgagttcgggtttttttcgggttatttagcgggtcgcgtttgtaggggggcgcgtcggggtagttttaagtattcggggcgcgcgggttcgattttagaggcgttcgggtttggggttcgcggcgagaagaggaaggaggcgggttacgaggtggtggtttggggtcgtaggagcgtcggagggtgagggcgggagttcggcgcgggcgtttcgacgttttttttcggagaggagagtttgttgtttcgtttgttattgtcgttgtcgtcgtcgtcgtcgtcgttgtaagttttttttagggtcggggaggaatttcgggtttagtaggtgtaaattaaacgttttggtattttaagtttagcgggtacgggaagtt

SEQ ID NO: 32822 - DNA, 759 bp, Artificial Sequence
  chemically treated genomic DNA (Homo sapiens) CpG-island No: 32822
aacttcccgtacccgctaaacttaaaataccaaaacgtttaatttacacctactaaacccgaaattcctccccgaccctaaaaaaaacttacaacgacgacgacgacgacgacaacgacaataacaaacgaaacaacaaactctcctctccgaaaaaaaacgtcgaaacgcccgcgccgaactcccgccctcaccctccgacgctcctacgaccccaaaccaccacctcgtaacccgcctccttcctcttctcgccgcgaaccccaaacccgaacgcctctaaaatcgaacccgcgcgccccgaatacttaaaactaccccgacgcgcccccctacaaacgcgacccgctaaataacccgaaaaaaacccgaactcgccccaaaaaaaacccccgacctcgaaaccccgcgccgaacctactaaaaaaccgacgatatccgcgcaatcccaaacattaacgcgctcgacgcaacccaaaaaaaacgaccgaccgctacccgccgaaccctaaacgcacaaaacccgcgcccgccgcccgaccccgacgcccgccgacgactttaccgcctactccgcgactctttatctccacttaaaacgaacgcccgactctaaaatttcgctacgaaaacgaactaaaaaaaccgaaaacgaactctcgatttcccgaccgccccccgctcgaactcgactcccccctcccccgcacctccccgacccgaactctcgacgcttccacgctctcgaaatcacgaccc

SEQ ID NO: 32823 - DNA, 759 bp, Artificial Sequence
  chemically treated genomic DNA (Homo sapiens) CpG-island No: 32823
ggtttttcgtgttcgttggatttaggatgttagggcgtttgatttgtatttattgagttcggagttttttttcggttttgggaagggtttgtagcggcggcggcggcggcggtagcggtagtagtagacggaatagtaggttttttttttcgagggggggcgtcgaagcgttcgcgtcgggttttcgtttttatttttcggcgtttttgcggttttaagttattatttcgtagttcgtttttttttttttttcgtcgcgagttttaggttcggacgtttttaggatcggattcgcgcgtttcggatgtttggggttgtttcggcgcgtttttttataggcgcgattcgttgagtgattcggagggggttcgagttcgttttaggaggggttttcggtttcgggatttcgcgtcggatttgttggggagtcgacgatgttcgcgtagttttaggtattgacgcgttcgacgtagtttagggaaggcggtcggtcgttgttcgtcgagttttaggcgtataaagttcgcgttcgtcgttcggtttcggcgttcgtcgacgattttgtcgtttgtttcgcggttttttgtttttatttggggcgggcgttcgattttgggatttcgttgcgagaacgagttgggggggtcgggggcgagttttcggtttttcggtcgtttttcgttcgggttcggtttttttttttttcgtattttttcggttcgggttttcggcgtttttacgttttcggaattacgattt

SEQ ID NO: 32824 - DNA, 759 bp, Artificial Sequence
  chemically treated genomic DNA (Homo sapiens) CpG-island No: 32824
aaatcgtaattccgaaaacgtaaaaacgccgaaaacccgaaccgaaaaaatacgaaaaaaaaaaaaaccgaacccgaacgaaaaacgaccgaaaaaccgaaaactcgcccccgacccccccaactcgttctcgcaacgaaatcccaaaatcgaacgcccgccccaaataaaaacaaaaaaccgcgaaacaaacgacaaaatcgtcgacgaacgccgaaaccgaacgacgaacgcgaactttatacgcctaaaactcgacgaacaacgaccgaccgccttccctaaactacgtcgaacgcgtcaatacctaaaactacgcgaacatcgtcgactccccaacaaatccgacgcgaaatcccgaaaccgaaaacccctcctaaaacgaactcgaaccccctccgaatcactcaacgaatcgcgcctataaaaaaacgcgccgaaacaaccccaaacatccgaaacgcgcgaatccgatcctaaaaacgtccgaacctaaaactcgcgacgaaaaaaaaaaaaaaacgaactacgaaataataacttaaaaccgcaaaaacgccgaaaaataaaaacgaaaacccgacgcgaacgcttcgacgccccccctcgaaaaaaaaaacctactattccgtctactactaccgctaccgccgccgccgccgccgctacaaacccttcccaaaaccgaaaaaaaactccgaactcaataaatacaaatcaaacgccctaacatcctaaatccaacgaacacgaaaaacc

SEQ ID NO: 32825 - DNA, 547 bp, Artificial Sequence
  chemically treated genomic DNA (Homo sapiens) CpG-island No: 32825
gggttttcgttgtttttagtttgagtatcgcgtttttatcgaggagcgtttagcgttatcgtcgttgtcgcgtcggagcgtataggtaggagagcgttggaggggagacgtagttcgagatcggggagttttacggttttttttttttttttcggttcggttttttttttcgcgtttcggtaaatttttaaaatatatatatttaatatatatatacgcgcgtacgtatatatatatatattaaaaaaaaaagtgtttcggatttacggatattatatatagataggcgaaggggacgagtacgaggtttgaattgtcgcgagagtagttttaaatagggattgaaaagtaataaaataatgtggtagtttcgttcggcgttggttaatgggagcgcggggtttttacgtggggttgcgggattcggtttacgattgggtgtcgttgggcgcgacgttataatgtttttttgtgtttaaaattatgtatgaaaagtagtaattaggttttattcgttggtgattttcgtatgggagtgaaaaatagt

SEQ ID NO: 32826 - DNA, 547 bp, Artificial Sequence
  chemically treated genomic DNA (Homo sapiens) CpG-island No: 32826
actatttttcactcccatacgaaaatcaccaacgaataaaacctaattactacttttcatacataattttaaacacaaaaaaacattataacgtcgcgcccaacgacacccaatcgtaaaccgaatcccgcaaccccacgtaaaaaccccgcgctcccattaaccaacgccgaacgaaactaccacattattttattacttttcaatccctatttaaaactactctcgcgacaattcaaacctcgtactcgtccccttcgcctatctatatataatatccgtaaatccgaaacacttttttttttaatatatatatatatacgtacgcgcgtatatatatattaaatatatatattttaaaaatttaccgaaacgcgaaaaaaaaaaccgaaccgaaaaaaaaaaaaaaaaccgtaaaactccccgatctcgaactacgtctcccctccaacgctctcctacctatacgctccgacgcgacaacgacgataacgctaaacgctcctcgataaaaacgcgatactcaaactaaaaacaacgaaaaccc

SEQ ID NO: 32827 - DNA, 547 bp, Artificial Sequence
  chemically treated genomic DNA (Homo sapiens) CpG-island No: 32827
gttgttttttatttttatgcgaaagttattagcgggtagggtttgattgttattttttatgtatagttttagatataagagggtattgtgacgtcgcgtttagcggtatttagtcgtaggtcgagtttcgtagttttacgtgggggtttcgcgtttttattggttagcgtcggacgaagttgttatattattttgttattttttagtttttatttggaattgttttcgcggtagtttagatttcgtgttcgtttttttcgtttgtttgtgtgtggtattcgtaggttcggggtatttttttttttggtgtgtgtgtgtgtgcgtgcgcgcgtgtgtgtgtgttgggtgtgtgtgttttgggggtttgtcggggcgcggagaggagagtcgggtcgaggggaaggaaggaagtcgtagagtttttcggtttcgggttgcgttttttttttagcgtttttttgtttgtgcgtttcgacgcggtagcggcggtggcgttgagcgtttttcggtggggacgcggtgtttaagttgggagtagcgagaattt

SEQ ID NO: 32828 - DNA, 547 bp, Artificial Sequence
  chemically treated genomic DNA (Homo sapiens) CpG-island No: 32828
aaattctcgctactcccaacttaaacaccgcgtccccaccgaaaaacgctcaacgccaccgccgctaccgcgtcgaaacgcacaaacaaaaaaacgctaaaaaaaaaacgcaacccgaaaccgaaaaactctacgacttccttccttcccctcgacccgactctcctctccgcgccccgacaaacccccaaaacacacacacccaacacacacacacgcgcgcacgcacacacacacacaccaaaaaaaaaaataccccgaacctacgaataccacacacaaacaaacgaaaaaaacgaacacgaaatctaaactaccgcgaaaacaattccaaataaaaactaaaaaataacaaaataatataacaacttcgtccgacgctaaccaataaaaacgcgaaacccccacgtaaaactacgaaactcgacctacgactaaataccgctaaacgcgacgtcacaataccctcttatatctaaaactatacataaaaaataacaatcaaaccctacccgctaataactttcgcataaaaataaaaaacaac

SEQ ID NO: 32829 - DNA, 581 bp, Artificial Sequence
  chemically treated genomic DNA (Homo sapiens) CpG-island No: 32829
  misc_feature (462)..(462): n is either a, c, g or t
ggcgttggcggaagtttgtaggtgtttcggtcgttagtttggatatttcgagggacgcggacgttttttcgttcgttcgtttcggtttcgggtttttcggatttttcgtttggtcgtataggttattcgatttcggggttagtttgttcgtaaatcgatggtttcgttttttcgcgttcggggttacggcggggtagacgagtaagtagggagtggattttaaagcgcgtatcgttcggtggacggttaaggcgggattttcggggtttttttcggtaagttcgcgagttcgcgcgcgagtcggtcgcgcgttttcggatttatattttttttttattaggagtcggaggttcgtttttgtattttaatgaggagttgagagttagcgggcgttcggaggtcggagcgcggggagttatacgtgagtattcgttttagaattgaattttttcgcgttcgttntcgtcgttagtttcgaatcgcgtttttttttttatttatttatttttttaaataaaaatataaatcgtgtttcggcgcgtatcgaagacgggggagggagaagttcggttcgatagatg

SEQ ID NO: 32830 - DNA, 581 bp, Artificial Sequence
  chemically treated genomic DNA (Homo sapiens) CpG-island No: 32830
  misc_feature (120)..(120): n is either a, c, g or t
catctatcgaaccgaacttctccctcccccgtcttcgatacgcgccgaaacacgatttatatttttatttaaaaaaataaataaataaaaaaaaaaacgcgattcgaaactaacgacganaacgaacgcgaaaaaattcaattctaaaacgaatactcacgtataactccccgcgctccgacctccgaacgcccgctaactctcaactcctcattaaaatacaaaaacgaacctccgactcctaataaaaaaaaaatataaatccgaaaacgcgcgaccgactcgcgcgcgaactcgcgaacttaccgaaaaaaaccccgaaaatcccgccttaaccgtccaccgaacgatacgcgctttaaaatccactccctacttactcgtctaccccgccgtaaccccgaacgcgaaaaaacgaaaccatcgatttacgaacaaactaaccccgaaatcgaataacctatacgaccaaacgaaaaatccgaaaaacccgaaaccgaaacgaacgaacgaaaaaacgtccgcgtccctcgaaatatccaaactaacgaccgaaacacctacaaacttccgccaacgcc

SEQ ID NO: 32831 - DNA, 581 bp, Artificial Sequence
  chemically treated genomic DNA (Homo sapiens) CpG-island No: 32831
  misc_feature (120)..(120): n is either a, c, g or t
tatttgtcgagtcgggtttttttttttttcgttttcggtgcgcgtcgaaatacgatttatgtttttatttaggagaataaataaatgaagaggggagcgcggttcggggttggcggcggnagcgggcgcggggaggtttagttttgaggcgggtgtttacgtgtaatttttcgcgtttcggttttcgagcgttcgttagtttttagttttttattaagatgtaaaagcgaattttcggtttttaatgaggggaaaatatagattcggggacgcgcggtcggttcgcgcgcgggttcgcggatttgtcggggagggtttcgggggtttcgttttggtcgtttatcgggcggtgcgcgttttgaggtttattttttgtttgttcgtttgtttcgtcgtaatttcgagcgcgggagggcgaggttatcggtttgcgggtaagttggtttcggagtcgagtggtttgtgcgattaagcggggggttcggggggttcggggtcggggcgagcgagcgggggagcgttcgcgtttttcggagtgtttaggttagcgatcgagatatttataggttttcgttaacgtt

SEQ ID NO: 32832 - DNA, 581 bp, Artificial Sequence
  chemically treated genomic DNA (Homo sapiens) CpG-island No: 32832
  misc_feature (462)..(462): n is either a, c, g or t
aacgttaacgaaaacctataaatatctcgatcgctaacctaaacactccgaaaaacgcgaacgctcccccgctcgctcgccccgaccccgaaccccccgaaccccccgcttaatcgcacaaaccactcgactccgaaaccaacttacccgcaaaccgataacctcgccctcccgcgctcgaaattacgacgaaacaaacgaacaaacaaaaaataaacctcaaaacgcgcaccgcccgataaacgaccaaaacgaaacccccgaaaccctccccgacaaatccgcgaacccgcgcgcgaaccgaccgcgcgtccccgaatctatattttcccctcattaaaaaccgaaaattcgcttttacatcttaataaaaaactaaaaactaacgaacgctcgaaaaccgaaacgcgaaaaattacacgtaaacacccgcctcaaaactaaacctccccgcgcccgctnccgccgccaaccccgaaccgcgctcccctcttcatttatttattctcctaaataaaaacataaatcgtatttcgacgcgcaccgaaaacgaaaaaaaaaaaaacccgactcgacaaata

SEQ ID NO: 32833 - DNA, 881 bp, Artificial Sequence
  chemically treated genomic DNA (Homo sapiens) CpG-island No: 32833
tcgttggtttttcgcgttggaagtgtttttattgtttttttttcgttgtatagtttgcgagtggagatttagagttcgggaatgaggcgtcgtgtttttaggaatttcgcgttcggggagcgttgagggatcggggagtcgggtggggagcgggtttcggggcgttcggcggcggaggcgtttttattcgcgcggagagggatggagcgcgttttgcgagcgttttcgagtttagttattttacgggttagggggaggggagcggggtcggcgtattagttcgtttttttcggttcgtttttttttttcgcgtcggggagtcgcggtggtgcgtttcggttagttgtgcgtcgtcgagcgaggcgttagttcgtgggtgttgtcgggggcggcggcgcggtgggggttttcgtagttggcggaggcgcgggtcgcggcgttgggttcgcggcggggagcgaaggtgagcgttagaacgcggagggttggcgcggttcgcggcgtcgggtttcgtttttcgttcgcggcggttttgtaggcgatttcgcgtttttatcggcgggagttcggggaagagcgggcggcggcgttgttgttggcggcggtcggttggatgcgagattcgcgtagattcggcggcggacggcggttttcgatttcggagagcggatcgcggggcgtaggagttcgatcgcgttggttatggtttttaattttaacgatatagttaagtagggttacgtgaaaattcgtagtaggaagtttggggtgagtggttcgttcggtttgtttttttttcggcgttcgttcggttcggttggttgtttggggggggggtagggagaggtgattcgtgcgggtatagggtagagagggattcg

SEQ ID NO: 32834 - DNA, 881 bp, Artificial Sequence
  chemically treated genomic DNA (Homo sapiens) CpG-island No: 32834
cgaatccctctctaccctatacccgcacgaatcacctctccctaccccccccccaaacaaccaaccgaaccgaacgaacgccgaaaaaaaaacaaaccgaacgaaccactcaccccaaacttcctactacgaattttcacgtaaccctacttaactatatcgttaaaattaaaaaccataaccaacgcgatcgaactcctacgccccgcgatccgctctccgaaatcgaaaaccgccgtccgccgccgaatctacgcgaatctcgcatccaaccgaccgccgccaacaacaacgccgccgcccgctcttccccgaactcccgccgataaaaacgcgaaatcgcctacaaaaccgccgcgaacgaaaaacgaaacccgacgccgcgaaccgcgccaaccctccgcgttctaacgctcaccttcgctccccgccgcgaacccaacgccgcgacccgcgcctccgccaactacgaaaacccccaccgcgccgccgcccccgacaacacccacgaactaacgcctcgctcgacgacgcacaactaaccgaaacgcaccaccgcgactccccgacgcgaaaaaaaaaaacgaaccgaaaaaaacgaactaatacgccgaccccgctcccctccccctaacccgtaaaataactaaactcgaaaacgctcgcaaaacgcgctccatccctctccgcgcgaataaaaacgcctccgccgccgaacgccccgaaacccgctccccacccgactccccgatccctcaacgctccccgaacgcgaaattcctaaaaacacgacgcctcattcccgaactctaaatctccactcgcaaactatacaacgaaaaaaaaacaataaaaacacttccaacgcgaaaaaccaacga

SEQ ID NO: 32835 - DNA, 881 bp, Artificial Sequence
  chemically treated genomic DNA (Homo sapiens) CpG-island No: 32835
cgggtttttttttgttttgtattcgtacgggttatttttttttgttttttttttaggtagttagtcgggtcgaacgagcgtcggggaaggagtaagtcgagcgagttatttattttaagttttttgttgcggatttttacgtagttttgtttgattatgtcgttaaagttggaggttatggttagcgcgatcgggtttttgcgtttcgcgattcgtttttcggagtcgagagtcgtcgttcgtcgtcgggtttgcgcgggtttcgtatttagtcggtcgtcgttagtagtagcgtcgtcgttcgttttttttcgagttttcgtcggtggggacgcggggtcgtttgtagggtcgtcgcggacggggaacggggttcggcgtcgcgagtcgcgttagtttttcgcgttttggcgtttattttcgtttttcgtcgcgagtttagcgtcgcggttcgcgttttcgttagttgcgggagtttttatcgcgtcgtcgttttcggtagtatttacgggttggcgtttcgttcggcggcgtatagttggtcggagcgtattatcgcggtttttcggcgcggggggagggggcgggtcggggggggcgggttgatgcgtcggtttcgtttttttttttttggttcgtggggtggttgggttcggagacgttcgtaagacgcgttttattttttttcgcgcgggtgggagcgttttcgtcgtcgggcgtttcgaggttcgttttttattcggtttttcggttttttagcgtttttcgggcgcgagatttttaaggatacggcgttttattttcgggttttaaatttttattcgtaagttgtgtagcggggaaagggtagtggggatatttttaacgcggaaggttagcgg

SEQ ID NO: 32836 - DNA, 881 bp, Artificial Sequence
  chemically treated genomic DNA (Homo sapiens) CpG-island No: 32836
ccgctaaccttccgcgttaaaaatatccccactaccctttccccgctacacaacttacgaataaaaatttaaaacccgaaaataaaacgccgtatccttaaaaatctcgcgcccgaaaaacgctaaaaaaccgaaaaaccgaataaaaaacgaacctcgaaacgcccgacgacgaaaacgctcccacccgcgcgaaaaaaaataaaacgcgtcttacgaacgtctccgaacccaaccaccccacgaaccaaaaaaaaaaaaacgaaaccgacgcatcaacccgccccccccgacccgccccctccccccgcgccgaaaaaccgcgataatacgctccgaccaactatacgccgccgaacgaaacgccaacccgtaaatactaccgaaaacgacgacgcgataaaaactcccgcaactaacgaaaacgcgaaccgcgacgctaaactcgcgacgaaaaacgaaaataaacgccaaaacgcgaaaaactaacgcgactcgcgacgccgaaccccgttccccgtccgcgacgaccctacaaacgaccccgcgtccccaccgacgaaaactcgaaaaaaaacgaacgacgacgctactactaacgacgaccgactaaatacgaaacccgcgcaaacccgacgacgaacgacgactctcgactccgaaaaacgaatcgcgaaacgcaaaaacccgatcgcgctaaccataacctccaactttaacgacataatcaaacaaaactacgtaaaaatccgcaacaaaaaacttaaaataaataactcgctcgacttactccttccccgacgctcgttcgacccgactaactacctaaaaaaaaaacaaaaaaaaataacccgtacgaatacaaaacaaaaaaaaacccg

SEQ ID NO: 32837 - DNA, 619 bp, Artificial Sequence
  chemically treated genomic DNA (Homo sapiens) CpG-island No: 32837
ttgacgttttcgggtcgaggtgcgttaggtggcgagggtgttaggcgcggttaagtcgcggcggtttgagttagttatttaattatgttgcggaattagggaggtcggttgggtcgttttcgtcgttgagtttcggtttttttcgcgcggggcgtttgtttttcgttttcgcgggcggagaggaagcggcggtcgaggcgaggcgcgggagtatttgagtaaggcgcgggcgtcgggttcggcgttttcggagttgagcgcgggttcgcggttcgcgtttttcgtttttaggtgcggcggtcgcgatacgtcggttttattaatagcgtcgttcgcgcggtcgtcgttaggtagtagaggcgattgcggatagtcggcggggatcgggaaagaggaggtttggcgttttcggtagaggggcgaggatcgagcgtttaaggttgggagagacgtcggcgttgagttttttagcgtcgttttatttcgtttttcgaatttcgcgattcgagcgtaaggcgagtattcggggtttcgggaaggttgggtcgggatggtttacgcgggggtgggaggattttgtttggaggggttggggtttttcgatattttatcgggtaaa

SEQ ID NO: 32838 - DNA, 619 bp, Artificial Sequence
  chemically treated genomic DNA (Homo sapiens) CpG-island No: 32838
tttacccgataaaatatcgaaaaaccccaacccctccaaacaaaatcctcccacccccgcgtaaaccatcccgacccaaccttcccgaaaccccgaatactcgccttacgctcgaatcgcgaaattcgaaaaacgaaataaaacgacgctaaaaaactcaacgccgacgtctctcccaaccttaaacgctcgatcctcgcccctctaccgaaaacgccaaacctcctctttcccgatccccgccgactatccgcaatcgcctctactacctaacgacgaccgcgcgaacgacgctattaataaaaccgacgtatcgcgaccgccgcacctaaaaacgaaaaacgcgaaccgcgaacccgcgctcaactccgaaaacgccgaacccgacgcccgcgccttactcaaatactcccgcgcctcgcctcgaccgccgcttcctctccgcccgcgaaaacgaaaaacaaacgccccgcgcgaaaaaaaccgaaactcaacgacgaaaacgacccaaccgacctccctaattccgcaacataattaaataactaactcaaaccgccgcgacttaaccgcgcctaacaccctcgccacctaacgcacctcgacccgaaaacgtcaa

SEQ ID NO: 32839 - DNA, 619 bp, Artificial Sequence
  chemically treated genomic DNA (Homo sapiens) CpG-island No: 32839
tttattcggtgaagtgtcgaaaagttttagtttttttagatagggtttttttattttcgcgtgggttatttcggtttagttttttcgaggtttcgggtattcgttttgcgttcgggtcgcggagttcgaaaagcgaggtgaggcggcgttgggaagtttagcgtcggcgttttttttagttttgggcgttcggttttcgtttttttgtcggaggcgttaggttttttttttttcggttttcgtcggttgttcgtagtcgtttttgttgtttggcggcggtcgcgcgggcggcgttgttagtggggtcggcgtgtcgcggtcgtcgtatttggaggcggggagcgcgggtcgcggattcgcgtttagtttcggaaacgtcgagttcggcgttcgcgttttgtttaggtgttttcgcgtttcgtttcggtcgtcgtttttttttcgttcgcgggggcggggagtaggcgtttcgcgcgggggaagtcggagtttaacggcgggggcggtttagtcggtttttttggtttcgtagtatagttgggtgattgatttagatcgtcgcgatttggtcgcgtttggtattttcgttatttggcgtatttcggttcggaggcgttag

SEQ ID NO: 32840 - DNA, 619 bp, Artificial Sequence
  chemically treated genomic DNA (Homo sapiens) CpG-island No: 32840
ctaacgcctccgaaccgaaatacgccaaataacgaaaataccaaacgcgaccaaatcgcgacgatctaaatcaatcacccaactatactacgaaaccaaaaaaaccgactaaaccgcccccgccgttaaactccgacttcccccgcgcgaaacgcctactccccgcccccgcgaacgaaaaaaaaacgacgaccgaaacgaaacgcgaaaacacctaaacaaaacgcgaacgccgaactcgacgtttccgaaactaaacgcgaatccgcgacccgcgctccccgcctccaaatacgacgaccgcgacacgccgaccccactaacaacgccgcccgcgcgaccgccgccaaacaacaaaaacgactacgaacaaccgacgaaaaccgaaaaaaaaaaaacctaacgcctccgacaaaaaaacgaaaaccgaacgcccaaaactaaaaaaaacgccgacgctaaacttcccaacgccgcctcacctcgcttttcgaactccgcgacccgaacgcaaaacgaatacccgaaacctcgaaaaaactaaaccgaaataacccacgcgaaaataaaaaaaccctatctaaaaaaactaaaacttttcgacacttcaccgaataaa

SEQ ID NO: 32841 - DNA, 669 bp, Artificial Sequence
  chemically treated genomic DNA (Homo sapiens) CpG-island No: 32841
atacgcgcgcgcgcgcgtattaggtttttatagatgttttttttttagagtcgcggtcgtagacgtagacgtaaatataaatatttacggcgggtttcgttttcgttcgtttcgaggggaagtcgcggcggtatatagggttcgtaatcggggttcgcgggcgggcgcgtagggaattcgggttcggggtttcggggggttcgcgttttttttttatttgtatttagcgcgtcggggttcgggcggcggcggcggcggcggcgacggggcggttggtgttggtgttgcggcggcgggggaggcggcggcggcggtggcggcggggttgagggtagtaaagatatgtaggtagttcgtcggaggggagaggtatcggtcggaggggatgcggggcgggcgggtcgggtcgggtcgtttgacgaacggtagaggcggcggcgcggaaggcggttgaagggagcgaggagatagatcgggggtcgggaagggggacgagggtcgcgtcgtcgggtttcgaggatagtgattttaggcgcgtaagagaggtttcgcggtcgcggtcgtcggcgcgaaggttttagtcgaaggaagttgcgttttcgtagggtcggagtcgcggttattgtttcgagagttacgtagagtttggttttggttttggttttttgg

SEQ ID NO: 32842 - DNA, 669 bp, Artificial Sequence
  chemically treated genomic DNA (Homo sapiens) CpG-island No: 32842
ccaaaaaaccaaaaccaaaaccaaactctacgtaactctcgaaacaataaccgcgactccgaccctacgaaaacgcaacttccttcgactaaaaccttcgcgccgacgaccgcgaccgcgaaacctctcttacgcgcctaaaatcactatcctcgaaacccgacgacgcgaccctcgtcccccttcccgacccccgatctatctcctcgctcccttcaaccgccttccgcgccgccgcctctaccgttcgtcaaacgacccgacccgacccgcccgccccgcatcccctccgaccgatacctctcccctccgacgaactacctacatatctttactaccctcaaccccgccgccaccgccgccgccgcctcccccgccgccgcaacaccaacaccaaccgccccgtcgccgccgccgccgccgccgcccgaaccccgacgcgctaaatacaaataaaaaaaaaacgcgaaccccccgaaaccccgaacccgaattccctacgcgcccgcccgcgaaccccgattacgaaccctatataccgccgcgacttcccctcgaaacgaacgaaaacgaaacccgccgtaaatatttatatttacgtctacgtctacgaccgcgactctaaaaaaaaaacatctataaaaacctaatacgcgcgcgcgcgcgtat

SEQ ID NO: 32843 - DNA, 669 bp, Artificial Sequence
  chemically treated genomic DNA (Homo sapiens) CpG-island No: 32843
ttaggaggttaaggttaaggttaggttttgcgtggttttcggagtagtagtcgcggtttcggttttgcgggggcgtagtttttttcggttggggttttcgcgtcggcggtcgcggtcgcggggttttttttgcgcgtttggggttattgttttcgaagttcggcggcgcggttttcgttttttttttcgattttcggtttgttttttcgttttttttagtcgtttttcgcgtcgtcgtttttgtcgttcgttaggcggttcggttcggttcgttcgtttcgtatttttttcggtcggtgtttttttttttcggcgggttgtttgtatgtttttgttgtttttagtttcgtcgttatcgtcgtcgtcgtttttttcgtcgtcgtagtattagtattagtcgtttcgtcgtcgtcgtcgtcgtcgtcgttcggatttcggcgcgttgaatgtaggtgaggagggggcgcgggtttttcgagatttcgggttcgggttttttgcgcgttcgttcgcgagtttcggttacgggttttgtgtgtcgtcgcggttttttttcggggcgggcgggagcgaggttcgtcgtgggtgtttgtgtttgcgtttgcgtttgcggtcgcggttttggaggggaagtatttgtgggggtttggtgcgcgcgcgcgcgcgtgt

SEQ ID NO: 32844 - DNA, 669 bp, Artificial Sequence
  chemically treated genomic DNA (Homo sapiens) CpG-island No: 32844
acacgcgcgcgcgcgcgcaccaaacccccacaaatacttcccctccaaaaccgcgaccgcaaacgcaaacgcaaacacaaacacccacgacgaacctcgctcccgcccgccccgaaaaaaaaccgcgacgacacacaaaacccgtaaccgaaactcgcgaacgaacgcgcaaaaaacccgaacccgaaatctcgaaaaacccgcgccccctcctcacctacattcaacgcgccgaaatccgaacgacgacgacgacgacgacgacgaaacgactaatactaatactacgacgacgaaaaaaacgacgacgacgataacgacgaaactaaaaacaacaaaaacatacaaacaacccgccgaaaaaaaaaaacaccgaccgaaaaaaatacgaaacgaacgaaccgaaccgaaccgcctaacgaacgacaaaaacgacgacgcgaaaaacgactaaaaaaaacgaaaaaacaaaccgaaaatcgaaaaaaaaaacgaaaaccgcgccgccgaacttcgaaaacaataaccccaaacgcgcaaaaaaaaccccgcgaccgcgaccgccgacgcgaaaaccccaaccgaaaaaaactacgcccccgcaaaaccgaaaccgcgactactactccgaaaaccacgcaaaacctaaccttaaccttaacctcctaa

SEQ ID NO: 32845 - DNA, 577 bp, Artificial Sequence
  chemically treated genomic DNA (Homo sapiens) CpG-island No: 32845
ttagtatttcggttttttacggtttcgtttcgtttaattaggtttcgcggtttttatggtgatatattttttcgcgttcgtagttcgtggtttattttttcggcggttttttatttaggtcgaaggtttatcgtttttaaggcgtttcggcgatcgcggtttttaattatttttaagtgtttatttcgatcgattattggagttttaatttattattttcgcgtcggtcgaggaattttttttcgtattttatattatcggatttttttcgttcggtttttcgtaggtatttttttttttcgttatttcgtttttcgtttcgtttattaagtgggtcgggcgttttttttttttcgttttatttttagtgtttttattttttaggttttttttttattcggagttgcgcgcgtcgttttttttttagtttagtatttttatttggcgggacgcgttttttttttttaaaaggttcgaatttttcgcgttttttttgtagttttttttttgtatagtttttttttttcgattttgtttataagttatatttttaaatgttttagattcgatttttgta

SEQ ID NO: 32846 - DNA, 577 bp, Artificial Sequence
  chemically treated genomic DNA (Homo sapiens) CpG-island No: 32846
tacaaaaatcgaatctaaaacatttaaaaatataacttataaacaaaatcgaaaaaaaaaaactatacaaaaaaaaaactacaaaaaaaacgcgaaaaattcgaaccttttaaaaaaaaaaaacgcgtcccgccaaataaaaatactaaactaaaaaaaaaacgacgcgcgcaactccgaataaaaaaaaaacctaaaaaataaaaacactaaaaataaaacgaaaaaaaaaaaacgcccgacccacttaataaacgaaacgaaaaacgaaataacgaaaaaaaaaaatacctacgaaaaaccgaacgaaaaaaatccgataatataaaatacgaaaaaaaattcctcgaccgacgcgaaaataataaattaaaactccaataatcgatcgaaataaacacttaaaaataattaaaaaccgcgatcgccgaaacgccttaaaaacgataaaccttcgacctaaataaaaaaccgccgaaaaaataaaccacgaactacgaacgcgaaaaaatatatcaccataaaaaccgcgaaacctaattaaacgaaacgaaaccgtaaaaaaccgaaatactaa

SEQ ID NO: 32847 - DNA, 577 bp, Artificial Sequence
  chemically treated genomic DNA (Homo sapiens) CpG-island No: 32847
tgtaggggtcgagtttggagtatttgggggtgtagtttgtaaatagggtcggaggagagaggttgtgtaggaagagggttgtaggggagacgcggagagttcgggttttttggagggaggagacgcgtttcgttaggtgggggtgttgggttaaggaaggggcgacgcgcgtagtttcgggtggggagggggtttgggaggtgggagtattgggggtggggcgagaaggggaaggcgttcggtttatttggtgggcggggcggggggcggggtggcgggaaggaggaatgtttgcgggaggtcgaacggggagagttcggtggtgtggggtgcgaaaggaggtttttcggtcggcgcggagatagtgagttggggttttagtagtcgatcgaggtagatatttagaggtagttaagagtcgcggtcgtcgagacgttttggggacggtgggttttcggtttaggtgaggggtcgtcgagggggtgggttacgagttgcgagcgcgggggggtgtgttattatggggatcgcggggtttaattgggcggggcggggtcgtggggagtcgaagtgttgg

SEQ ID NO: 32848 - DNA, 577 bp, Artificial Sequence
  chemically treated genomic DNA (Homo sapiens) CpG-island No: 32848
ccaacacttcgactccccacgaccccgccccgcccaattaaaccccgcgatccccataataacacacccccccgcgctcgcaactcgtaacccaccccctcgacgacccctcacctaaaccgaaaacccaccgtccccaaaacgtctcgacgaccgcgactcttaactacctctaaatatctacctcgatcgactactaaaaccccaactcactatctccgcgccgaccgaaaaacctcctttcgcaccccacaccaccgaactctccccgttcgacctcccgcaaacattcctccttcccgccaccccgccccccgccccgcccaccaaataaaccgaacgccttccccttctcgccccacccccaatactcccacctcccaaaccccctccccacccgaaactacgcgcgtcgccccttccttaacccaacacccccacctaacgaaacgcgtctcctccctccaaaaaacccgaactctccgcgtctcccctacaaccctcttcctacacaacctctctcctccgaccctatttacaaactacacccccaaatactccaaactcgacccctaca

SEQ ID NO: 32849 - DNA, 938 bp, Artificial Sequence
  chemically treated genomic DNA (Homo sapiens) CpG-island No: 32849
ttttcgtcgggttttaagcgtttcgtcgttatgttttcgttttcgattttatttttatttcgttatttggtgggggtagtaggcgttatcgattttcgtagtttttcgttgaggtttttcgttttgggcggtgacgcggagcgcgttaagggtttgggtttaggtttagtttcgttttaggtcgtattttcgtttggggaaggagaggtttcgggggtagcggcggtacggtcgttttcgcgtgaggttttggtcgaggttttgttggtattatttagcgtcggagatttggggaagaagttgtatagggtgttttgtcgcgatatatcgatagtcggtaaggtttaatcgttttgtcggacggagtttttaaaagtatcgtatttatcgcgcggtttttgttggcgggaaatttggggggaggcgcgtttcgtcggaggaattcgggttttagtggttaattaataggcgtttcgtcgtgcgcgggcggtgcgcgttaggtttcgttttcgggcgcgcggcgacgtggggaagggcggggttggtatattggtgggtaggggcggggttggtacgttggcggtgaggggttcgttttgtcgtcgacgtttgggtttcgcgcggggaattgttgagtttttttttttttacgtcgcggggttggtcgggtcggaatatttcgattcggggttagttgcggtcgcggggttagtaggttcggaaagttttgtttttttggagcggaagcgggaatagcgggggcgcgtatcgttcgggcggggataatcggggggattcgaaaggtttcggaaaggggttcgcggggagaaacgcgtttagcgttcgcgtgattttttgtcgttagagtattttcgtaaggagacggagcgaaagggattaaattttagttagtagtttatttttacgttgtattttta

SEQ ID NO: 32850 - DNA, 938 bp, Artificial Sequence
  chemically treated genomic DNA (Homo sapiens) CpG-island No: 32850
taaaaatacaacgtaaaaataaactactaactaaaatttaatccctttcgctccgtctccttacgaaaatactctaacgacaaaaaatcacgcgaacgctaaacgcgtttctccccgcgaacccctttccgaaacctttcgaatccccccgattatccccgcccgaacgatacgcgcccccgctattcccgcttccgctccaaaaaaacaaaactttccgaacctactaaccccgcgaccgcaactaaccccgaatcgaaatattccgacccgaccaaccccgcgacgtaaaaaaaaaaaaactcaacaattccccgcgcgaaacccaaacgtcgacgacaaaacgaacccctcaccgccaacgtaccaaccccgcccctacccaccaatataccaaccccgcccttccccacgtcgccgcgcgcccgaaaacgaaacctaacgcgcaccgcccgcgcacgacgaaacgcctattaattaaccactaaaacccgaattcctccgacgaaacgcgcctccccccaaatttcccgccaacaaaaaccgcgcgataaatacgatacttttaaaaactccgtccgacaaaacgattaaaccttaccgactatcgatatatcgcgacaaaacaccctatacaacttcttccccaaatctccgacgctaaataataccaacaaaacctcgaccaaaacctcacgcgaaaacgaccgtaccgccgctacccccgaaacctctccttccccaaacgaaaatacgacctaaaacgaaactaaacctaaacccaaacccttaacgcgctccgcgtcaccgcccaaaacgaaaaacctcaacgaaaaactacgaaaatcgataacgcctactacccccaccaaataacgaaataaaaataaaatcgaaaacgaaaacataacgacgaaacgcttaaaacccgacgaaaa

SEQ ID NO: 32851 - DNA, 938 bp, Artificial Sequence
  chemically treated genomic DNA (Homo sapiens) CpG-island No: 32851
tgagaatataacgtgaaggtgaattgttgattaaagtttggtttttttcgtttcgtttttttgcgaaaatgttttaacggtaggaggttacgcgagcgttggacgcgttttttttcgcgagttttttttcgaggtttttcgggttttttcggttattttcgttcgggcggtgcgcgttttcgttgttttcgttttcgttttagagaggtagggtttttcgagtttgttagtttcgcggtcgtaattaatttcgggtcggagtgtttcggttcggttagtttcgcggcgtgagggaaggggagtttagtagtttttcgcgcggggtttaggcgtcggcggtagggcgggttttttatcgttagcgtgttagtttcgtttttatttattagtgtgttagtttcgtttttttttacgtcgtcgcgcgttcgggggcggggtttggcgcgtatcgttcgcgtacggcgaggcgtttgttgattggttattggggttcgggttttttcggcggagcgcgtttttttttagatttttcgttagtaggagtcgcgcggtagatgcggtgtttttaggagtttcgttcgatagaacggttgggttttgtcggttgtcggtatgtcgcgatagagtattttgtatagttttttttttaagttttcggcgttgagtgatgttaataaggtttcggttagggttttacgcgaaggcggtcgtgtcgtcgttgttttcggggtttttttttttttaggcggggatgcggtttggagcgaggttgggtttgggtttaggtttttggcgcgtttcgcgttatcgtttaaggcgaagaattttaacggagggttgcggagatcggtagcgtttgttgtttttattaggtagcggggtgggggtggggtcgaaggcgggggtatagcggcggggcgtttggaattcggcgaggg

SEQ ID NO: 32852 - DNA, 938 bp, Artificial Sequence
  chemically treated genomic DNA (Homo sapiens) CpG-island No: 32852
ccctcgccgaattccaaacgccccgccgctatacccccgccttcgaccccacccccaccccgctacctaataaaaacaacaaacgctaccgatctccgcaaccctccgttaaaattcttcgccttaaacgataacgcgaaacgcgccaaaaacctaaacccaaacccaacctcgctccaaaccgcatccccgcctaaaaaaaaaaaaaccccgaaaacaacgacgacacgaccgccttcgcgtaaaaccctaaccgaaaccttattaacatcactcaacgccgaaaacttaaaaaaaaaactatacaaaatactctatcgcgacataccgacaaccgacaaaacccaaccgttctatcgaacgaaactcctaaaaacaccgcatctaccgcgcgactcctactaacgaaaaatctaaaaaaaaacgcgctccgccgaaaaaacccgaaccccaataaccaatcaacaaacgcctcgccgtacgcgaacgatacgcgccaaaccccgcccccgaacgcgcgacgacgtaaaaaaaaacgaaactaacacactaataaataaaaacgaaactaacacgctaacgataaaaaacccgccctaccgccgacgcctaaaccccgcgcgaaaaactactaaactccccttccctcacgccgcgaaactaaccgaaccgaaacactccgacccgaaattaattacgaccgcgaaactaacaaactcgaaaaaccctacctctctaaaacgaaaacgaaaacaacgaaaacgcgcaccgcccgaacgaaaataaccgaaaaaacccgaaaaacctcgaaaaaaaactcgcgaaaaaaaacgcgtccaacgctcgcgtaacctcctaccgttaaaacattttcgcaaaaaaacgaaacgaaaaaaaccaaactttaatcaacaattcaccttcacgttatattctca

SEQ ID NO: 32853 - DNA, 835 bp, Artificial Sequence
  chemically treated genomic DNA (Homo sapiens) CpG-island No: 32853
cggttttacgcgggggtataggttggggtaggggcgatcgagtcgggtataggaattcgtagtagggtagggttggcggttacgtcgttttcggttcgcggggaattacgcgggttttcgggttacgtcgtcgcgtttcgatcgttttcggggagaggggaggagtttttagcgtcgggcggggcgtggttaaggtcggtgggttttatcgtagttagacgttgttcgtttaagcgtagagggtcgcgggttacgtggtgggcggggtgggggcgtggtattaggaagcggcgttcgcgtcgggtttagagtcgtagtcgtagtcgtcgttatagttcgggtcgggttttatcgcgtattttgttttattttggcgatcgttttcggggttttcgtcgcgggcgcggcgttcgttatgggcgaggaggattattatttggagttgtgcgagcggtcggtgtagttcgagaaggcgaattttgttaattgcgtttttttcgatgaggttaataagtaggttcggcgcgttcgcgttttttttttcgcgcggttttgtcggggtcgtgggcgcgttaaggtcggtttcgcgcgattaggttcgagcgtttttttttgttttgtttcgtttcgttttagcgcgggaggcggcgcgcgttttttttttgttgggtgggtttagtcgcggttaggtgttttcgtaggtgatttcggggttggattttcgagttagttgcgcggatgtagtggtttcgtggttagtgttttaattgttggcgcgttcgttttatttaggttttttttgttgtgtttgttattagttatattcgtagttaag

SEQ ID NO: 32854 - DNA, 835 bp, Artificial Sequence
  chemically treated genomic DNA (Homo sapiens) CpG-island No: 32854
cttaactacgaatataactaataacaaacacaacaaaaaaaacctaaataaaacgaacgcgccaacaattaaaacactaaccacgaaaccactacatccgcgcaactaactcgaaaatccaaccccgaaatcacctacgaaaacacctaaccgcgactaaacccacccaacaaaaaaaaaacgcgcgccgcctcccgcgctaaaacgaaacgaaacaaaacaaaaaaaaacgctcgaacctaatcgcgcgaaaccgaccttaacgcgcccacgaccccgacaaaaccgcgcgaaaaaaaaaacgcgaacgcgccgaacctacttattaacctcatcgaaaaaaacgcaattaacaaaattcgccttctcgaactacaccgaccgctcgcacaactccaaataataatcctcctcgcccataacgaacgccgcgcccgcgacgaaaaccccgaaaacgatcgccaaaataaaacaaaatacgcgataaaacccgacccgaactataacgacgactacgactacgactctaaacccgacgcgaacgccgcttcctaataccacgcccccaccccgcccaccacgtaacccgcgaccctctacgcttaaacgaacaacgtctaactacgataaaacccaccgaccttaaccacgccccgcccgacgctaaaaactcctcccctctccccgaaaacgatcgaaacgcgacgacgtaacccgaaaacccgcgtaattccccgcgaaccgaaaacgacgtaaccgccaaccctaccctactacgaattcctatacccgactcgatcgcccctaccccaacctatacccccgcgtaaaaccg

SEQ ID NO: 32855 - DNA, 835 bp, Artificial Sequence
  chemically treated genomic DNA (Homo sapiens) CpG-island No: 32855
tttgattacgagtgtaattaatgataaatataataaaagaagtttagataagacgggcgcgttaataattgagatattggttacggggttattgtattcgcgtagttggttcgggggtttagtttcgaggttatttgcgaggatatttggtcgcggttgagtttatttaataaggaaggagcgcgcgtcgtttttcgcgttgggacgggacgggataggataggaggggacgttcgggtttggtcgcgcgggatcggttttggcgcgtttacgatttcggtagggtcgcgcgggggaggaagcgcgggcgcgtcggatttgtttgttggttttatcgaagaagacgtagttgatagggttcgttttttcgaattgtatcggtcgttcgtatagttttagatagtagtttttttcgtttatggcgggcgtcgcgttcgcggcgggggtttcgggggcggtcgttagagtggagtaggatgcgcggtggagttcggttcggattgtagcggcggttgcggttgcggttttgggttcggcgcggacgtcgttttttggtgttacgtttttatttcgtttattacgtgattcgcggttttttgcgtttaaacgggtagcgtttggttgcggtggggtttatcggttttaattacgtttcgttcggcgttggaggtttttttttttttttcgagggcggtcggaacgcggcggcgtgattcggaagttcgcgtggtttttcgcggatcgagggcggcgtagtcgttaattttattttgttgcgagtttttgtgttcggttcggtcgtttttgttttaatttgtattttcgcgtgggatcg

SEQ ID NO: 32856 - DNA, 835 bp, Artificial Sequence
  chemically treated genomic DNA (Homo sapiens) CpG-island No: 32856
cgatcccacgcgaaaatacaaattaaaacaaaaacgaccgaaccgaacacaaaaactcgcaacaaaataaaattaacgactacgccgccctcgatccgcgaaaaaccacgcgaacttccgaatcacgccgccgcgttccgaccgccctcgaaaaaaaaaaaaaaacctccaacgccgaacgaaacgtaattaaaaccgataaaccccaccgcaaccaaacgctacccgtttaaacgcaaaaaaccgcgaatcacgtaataaacgaaataaaaacgtaacaccaaaaaacgacgtccgcgccgaacccaaaaccgcaaccgcaaccgccgctacaatccgaaccgaactccaccgcgcatcctactccactctaacgaccgcccccgaaacccccgccgcgaacgcgacgcccgccataaacgaaaaaaactactatctaaaactatacgaacgaccgatacaattcgaaaaaacgaaccctatcaactacgtcttcttcgataaaaccaacaaacaaatccgacgcgcccgcgcttcctcccccgcgcgaccctaccgaaatcgtaaacgcgccaaaaccgatcccgcgcgaccaaacccgaacgtcccctcctatcctatcccgtcccgtcccaacgcgaaaaacgacgcgcgctccttccttattaaataaactcaaccgcgaccaaatatcctcgcaaataacctcgaaactaaacccccgaaccaactacgcgaatacaataaccccgtaaccaatatctcaattattaacgcgcccgtcttatctaaacttcttttattatatttatcattaattacactcgtaatcaaa

SEQ ID NO: 32857 - DNA, 915 bp, Artificial Sequence
  chemically treated genomic DNA (Homo sapiens) CpG-island No: 32857
cgcggtttcgttattcggtagtattttacgttagtttagtagttttttttattgttttcgttttttatattcgggttttagcgtcgttttttttttatattgatttcgttttcgtagttatttagatagatatttttttcgttttcgtttaggtttgtatcgttattgtcgtttttgtcgtcgcgtttcgtttcggttttgttacgttaggtcgcgtatttttggttaggacgatcgttgtcgtcgtcgtcgtcgtcgagttttagattgaagtttgggcgttcgcgatcgtattagttttttggttttagagattttgagttttcggttgacgcggaagcgtagttatttttattatcgtcgttacggttaatacgggtgttacgcgtcgttatcgtcgtcgggtcgtcgtcgtcgtcgtcgtcgtcgtcgtcgttgttgtagatcgttcgtcgtttattatggtttagtagtaaataggtagtaggaaacggaaagcgttcgcggtcgaggcgggagtcgggagttcgtcgtcgtagggtttagcggcggcggacggagaggggtttttgttatttaagaagtagaagcggtcggcgacgcgtcgtaggttggtgtattatttgaagggtcgggaggtaggagcgcggggtttagtcgggttttagggtttcgagggcgagttgcggggttacgtcgtttagaggttgttcgagttgttgacggagcgttagttggatttgggtatttttaataaggtgttcgcgttatagtggttgaacgttaggtaggtggtgtgcggtattaagtgtaatacgttgtttgtggtggacgtgtagttaggttatattacgcgtattttttttatgcgggataaggaggtcgggttggtttaggtttattagcggttgcggt

SEQ ID NO: 32858 - DNA, 915 bp, Artificial Sequence
  chemically treated genomic DNA (Homo sapiens) CpG-island No: 32858
accgcaaccgctaataaacctaaaccaacccgacctccttatcccgcataaaaaaaatacgcgtaatataacctaactacacgtccaccacaaacaacgtattacacttaataccgcacaccacctacctaacgttcaaccactataacgcgaacaccttattaaaaatacccaaatccaactaacgctccgtcaacaactcgaacaacctctaaacgacgtaaccccgcaactcgccctcgaaaccctaaaacccgactaaaccccgcgctcctacctcccgacccttcaaataatacaccaacctacgacgcgtcgccgaccgcttctacttcttaaataacaaaaacccctctccgtccgccgccgctaaaccctacgacgacgaactcccgactcccgcctcgaccgcgaacgctttccgtttcctactacctatttactactaaaccataataaacgacgaacgatctacaacaacgacgacgacgacgacgacgacgacgacgacccgacgacgataacgacgcgtaacacccgtattaaccgtaacgacgataataaaaataactacgcttccgcgtcaaccgaaaactcaaaatctctaaaaccaaaaaactaatacgatcgcgaacgcccaaacttcaatctaaaactcgacgacgacgacgacgacaacgatcgtcctaaccaaaaatacgcgacctaacgtaacaaaaccgaaacgaaacgcgacgacaaaaacgacaataacgatacaaacctaaacgaaaacgaaaaaaatatctatctaaataactacgaaaacgaaatcaatataaaaaaaaaacgacgctaaaacccgaatataaaaaacgaaaacaataaaaaaaactactaaactaacgtaaaatactaccgaataacgaaaccgcg

SEQ ID NO: 32859 - DNA, 915 bp, Artificial Sequence
  chemically treated genomic DNA (Homo sapiens) CpG-island No: 32859
gtcgtagtcgttggtgggtttgggttagttcggtttttttgtttcgtatgagggggatgcgcgtgatgtggtttgattgtacgtttattataaatagcgtattatatttggtgtcgtatattatttgtttggcgtttagttattgtgacgcgaatattttgttgagggtgtttaggtttagttggcgtttcgttagtagttcgggtagtttttggacggcgtagtttcgtagttcgttttcgaagttttggagttcggttgggtttcgcgtttttatttttcggttttttagatagtgtattagtttgcgacgcgtcgtcggtcgtttttgttttttgggtagtagaggttttttttcgttcgtcgtcgttaaattttgcgacgacgagttttcggttttcgtttcgatcgcgggcgtttttcgttttttgttatttgtttgttgttgggttatggtgggcggcgggcgatttgtagtagcggcggcggcggcggcggcggcggcggcggttcggcggcggtggcggcgcgtggtattcgtgttggtcgtggcggcggtggtggggatggttgcgttttcgcgttagtcgagagtttaggatttttaagattaagaagttggtgcgatcgcgggcgtttagattttagtttgaggttcggcggcggcggcggcggtagcggtcgttttggttagagatgcgcggtttgacgtagtagagtcggggcgaagcgcggcggtaagggcggtagtggcggtgtagatttaggcgagagcgggaagagtgtttgtttggatggttgcgggagcgaagttagtgtggggggaggacgacgttggggttcgagtgtgaagggcggaggtagtgggaggagttgttgggttggcgtggggtgttgtcgggtagcgaggtcgcg

SEQ ID NO: 32860 - DNA, 915 bp, Artificial Sequence
  chemically treated genomic DNA (Homo sapiens) CpG-island No: 32860
cgcgacctcgctacccgacaacaccccacgccaacccaacaactcctcccactacctccgcccttcacactcgaaccccaacgtcgtcctccccccacactaacttcgctcccgcaaccatccaaacaaacactcttcccgctctcgcctaaatctacaccgccactaccgcccttaccgccgcgcttcgccccgactctactacgtcaaaccgcgcatctctaaccaaaacgaccgctaccgccgccgccgccgccgaacctcaaactaaaatctaaacgcccgcgatcgcaccaacttcttaatcttaaaaatcctaaactctcgactaacgcgaaaacgcaaccatccccaccaccgccgccacgaccaacacgaataccacgcgccgccaccgccgccgaaccgccgccgccgccgccgccgccgccgccgctactacaaatcgcccgccgcccaccataacccaacaacaaacaaataacaaaaaacgaaaaacgcccgcgatcgaaacgaaaaccgaaaactcgtcgtcgcaaaatttaacgacgacgaacgaaaaaaaacctctactacccaaaaaacaaaaacgaccgacgacgcgtcgcaaactaatacactatctaaaaaaccgaaaaataaaaacgcgaaacccaaccgaactccaaaacttcgaaaacgaactacgaaactacgccgtccaaaaactacccgaactactaacgaaacgccaactaaacctaaacaccctcaacaaaatattcgcgtcacaataactaaacgccaaacaaataatatacgacaccaaatataatacgctatttataataaacgtacaatcaaaccacatcacgcgcatccccctcatacgaaacaaaaaaaccgaactaacccaaacccaccaacgactacgac

SEQ ID NO: 32861 - DNA, 530 bp, Artificial Sequence
  chemically treated genomic DNA (Homo sapiens) CpG-island No: 32861
  misc_feature (104)..(104): n is either a, c, g or t
gtcgagggtcgtttgttgggttgagggcggatatatgtagtttggttgagttgtcgagttgaggcgtgggcggcggcggcggcgttgtggcgttgcgtagatangtcgtttttcgttgtgtcgtgtagttgggtcgcgcgttgtttttcgtttcgcgtttcgtttcgaaggtattggtttttcgaattagttagggcgatcggcgtgtttacggtggggggacgcggaagtggggttttatgggttcggatgagtagtgggttaggtgttagttgcgttttttacgagcgttttggattgcggcgcggggattgaaatagtcggttaattgtagtaagaatagtgttcgtcggagggggcgtagggttgaggacgttaatattttgtttcgtttttgttcgtaagggtgagaatgatttttttagcgattttcgtttttttgttttttcgttaagttgtttattttaggtttttaggtttacgacgttggtattcggatattttttgtagtattttataggttttcggaa

SEQ ID NO: 32862 - DNA, 530 bp, Artificial Sequence
  chemically treated genomic DNA (Homo sapiens) CpG-island No: 32862
  misc_feature (427)..(427): n is either a, c, g or t
ttccgaaaacctataaaatactacaaaaaatatccgaataccaacgtcgtaaacctaaaaacctaaaataaacaacttaacgaaaaaacaaaaaaacgaaaatcgctaaaaaaatcattctcacccttacgaacaaaaacgaaacaaaatattaacgtcctcaaccctacgccccctccgacgaacactattcttactacaattaaccgactatttcaatccccgcgccgcaatccaaaacgctcgtaaaaaacgcaactaacacctaacccactactcatccgaacccataaaaccccacttccgcgtccccccaccgtaaacacgccgatcgccctaactaattcgaaaaaccaataccttcgaaacgaaacgcgaaacgaaaaacaacgcgcgacccaactacacgacacaacgaaaaacgacntatctacgcaacgccacaacgccgccgccgccgcccacgcctcaactcgacaactcaaccaaactacatatatccgccctcaacccaacaaacgaccctcgac

SEQ ID NO: 32863 - DNA, 530 bp, Artificial Sequence
  chemically treated genomic DNA (Homo sapiens) CpG-island No: 32863
  misc_feature (427)..(427): n is either a, c, g or t
tttcggaggtttgtggagtattgtagagagtgttcgaatgttagcgtcgtgagtttggaggtttagggtgggtagtttggcgagagagtaggagggcgaaagtcgttggaagagttatttttatttttacgggtaggagcggaataaagtgttagcgtttttagttttgcgtttttttcggcggatattgtttttgttgtagttggtcggttgttttagttttcgcgtcgtagtttagggcgttcgtagagggcgtaattggtatttggtttattatttattcgagtttatggaattttattttcgcgtttttttatcgtaagtacgtcggtcgttttagttgattcgggaggttagtattttcggggcggggcgcggggcggagagtagcgcgcgatttaattgtacggtataacgagagacggtntgtttgcgtagcgttataacgtcgtcgtcgtcgtttacgttttaattcggtagtttagttaggttgtatgtgttcgtttttagtttagtaagcggttttcgat

SEQ ID NO: 32864 - DNA, 530 bp, Artificial Sequence
  chemically treated genomic DNA (Homo sapiens) CpG-island No: 32864
  misc_feature (104)..(104): n is either a, c, g or t
atcgaaaaccgcttactaaactaaaaacgaacacatacaacctaactaaactaccgaattaaaacgtaaacgacgacgacgacgttataacgctacgcaaacanaccgtctctcgttataccgtacaattaaatcgcgcgctactctccgccccgcgccccgccccgaaaatactaacctcccgaatcaactaaaacgaccgacgtacttacgataaaaaaacgcgaaaataaaattccataaactcgaataaataataaaccaaataccaattacgccctctacgaacgccctaaactacgacgcgaaaactaaaacaaccgaccaactacaacaaaaacaatatccgccgaaaaaaacgcaaaactaaaaacgctaacactttattccgctcctacccgtaaaaataaaaataactcttccaacgactttcgccctcctactctctcgccaaactacccaccctaaacctccaaactcacgacgctaacattcgaacactctctacaatactccacaaacctccgaaa

SEQ ID NO: 32865 - DNA, 1365 bp, Artificial Sequence
  chemically treated genomic DNA (Homo sapiens) CpG-island No: 32865
tgttatatttatttcgttttttcggattttgttataagggtatttatttcgtttttttggatttcgttataagggtatttatttcgtttttttggatttcgttataagggtatttatttcgttttttcggattttgttataagggtatttatttcgttttttcggatttcgttataagggtatttatttcgttttttcggattttgttataagggtatttatttcgttttttcggatttcgttataagggtatttatttcgttttttcggattttgttataagggtatttatttcgttttttcggatttcgttataagggtatttatttcgttttttcggatttcgttataagggtatttatttcgtttttttggatttcgttataagggtatttatttcgttttttcggattttgttataagggtatttatttcgttttttcggattttgttataagggtatttatttcgttttttcggatttcgttataagggtatttatttcgttttttcggattttgttataagggtatttatttcgttttttcggatttcgttataagggtatttatttcgtttttttggatttcgttataagggtatttatttcgttttttcggattttgttataagggtatttatttcgttttttcggatttcgttataagggtatttatttcgttttttcggattttgttataagggtatttatttcgttttttcggattttgttataagggtagttatttcgttttttcggatttcgttataagggtatttatttcgtttttttggattttgttataagggtatttatttcgttttttcggattttgttatatttatttcgttttttcggattttgttataagggtatttatttcgttttttcggatttcgttataagggtatttatttcgtttttttggatttcgttataagggtatttatttcgttttttcggattttgttataagggtatttatttcgttttttcggatttcgttataagggtatttatttcgtttttttggatttcgttataagggtatttatttcgttttttcggattttgttataagggtatttatttcgttttttcggatttcgttataagggtatttatttcgttttttcggattttgttataagggtatttatttcgttttttcggatttcgttataagggtatttatttcgttttttcggatttcgttataagggtagttatttcgttttttcggatttcgtaataagggtatttatttcgtttttttggattttgttataagggtatttatttcgttttttcggatttcgttataagggtatttatttcgttttttcggatttcgttataagggt

SEQ ID NO: 32866 - DNA, 1365 bp, Artificial Sequence
  chemically treated genomic DNA (Homo sapiens) CpG-island No: 32866
acccttataacgaaatccgaaaaaacgaaataaatacccttataacgaaatccgaaaaaacgaaataaatacccttataacaaaatccaaaaaaacgaaataaatacccttattacgaaatccgaaaaaacgaaataactacccttataacgaaatccgaaaaaacgaaataaatacccttataacgaaatccgaaaaaacgaaataaatacccttataacaaaatccgaaaaaacgaaataaatacccttataacgaaatccgaaaaaacgaaataaatacccttataacaaaatccgaaaaaacgaaataaatacccttataacgaaatccaaaaaaacgaaataaatacccttataacgaaatccgaaaaaacgaaataaatacccttataacaaaatccgaaaaaacgaaataaatacccttataacgaaatccaaaaaaacgaaataaatacccttataacgaaatccgaaaaaacgaaataaatacccttataacaaaatccgaaaaaacgaaataaatataacaaaatccgaaaaaacgaaataaatacccttataacaaaatccaaaaaaacgaaataaatacccttataacgaaatccgaaaaaacgaaataactacccttataacaaaatccgaaaaaacgaaataaatacccttataacaaaatccgaaaaaacgaaataaatacccttataacgaaatccgaaaaaacgaaataaatacccttataacaaaatccgaaaaaacgaaataaatacccttataacgaaatccaaaaaaacgaaataaatacccttataacgaaatccgaaaaaacgaaataaatacccttataacaaaatccgaaaaaacgaaataaatacccttataacgaaatccgaaaaaacgaaataaatacccttataacaaaatccgaaaaaacgaaataaatacccttataacaaaatccgaaaaaacgaaataaatacccttataacgaaatccaaaaaaacgaaataaatacccttataacgaaatccgaaaaaacgaaataaatacccttataacgaaatccgaaaaaacgaaataaatacccttataacaaaatccgaaaaaacgaaataaatacccttataacgaaatccgaaaaaacgaaataaatacccttataacaaaatccgaaaaaacgaaataaatacccttataacgaaatccgaaaaaacgaaataaatacccttataacaaaatccgaaaaaacgaaataaatacccttataacgaaatccaaaaaaacgaaataaatacccttataacgaaatccaaaaaaacgaaataaatacccttataacaaaatccgaaaaaacgaaataaatataaca

SEQ ID NO: 32867 - DNA, 1365 bp, Artificial Sequence
  chemically treated genomic DNA (Homo sapiens) CpG-island No: 32867
gtttttgtaacggagttcgggggaacgggatgggtgtttttgtaacggagttcgggggaacgggatgggtgtttttgtaatagagtttaggggaacgggatgggtgtttttgttacggagttcgggggaacgggatggttgtttttgtaacggagttcgggggaacgggatgggtgtttttgtaacggagttcgggggaacgggatgggtgtttttgtaatagagttcgggggaacgggatgggtgtttttgtaacggagttcgggggaacgggatgggtgtttttataatagagttcgggggaacgggatgggtgtttttgtaacggagtttaggggaacgggatgggtgtttttgtaacggagttcgggggaacgggatgggtgtttttgtaatagagttcgggggaacgggatgggtgtttttgtaacggagtttaggggaacgggatgggtgtttttgtaacggagttcgggggaacgggatgggtgtttttataatagagttcgggggaacgggatgggtgtaatagagttcgggggaacgggatgggtgtttttgtaatagagtttaggggaacgggatgggtgtttttgtaacggagttcgggggaacgggatggttgtttttgtaatagagttcgggggaacgggatgggtgtttttataatagagttcgggggaacgggatgggtgtttttgtaacggagttcgggggaacgggatgggtgtttttataatagagttcgggggaacgggatgggtgtttttgtaacggagtttaggggaacgggatgggtgtttttgtaacggagttcgggggaacgggatgggtgtttttgtaatagagttcgggggaacgggatgggtgtttttgtaacggagttcgggggaacgggatgggtgtttttgtaatagagttcgggggaacgggatgggtgtttttataatagagttcgggggaacgggatgggtgtttttgtaacggagtttaggggaacgggatgggtgtttttgtaacggagttcgggggaacgggatgggtgtttttgtaacggagttcgggggaacgggatgggtgtttttgtaatagagttcggggaaacgggatgggtgtttttgtaacggagttcgggggaacgggatgggtgtttttataatagagttcgggggaacgggatgggtgtttttgtaacggagttcgggggaacgggatgggtgtttttataatagagttcgggggaacgggatgggtgtttttgtaacggagtttaggggaacgggatgggtgtttttgtaacggagtttaggggaacgggatgggtgtttttataatagagttcgggggagcgggatgggtgtaata

SEQ ID NO: 32868 - DNA, 1365 bp, Artificial Sequence
  chemically treated genomic DNA (Homo sapiens) CpG-island No: 32868
tattacacccatcccgctcccccgaactctattataaaaacacccatcccgttcccctaaactccgttacaaaaacacccatcccgttcccctaaactccgttacaaaaacacccatcccgttcccccgaactctattataaaaacacccatcccgttcccccgaactccgttacaaaaacacccatcccgttcccccgaactctattataaaaacacccatcccgttcccccgaactccgttacaaaaacacccatcccgtttccccgaactctattacaaaaacacccatcccgttcccccgaactccgttacaaaaacacccatcccgttcccccgaactccgttacaaaaacacccatcccgttcccctaaactccgttacaaaaacacccatcccgttcccccgaactctattataaaaacacccatcccgttcccccgaactctattacaaaaacacccatcccgttcccccgaactccgttacaaaaacacccatcccgttcccccgaactctattacaaaaacacccatcccgttcccccgaactccgttacaaaaacacccatcccgttcccctaaactccgttacaaaaacacccatcccgttcccccgaactctattataaaaacacccatcccgttcccccgaactccgttacaaaaacacccatcccgttcccccgaactctattataaaaacacccatcccgttcccccgaactctattacaaaaacaaccatcccgttcccccgaactccgttacaaaaacacccatcccgttcccctaaactctattacaaaaacacccatcccgttcccccgaactctattacacccatcccgttcccccgaactctattataaaaacacccatcccgttcccccgaactccgttacaaaaacacccatcccgttcccctaaactccgttacaaaaacacccatcccgttcccccgaactctattacaaaaacacccatcccgttcccccgaactccgttacaaaaacacccatcccgttcccctaaactccgttacaaaaacacccatcccgttcccccgaactctattataaaaacacccatcccgttcccccgaactccgttacaaaaacacccatcccgttcccccgaactctattacaaaaacacccatcccgttcccccgaactccgttacaaaaacacccatcccgttcccccgaactccgttacaaaaacaaccatcccgttcccccgaactccgtaacaaaaacacccatcccgttcccctaaactctattacaaaaacacccatcccgttcccccgaactccgttacaaaaacacccatcccgttcccccgaactccgttacaaaaac

SEQ ID NO: 32869 - DNA, 536 bp, Artificial Sequence
  chemically treated genomic DNA (Homo sapiens) CpG-island No: 32869
  misc_feature (79)..(79): n is either a, c, g or t
  misc_feature (124)..(124): n is either a, c, g or t
  misc_feature (170)..(170): n is either a, c, g or t
  misc_feature (216)..(216): n is either a, c, g or t
  misc_feature (308)..(308): n is either a, c, g or t
  misc_feature (353)..(353): n is either a, c, g or t
ggttgtagtttcggtaaatgtaattttggatgttcgcgtggtaggggtagttttagtttcggtaaatgtaattttggantggtcgtggcggggcgttttagtttcggtaaatgtaattttggantgcgcgtggcggggcggttttagtttcggtaaatgtaattttggantgcgcgtggcggggcggttttagtttcggtaaatgtaattttggantgcgcgtggcggggcggttttagtttcggtaaatgtaattttggatgttcgcgtgcggagcgtttttagtttcggtaaatgtaattttggantgcgcgtggcggggcgttttagtttcggtaaatgtaattttggantgcgcgtggcggggcggttttagtttcggtaaatgtaattttggattgcgcgtggcggggcgttttagtttcggtaaatgtaattttggatgcgcgtggcggggcggttttagtttcggtaaatgtaattttggatgtcgcgtggttgggaagtggagttattttacggcgtttagggtattt

SEQ ID NO: 32870 - DNA, 536 bp, Artificial Sequence
  chemically treated genomic DNA (Homo sapiens) CpG-island No: 32870
  misc_feature (184)..(184): n is either a, c, g or t
  misc_feature (229)..(229): n is either a, c, g or t
  misc_feature (321)..(321): n is either a, c, g or t
  misc_feature (367)..(367): n is either a, c, g or t
  misc_feature (413)..(413): n is either a, c, g or t
  misc_feature (458)..(458): n is either a, c, g or t
aaataccctaaacgccgtaaaataactccacttcccaaccacgcgacatccaaaattacatttaccgaaactaaaaccgccccgccacgcgcatccaaaattacatttaccgaaactaaaacgccccgccacgcgcaatccaaaattacatttaccgaaactaaaaccgccccgccacgcgcantccaaaattacatttaccgaaactaaaacgccccgccacgcgcantccaaaattacatttaccgaaactaaaaacgctccgcacgcgaacatccaaaattacatttaccgaaactaaaaccgccccgccacgcgcantccaaaattacatttaccgaaactaaaaccgccccgccacgcgcantccaaaattacatttaccgaaactaaaaccgccccgccacgcgcantccaaaattacatttaccgaaactaaaacgccccgccacgaccantccaaaattacatttaccgaaactaaaactacccctaccacgcgaacatccaaaattacatttaccgaaactacaacc

SEQ ID NO: 32871 - DNA, 536 bp, Artificial Sequence
  chemically treated genomic DNA (Homo sapiens) CpG-island No: 32871
  misc_feature (184)..(184): n is either a, c, g or t
  misc_feature (229)..(229): n is either a, c, g or t
  misc_feature (321)..(321): n is either a, c, g or t
  misc_feature (367)..(367): n is either a, c, g or t
  misc_feature (413)..(413): n is either a, c, g or t
  misc_feature (458)..(458): n is either a, c, g or t
ggatgttttgagcgtcgtagagtagttttattttttagttacgcggtatttaggattgtatttatcggggttggagtcgtttcgttacgcgtatttaggattgtatttatcggggttggagcgtttcgttacgcgtaatttaggattgtatttatcggggttggagtcgtttcgttacgcgtantttaggattgtatttatcggggttggagcgtttcgttacgcgtantttaggattgtatttatcggggttggaggcgtttcgtacgcgggtatttaggattgtatttatcggggttggagtcgtttcgttacgcgtantttaggattgtatttatcggggttggagtcgtttcgttacgcgtantttaggattgtatttatcggggttggagtcgtttcgttacgcgtantttaggattgtatttatcggggttggagcgtttcgttacggttantttaggattgtatttatcggggttggagttgtttttgttacgcgggtatttaggattgtatttatcgggattgtagtt

SEQ ID NO: 32872 - DNA, 536 bp, Artificial Sequence
  chemically treated genomic DNA (Homo sapiens) CpG-island No: 32872
  misc_feature (79)..(79): n is either a, c, g or t
  misc_feature (124)..(124): n is either a, c, g or t
  misc_feature (170)..(170): n is either a, c, g or t
  misc_feature (216)..(216): n is either a, c, g or t
  misc_feature (308)..(308): n is either a, c, g or t
  misc_feature (353)..(353): n is either a, c, g or t
aactacaatcccgataaatacaatcctaaatacccgcgtaacaaaaacaactccaaccccgataaatacaatcctaaantaaccgtaacgaaacgctccaaccccgataaatacaatcctaaantacgcgtaacgaaacgactccaaccccgataaatacaatcctaaantacgcgtaacgaaacgactccaaccccgataaatacaatcctaaantacgcgtaacgaaacgactccaaccccgataaatacaatcctaaatacccgcgtacgaaacgcctccaaccccgataaatacaatcctaaantacgcgtaacgaaacgctccaaccccgataaatacaatcctaaantacgcgtaacgaaacgactccaaccccgataaatacaatcctaaattacgcgtaacgaaacgctccaaccccgataaatacaatcctaaatacgcgtaacgaaacgactccaaccccgataaatacaatcctaaataccgcgtaactaaaaaataaaactactctacgacgctcaaaacatcc

SEQ ID NO: 32873 - DNA, 705 bp, Artificial Sequence
  chemically treated genomic DNA (Homo sapiens) CpG-island No: 32873
gcgcgtatataggaggtacgtgattagggttcggttcgttttcgtaggtcgcggtttattatttttttatcgcgggcgtcgagaaatcgggttatcgtcgattttttcggtaaattagagcggttagtgagcggagagggacgggaagcggcgtgcgaggttggcgggttcgggcgttagcgcgtttcgttgggtttttgttagttttagttaattgcggagtttcgggtgcggtttggagttcggagttcgtttcgggttttttcgggtttgcgtttcgtttagtttcgcgggtcgttatgaggtgacgaagaggaggtgtagggcgtcgttttcggttttttatcgttttattacgtcggttttgattttgatttgttttacgcgaggatcggttatggtttttcgagcgtcgcgagaaggaggggcggagagtcggggtaatcgtggagggcgacgcgtagaggttgcggttatttaggcgtggtcgtcggcgcgtatgcgtaggttgcgcggttcgtcgttttcgttacgtttcgcggggcgggtttattagagggcggtattttgttttcgttagtttttttatttttcgtgcgtttttttattcgtagtgaaacgtgttttttttttttttttcggattgtttttttttttattttaggcgtaagttatatatttcggtttttatagtttgggtttttg

SEQ ID NO: 32874 - DNA, 705 bp, Artificial Sequence
  chemically treated genomic DNA (Homo sapiens) CpG-island No: 32874
caaaaacccaaactataaaaaccgaaatatataacttacgcctaaaataaaaaaaaaaacaatccgaaaaaaaaaaaaaaaacacgtttcactacgaataaaaaaacgcacgaaaaataaaaaaactaacgaaaacaaaataccgccctctaataaacccgccccgcgaaacgtaacgaaaacgacgaaccgcgcaacctacgcatacgcgccgacgaccacgcctaaataaccgcaacctctacgcgtcgccctccacgattaccccgactctccgcccctccttctcgcgacgctcgaaaaaccataaccgatcctcgcgtaaaacaaatcaaaatcaaaaccgacgtaataaaacgataaaaaaccgaaaacgacgccctacacctcctcttcgtcacctcataacgacccgcgaaactaaacgaaacgcaaacccgaaaaaacccgaaacgaactccgaactccaaaccgcacccgaaactccgcaattaactaaaactaacaaaaacccaacgaaacgcgctaacgcccgaacccgccaacctcgcacgccgcttcccgtccctctccgctcactaaccgctctaatttaccgaaaaaatcgacgataacccgatttctcgacgcccgcgataaaaaaataataaaccgcgacctacgaaaacgaaccgaaccctaatcacgtacctcctatatacgcgc

SEQ ID NO: 32875 - DNA, 705 bp, Artificial Sequence
  chemically treated genomic DNA (Homo sapiens) CpG-island No: 32875
taaaggtttaggttgtggagatcgggatgtgtaatttgcgtttgaagtaaaaagaggggtagttcgagagagaggaggagggtacgttttattacgggtaaaggggcgtacgaggggtaaagggattggcgggagtagggtatcgttttttagtaaattcgtttcgcggggcgtggcggggacgacgggtcgcgtagtttgcgtatgcgcgtcggcgattacgtttaaatagtcgtagtttttgcgcgtcgttttttacggttatttcggtttttcgtttttttttttcgcggcgttcgagggattatggtcgattttcgcgtgagatagattaagattaagatcggcgtggtgaagcggtaaggagtcgggagcggcgttttgtatttttttttcgttattttatggcggttcgcgaggttgagcggagcgtaggttcgaggaggttcgaggcgggtttcgaattttaggtcgtattcggggtttcgtagttggttgggattggtagggatttagcggggcgcgttgacgttcgagttcgttagtttcgtacgtcgtttttcgttttttttcgtttattggtcgttttgatttgtcggaagagtcggcggtggttcggtttttcggcgttcgcggtgggaaggtggtgggtcgcggtttgcgagggcgggtcgggttttgattacgtgttttttgtgtgcgcgt

SEQ ID NO: 32876 - DNA, 705 bp, Artificial Sequence
  chemically treated genomic DNA (Homo sapiens) CpG-island No: 32876
acgcgcacacaaaaaacacgtaatcaaaacccgacccgccctcgcaaaccgcgacccaccaccttcccaccgcgaacgccgaaaaaccgaaccaccgccgactcttccgacaaatcaaaacgaccaataaacgaaaaaaaacgaaaaacgacgtacgaaactaacgaactcgaacgtcaacgcgccccgctaaatccctaccaatcccaaccaactacgaaaccccgaatacgacctaaaattcgaaacccgcctcgaacctcctcgaacctacgctccgctcaacctcgcgaaccgccataaaataacgaaaaaaaaatacaaaacgccgctcccgactccttaccgcttcaccacgccgatcttaatcttaatctatctcacgcgaaaatcgaccataatccctcgaacgccgcgaaaaaaaaaaacgaaaaaccgaaataaccgtaaaaaacgacgcgcaaaaactacgactatttaaacgtaatcgccgacgcgcatacgcaaactacgcgacccgtcgtccccgccacgccccgcgaaacgaatttactaaaaaacgataccctactcccgccaatccctttacccctcgtacgcccctttacccgtaataaaacgtaccctcctcctctctctcgaactacccctctttttacttcaaacgcaaattacacatcccgatctccacaacctaaaccttta

SEQ ID NO: 32877 - DNA, 524 bp, Artificial Sequence
  chemically treated genomic DNA (Homo sapiens) CpG-island No: 32877
ttgtgttgacgttggtttgtattagtcgttttagtgttgcgtttattttattgaatgtggaagtataaacgcgtcgtttgggcgtttttgaatttatcgttagtttcgtcgtttttttcggtgtaattattggttagaacggttgcgtcggtttgtattcggtaatgttggcggtgatggttgcgtttacggttggtattaattcgttggattcgatgtggattgcgacgttggtcggtattgttatcgttagtttcgtaggcgttgtcggtgtcggtggtggtgtaattttcgtcgtattgattgtattgtttgcgatgggtttgttagtaattttggtggcgttgttaattttcgttgaatcgtttatcgatatgggtcgtacggcgttaaacgttagtggttcgatgatagttggtacgttgattagttagtggttgaagtaaatcgataaagttattttggatagcgaagacgacgtcgaattggtatattattaatttttatgttggtaacggttcgtt

SEQ ID NO: 32878 - DNA, 524 bp, Artificial Sequence
  chemically treated genomic DNA (Homo sapiens) CpG-island No: 32878
aacgaaccgttaccaacataaaaattaataatataccaattcgacgtcgtcttcgctatccaaaataactttatcgatttacttcaaccactaactaatcaacgtaccaactatcatcgaaccactaacgtttaacgccgtacgacccatatcgataaacgattcaacgaaaattaacaacgccaccaaaattactaacaaacccatcgcaaacaatacaatcaatacgacgaaaattacaccaccaccgacaccgacaacgcctacgaaactaacgataacaataccgaccaacgtcgcaatccacatcgaatccaacgaattaataccaaccgtaaacgcaaccatcaccgccaacattaccgaatacaaaccgacgcaaccgttctaaccaataattacaccgaaaaaaacgacgaaactaacgataaattcaaaaacgcccaaacgacgcgtttatacttccacattcaataaaataaacgcaacactaaaacgactaatacaaaccaacgtcaacacaa

SEQ ID NO: 32879 - DNA, 524 bp, Artificial Sequence
  chemically treated genomic DNA (Homo sapiens) CpG-island No: 32879
aacggatcgttgttagtataagaattaatggtgtgttagttcggcgtcgttttcgttatttagaatggttttatcggtttgttttagttattggttggttagcgtgttagttgttatcgagttattaacgtttaacgtcgtacggtttatgtcgataagcggtttaacggagattaatagcgttattagggttattggtaggtttatcgtaggtagtataattagtgcggcgaaagttgtattattatcgatatcggtaacgtttgcggaattaacggtaataatatcgattagcgtcgtaatttatatcgggtttagcgggttaatgttaatcgtaggcgtaattattatcgttagtattgtcggatataaatcggcgtagtcgttttgattaatggttgtatcgaaagaggcggcgaaattggcgatggatttaggaacgtttagacgacgcgtttgtgtttttatatttagtgggatagacgtagtattggaacggttggtataggttaacgttagtatag

SEQ ID NO: 32880 - DNA, 524 bp, Artificial Sequence
  chemically treated genomic DNA (Homo sapiens) CpG-island No: 32880
ctatactaacgttaacctataccaaccgttccaatactacgtctatcccactaaatataaaaacacaaacgcgtcgtctaaacgttcctaaatccatcgccaatttcgccgcctctttcgatacaaccattaatcaaaacgactacgccgatttatatccgacaatactaacgataataattacgcctacgattaacattaacccgctaaacccgatataaattacgacgctaatcgatattattaccgttaattccgcaaacgttaccgatatcgataataatacaactttcgccgcactaattatactacctacgataaacctaccaataaccctaataacgctattaatctccgttaaaccgcttatcgacataaaccgtacgacgttaaacgttaataactcgataacaactaacacgctaaccaaccaataactaaaacaaaccgataaaaccattctaaataacgaaaacgacgccgaactaacacaccattaattcttatactaacaacgatccgtt

SEQ ID NO: 32881 - DNA, 539 bp, Artificial Sequence
  chemically treated genomic DNA (Homo sapiens) CpG-island No: 32881
tgttggcggtagaaatcgttgtaaattgggattcgttatattatgtcggttattatcgaagataagcggtttagtacgttttattgatatgatcgacggttagattattacgcgttaagatcgacgaattgatcggtttgttttacgattggtggttttggatttcgtagaacgtatcgaaggatggataaagatttgcgttcggtattgaaaatcgttgatgtttagggtaacgaacgatacggattttaggtatcgatatgttagcgtagatatatattaggcgggtaacgcgatagaatagttggaagatggcgtatagattagttttggtgatattttggcgcgtatttcgtaggaattcggcggtattaaggatattatcggtggtttgtcgcgcgttgcggatttgttcgaagtacgtcgttcgaaagagtcggtaattttggttgaaattagcggtatcgtttttttcggtaaagaaattaaaggtaaacgtcgtttggttattatttcggtagacggtagcgattcgtacg

SEQ ID NO: 32882 - DNA, 539 bp, Artificial Sequence
  chemically treated genomic DNA (Homo sapiens) CpG-island No: 32882
cgtacgaatcgctaccgtctaccgaaataataaccaaacgacgtttacctttaatttctttaccgaaaaaaacgataccgctaatttcaaccaaaattaccgactctttcgaacgacgtacttcgaacaaatccgcaacgcgcgacaaaccaccgataatatccttaataccgccgaattcctacgaaatacgcgccaaaatatcaccaaaactaatctatacgccatcttccaactattctatcgcgttacccgcctaatatatatctacgctaacatatcgatacctaaaatccgtatcgttcgttaccctaaacatcaacgattttcaataccgaacgcaaatctttatccatccttcgatacgttctacgaaatccaaaaccaccaatcgtaaaacaaaccgatcaattcgtcgatcttaacgcgtaataatctaaccgtcgatcatatcaataaaacgtactaaaccgcttatcttcgataataaccgacataatataacgaatcccaatttacaacgatttctaccgccaaca

SEQ ID NO: 32883 - DNA, 539 bp, Artificial Sequence
  chemically treated genomic DNA (Homo sapiens) CpG-island No: 32883
cgtacggatcgttatcgtttatcggggtgataattagacgacgtttatttttggtttttttatcgaaggaaacgatatcgttgattttagttaggattgtcggttttttcggacgacgtgtttcgaataggttcgtaacgcgcggtagattatcggtgatgtttttggtatcgtcggatttttgcggaatacgcgttagggtgttattagagttgatttgtacgttattttttagttgttttatcgcgttattcgtttggtatgtatttgcgttggtatatcggtatttgggattcgtatcgttcgttattttgagtattaacgatttttagtgtcggacgtagatttttatttatttttcggtacgttttgcggaatttagaattattagtcgtaagatagatcggttagttcgtcggttttgacgcgtaatggtttggtcgtcgattatgttagtaaagcgtattaaatcgtttattttcggtgataatcggtatggtgtggcgggttttagtttgtaacggtttttgtcgttagta

SEQ ID NO: 32884 - DNA, 539 bp, Artificial Sequence
  chemically treated genomic DNA (Homo sapiens) CpG-island No: 32884
tactaacgacaaaaaccgttacaaactaaaacccgccacaccataccgattatcaccgaaaataaacgatttaatacgctttactaacataatcgacgaccaaaccattacgcgtcaaaaccgacgaactaaccgatctatcttacgactaataattctaaattccgcaaaacgtaccgaaaaataaataaaaatctacgtccgacactaaaaatcgttaatactcaaaataacgaacgatacgaatcccaaataccgatataccaacgcaaatacataccaaacgaataacgcgataaaacaactaaaaaataacgtacaaatcaactctaataacaccctaacgcgtattccgcaaaaatccgacgataccaaaaacatcaccgataatctaccgcgcgttacgaacctattcgaaacacgtcgtccgaaaaaaccgacaatcctaactaaaatcaacgatatcgtttccttcgataaaaaaaccaaaaataaacgtcgtctaattatcaccccgataaacgataacgatccgtacg

SEQ ID NO: 32885 - DNA, 1028 bp, Artificial Sequence
  chemically treated genomic DNA (Homo sapiens) CpG-island No: 32885
  misc_feature (763)..(763): n is either a, c, g or t
gtcggtttttcgtttttcgtttttgttgtataggttaatatcgtatcgggatcgttcgataaagcgtttaattagtatgtcgtatatagcggatttattttttcggttgacgttagtttgacgcgcggtaagtagagtaacggtttgtacggcgattacgacgtcgagagcggtttgtaataattgttggacggtagcggattgtaggtaaaatcgttgggaaataatagttggacgttggagttcgcgttcgtattaaaagaagatgttttgatcgtggtcggcgattggttgggtgatgcgcgtgaaaacgacgtatttgaatatgttggcgcgcgtgacgtgattcgtcgtgaggatttcgttaaaatcggcgtaattattatgcgtgaggtatttaatcgtatttttggcgttagcgcgtcggaaaataacggtatcggtagttacgatttggcgatgaattttggtattcggggtttgaattcgcgtttcgttagtcgttcgatcgttttgatggacggtattttcgtttttttcgttttttacggttagtcgtagtttttattggttttcgtttcgttcggtaatatggatttattgacgtgtacgcggtggtggtgcggtcgttacggatcgtaagcgtggcggcgtgtgaattttgttattcgtttatttcgtagattttggtatcgaggcgggcgtggaaggttagtttagtttaatttttttataaaataattcgaaagagacgtataatttngatggtgggcggtatagcggataacggttttggtatcgcgttgttttatttcggtacgcgcggtagtgattggcgcgagtatagcgttattcgtatcgacgatttgatgttgaaaagtaaatatgcgtcggatgaggtgtatatttttaatagtttgttgtaatattacgacggtgaagtcgatatgttcggtggtttgtttcgcgcggattacgacgtcgatcgttggtaatttattcgttcgtatgatcgtttttggggtcgt

SEQ ID NO: 32886 - DNA, 1028 bp, Artificial Sequence
  chemically treated genomic DNA (Homo sapiens) CpG-island No: 32886
  misc_feature (266)..(266): n is either a, c, g or t
acgaccccaaaaacgatcatacgaacgaataaattaccaacgatcgacgtcgtaatccgcgcgaaacaaaccaccgaacatatcgacttcaccgtcgtaatattacaacaaactattaaaaatatacacctcatccgacgcatatttacttttcaacatcaaatcgtcgatacgaataacgctatactcgcgccaatcactaccgcgcgtaccgaaataaaacaacgcgataccaaaaccgttatccgctataccgcccaccatcnaaattatacgtctctttcgaattattttataaaaaaattaaactaaactaaccttccacgcccgcctcgataccaaaatctacgaaataaacgaataacaaaattcacacgccgccacgcttacgatccgtaacgaccgcaccaccaccgcgtacacgtcaataaatccatattaccgaacgaaacgaaaaccaataaaaactacgactaaccgtaaaaaacgaaaaaaacgaaaataccgtccatcaaaacgatcgaacgactaacgaaacgcgaattcaaaccccgaataccaaaattcatcgccaaatcgtaactaccgataccgttattttccgacgcgctaacgccaaaaatacgattaaatacctcacgcataataattacgccgattttaacgaaatcctcacgacgaatcacgtcacgcgcgccaacatattcaaatacgtcgttttcacgcgcatcacccaaccaatcgccgaccacgatcaaaacatcttcttttaatacgaacgcgaactccaacgtccaactattatttcccaacgattttacctacaatccgctaccgtccaacaattattacaaaccgctctcgacgtcgtaatcgccgtacaaaccgttactctacttaccgcgcgtcaaactaacgtcaaccgaaaaaataaatccgctatatacgacatactaattaaacgctttatcgaacgatcccgatacgatattaacctatacaacaaaaacgaaaaacgaaaaaccgac

SEQ ID NO: 32887 - DNA, 1028 bp, Artificial Sequence
  chemically treated genomic DNA (Homo sapiens) CpG-island No: 32887
  misc_feature (266)..(266): n is either a, c, g or t
acgattttagaagcggttatacgggcgggtggattgttagcgatcggcgtcgtaattcgcgcgagataggttatcgggtatgtcggttttatcgtcgtaatattgtagtaggttgttgaaggtgtgtattttattcggcgtatatttgttttttagtattaggtcgtcgatgcgggtggcgttgtgttcgcgttagttattgtcgcgcgtgtcggagtagagtagcgcggtgttaaaatcgttgttcgttgtgtcgtttattattnaggttgtgcgtttttttcgggttgttttgtgaagaggttgggttgagttgattttttacgttcgtttcgatattaaagtttgcggaatggacgggtaataaagtttatacgtcgttacgtttgcggttcgtaacgatcgtattattatcgcgtatacgttaatggatttatgttgtcgagcgaaacgggagttagtgaaagttgcggttgatcgtaaggggcgaaggggacggggatgtcgtttattaggacggtcgagcggttggcgaggcgcgggtttaggtttcggatgttaaagtttatcgttaggtcgtggttgtcggtgtcgttgtttttcggcgcgttgacgttagggatgcggttaagtattttacgtatggtggttgcgtcggttttggcgaaatttttacggcggattacgttacgcgcgttagtatgtttaaatacgtcgtttttacgcgtattatttagttagtcgtcgattacggttagggtatttttttttggtgcgggcgcgggttttagcgtttagttgttattttttagcggttttatttgtagttcgttgtcgtttagtagttgttgtaggtcgttttcgacgtcgtaatcgtcgtgtaggtcgttgttttgtttgtcgcgcgttaggttggcgttaatcgagagggtaaattcgttgtgtgcggtatattgattgagcgttttatcgagcgatttcggtgcgatattaatttgtgtagtaaaagcggaaaacgagagatcggt

SEQ ID NO: 32888 - DNA, 1028 bp, Artificial Sequence
  chemically treated genomic DNA (Homo sapiens) CpG-island No: 32888
  misc_feature (763)..(763): n is either a, c, g or t
accgatctctcgttttccgcttttactacacaaattaatatcgcaccgaaatcgctcgataaaacgctcaatcaatataccgcacacaacgaatttaccctctcgattaacgccaacctaacgcgcgacaaacaaaacaacgacctacacgacgattacgacgtcgaaaacgacctacaacaactactaaacgacaacgaactacaaataaaaccgctaaaaaataacaactaaacgctaaaacccgcgcccgcaccaaaaaaaaataccctaaccgtaatcgacgactaactaaataatacgcgtaaaaacgacgtatttaaacatactaacgcgcgtaacgtaatccgccgtaaaaatttcgccaaaaccgacgcaaccaccatacgtaaaatacttaaccgcatccctaacgtcaacgcgccgaaaaacaacgacaccgacaaccacgacctaacgataaactttaacatccgaaacctaaacccgcgcctcgccaaccgctcgaccgtcctaataaacgacatccccgtccccttcgccccttacgatcaaccgcaactttcactaactcccgtttcgctcgacaacataaatccattaacgtatacgcgataataatacgatcgttacgaaccgcaaacgtaacgacgtataaactttattacccgtccattccgcaaactttaatatcgaaacgaacgtaaaaaatcaactcaacccaacctcttcacaaaacaacccgaaaaaaacgcacaacctnaataataaacgacacaacgaacaacgattttaacaccgcgctactctactccgacacgcgcgacaataactaacgcgaacacaacgccacccgcatcgacgacctaatactaaaaaacaaatatacgccgaataaaatacacaccttcaacaacctactacaatattacgacgataaaaccgacatacccgataacctatctcgcgcgaattacgacgccgatcgctaacaatccacccgcccgtataaccgcttctaaaatcgt

SEQ ID NO: 32889 - DNA, 508 bp, Artificial Sequence
  chemically treated genomic DNA (Homo sapiens) CpG-island No: 32889
taagtatcgtaaggtttacgacgcgaacgttggttggcggggcgtgtattgttttcgtatacgtttttttcgttatcggagatatttatggcgaataaggtaaatttgtatttgcgtcggaaatgtcgttatggtttaatttaagttatagcggtgacgatatcgttttgttgttgagtgatgaaggcgaagtcggttgcgatatcgaagtgattcgttcgcgcgttaattggcgttggttggcgaacgtcgtatttagtttcggggaatacgttgagatggacgtcgtgtattttgattagtaattggaaatgttttggcgtatttggacgcgtaaagaagttatcgttaaatagcgtggcggtagcgtttggtaaatcgttagcgtagatagtatttattatttttcgttgttagttagttattgttagtttgaaaatttaagttttgcgatttgtatttttattttttttacgtttatcgtcgatagtgtgtaatggatcgattt

SEQ ID NO: 32890 - DNA, 508 bp, Artificial Sequence
  chemically treated genomic DNA (Homo sapiens) CpG-island No: 32890
aaatcgatccattacacactatcgacgataaacgtaaaaaaaataaaaatacaaatcgcaaaacttaaattttcaaactaacaataactaactaacaacgaaaaataataaatactatctacgctaacgatttaccaaacgctaccgccacgctatttaacgataacttctttacgcgtccaaatacgccaaaacatttccaattactaatcaaaatacacgacgtccatctcaacgtattccccgaaactaaatacgacgttcgccaaccaacgccaattaacgcgcgaacgaatcacttcgatatcgcaaccgacttcgccttcatcactcaacaacaaaacgatatcgtcaccgctataacttaaattaaaccataacgacatttccgacgcaaatacaaatttaccttattcgccataaatatctccgataacgaaaaaaacgtatacgaaaacaatacacgccccgccaaccaacgttcgcgtcgtaaaccttacgatactta

SEQ ID NO: 32891 - DNA, 508 bp, Artificial Sequence
  chemically treated genomic DNA (Homo sapiens) CpG-island No: 32891
gaatcgatttattgtatattgtcggcggtgagcgtaaagggagtaggggtgtagatcgtaaggtttaaatttttaagttgataatggttgattgatagcgaggagtgataggtgttgtttacgttgacgatttgttaggcgttgtcgttacgttgtttaacgatggtttttttgcgcgtttagatgcgttagaatatttttagttgttgattaggatgtacggcgtttattttagcgtgtttttcgaggttgaatacggcgttcgttagttagcgttagttggcgcgcgggcgaattatttcgatatcgtagtcgatttcgtttttattatttaatagtagggcgatatcgttatcgttatggtttaagttgaattatagcggtattttcggcgtaaatgtaggtttgttttgttcgttatagatattttcggtagcggggaaagcgtgtgcgaaagtaatgtacgtttcgttagttagcgttcgcgtcgtggattttgcggtgtttg

SEQ ID NO: 32892 - DNA, 508 bp, Artificial Sequence
  chemically treated genomic DNA (Homo sapiens) CpG-island No: 32892
caaacaccgcaaaatccacgacgcgaacgctaactaacgaaacgtacattactttcgcacacgctttccccgctaccgaaaatatctataacgaacaaaacaaacctacatttacgccgaaaataccgctataattcaacttaaaccataacgataacgatatcgccctactattaaataataaaaacgaaatcgactacgatatcgaaataattcgcccgcgcgccaactaacgctaactaacgaacgccgtattcaacctcgaaaaacacgctaaaataaacgccgtacatcctaatcaacaactaaaaatattctaacgcatctaaacgcgcaaaaaaaccatcgttaaacaacgtaacgacaacgcctaacaaatcgtcaacgtaaacaacacctatcactcctcgctatcaatcaaccattatcaacttaaaaatttaaaccttacgatctacacccctactccctttacgctcaccgccgacaatatacaataaatcgattc

SEQ ID NO: 32893 - DNA, 921 bp, Artificial Sequence
  chemically treated genomic DNA (Homo sapiens) CpG-island No: 32893
tgtggtgatgttcgtgatatcgtcggatattatatttagatcgtattttgtttttcgtttcgtcgcgttcgtttgcgtcgtgagtttttttgtcgcgttatattcgttgcgcgtgacgttgtcgttcgttagttttttttttattattcgttttagttcggtttcgttttttgtatgtagtattttacgtcggtttaggttgtcggtgacggtgatgcggttttgtttataaagatagcggtagtttaattttgtcgggtttagttgttttattattcgtttcgtatcgtcgtagcggtagcgtattttcggttttttcgcgtaacggtgcgttattattcggttcgggtgttgcgcgttatacgtgaaagcgcgtatttgcgtattgttgcggttatatatcgttagtagtttatcggttttcgtatacgtgtatcgtattagtggcgtagcgggtaggtttttcgggtatgtcgggtcgtgtattagttatatcgtcgaaaggcggatatttttgtcggggtcgtattcggtatcgggtagtgtgtcggggaacgttgaggttgagagagggcgggaattgttagaagaagatagcgaagaggtgcgggtttttttcgtacgttgcgtttgcgtggttagtattagacggaattttcgttcggtatcgttcgttacgtcggtgattttttcggttaggattatcggacggttttacgtcggtacgttagcgttcgtttagaagcggttcgttatttcggtaagtatattaggtacggcggtagcggagttggtagtacgtttttagtattaggataatcgattagatatatttatagtatgtaataacggatcgttgtgtagttgaaggtacggttagggtaaagatgcgggttttataggatattcggcgggaagcga

SEQ ID NO: 32894 - DNA, 921 bp, Artificial Sequence
  chemically treated genomic DNA (Homo sapiens) CpG-island No: 32894
tcgcttcccgccgaatatcctataaaacccgcatctttaccctaaccgtaccttcaactacacaacgatccgttattacatactataaatatatctaatcgattatcctaatactaaaaacgtactaccaactccgctaccgccgtacctaatatacttaccgaaataacgaaccgcttctaaacgaacgctaacgtaccgacgtaaaaccgtccgataatcctaaccgaaaaaatcaccgacgtaacgaacgataccgaacgaaaattccgtctaatactaaccacgcaaacgcaacgtacgaaaaaaacccgcacctcttcgctatcttcttctaacaattcccgccctctctcaacctcaacgttccccgacacactacccgataccgaatacgaccccgacaaaaatatccgcctttcgacgatataactaatacacgacccgacatacccgaaaaacctacccgctacgccactaatacgatacacgtatacgaaaaccgataaactactaacgatatataaccgcaacaatacgcaaatacgcgctttcacgtataacgcgcaacacccgaaccgaataataacgcaccgttacgcgaaaaaaccgaaaatacgctaccgctacgacgatacgaaacgaataataaaacaactaaacccgacaaaattaaactaccgctatctttataaacaaaaccgcatcaccgtcaccgacaacctaaaccgacgtaaaatactacatacaaaaaacgaaaccgaactaaaacgaataataaaaaaaaaactaacgaacgacaacgtcacgcgcaacgaatataacgcgacaaaaaaactcacgacgcaaacgaacgcgacgaaacgaaaaacaaaatacgatctaaatataatatccgacgatatcacgaacatcaccaca

SEQ ID NO: 32895 - DNA, 921 bp, Artificial Sequence
  chemically treated genomic DNA (Homo sapiens) CpG-island No: 32895
tcgtttttcgtcggatattttgtgaagttcgtatttttattttggtcgtatttttagttgtatagcggttcgttgttgtatattgtgggtgtgtttgatcggttgttttggtgttgaggacgtattgttagtttcgttgtcgtcgtatttggtgtgtttatcgggatggcggatcgtttttgggcggacgttgacgtatcggcgtgaggtcgttcggtgattttggtcggggaaattatcggcgtgacggacggtgtcgggcgggagtttcgtttggtgttgattacgtaggcgtagcgtgcggaagaggttcgtattttttcgttatttttttttgatagttttcgtttttttttagttttagcgtttttcgatatattgttcggtatcgaatacggtttcgataggggtattcgtttttcggcggtgtggttgatgtacgattcggtatattcggagagtttgttcgttgcgttattggtgcggtatacgtatacggaagtcggtgaattgttggcggtatatgatcgtagtaatacgtaggtgcgcgtttttacgtatgacgcgtagtattcgggtcggatggtggcgtatcgttacgcgggaaggtcggagatgcgttatcgttacgacgatacggggcgggtggtggagtaattgaattcggtagggttaagttatcgttatttttatgagtaggatcgtattatcgttatcgatagtttgaatcggcgtgaggtgttgtatatagaaggcggggtcgggttgaaacgggtggtgaaaaaagaattggcggacggtagcgttacgcgtagcgggtatgacgcggtaggaaggtttacggcgtagacggacgcggcgggacggaggatagagtacggtttgaatgtggtgttcggcgatattacggatattattata

SEQ ID NO: 32896 - DNA, 921 bp, Artificial Sequence
  chemically treated genomic DNA (Homo sapiens) CpG-island No: 32896
tataataatatccgtaatatcgccgaacaccacattcaaaccgtactctatcctccgtcccgccgcgtccgtctacgccgtaaaccttcctaccgcgtcatacccgctacgcgtaacgctaccgtccgccaattcttttttcaccacccgtttcaacccgaccccgccttctatatacaacacctcacgccgattcaaactatcgataacgataatacgatcctactcataaaaataacgataacttaaccctaccgaattcaattactccaccacccgccccgtatcgtcgtaacgataacgcatctccgaccttcccgcgtaacgatacgccaccatccgacccgaatactacgcgtcatacgtaaaaacgcgcacctacgtattactacgatcatataccgccaacaattcaccgacttccgtatacgtataccgcaccaataacgcaacgaacaaactctccgaatataccgaatcgtacatcaaccacaccgccgaaaaacgaatacccctatcgaaaccgtattcgataccgaacaatatatcgaaaaacgctaaaactaaaaaaaaacgaaaactatcaaaaaaaaataacgaaaaaatacgaacctcttccgcacgctacgcctacgtaatcaacaccaaacgaaactcccgcccgacaccgtccgtcacgccgataatttccccgaccaaaatcaccgaacgacctcacgccgatacgtcaacgtccgcccaaaaacgatccgccatcccgataaacacaccaaatacgacgacaacgaaactaacaatacgtcctcaacaccaaaacaaccgatcaaacacacccacaatatacaacaacgaaccgctatacaactaaaaatacgaccaaaataaaaatacgaacttcacaaaatatccgacgaaaaacga

SEQ ID NO: 32897 - DNA, 547 bp, Artificial Sequence
  chemically treated genomic DNA (Homo sapiens) CpG-island No: 32897
tatttttagttatattgtcgttaatggaataggcgatttgtgaggaagggttcggtgcgtagtagagattatgcggtgtaacggtttgggagatcgttaggttacgtacgtttggttgtacgcgcgcgcggcgattaacggggttaatgtcgaggattttttttaagcgcgttattattaataatatatttttttttagtcggtagcgtcgttattagaaagttcggtgtttgtattacgggttattatcggtatacgtaggcgatggtagatagttagaatcgttgttatttgttttatttgtttaggtagaataattagtaatggacgcgtgcgatacgcgtttaattcgttatattcgtaaggaatgatttttttatcggtatgtaggattttaagtttagggatatgtttacgtagtgttattagtatcgatgtgcggtcgatatcgggtaaagcgttattaagacgtttttcgtataagatgtttatgagtaggtttcgttttgttgtgttgtgtggtagttgatttttgcgcgttgttttt

SEQ ID NO: 32898 - DNA, 547 bp, Artificial Sequence
  chemically treated genomic DNA (Homo sapiens) CpG-island No: 32898
aaaaacaacgcgcaaaaatcaactaccacacaacacaacaaaacgaaacctactcataaacatcttatacgaaaaacgtcttaataacgctttacccgatatcgaccgcacatcgatactaataacactacgtaaacatatccctaaacttaaaatcctacataccgataaaaaaatcattccttacgaatataacgaattaaacgcgtatcgcacgcgtccattactaattattctacctaaacaaataaaacaaataacaacgattctaactatctaccatcgcctacgtataccgataataacccgtaatacaaacaccgaactttctaataacgacgctaccgactaaaaaaaaatatattattaataataacgcgcttaaaaaaaatcctcgacattaaccccgttaatcgccgcgcgcgcgtacaaccaaacgtacgtaacctaacgatctcccaaaccgttacaccgcataatctctactacgcaccgaacccttcctcacaaatcgcctattccattaacgacaatataactaaaaata

SEQ ID NO: 32899 - DNA, 547 bp, Artificial Sequence
  chemically treated genomic DNA (Homo sapiens) CpG-island No: 32899
agaagtagcgcgtaaaaattagttgttatataatataataaagcgaagtttatttatgagtattttgtacgaagagcgttttgatggcgttttattcgatgtcgatcgtatatcggtattgatggtattgcgtgagtatgtttttggatttgagattttgtatatcgatgaggagattattttttacgagtgtgacgggttgagcgcgtatcgtacgcgtttattattggttgttttgtttaagtaaatggaataggtgatagcgattttggttgtttgttatcgtttgcgtgtatcggtggtgattcgtggtgtaggtatcgggttttttggtggcgacgttgtcgattggaaaaaggtgtgttgttggtgatggcgcgtttaaaagagattttcgatattaatttcgttggtcgtcgcgcgcgcgtgtagttaggcgtgcgtaatttggcgattttttaggtcgttgtatcgtataatttttattacgtatcggatttttttttataaatcgtttgttttattggcggtaatgtggttgaaaatg

SEQ ID NO: 32900 - DNA, 547 bp, Artificial Sequence
  chemically treated genomic DNA (Homo sapiens) CpG-island No: 32900
cattttcaaccacattaccgccaataaaacaaacgatttataaaaaaaaatccgatacgtaataaaaattatacgatacaacgacctaaaaaatcgccaaattacgcacgcctaactacacgcgcgcgcgacgaccaacgaaattaatatcgaaaatctcttttaaacgcgccatcaccaacaacacacctttttccaatcgacaacgtcgccaccaaaaaacccgatacctacaccacgaatcaccaccgatacacgcaaacgataacaaacaaccaaaatcgctatcacctattccatttacttaaacaaaacaaccaataataaacgcgtacgatacgcgctcaacccgtcacactcgtaaaaaataatctcctcatcgatatacaaaatctcaaatccaaaaacatactcacgcaataccatcaataccgatatacgatcgacatcgaataaaacgccatcaaaacgctcttcgtacaaaatactcataaataaacttcgctttattatattatataacaactaatttttacgcgctacttct

SEQ ID NO: 32901 - DNA, 804 bp, Artificial Sequence
  chemically treated genomic DNA (Homo sapiens) CpG-island No: 32901
attttattgatcgtttaggaaacgttgttattggtatagtgttttggtcgtattttggcgagcgatgtcgtttcgtcgtttgatgtttcggggtttgataatttcgtaatggacggttacgcggtgcgtttagtcgatattgttttcgggtaatcgttgttcgttgtcggtaaattttttgtcggttagttatattatggtgaatggtttgcgggtatttgtattcgtattatgatcggtgcgtcggtgtcggaaggttgcgaagcggtggtgatgtaggagtagattgaataaatggataatggcgtgcgttttattgttgaagtgcgtagcgggtaaaatattcgtcgtcgcggtgaagatatttttgtaggtgcggttgttttttcggcgggaattcgtttgattatcgtagagttgttagtaattgttttattggggattgtcgaagtttcggtgattcgtaaagtgcgtgtagcgtttttttttatcggtgatgaattttagttgttcggttagtcgttgggcgacggttaaatttacgatattaatcgtttcgtcgtatatttgatgttagaatagttgggatgcgaggtaattaatttagggattattcgcgacgatttttatgttttgcgcgtcgtatttattgaagtcgatagttaggcggatgtggtgattagtttcggcggtgttttagtgggtgaggcggattatattaaaacgatttttgaagagttgggggagatcgttttttggaagttggcgattaaattaggtaaatcgttcgcgttcggtaaattt

SEQ ID NO: 32902 - DNA, 804 bp, Artificial Sequence
  chemically treated genomic DNA (Homo sapiens) CpG-island No: 32902
aaatttaccgaacgcgaacgatttacctaatttaatcgccaacttccaaaaaacgatctcccccaactcttcaaaaatcgttttaatataatccgcctcacccactaaaacaccgccgaaactaatcaccacatccgcctaactatcgacttcaataaatacgacgcgcaaaacataaaaatcgtcgcgaataatccctaaattaattacctcgcatcccaactattctaacatcaaatatacgacgaaacgattaatatcgtaaatttaaccgtcgcccaacgactaaccgaacaactaaaattcatcaccgataaaaaaaaacgctacacgcactttacgaatcaccgaaacttcgacaatccccaataaaacaattactaacaactctacgataatcaaacgaattcccgccgaaaaaacaaccgcacctacaaaaatatcttcaccgcgacgacgaatattttacccgctacgcacttcaacaataaaacgcacgccattatccatttattcaatctactcctacatcaccaccgcttcgcaaccttccgacaccgacgcaccgatcataatacgaatacaaatacccgcaaaccattcaccataatataactaaccgacaaaaaatttaccgacaacgaacaacgattacccgaaaacaatatcgactaaacgcaccgcgtaaccgtccattacgaaattatcaaaccccgaaacatcaaacgacgaaacgacatcgctcgccaaaatacgaccaaaacactataccaataacaacgtttcctaaacgatcaataaaat

SEQ ID NO: 32903 - DNA, 804 bp, Artificial Sequence
  chemically treated genomic DNA (Homo sapiens) CpG-island No: 32903
gagtttatcgaacgcgaacggtttatttggtttaatcgttagtttttagaaggcgattttttttagttttttaagaatcgttttggtgtaattcgttttatttattgaaatatcgtcggaattgattattatattcgtttggttgtcggttttaataaatgcggcgcgtagggtatggggatcgtcgcggataatttttaagttaattatttcgtattttaattgttttaatattaggtgtacggcgagacggttggtatcgtagatttggtcgtcgtttagcggttgatcgggtaattggagtttattatcggtagaaaaaagcgttatacgtattttacgaattatcggaatttcggtaatttttagtgaagtaattattggtagttttgcggtagttaggcgagttttcgtcgggaaaataatcgtatttgtagagatatttttatcgcgacggcgaatattttgttcgttacgtattttagtagtaaaacgtacgttattgtttatttgtttagtttgtttttgtattattatcgtttcgtagtttttcggtatcggcgtatcggttataatacgaatgtaggtattcgtaggttatttattatggtatggttgatcggtaaaggatttatcggtaacgggtagcggttgttcggaggtaatatcggttaaacgtatcgcgtagtcgtttattgcggagttattaaatttcggaatattaagcggcgaaacgatatcgttcgttagaatacgattaaaatattgtattagtggtagcgttttttgggcggttagtggggt

SEQ ID NO: 32904 - DNA, 804 bp, Artificial Sequence
  chemically treated genomic DNA (Homo sapiens) CpG-island No: 32904
accccactaaccgcccaaaaaacgctaccactaatacaatattttaatcgtattctaacgaacgatatcgtttcgccgcttaatattccgaaatttaataactccgcaataaacgactacgcgatacgtttaaccgatattacctccgaacaaccgctacccgttaccgataaatcctttaccgatcaaccataccataataaataacctacgaatacctacattcgtattataaccgatacgccgataccgaaaaactacgaaacgataataatacaaaaacaaactaaacaaataaacaataacgtacgttttactactaaaatacgtaacgaacaaaatattcgccgtcgcgataaaaatatctctacaaatacgattattttcccgacgaaaactcgcctaactaccgcaaaactaccaataattacttcactaaaaattaccgaaattccgataattcgtaaaatacgtataacgcttttttctaccgataataaactccaattacccgatcaaccgctaaacgacgaccaaatctacgataccaaccgtctcgccgtacacctaatattaaaacaattaaaatacgaaataattaacttaaaaattatccgcgacgatccccataccctacgcgccgcatttattaaaaccgacaaccaaacgaatataataatcaattccgacgatatttcaataaataaaacgaattacaccaaaacgattcttaaaaaactaaaaaaaatcgccttctaaaaactaacgattaaaccaaataaaccgttcgcgttcgataaactc

SEQ ID NO: 32905 - DNA, 566 bp, Artificial Sequence
  chemically treated genomic DNA (Homo sapiens) CpG-island No: 32905
gacgtagcgcgaggattttttttattattttgttgttattttatttatcggcgtttgggttttgatcggaggcgcgggtgttgtaagcgcgatatatttttttacgtagagtttggttgtcgtagtaggttattatcggtaagtagtttgggatatttagcgttagtaaataattttttagttttttcgtttcggtttgggttttgtcgtagttagcgcgttttttggtattttcgttagtttcgtttcgtcggtaacgagttggtttagtttatgtcgtatcgaggacgtgttgttgtattggtgtttagtttagaaagacgggtcgtaatttcgtcgtaacgttgttgtttttttttcggtagatttatgttagagagtttaaagtcgcgtagtgcgttattaatcgatttaatttttagcgtcgatgtaatagcgtggcgtaatgatcgttatcgcgtaggtcgcgatacgtttatatatagttttttatgttgattttatttaggtgttgtattttagatagtagcggtagggtttgttcgtaagttttacgtagttttagg

SEQ ID NO: 32906 - DNA, 566 bp, Artificial Sequence
  chemically treated genomic DNA (Homo sapiens) CpG-island No: 32906
cctaaaactacgtaaaacttacgaacaaaccctaccgctactatctaaaatacaacacctaaataaaatcaacataaaaaactatatataaacgtatcgcgacctacgcgataacgatcattacgccacgctattacatcgacgctaaaaattaaatcgattaataacgcactacgcgactttaaactctctaacataaatctaccgaaaaaaaaacaacaacgttacgacgaaattacgacccgtctttctaaactaaacaccaatacaacaacacgtcctcgatacgacataaactaaaccaactcgttaccgacgaaacgaaactaacgaaaataccaaaaaacgcgctaactacgacaaaacccaaaccgaaacgaaaaaactaaaaaattatttactaacgctaaatatcccaaactacttaccgataataacctactacgacaaccaaactctacgtaaaaaaatatatcgcgcttacaacacccgcgcctccgatcaaaacccaaacgccgataaataaaataacaacaaaataataaaaaaaatcctcgcgctacgtc

SEQ ID NO: 32907 - DNA, 566 bp, Artificial Sequence
  chemically treated genomic DNA (Homo sapiens) CpG-island No: 32907
tttggaattgcgtgaagtttacgaataaattttgtcgttgttgtttggaatatagtatttgggtagggttaatatgaagggttgtatataagcgtatcgcgatttgcgcgatggcgattattacgttacgttgttatatcggcgttagaagttaagtcggttgataacgtattgcgcgattttgaattttttggtataggtttgtcgaaagagaaatagtagcgttacggcgaaattgcgattcgtttttttgaattgggtattagtatagtaatacgttttcgatgcgatatgggttggattaattcgttatcgacgaagcggagttggcggggatgttagaaagcgcgttggttgcggtaaagtttaggtcgaagcgaaagagttggaaggttatttgttgacgttggatattttaagttatttgtcggtaatgatttattgcgataattaggttttgcgtgaagagatgtatcgcgtttatagtattcgcgttttcgattaaggtttaaacgtcggtaaatgggataatagtaaggtgatggaagagattttcgcgttgcgtt

SEQ ID NO: 32908 - DNA, 566 bp, Artificial Sequence
  chemically treated genomic DNA (Homo sapiens) CpG-island No: 32908
aacgcaacgcgaaaatctcttccatcaccttactattatcccatttaccgacgtttaaaccttaatcgaaaacgcgaatactataaacgcgatacatctcttcacgcaaaacctaattatcgcaataaatcattaccgacaaataacttaaaatatccaacgtcaacaaataaccttccaactctttcgcttcgacctaaactttaccgcaaccaacgcgctttctaacatccccgccaactccgcttcgtcgataacgaattaatccaacccatatcgcatcgaaaacgtattactatactaatacccaattcaaaaaaacgaatcgcaatttcgccgtaacgctactatttctctttcgacaaacctataccaaaaaattcaaaatcgcgcaatacgttatcaaccgacttaacttctaacgccgatataacaacgtaacgtaataatcgccatcgcgcaaatcgcgatacgcttatatacaacccttcatattaaccctacccaaatactatattccaaacaacaacgacaaaatttattcgtaaacttcacgcaattccaaa

SEQ ID NO: 32909 - DNA, 529 bp, Artificial Sequence
  chemically treated genomic DNA (Homo sapiens) CpG-island No: 32909
ggcgaatgtgaaacgtcggtgcgtaaggcgaagtacggtgattttagcggcgtacgcggcgttgcgtggttatggttataagagtaaaaaacgtaggtaattggcgtattatgtttgatgcgacgtttgtcgcgttttattaggtttataaaaggtgttagaatcgtaagtcggataaggcgtttacgtcgtattcggtaataagtgtttcgatgtttgatgcgacgttgacgcgttttattcggtttataaatttgtacgcgaatcgcgtaggtcggataaggcgtttacgtcgtattcgatttgaaaatttttaaattaattttcgtcgggggttatgcgttttcgttgttgtggaggttatttatgtgcgaattgttcgggatgagcgttaacgtttttatcgatatttgttttagttttatcgggtttgtatagcgtggtggtggaatcgggttatataaagatggttggggtattattttttacgaaggtaaaggttgtcgtatatttaaagatttataattta

SEQ ID NO: 32910 - DNA, 529 bp, Artificial Sequence
  chemically treated genomic DNA (Homo sapiens) CpG-island No: 32910
taaattataaatctttaaatatacgacaacctttaccttcgtaaaaaataataccccaaccatctttatataacccgattccaccaccacgctatacaaacccgataaaactaaaacaaatatcgataaaaacgttaacgctcatcccgaacaattcgcacataaataacctccacaacaacgaaaacgcataacccccgacgaaaattaatttaaaaattttcaaatcgaatacgacgtaaacgccttatccgacctacgcgattcgcgtacaaatttataaaccgaataaaacgcgtcaacgtcgcatcaaacatcgaaacacttattaccgaatacgacgtaaacgccttatccgacttacgattctaacaccttttataaacctaataaaacgcgacaaacgtcgcatcaaacataatacgccaattacctacgttttttactcttataaccataaccacgcaacgccgcgtacgccgctaaaatcaccgtacttcgccttacgcaccgacgtttcacattcgcc

SEQ ID NO: 32911 - DNA, 529 bp, Artificial Sequence
  chemically treated genomic DNA (Homo sapiens) CpG-island No: 32911
tgggttgtggatttttaaatgtgcgatagtttttattttcgtaaaaggtaatgttttagttatttttatgtggttcggttttattattacgttgtataagttcggtgaaattaaagtagatatcggtagggacgttggcgtttatttcgagtaattcgtatatgggtaatttttataatagcgggagcgtatggttttcggcgaagattgatttaagaatttttaggtcggatgcggcgtaaacgttttattcggtttacgcggttcgcgtatagatttgtaggtcggataagacgcgttagcgtcgtattaggtatcggagtatttattgtcggatgcggcgtgaacgttttattcggtttacggttttggtattttttgtaggtttgataagacgcggtaagcgtcgtattaggtatgatgcgttaattgtttacgttttttatttttgtggttataattacgtagcgtcgcgtacgtcgttggaattatcgtgtttcgttttacgtatcggcgttttatattcgtt

SEQ ID NO: 32912 - DNA, 529 bp, Artificial Sequence
  chemically treated genomic DNA (Homo sapiens) CpG-island No: 32912
aacgaatataaaacgccgatacgtaaaacgaaacacgataattccaacgacgtacgcgacgctacgtaattataaccacaaaaataaaaaacgtaaacaattaacgcatcatacctaatacgacgcttaccgcgtcttatcaaacctacaaaaaataccaaaaccgtaaaccgaataaaacgttcacgccgcatccgacaataaatactccgatacctaatacgacgctaacgcgtcttatccgacctacaaatctatacgcgaaccgcgtaaaccgaataaaacgtttacgccgcatccgacctaaaaattcttaaatcaatcttcgccgaaaaccatacgctcccgctattataaaaattacccatatacgaattactcgaaataaacgccaacgtccctaccgatatctactttaatttcaccgaacttatacaacgtaataataaaaccgaaccacataaaaataactaaaacattaccttttacgaaaataaaaactatcgcacatttaaaaatccacaaccca

SEQ ID NO: 32913 - DNA, 522 bp, Artificial Sequence
  chemically treated genomic DNA (Homo sapiens) CpG-island No: 32913
ggcgtagtataagtttgttgcgggcgatgagtatattattgcggatatggcgatttggtcgtggtttggtaacgtggtgttaggtggtgtgtatgatgtcgttgagttttttgatgcgggtagttatagtatgtataacgttgggcgaaagaagtaggcgaacgttcggcggtgaaacgtgggcgtattgttaatcgtattaacggatcgttgaatgagtagttgtatgagcgttatgacgttagtgatttcgagacgaatacggaagataagcgttaggggtaagggttggtgttcgtcgtagataagttatttaggttcggaaacggtgtttacgtcgtattcggtaatcggtgtttaatgtttgatgcgacgtttatcgcgttttattaggtttataacgatataaatttgtaggtcggataaggcgtttacgtcgtattcggtatgaataacgcgtatttagttaataattaggatgtgaggttattttttattttgttatattcgtaaaaacggtat

SEQ ID NO: 32914 - DNA, 522 bp, Artificial Sequence
  chemically treated genomic DNA (Homo sapiens) CpG-island No: 32914
ataccgtttttacgaatataacaaaataaaaaataacctcacatcctaattattaactaaatacgcgttattcataccgaatacgacgtaaacgccttatccgacctacaaatttatatcgttataaacctaataaaacgcgataaacgtcgcatcaaacattaaacaccgattaccgaatacgacgtaaacaccgtttccgaacctaaataacttatctacgacgaacaccaacccttacccctaacgcttatcttccgtattcgtctcgaaatcactaacgtcataacgctcatacaactactcattcaacgatccgttaatacgattaacaatacgcccacgtttcaccgccgaacgttcgcctacttctttcgcccaacgttatacatactataactacccgcatcaaaaaactcaacgacatcatacacaccacctaacaccacgttaccaaaccacgaccaaatcgccatatccgcaataatatactcatcgcccgcaacaaacttatactacgcc

SEQ ID NO: 32915 - DNA, 522 bp, Artificial Sequence
  chemically treated genomic DNA (Homo sapiens) CpG-island No: 32915
atgtcgtttttacggatatgatagggtgaggggtaattttatattttgattattgattaagtgcgcgttgtttatgtcggatgcggcgtgaacgttttattcggtttataggtttgtatcgttgtaggtttgataagacgcggtaagcgtcgtattaggtattgagtatcgattgtcggatgcggcgtgaatatcgttttcgggtttggatggtttgtttgcgacgaatattaatttttatttttgacgtttatttttcgtattcgtttcgaaattattggcgttatggcgtttatgtaattgtttatttagcggttcgttggtgcggttaataatacgtttacgttttatcgtcggacgttcgtttatttttttcgtttagcgttgtatatgttataattgttcgtattaagaaatttagcggtattatatatattatttaatattacgttgttaaattacggttaaatcgttatattcgtaatggtgtatttatcgttcgtaataaatttatgttgcgtt

SEQ ID NO: 32916 - DNA, 522 bp, Artificial Sequence
  chemically treated genomic DNA (Homo sapiens) CpG-island No: 32916
aacgcaacataaatttattacgaacgataaatacaccattacgaatataacgatttaaccgtaatttaacaacgtaatattaaataatatatataataccgctaaatttcttaatacgaacaattataacatatacaacgctaaacgaaaaaaataaacgaacgtccgacgataaaacgtaaacgtattattaaccgcaccaacgaaccgctaaataaacaattacataaacgccataacgccaataatttcgaaacgaatacgaaaaataaacgtcaaaaataaaaattaatattcgtcgcaaacaaaccatccaaacccgaaaacgatattcacgccgcatccgacaatcgatactcaatacctaatacgacgcttaccgcgtcttatcaaacctacaacgatacaaacctataaaccgaataaaacgttcacgccgcatccgacataaacaacgcgcacttaatcaataatcaaaatataaaattacccctcaccctatcatatccgtaaaaacgacat

SEQ ID NO: 32917 - DNA, 1004 bp, Artificial Sequence
  chemically treated genomic DNA (Homo sapiens) CpG-island No: 32917
  misc_feature (900)..(900): n is either a, c, g or t
gcggttgtcgtttttggcgtaaataaggtacgtagtggtggcgtagattgtttttcgttagcgaaaatcgtcgatttcggtagttagcgtattaatagcggtattagaattaacggtattatattatttatttaaaatatcgtttgttatgttaagtttgttttcgcgaaatttagtgtcgtcgttagcgtcgcgttaatgggaatatcgtaatatattaggtttattgtcgttttacgaaaacgtggattcgcggttttagacgttagggcgataagattcggtaacgtcgtttttagttcgatatcggttattagtcgcgtaaagattagtgaggggaaattttaggtaatcgtcgttgttagtgagaataaattaaatagcgtaattgagttaattaaaatgcgtttgcgattataacggttcgttagtatttcgttaattaacgcgtcgggtagtaaatcgagtatttcggcgttaaatatttagtttatttgtattttatcgagtgcgaaagtttgggcgatgttattcgtcgtaatgttagtcgtttgaagatttagtttttttattagagcgattaaaaaataaagttcgatggttagtattaggcgggatgaagatgatgaagggggtacgagtcgatataagatgaatttcgttgcgagtgtaggtgaatcgcgattgatatatcgttatttacgtcgggtcggagaagtagtcgttgttggcgataaatttaaatatttcgcgttgttgttcgacggaataattcgtttgaataattttcggcgttagcgtttgaattagtagtgtcgtttcggcgttattgcggttatggtatttatcgtttatatgtagcgtttgcgttagtattaagcgtagatcgatttcgtcgantatttttatcgcgtcgcgtagtattggtttttgtatattacgtatttagtttaggcggttaattacgttttggtcgttagcgtttatacgtaaaattttcgtta

SEQ ID NO: 32918 - DNA, 1004 bp, Artificial Sequence
  chemically treated genomic DNA (Homo sapiens) CpG-island No: 32918
  misc_feature (105)..(105): n is either a, c, g or t
taacgaaaattttacgtataaacgctaacgaccaaaacgtaattaaccgcctaaactaaatacgtaatatacaaaaaccaatactacgcgacgcgataaaaatantcgacgaaatcgatctacgcttaatactaacgcaaacgctacatataaacgataaataccataaccgcaataacgccgaaacgacactactaattcaaacgctaacgccgaaaattattcaaacgaattattccgtcgaacaacaacgcgaaatatttaaatttatcgccaacaacgactacttctccgacccgacgtaaataacgatatatcaatcgcgattcacctacactcgcaacgaaattcatcttatatcgactcgtacccccttcatcatcttcatcccgcctaatactaaccatcgaactttattttttaatcgctctaataaaaaaactaaatcttcaaacgactaacattacgacgaataacatcgcccaaactttcgcactcgataaaatacaaataaactaaatatttaacgccgaaatactcgatttactacccgacgcgttaattaacgaaatactaacgaaccgttataatcgcaaacgcattttaattaactcaattacgctatttaatttattctcactaacaacgacgattacctaaaatttcccctcactaatctttacgcgactaataaccgatatcgaactaaaaacgacgttaccgaatcttatcgccctaacgtctaaaaccgcgaatccacgttttcgtaaaacgacaataaacctaatatattacgatattcccattaacgcgacgctaacgacgacactaaatttcgcgaaaacaaacttaacataacaaacgatattttaaataaataatataataccgttaattctaataccgctattaatacgctaactaccgaaatcgacgattttcgctaacgaaaaacaatctacgccaccactacgtaccttatttacgccaaaaacgacaaccgc

SEQ ID NO: 32919 - DNA, 1004 bp, Artificial Sequence
  chemically treated genomic DNA (Homo sapiens) CpG-island No: 32919
  misc_feature (105)..(105): n is either a, c, g or t
tggcgaagattttgcgtatgggcgttaacgattagagcgtgattgatcgtttgaattggatgcgtgatgtgtagggattaatattgcgcgacgcgatgaaaatantcggcgaaatcgatttgcgtttaatgttggcgtaggcgttgtatatgggcgatgagtgttataatcgtaataacgtcgggacgatattgttgatttaggcgttgacgtcggggattatttaggcgggttatttcgtcgagtaatagcgcgaagtgtttgagtttgtcgttagtagcgattattttttcggttcgacgtggatggcgatgtattagtcgcgatttatttgtattcgtaacgaggtttattttatgtcgattcgtattttttttattatttttatttcgtttgatgttgattatcgggttttgttttttggtcgttttgatggaagggttggatttttaggcggttggtattgcggcgggtggtatcgtttaggttttcgtattcgataaaatgtaaatgggttggatatttagcgtcggaatattcggtttgttattcggcgcgttggttggcggaatgttggcggatcgttatggtcgtaagcgtattttgattggtttagttgcgttgtttggtttgtttttattggtaacggcgattgtttgggatttttttttattggtttttgcgcggttgatgatcggtgtcgggttgggggcggcgttgtcgaattttatcgttttgacgtttgaagtcgcgggtttacgttttcgtgggacggtagtgagtttgatgtattgcggtgtttttattggcgcggcgttggcggcgatattgggtttcgcgggggtaaatttagtatggtaaacggtgttttgggtaggtggtgtggtgtcgttgattttggtgtcgttattaatgcgttggttgtcggagtcggcggttttcgttggcgaaaaatagtttgcgttattattgcgtgttttatttgcgttagaaacggtaatcgt

SEQ ID NO: 32920 - DNA, 1004 bp, Artificial Sequence
  chemically treated genomic DNA (Homo sapiens) CpG-island No: 32920
  misc_feature (900)..(900): n is either a, c, g or t
acgattaccgtttctaacgcaaataaaacacgcaataataacgcaaactatttttcgccaacgaaaaccgccgactccgacaaccaacgcattaataacgacaccaaaatcaacgacaccacaccacctacccaaaacaccgtttaccatactaaatttacccccgcgaaacccaatatcgccgccaacgccgcgccaataaaaacaccgcaatacatcaaactcactaccgtcccacgaaaacgtaaacccgcgacttcaaacgtcaaaacgataaaattcgacaacgccgcccccaacccgacaccgatcatcaaccgcgcaaaaaccaataaaaaaaaatcccaaacaatcgccgttaccaataaaaacaaaccaaacaacgcaactaaaccaatcaaaatacgcttacgaccataacgatccgccaacattccgccaaccaacgcgccgaataacaaaccgaatattccgacgctaaatatccaacccatttacattttatcgaatacgaaaacctaaacgataccacccgccgcaataccaaccgcctaaaaatccaacccttccatcaaaacgaccaaaaaacaaaacccgataatcaacatcaaacgaaataaaaataataaaaaaaatacgaatcgacataaaataaacctcgttacgaatacaaataaatcgcgactaatacatcgccatccacgtcgaaccgaaaaaataatcgctactaacgacaaactcaaacacttcgcgctattactcgacgaaataacccgcctaaataatccccgacgtcaacgcctaaatcaacaatatcgtcccgacgttattacgattataacactcatcgcccatatacaacgcctacgccaacattaaacgcaaatcgatttcgccgantattttcatcgcgtcgcgcaatattaatccctacacatcacgcatccaattcaaacgatcaatcacgctctaatcgttaacgcccatacgcaaaatcttcgcca

SEQ ID NO: 32921 - DNA, 843 bp, Artificial Sequence
  chemically treated genomic DNA (Homo sapiens) CpG-island No: 32921
atgtcggatatatttatcggtaagtttatttgttttgtcgttagtttttcggcgattttaatcggtagcgtgatcgtgttgttatcgtaattaaaggagacgcgtgtatttgcgtttatatttaatttcgcggtattcgttgggttgagtttgatgtacggttgcggtatacggttttggaagatcggagtacgttgtgataatttatcgttgttaaataggtggtaatacggcgcgatacgttatttttcgttttgcggttggaagcgtgtcggtacgttggtgaagtaatttagattattttcgttggttttaaatagacgtacgttcggatcgttaaagcgtagtttgtcgtttatttcgttttggaatttgttttacgtttgcggggagttttagttcggcgtttaggtaaacggtatttgcgaacggtgcgtagtcggttggttgttattttttatcgagaaggtgaatatggtgttaatattttgcggttgacgcggtttatgaacgttgatattggcgcgtatggcggtacgatcgttgtaacggtgcggtttacgggttagtttttgtttacgaatacggaatgtcgtattcggcgtagtatttttgatatttgttagtttcgggattttcgttataatagcgttaattatatggtcgagttgcgtttagtttattttacggtttagtagggtgttgtgtagcgagtgtaattagcgttagttttttagtatgatagttttgttgtcgtaataagtaggatcgtaaatttggaagaaacgttgggcgcggttttcgttgttgattatcgtatcgtcgtttttagtaaagttggta

SEQ ID NO: 32922 - DNA, 843 bp, Artificial Sequence
  chemically treated genomic DNA (Homo sapiens) CpG-island No: 32922
taccaactttactaaaaacgacgatacgataatcaacaacgaaaaccgcgcccaacgtttcttccaaatttacgatcctacttattacgacaacaaaactatcatactaaaaaactaacgctaattacactcgctacacaacaccctactaaaccgtaaaataaactaaacgcaactcgaccatataattaacgctattataacgaaaatcccgaaactaacaaatatcaaaaatactacgccgaatacgacattccgtattcgtaaacaaaaactaacccgtaaaccgcaccgttacaacgatcgtaccgccatacgcgccaatatcaacgttcataaaccgcgtcaaccgcaaaatattaacaccatattcaccttctcgataaaaaataacaaccaaccgactacgcaccgttcgcaaataccgtttacctaaacgccgaactaaaactccccgcaaacgtaaaacaaattccaaaacgaaataaacgacaaactacgctttaacgatccgaacgtacgtctatttaaaaccaacgaaaataatctaaattacttcaccaacgtaccgacacgcttccaaccgcaaaacgaaaaataacgtatcgcgccgtattaccacctatttaacaacgataaattatcacaacgtactccgatcttccaaaaccgtataccgcaaccgtacatcaaactcaacccaacgaataccgcgaaattaaatataaacgcaaatacacgcgtctcctttaattacgataacaacacgatcacgctaccgattaaaatcgccgaaaaactaacgacaaaacaaataaacttaccgataaatatatccgacat

SEQ ID NO: 32923 - DNA, 843 bp, Artificial Sequence
  chemically treated genomic DNA (Homo sapiens) CpG-island No: 32923
tgttagttttgttgaaagcgacggtacggtgattaataacgaaggtcgcgtttaacgttttttttaggtttacgattttgtttattacgatagtaaaattgttatgttggaaagttggcgttggttatattcgttgtatagtattttgttgagtcgtgaagtggattggacgtagttcgattatgtgattgacgttgttgtggcgaaaatttcggaattggtaggtattaaagatgttgcgtcggatgcgatatttcgtattcgtgggtagaaattggttcgtgaatcgtatcgttatagcggtcgtatcgttatgcgcgttaatattagcgtttatgagtcgcgttagtcgtaggatattgatattatgtttattttttcgatggaaggtaataattagtcgattgcgtatcgttcgtaagtgtcgtttgtttgggcgtcgggttggaatttttcgtaggcgtggaataaattttaggacgaagtgggcggtaaattgcgttttggcgattcgggcgtgcgtttgtttgaaattagcgaaaatggtttggattattttattagcgtatcggtacgtttttagtcgtaggacgggaaatggcgtatcgcgtcgtattattatttgtttggtagcgatgaattgttatagcgtgtttcggttttttagagtcgtatgtcgtagtcgtatattaaatttaatttagcggatgtcgcgaagttgggtgtgaacgtaggtatacgcgttttttttagttacgatggtaatacggttacgttgtcggttgaaatcgtcgaaggattgacggtagggtaggtgggtttgtcgatgggtatgttcggtat

SEQ ID NO: 32924 - DNA, 843 bp, Artificial Sequence
  chemically treated genomic DNA (Homo sapiens) CpG-island No: 32924
ataccgaacatacccatcgacaaacccacctaccctaccgtcaatccttcgacgatttcaaccgacaacgtaaccgtattaccatcgtaactaaaaaaaacgcgtatacctacgttcacacccaacttcgcgacatccgctaaattaaatttaatatacgactacgacatacgactctaaaaaaccgaaacacgctataacaattcatcgctaccaaacaaataataatacgacgcgatacgccatttcccgtcctacgactaaaaacgtaccgatacgctaataaaataatccaaaccattttcgctaatttcaaacaaacgcacgcccgaatcgccaaaacgcaatttaccgcccacttcgtcctaaaatttattccacgcctacgaaaaattccaacccgacgcccaaacaaacgacacttacgaacgatacgcaatcgactaattattaccttccatcgaaaaaataaacataatatcaatatcctacgactaacgcgactcataaacgctaatattaacgcgcataacgatacgaccgctataacgatacgattcacgaaccaatttctacccacgaatacgaaatatcgcatccgacgcaacatctttaatacctaccaattccgaaattttcgccacaacaacgtcaatcacataatcgaactacgtccaatccacttcacgactcaacaaaatactatacaacgaatataaccaacgccaactttccaacataacaattttactatcgtaataaacaaaatcgtaaacctaaaaaaaacgttaaacgcgaccttcgttattaatcaccgtaccgtcgctttcaacaaaactaaca

SEQ ID NO: 32925 - DNA, 567 bp, Artificial Sequence
  chemically treated genomic DNA (Homo sapiens) CpG-island No: 32925
gtagagaagtagaaattacgttggtgagtaaggcgttgaattattcgaatattcgcgtgttggagcgtagtaacgcggttgatttgattgtttttgataaaagtggtttgtcgggtacgcgacgggttgttggcgcgtgggtatggaatcgtaataaagaaacggtggaaatttgttacgtaaaagcggtggtgttggtaatcggcggtgcgtcgaaggtttattagtatattattaattcggatattttttttggcgatggtattgttatggcgtggcgcgtaggttgtcgggttgttaatttcgaatttaattagttttattttatcgcgttatattatttataggtacgtaattttttgttaatagaagtattgcgcggcgaaggcgtttattttaagcgttcggatggtacgcgtataatgttcgatttgatgagcgcggcgaattggtttcgcgcgatattgtcgttcgcgttattgattatgaaatgaaacgtttcggcgtagattgtatgttttttgatattagttataagttcgtcgattttattcgttagtatttttt

SEQ ID NO: 32926 - DNA, 567 bp, Artificial Sequence
  chemically treated genomic DNA (Homo sapiens) CpG-island No: 32926
aaaaaatactaacgaataaaatcgacgaacttataactaatatcaaaaaacatacaatctacgccgaaacgtttcatttcataatcaataacgcgaacgacaatatcgcgcgaaaccaattcgccgcgctcatcaaatcgaacattatacgcgtaccatccgaacgcttaaaataaacgccttcgccgcgcaatacttctattaacaaaaaattacgtacctataaataatataacgcgataaaataaaactaattaaattcgaaattaacaacccgacaacctacgcgccacgccataacaataccatcgccaaaaaaaatatccgaattaataatatactaataaaccttcgacgcaccgccgattaccaacaccaccgcttttacgtaacaaatttccaccgtttctttattacgattccatacccacgcgccaacaacccgtcgcgtacccgacaaaccacttttatcaaaaacaatcaaatcaaccgcgttactacgctccaacacgcgaatattcgaataattcaacgccttactcaccaacgtaatttctacttctctac

SEQ ID NO: 32927 - DNA, 567 bp, Artificial Sequence
  chemically treated genomic DNA (Homo sapiens) CpG-island No: 32927
gggaaatgttggcgaataaaatcggcgggtttatggttgatattaaggaatatataatttgcgtcgaggcgttttattttatggttaatggcgcgggcgataatatcgcgcggggttagttcgtcgcgtttattaaatcgggtattatacgcgtattattcgggcgtttgagataagcgttttcgtcgcgtagtgtttttgttaataggaaattgcgtgtttgtgggtgatatagcgcggtagggtggaattgattaaattcgagattggtaattcggtagtttgcgcgttacgttatagtaatgttatcgttagaagaaatattcggattggtggtgtattgataaattttcgacgtatcgtcggttgttagtattatcgtttttgcgtggtaggtttttatcgtttttttattacggttttatatttacgcgttaataattcgtcgcgtgttcggtaggttatttttgttagaaataattagattaatcgcgttgttgcgttttagtacgcgaatattcggatggtttagcgttttgtttattagcgtggtttttatttttttat

SEQ ID NO: 32928 - DNA, 567 bp, Artificial Sequence
  chemically treated genomic DNA (Homo sapiens) CpG-island No: 32928
ataaaaaaataaaaaccacgctaataaacaaaacgctaaaccatccgaatattcgcgtactaaaacgcaacaacgcgattaatctaattatttctaacaaaaataacctaccgaacacgcgacgaattattaacgcgtaaatataaaaccgtaataaaaaaacgataaaaacctaccacgcaaaaacgataatactaacaaccgacgatacgtcgaaaatttatcaatacaccaccaatccgaatatttcttctaacgataacattactataacgtaacgcgcaaactaccgaattaccaatctcgaatttaatcaattccaccctaccgcgctatatcacccacaaacacgcaatttcctattaacaaaaacactacgcgacgaaaacgcttatctcaaacgcccgaataatacgcgtataatacccgatttaataaacgcgacgaactaaccccgcgcgatattatcgcccgcgccattaaccataaaataaaacgcctcgacgcaaattatatattccttaatatcaaccataaacccgccgattttattcgccaacatttccc

SEQ ID NO: 32929 - DNA, 570 bp, Artificial Sequence
  chemically treated genomic DNA (Homo sapiens) CpG-island No: 32929
gcgcgtttggaaaaaagagaatatcggatttcgtttattacgggcgggttattattcgggaaatgggggtaaattttggcggtttaggtaacgcgcgggtagggtttggaaaatttagtttatggggtcggaatgtgtggttaacgtttcgttgtttaatattgcgggcgaattagcggaagggttgttggtgattaagtcgaagaattacgattaggtttcggcgaataaatttattgttgacgcgattaaagcgaaaaaataggatttaagtggcgtattcgtttggattatttacgtcgcgttgtaatttttgtaggcgggtttgaattagtttgacgattcggttgaaatcgttaaatatttgaaagcgaatttcgtggatatcgtaatgggatcgttgatttgggatgagaaaggcgatttgaaaggttttgagttcggcgtatttgattggtacgttaacggtacggcgatcgatgcgaagtaattattaatcggtaattttgggttgtcgttaaattgttaatatcgagtacgttgttttatgtcggatgcggcgtaacgttt

SEQ ID NO: 32930 - DNA, 570 bp, Artificial Sequence
  chemically treated genomic DNA (Homo sapiens) CpG-island No: 32930
aaacgttacgccgcatccgacataaaacaacgtactcgatattaacaatttaacgacaacccaaaattaccgattaataattacttcgcatcgatcgccgtaccgttaacgtaccaatcaaatacgccgaactcaaaacctttcaaatcgcctttctcatcccaaatcaacgatcccattacgatatccacgaaattcgctttcaaatatttaacgatttcaaccgaatcgtcaaactaattcaaacccgcctacaaaaattacaacgcgacgtaaataatccaaacgaatacgccacttaaatcctattttttcgctttaatcgcgtcaacaataaatttattcgccgaaacctaatcgtaattcttcgacttaatcaccaacaacccttccgctaattcgcccgcaatattaaacaacgaaacgttaaccacacattccgaccccataaactaaattttccaaaccctacccgcgcgttacctaaaccgccaaaatttacccccatttcccgaataataacccgcccgtaataaacgaaatccgatattctcttttttccaaacgcgc

SEQ ID NO: 32931 - DNA, 570 bp, Artificial Sequence
  chemically treated genomic DNA (Homo sapiens) CpG-island No: 32931
aggcgttacgtcgtattcggtatgaagtaacgtattcgatattagtaatttggcggtaatttaaagttgtcgattaatgattatttcgtatcggtcgtcgtgtcgttggcgtgttagttaaatacgtcgaatttaaagttttttagatcgttttttttattttaggttagcggttttattacggtatttacggagttcgtttttaggtatttggcgattttagtcggatcgttagattgatttaggttcgtttgtaaagattgtagcgcggcgtaggtggtttaaacgaatgcgttatttgggttttgttttttcgttttgatcgcgttaataatgggtttgttcgtcggaatttgatcgtagtttttcggtttggttattagtagttttttcgttgattcgttcgtaatgttagatagcgaaacgttagttatatatttcggttttataaattgagttttttaagttttgttcgcgcgttgtttgaatcgttaggatttgtttttatttttcgggtgataattcgttcgtagtaaacggagttcgatatttttttttttttagacgcgt

SEQ ID NO: 32932 - DNA, 570 bp, Artificial Sequence
  chemically treated genomic DNA (Homo sapiens) CpG-island No: 32932
acgcgtctaaaaaaaaaaaaatatcgaactccgtttactacgaacgaattatcacccgaaaaataaaaacaaatcctaacgattcaaacaacgcgcgaacaaaacttaaaaaactcaatttataaaaccgaaatatataactaacgtttcgctatctaacattacgaacgaatcaacgaaaaaactactaataaccaaaccgaaaaactacgatcaaattccgacgaacaaacccattattaacgcgatcaaaacgaaaaaacaaaacccaaataacgcattcgtttaaaccacctacgccgcgctacaatctttacaaacgaacctaaatcaatctaacgatccgactaaaatcgccaaatacctaaaaacgaactccgtaaataccgtaataaaaccgctaacctaaaataaaaaaaacgatctaaaaaactttaaattcgacgtatttaactaacacgccaacgacacgacgaccgatacgaaataatcattaatcgacaactttaaattaccgccaaattactaatatcgaatacgttacttcataccgaatacgacgtaacgcct

SEQ ID NO: 32933 - DNA, 560 bp, Artificial Sequence
  chemically treated genomic DNA (Homo sapiens) CpG-island No: 32933
cggttaatatataatacgcgtttacgcggtagtagcgtttaggtgttgcgtttattcgtcggtttcggtagtaatcgttgtgtttttgtttgcgttagttcgttatattgcgtatataacgtttgtaattttggacgatttgttgtttattttcgtagtgtatttagcggttgagttaatgcggtttttaattgcgtatcgatcggatattttgtattttgacgcgcgagcgttattgttagcgtatttttcgggcgattcgttagtagacggtagagatagagcggatcgtttgttttcggttcggtatcggataatttttcgtcgtcgaacggttgtatattaattattgcgtttattatattacggttaatatataggttattaatatgggtcgagttagtgatttgggcgatggttttattaatgcgcgtatgacgttaagcgttagattataatcggaagcgttaatttgttcgattagttttggtagttggttacggttgtaacgtattatatgtagtatcggattaaagatttttttttgtaattcggtaaag

SEQ ID NO: 32934 - DNA, 560 bp, Artificial Sequence
  chemically treated genomic DNA (Homo sapiens) CpG-island No: 32934
ctttaccgaattacaaaaaaaaatctttaatccgatactacatataatacgttacaaccgtaaccaactaccaaaactaatcgaacaaattaacgcttccgattataatctaacgcttaacgtcatacgcgcattaataaaaccatcgcccaaatcactaactcgacccatattaataacctatatattaaccgtaatataataaacgcaataattaatatacaaccgttcgacgacgaaaaattatccgataccgaaccgaaaacaaacgatccgctctatctctaccgtctactaacgaatcgcccgaaaaatacgctaacaataacgctcgcgcgtcaaaatacaaaatatccgatcgatacgcaattaaaaaccgcattaactcaaccgctaaatacactacgaaaataaacaacaaatcgtccaaaattacaaacgttatatacgcaatataacgaactaacgcaaacaaaaacacaacgattactaccgaaaccgacgaataaacgcaacacctaaacgctactaccgcgtaaacgcgtattatatattaaccg

SEQ ID NO: 32935 - DNA, 560 bp, Artificial Sequence
  chemically treated genomic DNA (Homo sapiens) CpG-island No: 32935
ttttgtcgaattgtaaaaagaggtttttggttcggtgttgtatgtggtgcgttataatcgtaattagttattagagttgatcgagtagattaacgttttcggttatggtttgacgtttggcgttatacgcgtattgatgaaattatcgtttaggttattggttcggtttatgttggtaatttgtatgttaatcgtaatatggtgggcgtagtggttggtgtgtagtcgttcggcggcgaagggttgttcggtatcgggtcgaaagtaggcggttcgttttatttttatcgtttgttggcgaatcgttcggaaagtgcgttggtagtgacgttcgcgcgttaggatgtaaagtattcggtcgatgcgtagttgaaagtcgtattgatttagtcgttaaatgtattgcgggaatgggtagtaaatcgtttagaattgtaggcgttatgtacgtaatatggcgagttggcgtaggtaggaatataacgattgttgtcggggtcgacgggtgaacgtaatatttggacgttgttgtcgcgtgagcgcgtgttgtgtattagtcg

SEQ ID NO: 32936 - DNA, 560 bp, Artificial Sequence
  chemically treated genomic DNA (Homo sapiens) CpG-island No: 32936
cgactaatacacaacacgcgctcacgcgacaacaacgtccaaatattacgttcacccgtcgaccccgacaacaatcgttatattcctacctacgccaactcgccatattacgtacataacgcctacaattctaaacgatttactacccattcccgcaatacatttaacgactaaatcaatacgactttcaactacgcatcgaccgaatactttacatcctaacgcgcgaacgtcactaccaacgcactttccgaacgattcgccaacaaacgataaaaataaaacgaaccgcctactttcgacccgataccgaacaacccttcgccgccgaacgactacacaccaaccactacgcccaccatattacgattaacatacaaattaccaacataaaccgaaccaataacctaaacgataatttcatcaatacgcgtataacgccaaacgtcaaaccataaccgaaaacgttaatctactcgatcaactctaataactaattacgattataacgcaccacatacaacaccgaaccaaaaacctctttttacaattcgacaaaa

SEQ ID NO: 32937 - DNA, 885 bp, Artificial Sequence
  chemically treated genomic DNA (Homo sapiens) CpG-island No: 32937
attttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgttacgcggcgaattggcggtggtgtatgatcgtagtggtaaataggtgcgtagtttatatttacgatgataatatcggggtcggatggtggcgtatcgttatacgggtcggtcggaaattcgttatcgttatagatagacgacgggcgggtgatagaatagttaaattcggtaggtttaagtttatacgtattagtatgaagaaagatcgtattattattatacgatagtttggatcgtcgtgaaatgttgtatacgtaggggcgaatgtcgggtttgaagcgggtggtgaaaaaggaatacgcggacggaagagtttacgtagagttagtttgatagttttggagtaggtttagggtatagatagatggcgttaaggtagatagagagggaattaaatggcgg

SEQ ID NO: 32938 - DNA, 885 bp, Artificial Sequence
  chemically treated genomic DNA (Homo sapiens) CpG-island No: 32938
ccgccatttaattccctctctatctaccttaacgccatctatctataccctaaacctactccaaaactatcaaactaactctacgtaaactcttccgtccgcgtattcctttttcaccacccgcttcaaacccgacattcgcccctacgtatacaacatttcacgacgatccaaactatcgtataataataatacgatctttcttcatactaatacgtataaacttaaacctaccgaatttaactattctatcacccgcccgtcgtctatctataacgataacgaatttccgaccgacccgtataacgatacgccaccatccgaccccgatattatcatcgtaaatataaactacgcacctatttaccactacgatcatacaccaccgccaattcgccgcgtaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaat

SEQ ID NO: 32939 - DNA, 885 bp, Artificial Sequence
  chemically treated genomic DNA (Homo sapiens) CpG-island No: 32939
tcgttatttaattttttttttgtttgttttaacgttatttgtttgtgttttgagtttgttttaagattgttaaattgattttgcgtagattttttcgttcgcgtgttttttttttattattcgttttagattcggtattcgtttttgcgtgtgtagtattttacggcggtttaggttgtcgtgtgatggtgatgcggtttttttttatattgatacgtgtagatttaagtttgtcgggtttagttgttttgttattcgttcgtcgtttgtttgtaacggtaacggattttcggtcggttcgtgtgacggtgcgttattattcggtttcggtattattatcgtaagtataagttgcgtatttgtttgttattacggttatatattatcgttagttcgtcgcgtggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggtttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagt

SEQ ID NO: 32940 - DNA, 885 bp, Artificial Sequence
  chemically treated genomic DNA (Homo sapiens) CpG-island No: 32940
actctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccacgcgacgaactaacgataatatataaccgtaataacaaacaaatacgcaacttatacttacgataataataccgaaaccgaataataacgcaccgtcacacgaaccgaccgaaaatccgttaccgttacaaacaaacgacgaacgaataacaaaacaactaaacccgacaaacttaaatctacacgtatcaatataaaaaaaaaccgcatcaccatcacacgacaacctaaaccgccgtaaaatactacacacgcaaaaacgaataccgaatctaaaacgaataataaaaaaaaaacacgcgaacgaaaaaatctacgcaaaatcaatttaacaatcttaaaacaaactcaaaacacaaacaaataacgttaaaacaaacaaaaaaaaaattaaataacga

SEQ ID NO: 32941 - DNA, 759 bp, Artificial Sequence
  chemically treated genomic DNA (Homo sapiens) CpG-island No: 32941
tggtaatcgtcgttaaaggtaaaatcgtagtcgttgcgttttgcgaaggtatcgttcgttatttttcgatggttggtcgggataataaaacgatttttatagttggtaatggcgagatagcgatatattttttcgatttgggcgacgtttaggtttatttcgtcgatggtacgagtattagtaacgttttttacggtttgtgaacgtatatagtggcgtatcgttattattcgttttagcgttcgtagtatcggatcggtatcgtcggtatttaatatattggcgagatattgtatcggaatacgtaggttttcgatggcgggtagtacgttttcgtttttcggtaaatcgttcgtatttgcgtaggattgaatcggtgatagcggaggaacgtattagattatcggtagggtgcggtatttagggtgtaacggtagtgttagtttttagtttatcgttattttgtagattggcgaacgttgggtagcgttaattatattttgtggaatattttgtttttagggttttttcgattattgagggatcgtgtggatcgaggaatatttcgtattggcggtttatagaggttaatttcgcgttcggtgttcgtcgttttttcgatgcggtcggcgtcgtaaagtagtacgtttagatatcggatgcgatttatcgtaggtttttgagtatacggtcggttgatcggatttaattcgtgggtaatagaagatgtatttttttgatttgtcgtttttttagttg

SEQ ID NO: 32942 - DNA, 759 bp, Artificial Sequence
  chemically treated genomic DNA (Homo sapiens) CpG-island No: 32942
caactaaaaaaacgacaaatcaaaaaaatacatcttctattacccacgaattaaatccgatcaaccgaccgtatactcaaaaacctacgataaatcgcatccgatatctaaacgtactactttacgacgccgaccgcatcgaaaaaacgacgaacaccgaacgcgaaattaacctctataaaccgccaatacgaaatattcctcgatccacacgatccctcaataatcgaaaaaaccctaaaaacaaaatattccacaaaatataattaacgctacccaacgttcgccaatctacaaaataacgataaactaaaaactaacactaccgttacaccctaaataccgcaccctaccgataatctaatacgttcctccgctatcaccgattcaatcctacgcaaatacgaacgatttaccgaaaaacgaaaacgtactacccgccatcgaaaacctacgtattccgatacaatatctcgccaatatattaaataccgacgataccgatccgatactacgaacgctaaaacgaataataacgatacgccactatatacgttcacaaaccgtaaaaaacgttactaatactcgtaccatcgacgaaataaacctaaacgtcgcccaaatcgaaaaaatatatcgctatctcgccattaccaactataaaaatcgttttattatcccgaccaaccatcgaaaaataacgaacgataccttcgcaaaacgcaacgactacgattttacctttaacgacgattacca

SEQ ID NO: 32943 - DNA, 759 bp, Artificial Sequence
  chemically treated genomic DNA (Homo sapiens) CpG-island No: 32943
taattggaaaagcggtaagttagaaaaatgtattttttgttatttacgaattgagttcggttaatcgatcgtgtgtttagaaatttgcgatgggtcgtattcggtatttgggcgtgttgttttacgacgtcgatcgtatcgaggaagcggcgagtatcgagcgcgaagttgatttttatgaatcgttagtgcgaagtgtttttcgatttatacgattttttagtgatcgaggaagttttggaaataaggtattttataaaatgtgattgacgttgtttagcgttcgttagtttataaaatggcgatggattggaaattggtattatcgttgtattttgaatatcgtattttgtcgatggtttggtacgttttttcgttgttatcgatttagttttacgtagatgcgggcggtttgtcgaaaagcgaaggcgtgttgttcgttatcgaaagtttgcgtatttcggtgtaatatttcgttaatatgttgagtgtcggcgatatcggttcggtattgcgggcgttgaaacggatgatggcgatgcgttattatatgcgtttataaatcgtggaaggcgttattgatattcgtgttatcgacgaagtaggtttgagcgtcgtttaggtcgaagagatgtatcgttatttcgttattgttaattatgaagatcgttttgttatttcgattagttatcgggaaatggcgggcgatgttttcgtagaacgtaacggttgcggttttatttttggcgacggttgtta

SEQ ID NO: 32944 - DNA, 759 bp, Artificial Sequence
  chemically treated genomic DNA (Homo sapiens) CpG-island No: 32944
taacaaccgtcgccaaaaataaaaccgcaaccgttacgttctacgaaaacatcgcccgccatttcccgataactaatcgaaataacaaaacgatcttcataattaacaataacgaaataacgatacatctcttcgacctaaacgacgctcaaacctacttcgtcgataacacgaatatcaataacgccttccacgatttataaacgcatataataacgcatcgccatcatccgtttcaacgcccgcaataccgaaccgatatcgccgacactcaacatattaacgaaatattacaccgaaatacgcaaactttcgataacgaacaacacgccttcgcttttcgacaaaccgcccgcatctacgtaaaactaaatcgataacaacgaaaaaacgtaccaaaccatcgacaaaatacgatattcaaaatacaacgataataccaatttccaatccatcgccattttataaactaacgaacgctaaacaacgtcaatcacattttataaaataccttatttccaaaacttcctcgatcactaaaaaatcgtataaatcgaaaaacacttcgcactaacgattcataaaaatcaacttcgcgctcgatactcgccgcttcctcgatacgatcgacgtcgtaaaacaacacgcccaaataccgaatacgacccatcgcaaatttctaaacacacgatcgattaaccgaactcaattcgtaaataacaaaaaatacatttttctaacttaccgcttttccaatta

SEQ ID NO: 32945 - DNA, 509 bp, Artificial Sequence
  chemically treated genomic DNA (Homo sapiens) CpG-island No: 32945
  misc_feature (424)..(424): n is either a, c, g or t
  misc_feature (472)..(472): n is either a, c, g or t
  misc_feature (492)..(492): n is either a, c, g or t
gcgttggagtgcgtgaaagagttcgtcgagtcggtatgtgtgattgtgaagtacgttaatttttgcggcgtggttatcggtaattttatttttgatgtttacgatcgcgcgtataaaatcgatttaattttcgtattcggcggtattattgtttttaatcgcgagttggatgcggaaatcgtataggttattatttttcgttagtttgtcgaagtgattattgcgtcgttcgttagcgaagaagttttgaaaattatcgtcgttaaatagaacgtacgcgttttgatttgcggttagtggggcgagcgtgtttcgggtttcgattttaaacgcgtgaacggcggtttgttggtttaggatcgtgatttggggatggtcggtgcggaagaattgcgcgtggtgattaaacgttagtcgagcgaantaggaaatttggcgtgattgcgtttgtttttgcgtggataggtggcgnaagtttggtgaaatttaatngttattcgtttatgtta

SEQ ID NO: 32946 - DNA, 509 bp, Artificial Sequence
  chemically treated genomic DNA (Homo sapiens) CpG-island No: 32946
  misc_feature (18)..(18): n is either a, c, g or t
  misc_feature (38)..(38): n is either a, c, g or t
  misc_feature (86)..(86): n is either a, c, g or t
taacataaacgaataacnattaaatttcaccaaacttncgccacctatccacgcaaaaacaaacgcaatcacgccaaatttcctanttcgctcgactaacgtttaatcaccacgcgcaattcttccgcaccgaccatccccaaatcacgatcctaaaccaacaaaccgccgttcacgcgtttaaaatcgaaacccgaaacacgctcgccccactaaccgcaaatcaaaacgcgtacgttctatttaacgacgataattttcaaaacttcttcgctaacgaacgacgcaataatcacttcgacaaactaacgaaaaataataacctatacgatttccgcatccaactcgcgattaaaaacaataataccgccgaatacgaaaattaaatcgattttatacgcgcgatcgtaaacatcaaaaataaaattaccgataaccacgccgcaaaaattaacgtacttcacaatcacacataccgactcgacgaactctttcacgcactccaacgc

SEQ ID NO: 32947 - DNA, 509 bp, Artificial Sequence
  chemically treated genomic DNA (Homo sapiens) CpG-island No: 32947
  misc_feature (18)..(18): n is either a, c, g or t
  misc_feature (38)..(38): n is either a, c, g or t
  misc_feature (86)..(86): n is either a, c, g or t
tggtatagacggatagtngttggattttattaaatttncgttatttgtttacgtaagaataagcgtaattacgttaagttttttgnttcgttcggttgacgtttggttattacgcgtagttttttcgtatcgattatttttaggttacgattttgaattagtagatcgtcgtttacgcgtttgaaatcgaggttcggaatacgttcgttttattgatcgtaggttagaacgcgtacgttttgtttggcggcggtgatttttagggttttttcgttggcggacggcgtaataattatttcgataaattgacgagaaatgatggtttgtgcggttttcgtatttagttcgcggttaaaggtaatgatgtcgtcgaatgcggaggttgggtcggttttgtacgcgcgatcgtaagtattaagaatggaattgtcgatagttacgtcgtaagggttggcgtgttttataattatatatgtcggttcggcgaatttttttacgtattttagcgt

SEQ ID NO: 32948 - DNA, 509 bp, Artificial Sequence
  chemically treated genomic DNA (Homo sapiens) CpG-island No: 32948
  misc_feature (424)..(424): n is either a, c, g or t
  misc_feature (472)..(472): n is either a, c, g or t
  misc_feature (492)..(492): n is either a, c, g or t
acgctaaaatacgtaaaaaaattcgccgaaccgacatatataattataaaacacgccaacccttacgacgtaactatcgacaattccattcttaatacttacgatcgcgcgtacaaaaccgacccaacctccgcattcgacgacatcattacctttaaccgcgaactaaatacgaaaaccgcacaaaccatcatttctcgtcaatttatcgaaataattattacgccgtccgccaacgaaaaaaccctaaaaatcaccgccgccaaacaaaacgtacgcgttctaacctacgatcaataaaacgaacgtattccgaacctcgatttcaaacgcgtaaacgacgatctactaattcaaaatcgtaacctaaaaataatcgatacgaaaaaactacgcgtaataaccaaacgtcaaccgaacgaancaaaaaacttaacgtaattacgcttattcttacgtaaacaaataacgnaaatttaataaaatccaacnactatccgtctatacca

SEQ ID NO: 32949 - DNA, 946 bp, Artificial Sequence
  chemically treated genomic DNA (Homo sapiens) CpG-island No: 32949
attgttatcgttcggttgcgtttttggttttagtagatggaaaaaagtttcgtttatgaggtacgtttttgttgcggttcgataagttcgcgtattaggtttattagtttcgtttacgggtgaatattatttagtacgtcgcgatagttttcgtcggtaaatattaaagtggtaggaaagcgaaagacgttaaagcgatcgtcgatggtttcgttttgtttaaggttagtaatcgttatttgttatgtatagtcgggaaattcgcgtagtaattcgttaattattatcggattatcgttgatttttggcgtgcgtttcgggttattgttaaataatattacgtcgtttggcgtttgcgtaagttagtcgttaagacggggatttattgattggcgtttagtcgcgcgttagtattcgttgttataacgtattaaatggcgtgtcgttgtttatttttgttttttttgtgttattcggtattggcgtaagcgaacgttttcgtaattttttatcgatagatagttataattgagatagcgcgatttattagtcggttgcggtataattttttacgtagtaagttgcgttagcgtcgtttgtttcgtagcgggtagttgttttcgtgttagttcgtttaggttatcgtcgtagtcgtcgagtattgcgggttgtagatcgacgagggtaatatgtgttggtagatgttcgcggatattcgtagcgttaatatttcggagaaattgttttgatgtaggtttatttttttcgcgttgagataagtcggaatgcgtttttcggtataggttcgtagcgttttaggttttagttcgtagttaatggtatcgagaattaatagatggttggcgttttcgatatattttagtaagtttagtttttgagtatcgttatcgataatttttatatattcgggttagtggtaatgggt

SEQ ID NO: 32950 - DNA, 946 bp, Artificial Sequence
  chemically treated genomic DNA (Homo sapiens) CpG-island No: 32950
acccattaccactaacccgaatatataaaaattatcgataacgatactcaaaaactaaacttactaaaatatatcgaaaacgccaaccatctattaattctcgataccattaactacgaactaaaacctaaaacgctacgaacctataccgaaaaacgcattccgacttatctcaacgcgaaaaaaataaacctacatcaaaacaatttctccgaaatattaacgctacgaatatccgcgaacatctaccaacacatattaccctcgtcgatctacaacccgcaatactcgacgactacgacgataacctaaacgaactaacacgaaaacaactacccgctacgaaacaaacgacgctaacgcaacttactacgtaaaaaattataccgcaaccgactaataaatcgcgctatctcaattataactatctatcgataaaaaattacgaaaacgttcgcttacgccaataccgaataacacaaaaaaaacaaaaataaacaacgacacgccatttaatacgttataacaacgaatactaacgcgcgactaaacgccaatcaataaatccccgtcttaacgactaacttacgcaaacgccaaacgacgtaatattatttaacaataacccgaaacgcacgccaaaaatcaacgataatccgataataattaacgaattactacgcgaatttcccgactatacataacaaataacgattactaaccttaaacaaaacgaaaccatcgacgatcgctttaacgtctttcgctttcctaccactttaatatttaccgacgaaaactatcgcgacgtactaaataatattcacccgtaaacgaaactaataaacctaatacgcgaacttatcgaaccgcaacaaaaacgtacctcataaacgaaacttttttccatctactaaaaccaaaaacgcaaccgaacgataacaat

SEQ ID NO: 32951 - DNA, 946 bp, Artificial Sequence
  chemically treated genomic DNA (Homo sapiens) CpG-island No: 32951
gtttattattattggttcgagtatgtggagattgtcgatggcggtatttagggattgaatttgttggggtatgtcgaaagcgttagttatttgttgattttcgatgttattgattacgggttggaatttggaacgttgcgaatttatgtcggagaacgtatttcggtttattttagcgcgaagaaaatgagtttgtattagaatagttttttcgaagtgttggcgttgcggatattcgcggatatttgttagtatatattgttttcgtcggtttgtaattcgtaatgttcgacgattacggcggtagtttgagcgaattggtacgggagtaattgttcgttgcggaataggcggcgttggcgtagtttgttgcgtggggaattgtgtcgtaatcggttaatgaatcgcgttgttttaattatgattgtttgtcgatggaaaattacgaaggcgttcgtttgcgttagtatcggatgatataggaggagtagggatgagtaacgatacgttatttgatgcgttgtggtaacgaatgttggcgcgcggttggacgttagttagtgaattttcgttttgacgattggtttacgtaagcgttagacggcgtggtgttatttagtagtgattcgaaacgtacgttagaggttagcgataattcggtaatgattggcgaattattgcgcgagtttttcgattatatatggtaggtggcgattgttgattttgagtagagcgaagttatcggcgatcgttttggcgtttttcgtttttttgttattttagtgtttatcggcggaaattatcgcggcgtgttgaatggtatttattcgtgggcggaattgataaatttgatgcgcgggtttgtcgaatcgtagtaggagcgtgttttatgagcgaaatttttttttatttgttggggttaggaacgtaatcgaacgatgatagt

SEQ ID NO: 32952 - DNA, 946 bp, Artificial Sequence
  chemically treated genomic DNA (Homo sapiens) CpG-island No: 32952
actatcatcgttcgattacgttcctaaccccaacaaataaaaaaaaatttcgctcataaaacacgctcctactacgattcgacaaacccgcgcatcaaatttatcaattccgcccacgaataaataccattcaacacgccgcgataatttccgccgataaacactaaaataacaaaaaaacgaaaaacgccaaaacgatcgccgataacttcgctctactcaaaatcaacaatcgccacctaccatatataatcgaaaaactcgcgcaataattcgccaatcattaccgaattatcgctaacctctaacgtacgtttcgaatcactactaaataacaccacgccgtctaacgcttacgtaaaccaatcgtcaaaacgaaaattcactaactaacgtccaaccgcgcgccaacattcgttaccacaacgcatcaaataacgtatcgttactcatccctactcctcctatatcatccgatactaacgcaaacgaacgccttcgtaattttccatcgacaaacaatcataattaaaacaacgcgattcattaaccgattacgacacaattccccacgcaacaaactacgccaacgccgcctattccgcaacgaacaattactcccgtaccaattcgctcaaactaccgccgtaatcgtcgaacattacgaattacaaaccgacgaaaacaatatatactaacaaatatccgcgaatatccgcaacgccaacacttcgaaaaaactattctaatacaaactcattttcttcgcgctaaaataaaccgaaatacgttctccgacataaattcgcaacgttccaaattccaacccgtaatcaataacatcgaaaatcaacaaataactaacgctttcgacataccccaacaaattcaatccctaaataccgccatcgacaatctccacatactcgaaccaataataataaac

SEQ ID NO: 32953 - DNA, 573 bp, Artificial Sequence
  chemically treated genomic DNA (Homo sapiens) CpG-island No: 32953
  misc_feature (2)..(2): n is either a, c, g or t
  misc_feature (251)..(251): n is either a, c, g or t
  misc_feature (274)..(274): n is either a, c, g or t
  misc_feature (288)..(288): n is either a, c, g or t
tntggttagttgtggttgtaacgtgcgattaaacgtcgaatcgcgatgacgcgttaatttttttagattaatatcgttcggttgttgttgtattaatagcgttttatcgttgtcggtataatcgttaattagtattatcggtttttgtgttagtttaatagtcgtttgaatcgcggtttggcgtagtgttttataatcgttttttattagcggataattaattttcgttgtatgtaattagttttgtatanatatgtgagcgttgatcgttatngggcgtagtagagnaatattttgcggattttgtaggtacgttgttcgttaggcgtttatgcgttgttgacgaattttattcgttattagtttatgttttagcgttagcgttgcgtttgagttttgttgtttatagtaggtgttaacggcggcgcgtttatcgttatttattaacggtagattgatagcggcgggtattgcgtcgtgtttaaattcgataggggcgcgaatattaataatgggcgtattagtaattagtagggtacgatagttttgtttcgtgtgttttttttgtatagt

SEQ ID NO: 32954 - DNA, 573 bp, Artificial Sequence
  chemically treated genomic DNA (Homo sapiens) CpG-island No: 32954
  misc_feature (286)..(286): n is either a, c, g or t
  misc_feature (300)..(300): n is either a, c, g or t
  misc_feature (323)..(323): n is either a, c, g or t
  misc_feature (572)..(572): n is either a, c, g or t
actatacaaaaaaaacacacgaaacaaaactatcgtaccctactaattactaatacgcccattattaatattcgcgcccctatcgaatttaaacacgacgcaatacccgccgctatcaatctaccgttaataaataacgataaacgcgccgccgttaacacctactataaacaacaaaactcaaacgcaacgctaacgctaaaacataaactaataacgaataaaattcgtcaacaacgcataaacgcctaacgaacaacgtacctacaaaatccgcaaaatattnctctactacgcccnataacgatcaacgctcacatatntatacaaaactaattacatacaacgaaaattaattatccgctaataaaaaacgattataaaacactacgccaaaccgcgattcaaacgactattaaactaacacaaaaaccgataatactaattaacgattataccgacaacgataaaacgctattaatacaacaacaaccgaacgatattaatctaaaaaaattaacgcgtcatcgcgattcgacgtttaatcgcacgttacaaccacaactaaccana

SEQ ID NO: 32955 - DNA, 573 bp, Artificial Sequence
  chemically treated genomic DNA (Homo sapiens) CpG-island No: 32955
  misc_feature (286)..(286): n is either a, c, g or t
  misc_feature (300)..(300): n is either a, c, g or t
  misc_feature (323)..(323): n is either a, c, g or t
  misc_feature (572)..(572): n is either a, c, g or t
attatgtaagagagatatacggaataggattatcgtgttttgttgattgttgatacgtttattattgatgttcgcgtttttatcgagtttgagtacggcgtaatgttcgtcgttattaatttgtcgttaatgaataacgatgaacgcgtcgtcgttggtatttgttataaatagtaaggtttagacgtagcgttggcgttgggatataaattggtggcgggtgaaattcgttagtagcgtatggacgtttggcgggtagcgtgtttgtaaaattcgtaaggtattnttttgttgcgtttngtggcggttagcgtttatatatntgtgtaaagttggttgtatgtagcggggattgattattcgttggtggaaggcggttataaggtattgcgttagatcgcgatttaggcgattattgaattggtataaaaatcgatagtgttgattggcggttgtatcggtagcggtaaaacgttgttagtgtagtaatagtcgaacggtgttgatttggaagggttggcgcgttatcgcggttcggcgtttggtcgtacgttataattataattagttang

SEQ ID NO: 32956 - DNA, 573 bp, Artificial Sequence
  chemically treated genomic DNA (Homo sapiens) CpG-island No: 32956
  misc_feature (2)..(2): n is either a, c, g or t
  misc_feature (251)..(251): n is either a, c, g or t
  misc_feature (274)..(274): n is either a, c, g or t
  misc_feature (288)..(288): n is either a, c, g or t
cntaactaattataattataacgtacgaccaaacgccgaaccgcgataacgcgccaacccttccaaatcaacaccgttcgactattactacactaacaacgttttaccgctaccgatacaaccgccaatcaacactatcgatttttataccaattcaataatcgcctaaatcgcgatctaacgcaataccttataaccgccttccaccaacgaataatcaatccccgctacatacaaccaactttacacanatatataaacgctaaccgccacnaaacgcaacaaaanaataccttacgaattttacaaacacgctacccgccaaacgtccatacgctactaacgaatttcacccgccaccaatttatatcccaacgccaacgctacgtctaaaccttactatttataacaaataccaacgacgacgcgttcatcgttattcattaacgacaaattaataacgacgaacattacgccgtactcaaactcgataaaaacgcgaacatcaataataaacgtatcaacaatcaacaaaacacgataatcctattccgtatatctctcttacataat

SEQ ID NO: 32957 - DNA, 749 bp, Artificial Sequence
  chemically treated genomic DNA (Homo sapiens) CpG-island No: 32957
gcgattaatgtcggagtgtttgtagtcgttaacgggtatttttgtcggggattcgttttaggtgttgatttagtaaatattcgtttttagttgatgaatgacgcgatgcgcgcggtttaggttcgttgttacgatgttcgtcgttaggtcgtagtcggtatcgttagcgcggcgaatgatttcgtttttcgattcgtaggttagaatggatattattggttcgaagatttttttacgtacgatggttatatcgtcgttgtaatcggtgaatattgtcggtgtaatttatgcgtcgttatcgaagttatcgttttttagtatatcgtcgtcgtatagtacgcgcgcgtttttttttttgtttttggcgatatagcgtagtacgttatcgcgatgcgggaagttgattagcgggtcgaagttagtttgcggatcgaaaacgtcgttcgcgcgaatgcgtttaacgcgcgttagaattttttgtttaaatgcggttttgtatttcgtcggaacgaagacgcgggtgttattggtatatatttgatcggagttgaagaagtttgttattatggcgatatcggcggcgagatcgagattcgtattatcgaaaacgattagcggtgatttatcgtttagttttatggttattttttttagggaagaggtcgtcgagttagttattatttttttgtcgttggcgatatcgtcggtaaatgatattttggtaatgttcggatgtttcggttagatat

SEQ ID NO: 32958 - DNA, 749 bp, Artificial Sequence
  chemically treated genomic DNA (Homo sapiens) CpG-island No: 32958
atatctaaccgaaacatccgaacattaccaaaatatcatttaccgacgatatcgccaacgacaaaaaaataataactaactcgacgacctcttccctaaaaaaaataaccataaaactaaacgataaatcaccgctaatcgttttcgataatacgaatctcgatctcgccgccgatatcgccataataacaaacttcttcaactccgatcaaatatataccaataacacccgcgtcttcgttccgacgaaatacaaaaccgcatttaaacaaaaaattctaacgcgcgttaaacgcattcgcgcgaacgacgttttcgatccgcaaactaacttcgacccgctaatcaacttcccgcatcgcgataacgtactacgctatatcgccaaaaacaaaaaaaaaaacgcgcgcgtactatacgacgacgatatactaaaaaacgataacttcgataacgacgcataaattacaccgacaatattcaccgattacaacgacgatataaccatcgtacgtaaaaaaatcttcgaaccaataatatccattctaacctacgaatcgaaaaacgaaatcattcgccgcgctaacgataccgactacgacctaacgacgaacatcgtaacaacgaacctaaaccgcgcgcatcgcgtcattcatcaactaaaaacgaatatttactaaatcaacacctaaaacgaatccccgacaaaaatacccgttaacgactacaaacactccgacattaatcgc

SEQ ID NO: 32959 - DNA, 749 bp, Artificial Sequence
  chemically treated genomic DNA (Homo sapiens) CpG-island No: 32959
atatttgatcgagatattcgggtattgttaaagtgttatttatcggcggtgtcgttagcggtaaaaaagtgatggttaattcggcggttttttttttgaaagaagtgattatggaattgggcggtaaattatcgttgatcgttttcgatgatgcggatttcgatttcgtcgtcgatatcgttatgatggtaaatttttttagtttcggttaggtgtgtattaatggtattcgcgttttcgtttcggcgaaatgtaaagtcgtatttgagtagaaaattttggcgcgcgttgagcgtattcgcgcgggcgacgttttcgattcgtaaattaatttcggttcgttggttagtttttcgtatcgcgataacgtgttgcgttatatcgttaaaggtaaagaggaaggcgcgcgcgtattgtgcggcggcgatgtattgaaaggcgatggtttcgataacggcgtatgggttgtatcgatagtgtttatcgattgtagcgacgatatgattatcgtgcgtgaagagattttcgggttagtgatgtttattttgatttacgagtcggaagacgaagttattcgtcgcgttaacgatatcgattacggtttggcggcgggtatcgtgatagcggatttgaatcgcgcgtatcgcgttatttattagttggaagcgggtatttgttggattaatatttggggcgaattttcggtagagatgttcgttggcggttataaatatttcggtattggtcgt

SEQ ID NO: 32960 - DNA, 749 bp, Artificial Sequence
  chemically treated genomic DNA (Homo sapiens) CpG-island No: 32960
acgaccaataccgaaatatttataaccgccaacgaacatctctaccgaaaattcgccccaaatattaatccaacaaatacccgcttccaactaataaataacgcgatacgcgcgattcaaatccgctatcacgatacccgccgccaaaccgtaatcgatatcgttaacgcgacgaataacttcgtcttccgactcgtaaatcaaaataaacatcactaacccgaaaatctcttcacgcacgataatcatatcgtcgctacaatcgataaacactatcgatacaacccatacgccgttatcgaaaccatcgcctttcaatacatcgccgccgcacaatacgcgcgcgccttcctctttacctttaacgatataacgcaacacgttatcgcgatacgaaaaactaaccaacgaaccgaaattaatttacgaatcgaaaacgtcgcccgcgcgaatacgctcaacgcgcgccaaaattttctactcaaatacgactttacatttcgccgaaacgaaaacgcgaataccattaatacacacctaaccgaaactaaaaaaatttaccatcataacgatatcgacgacgaaatcgaaatccgcatcatcgaaaacgatcaacgataatttaccgcccaattccataatcacttctttcaaaaaaaaaaccgccgaattaaccatcacttttttaccgctaacgacaccgccgataaataacactttaacaatacccgaatatctcgatcaaatat

SEQ ID NO: 32961 - DNA, 762 bp, Artificial Sequence
  chemically treated genomic DNA (Homo sapiens) CpG-island No: 32961
tttacggttagtaatatgtttggttgtagcgtcgtggtgtttcgcggtgaaaaacgcggatttttatgaattttaatgtcgatgcgtgatcggtgttatgatcgaaatagtcgttataatttgtttttgtaatgattcggcgcgcggtatcgttaatttgttggtagcgtacgtcggggcgaatcgcggagattgttgcgagttgtgtttgtaggataatttgatagacgttaaatagtaggtgagattcggcgtttattttttcgttatttattagtaaggtgcgcgttatattagagtagtagttttgatatagcgtatcgaaatcgagagtgataaattcgttcgttgtaataattttgtcgttgttttgtcgtgcggtagcgttttacgttagttattggcgataatggtgttaaagaggttttttttgcgttttgttggcgtataaattattttagtttagcggttatttcgcgttcgtttattttcgtttgaataaagcggcgaatatgttttgtatcgcgattagtaattttataggcgaggcggattttttttattttttttggcgttttgatttgtcgtagtatattcggcgtggcgttaattagtttcgtattgagtttagattgttagcggtgcgcggttttttaatttatttgttggtttttaaaatcgagcgtttgtaattgtttatcggtaatgatttgattgacgatagtggtaagcgtgttcgtcgcgttaagtaaatgtagttgg

SEQ ID NO: 32962 - DNA, 762 bp, Artificial Sequence
  chemically treated genomic DNA (Homo sapiens) CpG-island No: 32962
ccaactacatttacttaacgcgacgaacacgcttaccactatcgtcaatcaaatcattaccgataaacaattacaaacgctcgattttaaaaaccaacaaataaattaaaaaaccgcgcaccgctaacaatctaaactcaatacgaaactaattaacgccacgccgaatatactacgacaaatcaaaacgccaaaaaaaataaaaaaaatccgcctcgcctataaaattactaatcgcgatacaaaacatattcgccgctttattcaaacgaaaataaacgaacgcgaaataaccgctaaactaaaataatttatacgccaacaaaacgcaaaaaaaacctctttaacaccattatcgccaataactaacgtaaaacgctaccgcacgacaaaacaacgacaaaattattacaacgaacgaatttatcactctcgatttcgatacgctatatcaaaactactactctaatataacgcgcaccttactaataaataacgaaaaaataaacgccgaatctcacctactatttaacgtctatcaaattatcctacaaacacaactcgcaacaatctccgcgattcgccccgacgtacgctaccaacaaattaacgataccgcgcgccgaatcattacaaaaacaaattataacgactatttcgatcataacaccgatcacgcatcgacattaaaattcataaaaatccgcgtttttcaccgcgaaacaccacgacgctacaaccaaacatattactaaccgtaaa

SEQ ID NO: 32963 - DNA, 762 bp, Artificial Sequence
  chemically treated genomic DNA (Homo sapiens) CpG-island No: 32963
ttagttgtatttgtttgacgcgacgaatacgtttattattatcgttaattaaattattgtcgatgaatagttgtaaacgttcggttttgagggttagtaggtgagttgggaaatcgcgtatcgttggtagtttgaatttaatgcgaaattggttagcgttacgtcggatgtgttgcggtaaattaaaacgttagaggaggtggagaaaattcgtttcgtttgtgggattgttgatcgcggtgtagagtatattcgtcgttttatttaggcggggatgagcgagcgcgagatagtcgttgaattggagtggtttatgcgttagtagggcgtagaaaaagtttttttgatattattgtcgttagtggttggcgtggggcgttgtcgtacggtaaagtagcgataagattgttgtagcgggcgagtttgttattttcgatttcggtgcgttgtattagggttattgttttgatatgacgcgtattttgttggtgaatggcgaaggggtgagcgtcgaattttatttgttgtttaacgtttattaaattgttttgtaggtatagttcgtagtaattttcgcgattcgtttcggcgtgcgttgttagtaggttgacgatgtcgcgcgtcgggttattatagaagtaggttatggcgattatttcggttataatatcggttacgtatcggtattgaagtttatgaagattcgcgttttttatcgcgggatattacgacgttatagttaggtatgttattgatcgtgga

SEQ ID NO: 32964 - DNA, 762 bp, Artificial Sequence
  chemically treated genomic DNA (Homo sapiens) CpG-island No: 32964
tccacgatcaataacatacctaactataacgtcgtaatatcccgcgataaaaaacgcgaatcttcataaacttcaataccgatacgtaaccgatattataaccgaaataatcgccataacctacttctataataacccgacgcgcgacatcgtcaacctactaacaacgcacgccgaaacgaatcgcgaaaattactacgaactatacctacaaaacaatttaataaacgttaaacaacaaataaaattcgacgctcaccccttcgccattcaccaacaaaatacgcgtcatatcaaaacaataaccctaatacaacgcaccgaaatcgaaaataacaaactcgcccgctacaacaatcttatcgctactttaccgtacgacaacgccccacgccaaccactaacgacaataatatcaaaaaaactttttctacgccctactaacgcataaaccactccaattcaacgactatctcgcgctcgctcatccccgcctaaataaaacgacgaatatactctacaccgcgatcaacaatcccacaaacgaaacgaattttctccacctcctctaacgttttaatttaccgcaacacatccgacgtaacgctaaccaatttcgcattaaattcaaactaccaacgatacgcgatttcccaactcacctactaaccctcaaaaccgaacgtttacaactattcatcgacaataatttaattaacgataataataaacgtattcgtcgcgtcaaacaaatacaactaa

SEQ ID NO: 32965 - DNA, 987 bp, Artificial Sequence
  chemically treated genomic DNA (Homo sapiens) CpG-island No: 32965
tgatgtgtgggttcgtggttaggtgtcgtgtcgtttaatttgtcgcggttattatcgtttagtttcgatagtttattatcggtgaagcgatggcgattggcgagtcgtgcgttcggttgcgttgttggatttcgtcgttttttgttcgtttggcggtcggtgaatgcgttaatttaatatcgttcgtaatttataaattggcgatattaaacgtattaaatttttcgttaattggatggcgtgcggtaggttattttttggtgaagatgcgggtttgtatgaagtcgttaaattcgtgggtcgaagagttttgttcggcgttgggtttgacgatttcggtgggtaaagatttttatgtcgatgaaaatttgttgttaggaaggtaacgaagagcgcgaaatgacgtcgtcgttgtcgttggtgatttttgtatttgttcgcgtggaagatgtacgttatattattacgtcgtagttttttatcgaagataacgtattgttgttgattgatttgggtaaaggtaataacgcgttgggcgtaacggcgttggcgtaggtttatcgttagtttggcgataatcggtagatgtcgcgatgttcgtaattaaaggtttttatacgcgatttaggcgttggttgtatagcgtaagttgttggcgtattacgatcgttttgatggcggtttgttggtaacgttgcggaaatggtttttgttggttattgtggtattgacgcggattcgttattttgggtgacgatcgtttggcggcgttgtttaacgaagaattgggtgcggtgatttaggttcgtgtcgttatcgtgaagcggtcgagttcgtattggtatagtatgggtttgttgattgtgtttattatgtaggtaggcggttttcggtgatcgttttgtgattatcgttacgggtagattgtatttagcgaaagtcgtattacgttgcgtgtttggtgggtagaaaattatttggtagatg

SEQ ID NO: 32966 - DNA, 987 bp, Artificial Sequence
  chemically treated genomic DNA (Homo sapiens) CpG-island No: 32966
catctaccaaataattttctacccaccaaacacgcaacgtaatacgactttcgctaaatacaatctacccgtaacgataatcacaaaacgatcaccgaaaaccgcctacctacataataaacacaatcaacaaacccatactataccaatacgaactcgaccgcttcacgataacgacacgaacctaaatcaccgcacccaattcttcgttaaacaacgccgccaaacgatcgtcacccaaaataacgaatccgcgtcaataccacaataaccaacaaaaaccatttccgcaacgttaccaacaaaccgccatcaaaacgatcgtaatacgccaacaacttacgctatacaaccaacgcctaaatcgcgtataaaaacctttaattacgaacatcgcgacatctaccgattatcgccaaactaacgataaacctacgccaacgccgttacgcccaacgcgttattacctttacccaaatcaatcaacaacaatacgttatcttcgataaaaaactacgacgtaataatataacgtacatcttccacgcgaacaaatacaaaaatcaccaacgacaacgacgacgtcatttcgcgctcttcgttaccttcctaacaacaaattttcatcgacataaaaatctttacccaccgaaatcgtcaaacccaacgccgaacaaaactcttcgacccacgaatttaacgacttcatacaaacccgcatcttcaccaaaaaataacctaccgcacgccatccaattaacgaaaaatttaatacgtttaatatcgccaatttataaattacgaacgatattaaattaacgcattcaccgaccgccaaacgaacaaaaaacgacgaaatccaacaacgcaaccgaacgcacgactcgccaatcgccatcgcttcaccgataataaactatcgaaactaaacgataataaccgcgacaaattaaacgacacgacacctaaccacgaacccacacatca

SEQ ID NO: 32967 - DNA, 987 bp, Artificial Sequence
  chemically treated genomic DNA (Homo sapiens) CpG-island No: 32967
tatttgttaggtagttttttgtttattagatacgtaacgtggtgcggttttcgttgaatatagtttgttcgtggcggtaattataaaacggttatcggaaatcgtttgtttatataatggatataattagtaagtttatgttgtgttagtacggattcgatcgttttacggtagcggtacgaatttgaattatcgtatttagtttttcgttaaataacgtcgttaggcgatcgttatttagagtggcgaattcgcgttaatgttataatgattagtaaaggttattttcgtagcgttattagtaggtcgttattagagcggtcgtgatacgttagtagtttacgttgtgtaattagcgtttgaatcgcgtatagaagtttttagttgcggatatcgcgatatttgtcggttgtcgttaagttgacgataaatttgcgttagcgtcgttgcgtttagcgcgttattgtttttgtttaaattaattagtagtagtgcgttattttcggtagaaagttgcggcgtgatggtgtgacgtatattttttacgcgggtaaatgtagaaattattagcgatagcggcgacgttatttcgcgtttttcgttatttttttgatagtaggtttttatcgatatggagatttttatttatcgggatcgttaggtttagcgtcggataaagtttttcgatttacggatttaacggttttatataggttcgtatttttattagaggatggtttgtcgtacgttatttagttggcggaaagtttgatgcgtttgatatcgttaatttgtaggttgcgagcgatgttaggttaacgtatttatcgatcgttagacgggtagagagcggcgaaatttagtagcgtaatcggacgtacgattcgttaatcgttatcgttttatcgatagtagattgtcgaggttggacggtagtgatcgcgatagattaagcgatacggtatttgattacggatttatatatta

SEQ ID NO: 32968 - DNA, 987 bp, Artificial Sequence
  chemically treated genomic DNA (Homo sapiens) CpG-island No: 32968
taatatataaatccgtaatcaaataccgtatcgcttaatctatcgcgatcactaccgtccaacctcgacaatctactatcgataaaacgataacgattaacgaatcgtacgtccgattacgctactaaatttcgccgctctctacccgtctaacgatcgataaatacgttaacctaacatcgctcgcaacctacaaattaacgatatcaaacgcatcaaactttccgccaactaaataacgtacgacaaaccatcctctaataaaaatacgaacctatataaaaccgttaaatccgtaaatcgaaaaactttatccgacgctaaacctaacgatcccgataaataaaaatctccatatcgataaaaacctactatcaaaaaaataacgaaaaacgcgaaataacgtcgccgctatcgctaataatttctacatttacccgcgtaaaaaatatacgtcacaccatcacgccgcaactttctaccgaaaataacgcactactactaattaatttaaacaaaaacaataacgcgctaaacgcaacgacgctaacgcaaatttatcgtcaacttaacgacaaccgacaaatatcgcgatatccgcaactaaaaacttctatacgcgattcaaacgctaattacacaacgtaaactactaacgtatcacgaccgctctaataacgacctactaataacgctacgaaaataacctttactaatcattataacattaacgcgaattcgccactctaaataacgatcgcctaacgacgttatttaacgaaaaactaaatacgataattcaaattcgtaccgctaccgtaaaacgatcgaatccgtactaacacaacataaacttactaattatatccattatataaacaaacgatttccgataaccgttttataattaccgccacgaacaaactatattcaacgaaaaccgcaccacgttacgtatctaataaacaaaaaactacctaacaaata

SEQ ID NO: 32969 - DNA, 610 bp, Artificial Sequence
  chemically treated genomic DNA (Homo sapiens) CpG-island No: 32969
gtacggcgggtaggcgtaggcgaagttcgacgaatattaatcggtgtttatgttagtcggcgcgttttgttcgtcgttggaaaaataattggcgatgcgttggcggatgggcgtgcgtaatagtgtatatattttggcgaaattggcgacgttatttgtcgaaggtgaggcgttgcgtttttttagcgtttcgtattcggaatatattggacgcgtcgcgaagttttttagcgatatcggcgggcgggcgttattaatgtatggtattgaaggtgaagtgtatgttaattcgtagcgttgttcgtagattaattttattgatcgtgaagggatgcgggtgttgtatgaaaaataggatattgttggtagcgagttattgttataagtaaaagattcggaaattacggcgtagtggattgagcgttgttttgttggtagcgaatcgattttcgaatcgttgaaaatttagatggtttgttgtttggtggttacgggtgaagcggtaattattagcgacggtttggcgcgcgttaattaggtattttaattttttttttagtcggatgagttatgttattcggtttttattttatcgtaatatgaaattttt

SEQ ID NO: 32970 - DNA, 610 bp, Artificial Sequence
  chemically treated genomic DNA (Homo sapiens) CpG-island No: 32970
aaaaatttcatattacgataaaataaaaaccgaataacataactcatccgactaaaaaaaaaattaaaatacctaattaacgcgcgccaaaccgtcgctaataattaccgcttcacccgtaaccaccaaacaacaaaccatctaaattttcaacgattcgaaaatcgattcgctaccaacaaaacaacgctcaatccactacgccgtaatttccgaatcttttacttataacaataactcgctaccaacaatatcctatttttcatacaacacccgcatcccttcacgatcaataaaattaatctacgaacaacgctacgaattaacatacacttcaccttcaataccatacattaataacgcccgcccgccgatatcgctaaaaaacttcgcgacgcgtccaatatattccgaatacgaaacgctaaaaaaacgcaacgcctcaccttcgacaaataacgtcgccaatttcgccaaaatatatacactattacgcacgcccatccgccaacgcatcgccaattatttttccaacgacgaacaaaacgcgccgactaacataaacaccgattaatattcgtcgaacttcgcctacgcctacccgccgtac

SEQ ID NO: 32971 - DNA, 610 bp, Artificial Sequence
  chemically treated genomic DNA (Homo sapiens) CpG-island No: 32971
aggaattttatattgcggtggggtaaaagtcggatgatatggtttattcggttgagaaaagaattaaaatgtttgattaacgcgcgttaggtcgtcgttgatagttgtcgttttattcgtagttattaggtagtaagttatttggatttttagcgattcgggaatcggttcgttgttagtaaggtaacgtttaatttattgcgtcgtggttttcggattttttgtttgtggtagtaattcgttattagtagtgttttgttttttatatagtattcgtatttttttacggttaatgagattgatttgcgggtagcgttgcggattagtatatattttatttttagtattatgtattagtagcgttcgttcgtcgatatcgttaaagaatttcgcgacgcgtttaatgtatttcggatgcgaaacgttggaaagacgtagcgttttattttcggtaaatggcgtcgttagtttcgttagggtatgtgtattgttacgtacgtttattcgttagcgtatcgttagttgtttttttagcggcgggtaaaacgcgtcgattggtataaatatcggttgatgttcgtcgagtttcgtttgcgtttgttcgtcgtgt

SEQ ID NO: 32972 - DNA, 610 bp, Artificial Sequence
  chemically treated genomic DNA (Homo sapiens) CpG-island No: 32972
acacgacgaacaaacgcaaacgaaactcgacgaacatcaaccgatatttataccaatcgacgcgttttacccgccgctaaaaaaacaactaacgatacgctaacgaataaacgtacgtaacaatacacataccctaacgaaactaacgacgccatttaccgaaaataaaacgctacgtctttccaacgtttcgcatccgaaatacattaaacgcgtcgcgaaattctttaacgatatcgacgaacgaacgctactaatacataatactaaaaataaaatatatactaatccgcaacgctacccgcaaatcaatctcattaaccgtaaaaaaatacgaatactatataaaaaacaaaacactactaataacgaattactaccacaaacaaaaaatccgaaaaccacgacgcaataaattaaacgttaccttactaacaacgaaccgattcccgaatcgctaaaaatccaaataacttactacctaataactacgaataaaacgacaactatcaacgacgacctaacgcgcgttaatcaaacattttaattcttttctcaaccgaataaaccatatcatccgacttttaccccaccgcaatataaaattcct

SEQ ID NO: 32973 - DNA, 648 bp, Artificial Sequence
  chemically treated genomic DNA (Homo sapiens) CpG-island No: 32973
gtgtgggcgtcgttagggaagtatcgataagtatatagagagggggtcgtgtgggcgtcgttagggaagtgcggataagtatatagagagggggtcgtgtgggcgtcgttagggaagtatcgataagtatatagagagggggtcgtgtgggcgtcgttagggaagtatcgataagtatattggagaggggttcgcgtgggttttattagggaagtatcgataagtatacggagaggggttcgcgtgggtttcgttagggaagtatcgataagtatacggagaggggttcgcgtgggcgtcgttagggaagtatcgataagtatatagagaggggttcgtgtgggcgtcgttagggaagtgcggataagtatacggagaggggttcgcgtgggcgtcgttagggaagtatcgataagtatatagagagggggtcgtgtgggcgtcgttagggaagtgcggataagtatattggagaggggttcgcgtgggtttcgttagggaagtatcgataagtatatagagagggggtcgcgtgggcgtcgttagggaagtgcggataagtatacggagagggggtcgcgtgggcgtcgttagggaagtgtagatggaaattatagcgaggtttttgtatattttttagggggttta

SEQ ID NO: 32974 - DNA, 648 bp, Artificial Sequence
  chemically treated genomic DNA (Homo sapiens) CpG-island No: 32974
taaaccccctaaaaaatatacaaaaacctcgctataatttccatctacacttccctaacgacgcccacgcgaccccctctccgtatacttatccgcacttccctaacgacgcccacgcgaccccctctctatatacttatcgatacttccctaacgaaacccacgcgaacccctctccaatatacttatccgcacttccctaacgacgcccacacgaccccctctctatatacttatcgatacttccctaacgacgcccacgcgaacccctctccgtatacttatccgcacttccctaacgacgcccacacgaacccctctctatatacttatcgatacttccctaacgacgcccacgcgaacccctctccgtatacttatcgatacttccctaacgaaacccacgcgaacccctctccgtatacttatcgatacttccctaataaaacccacgcgaacccctctccaatatacttatcgatacttccctaacgacgcccacacgaccccctctctatatacttatcgatacttccctaacgacgcccacacgaccccctctctatatacttatccgcacttccctaacgacgcccacacgaccccctctctatatacttatcgatacttccctaacgacgcccacac

SEQ ID NO: 32975 - DNA, 648 bp, Artificial Sequence
  chemically treated genomic DNA (Homo sapiens) CpG-island No: 32975
tgagttttttggagagtgtgtaggggtttcgttgtggtttttatttgtatttttttgacggcgtttacgcggtttttttttcgtgtgtttgttcgtatttttttgacggcgtttacgcggttttttttttgtgtgtttgtcggtatttttttgacgaggtttacgcggatttttttttagtgtgtttgttcgtatttttttgacggcgtttatacggttttttttttgtgtgtttgtcggtatttttttgacggcgtttacgcggattttttttcgtgtgtttgttcgtatttttttgacggcgtttatacggatttttttttgtgtgtttgtcggtatttttttgacggcgtttacgcggattttttttcgtgtgtttgtcggtatttttttgacggggtttacgcggattttttttcgtgtgtttgtcggtatttttttgatggggtttacgcggatttttttttagtgtgtttgtcggtatttttttgacggcgtttatacggttttttttttgtgtgtttgtcggtatttttttgacggcgtttatacggttttttttttgtgtgtttgttcgtatttttttgacggcgtttatacggttttttttttgtgtgtttgtcggtatttttttgacggcgtttatat

SEQ ID NO: 32976 - DNA, 648 bp, Artificial Sequence
  chemically treated genomic DNA (Homo sapiens) CpG-island No: 32976
atataaacgccgtcaaaaaaataccgacaaacacacaaaaaaaaaaccgtataaacgccgtcaaaaaaatacgaacaaacacacaaaaaaaaaaccgtataaacgccgtcaaaaaaataccgacaaacacacaaaaaaaaaaccgtataaacgccgtcaaaaaaataccgacaaacacactaaaaaaaaatccgcgtaaaccccatcaaaaaaataccgacaaacacacgaaaaaaaatccgcgtaaaccccgtcaaaaaaataccgacaaacacacgaaaaaaaatccgcgtaaacgccgtcaaaaaaataccgacaaacacacaaaaaaaaatccgtataaacgccgtcaaaaaaatacgaacaaacacacgaaaaaaaatccgcgtaaacgccgtcaaaaaaataccgacaaacacacaaaaaaaaaaccgtataaacgccgtcaaaaaaatacgaacaaacacactaaaaaaaaatccgcgtaaacctcgtcaaaaaaataccgacaaacacacaaaaaaaaaaccgcgtaaacgccgtcaaaaaaatacgaacaaacacacgaaaaaaaaaccgcgtaaacgccgtcaaaaaaatacaaataaaaaccacaacgaaacccctacacactctccaaaaaactca

SEQ ID NO: 32977 - DNA, 844 bp, Artificial Sequence
  chemically treated genomic DNA (Homo sapiens) CpG-island No: 32977
ttggcgcggtcgacggtgattttcgttcgcggtttttgtaaagttttttcgtcgcgttttcgtatcgagttcgtagcgtcgaatttcgggtattttaattcgggggtttagggacgcgtagggcggttcgggaatgtggttcgggggagcgcggggggtaggggttgcggcgtaggtggttgttggggttgacgggtttagttttcgttttcgggtgtttttcgcgtcgcgttcgtaggatcgagtttcgcgttcgtttattttggagacgtagtaattgtagcggaggttttttcggcgattcggtcgcgcgcgattaagtgtttagcgtagcgttttttttgtcgtttcgtttcgtttttagtttcgtttttagcgtttcgcgttcgtttttcgtgtttattggtagtttcgttttcgtcgttttattaggttcggagtatgcgcgggcgtattgagattttagttttataagatcggtttcgttgaggtttcgtcggtcgttaggtattcgtttagcgtagggcgcggcggatttgcgggtcgtgggaatcgttgggtagtggtagcgaggttttttatttgtttttggggtttttcggggacgatcggatttcgatttttgcgtttcgtaggacgcgcgttgacggtgcggcgggggatggatgagcgcggtcgcggttttttggggtggggtgggttggcggcggggtttcgaggatagtgcggggcgagtttcgatcgcgtttagttttttaaggagtcgtagacggtgtagggaagcggtagggtcgggttgtgagggtgttcggattttaaggcggggcgtatttaggggattggg

SEQ ID NO: 32978 - DNA, 844 bp, Artificial Sequence
  chemically treated genomic DNA (Homo sapiens) CpG-island No: 32978
cccaatcccctaaatacgccccgccttaaaatccgaacaccctcacaacccgaccctaccgcttccctacaccgtctacgactccttaaaaaactaaacgcgatcgaaactcgccccgcactatcctcgaaaccccgccgccaacccaccccaccccaaaaaaccgcgaccgcgctcatccatcccccgccgcaccgtcaacgcgcgtcctacgaaacgcaaaaatcgaaatccgatcgtccccgaaaaaccccaaaaacaaataaaaaacctcgctaccactacccaacgattcccacgacccgcaaatccgccgcgccctacgctaaacgaatacctaacgaccgacgaaacctcaacgaaaccgatcttataaaactaaaatctcaatacgcccgcgcatactccgaacctaataaaacgacgaaaacgaaactaccaataaacacgaaaaacgaacgcgaaacgctaaaaacgaaactaaaaacgaaacgaaacgacaaaaaaaacgctacgctaaacacttaatcgcgcgcgaccgaatcgccgaaaaaacctccgctacaattactacgtctccaaaataaacgaacgcgaaactcgatcctacgaacgcgacgcgaaaaacacccgaaaacgaaaactaaacccgtcaaccccaacaaccacctacgccgcaacccctaccccccgcgctcccccgaaccacattcccgaaccgccctacgcgtccctaaacccccgaattaaaatacccgaaattcgacgctacgaactcgatacgaaaacgcgacgaaaaaactttacaaaaaccgcgaacgaaaatcaccgtcgaccgcgccaa

SEQ ID NO: 32979 - DNA, 844 bp, Artificial Sequence
  chemically treated genomic DNA (Homo sapiens) CpG-island No: 32979
tttagttttttgggtgcgtttcgttttggggttcgagtatttttatagttcggttttgtcgtttttttgtatcgtttgcggttttttaaagaattgggcgcggtcggggttcgtttcgtattgttttcgaggtttcgtcgttaatttattttattttaggaggtcgcggtcgcgtttatttatttttcgtcgtatcgttaacgcgcgttttgcggggcgtagagatcggggttcggtcgttttcggggggttttagagataggtgaggggtttcgttgttattgtttagcggtttttacggttcgtaggttcgtcgcgttttgcgttgagcggatatttggcggtcggcggagttttagcggagtcggttttgtaaggttgaggttttagtgcgttcgcgtatgtttcgggtttggtggggcggcgggggcggggttgttaatgaatacgaggggcgggcgcgggacgttgggggcggggttgggggcggggcggggcggtagggggagcgttgcgttgagtatttggtcgcgcgcggtcgggtcgtcgggggagttttcgttgtagttgttgcgtttttaaggtaagcgggcgcggggttcggttttgcgggcgcggcgcggggggtattcgggggcggagattgggttcgttagttttagtagttatttgcgtcgtagtttttgtttttcgcgttttttcgagttatattttcgggtcgttttgcgcgtttttgagttttcggattgggatgttcggagttcggcgttgcgggttcggtgcgaggacgcgacggggaggttttgtaaaggtcgcgagcgggggttatcgtcggtcgcgttag

SEQ ID NO: 32980 - DNA, 844 bp, Artificial Sequence
  chemically treated genomic DNA (Homo sapiens) CpG-island No: 32980
ctaacgcgaccgacgataacccccgctcgcgacctttacaaaacctccccgtcgcgtcctcgcaccgaacccgcaacgccgaactccgaacatcccaatccgaaaactcaaaaacgcgcaaaacgacccgaaaatataactcgaaaaaacgcgaaaaacaaaaactacgacgcaaataactactaaaactaacgaacccaatctccgcccccgaataccccccgcgccgcgcccgcaaaaccgaaccccgcgcccgcttaccttaaaaacgcaacaactacaacgaaaactcccccgacgacccgaccgcgcgcgaccaaatactcaacgcaacgctccccctaccgccccgccccgcccccaaccccgcccccaacgtcccgcgcccgcccctcgtattcattaacaaccccgcccccgccgccccaccaaacccgaaacatacgcgaacgcactaaaacctcaaccttacaaaaccgactccgctaaaactccgccgaccgccaaatatccgctcaacgcaaaacgcgacgaacctacgaaccgtaaaaaccgctaaacaataacaacgaaacccctcacctatctctaaaaccccccgaaaacgaccgaaccccgatctctacgccccgcaaaacgcgcgttaacgatacgacgaaaaataaataaacgcgaccgcgacctcctaaaataaaataaattaacgacgaaacctcgaaaacaatacgaaacgaaccccgaccgcgcccaattctttaaaaaaccgcaaacgatacaaaaaaacgacaaaaccgaactataaaaatactcgaaccccaaaacgaaacgcacccaaaaaactaaa

SEQ ID NO: 32981 - DNA, 1007 bp, Artificial Sequence
  chemically treated genomic DNA (Homo sapiens) CpG-island No: 32981
aattgggcgcggtcggggttcgtttcgtattgttttcgaggtttcgtcgttaatttattttattttaggaggtcgcggtcgcgttatttatttttcgtcgtatcgttaacgcgcgtttgcggggcgtagagatcggggttcggtcgttttcggggggttttagagttaggtgaggggttttcgtcgttttttgtttagcggtttttacgattcgcgggtcggttcgcgttttgcgttgagcggatattcggcggttcgcggggtttgagtagagtcggttttgtaaggtagaggtttcggtgcgttcgcgcgttttcgggtcgggtggggcggcgggggcggggttgttaatgagcgcgcggggcgggacgttgggcgggcgtcggacgttgggggtcgggggcgggttcgggatcgggttgggcggggttgggcggtgttgggcgggacgggcgggcgcggggcggcggttggagagtttcgttgagtatcgggtcgcgcgcggtcgagtcgcggaggcgttttcgttgtagtcgttgcgtttttaaggtaagcgggcgcggggttcggtttcgcgggcgcggcgcggggggtattcgggggcggagattgggttcgttagttttagtagttatttgcgtcgtagtttttgtttttcgcgttttttcgagtttttttttcggatcgtttcgcgcgtttttgagttttcggattgggatgttcggagttcggcgttgcgggttcggtgcgaggacgcgacggggaggttttgtaaaggtcgcgagcgggggttatcgtcggtcgcgttagggataggtttgttatcgttttcgggttttgtgtttggcgttttggttttttttcgcggttacggacgtttttgtagtttttttttttagattttttttagttcgggattcgaatcgtttttttatttttaggcgtaggggtcgtcgtgtgaggcgtgggaaattagggcgtggagggttggaatgaagttattgttt

SEQ ID NO: 32982 - DNA, 1007 bp, Artificial Sequence
  chemically treated genomic DNA (Homo sapiens) CpG-island No: 32982
aaacaataacttcattccaaccctccacgccctaatttcccacgcctcacacgacgacccctacgcctaaaaataaaaaaacgattcgaatcccgaactaaaaaaaatctaaaaaaaaaaactacaaaaacgtccgtaaccgcgaaaaaaaaccaaaacgccaaacacaaaacccgaaaacgataacaaacctatccctaacgcgaccgacgataacccccgctcgcgacctttacaaaacctccccgtcgcgtcctcgcaccgaacccgcaacgccgaactccgaacatcccaatccgaaaactcaaaaacgcgcgaaacgatccgaaaaaaaaactcgaaaaaacgcgaaaaacaaaaactacgacgcaaataactactaaaactaacgaacccaatctccgcccccgaataccccccgcgccgcgcccgcgaaaccgaaccccgcgcccgcttaccttaaaaacgcaacgactacaacgaaaacgcctccgcgactcgaccgcgcgcgacccgatactcaacgaaactctccaaccgccgccccgcgcccgcccgtcccgcccaacaccgcccaaccccgcccaacccgatcccgaacccgcccccgacccccaacgtccgacgcccgcccaacgtcccgccccgcgcgctcattaacaaccccgcccccgccgccccacccgacccgaaaacgcgcgaacgcaccgaaacctctaccttacaaaaccgactctactcaaaccccgcgaaccgccgaatatccgctcaacgcaaaacgcgaaccgacccgcgaatcgtaaaaaccgctaaacaaaaaacgacgaaaacccctcacctaactctaaaaccccccgaaaacgaccgaaccccgatctctacgccccgcaaacgcgcgttaacgatacgacgaaaaataaataacgcgaccgcgacctcctaaaataaaataaattaacgacgaaacctcgaaaacaatacgaaacgaaccccgaccgcgcccaatt

SEQ ID NO: 32983 - DNA, 1007 bp, Artificial Sequence
  chemically treated genomic DNA (Homo sapiens) CpG-island No: 32983
gggtagtggttttattttagttttttacgttttaattttttacgttttatacggcggtttttacgtttgggaatagggaaacggttcgagtttcgggttggggagggtttggagggaagggttgtaggggcgttcgtggtcgcgaagaaaggttaaagcgttaggtatagggttcggagacggtgatagatttgtttttggcgcggtcgacggtgattttcgttcgcggtttttgtaaagttttttcgtcgcgttttcgtatcgagttcgtagcgtcgaatttcgggtattttaattcgggggtttagggacgcgcggggcggttcgggaagggggttcgggggagcgcggggggtaggggttgcggcgtaggtggttgttggggttgacgggtttagttttcgttttcgggtgtttttcgcgtcgcgttcgcgggatcgagtttcgcgttcgtttattttggagacgtagcgattgtagcggaggcgttttcgcgattcggtcgcgcgcgattcggtgtttagcggagttttttagtcgtcgtttcgcgttcgttcgtttcgtttagtatcgtttagtttcgtttagttcggtttcgggttcgttttcggtttttagcgttcggcgttcgtttagcgtttcgtttcgcgcgtttattggtagtttcgttttcgtcgttttattcggttcggggacgcgcgggcgtatcgagatttttgttttataaggtcgattttgtttaggtttcgcggatcgtcgggtattcgtttagcgtagggcgcgggtcgattcgcgggtcgtgggaatcgttgggtagggggcggcgggggttttttatttggttttggggtttttcggggacgatcggatttcgatttttgcgtttcgtagacgcgcgttgacggtgcggcgggggatggatagcgcggtcgcggttttttggggtggggtgggttggcggcggggtttcgaggatagtgcggggcgagtttcgatcgcgtttagtt

SEQ ID NO: 32984 - DNA, 1007 bp, Artificial Sequence
  chemically treated genomic DNA (Homo sapiens) CpG-island No: 32984
aactaaacgcgatcgaaactcgccccgcactatcctcgaaaccccgccgccaacccaccccaccccaaaaaaccgcgaccgcgctatccatcccccgccgcaccgtcaacgcgcgtctacgaaacgcaaaaatcgaaatccgatcgtccccgaaaaaccccaaaaccaaataaaaaacccccgccgccccctacccaacgattcccacgacccgcgaatcgacccgcgccctacgctaaacgaatacccgacgatccgcgaaacctaaacaaaatcgaccttataaaacaaaaatctcgatacgcccgcgcgtccccgaaccgaataaaacgacgaaaacgaaactaccaataaacgcgcgaaacgaaacgctaaacgaacgccgaacgctaaaaaccgaaaacgaacccgaaaccgaactaaacgaaactaaacgatactaaacgaaacgaacgaacgcgaaacgacgactaaaaaactccgctaaacaccgaatcgcgcgcgaccgaatcgcgaaaacgcctccgctacaatcgctacgtctccaaaataaacgaacgcgaaactcgatcccgcgaacgcgacgcgaaaaacacccgaaaacgaaaactaaacccgtcaaccccaacaaccacctacgccgcaacccctaccccccgcgctcccccgaacccccttcccgaaccgccccgcgcgtccctaaacccccgaattaaaatacccgaaattcgacgctacgaactcgatacgaaaacgcgacgaaaaaactttacaaaaaccgcgaacgaaaatcaccgtcgaccgcgccaaaaacaaatctatcaccgtctccgaaccctatacctaacgctttaacctttcttcgcgaccacgaacgcccctacaacccttccctccaaaccctccccaacccgaaactcgaaccgtttccctattcccaaacgtaaaaaccgccgtataaaacgtaaaaaattaaaacgtaaaaaactaaaataaaaccactaccc

SEQ ID NO: 32985 - DNA, 768 bp, Artificial Sequence
  chemically treated genomic DNA (Homo sapiens) CpG-island No: 32985
ggtcgtcgtcgggatggtatggttggtggatgggcgttatgaaattatttcgatggcgattagtagtatgatcggcgatgttagcggtatgatttgcgatggtgcgtcgaatagttgcgcgatgaaggtttcgattagtgtttcggttgcgtggaaagcggtgttaatggcgttggatgatatcgtcgtgatcggtaatgaagggattgtggcgtatgatgttgagtagtcgattgttaatttgtgtgcgttagtaagttattcgatgtagtaaacggatcggtagattatcgagattatggcgagtaaggttagataaacgttaggttttggggatcgtgtcggatgcgatgttggcgtattttgttcggtttacgggttgtttaattcgttaatgttgttggattttgtaggtcggataaggcgttttcgtcgtattcggtattcggagtttgatgcgacgttggcgcgttttattaggtttataaatcgagtcgtagtcggataaggcgtttacgtcgtattcggtattttaatattagattttatatgcgtcgttttcgtagttatcgttttggattgacggtattagatcgttttgtgcgtttttagcgtcgtcgtcggtgttttgattaatatagtgttttgatttcgaatttgtaggcggtgagtaggttttttagtaattgttgtatcggtattttttttgacgggaagcgtgacggatcgtagttggtgttggtagagatcgattgatcgataaatttt

SEQ ID NO: 32986 - DNA, 768 bp, Artificial Sequence
  chemically treated genomic DNA (Homo sapiens) CpG-island No: 32986
aaaatttatcgatcaatcgatctctaccaacaccaactacgatccgtcacgcttcccgtcaaaaaaaataccgatacaacaattactaaaaaacctactcaccgcctacaaattcgaaatcaaaacactatattaatcaaaacaccgacgacgacgctaaaaacgcacaaaacgatctaataccgtcaatccaaaacgataactacgaaaacgacgcatataaaatctaatattaaaataccgaatacgacgtaaacgccttatccgactacgactcgatttataaacctaataaaacgcgccaacgtcgcatcaaactccgaataccgaatacgacgaaaacgccttatccgacctacaaaatccaacaacattaacgaattaaacaacccgtaaaccgaacaaaatacgccaacatcgcatccgacacgatccccaaaacctaacgtttatctaaccttactcgccataatctcgataatctaccgatccgtttactacatcgaataacttactaacgcacacaaattaacaatcgactactcaacatcatacgccacaatcccttcattaccgatcacgacgatatcatccaacgccattaacaccgctttccacgcaaccgaaacactaatcgaaaccttcatcgcgcaactattcgacgcaccatcgcaaatcataccgctaacatcgccgatcatactactaatcgccatcgaaataatttcataacgcccatccaccaaccataccatcccgacgacgacc

SEQ ID NO: 32987 - DNA, 768 bp, Artificial Sequence
  chemically treated genomic DNA (Homo sapiens) CpG-island No: 32987
gaaatttatcgattagtcgatttttgttaatattaattacgattcgttacgtttttcgttaggaaaagtgtcgatgtagtagttgttgaaagatttgtttatcgtttataaattcggggttaaaatattgtattaattagaatatcggcggcggcgttgaagacgtataagacgatttggtgtcgttaatttaggacgatggttgcgaaagcggcgtatgtaagatttgatattgagatgtcggatgcggcgtaaacgttttattcggttacggttcggtttgtaggtttgataagacgcgttagcgtcgtattaggtttcgggtgtcggatgcggcgaaaacgttttattcggtttataaaatttaataatattaacgaattaaataattcgtaggtcggataagatgcgttagtatcgtattcggtacgatttttaaaatttggcgtttatttggttttgttcgttataatttcgataatttgtcgattcgtttgttgtatcgaatggtttgttaacgtatataggttggtaatcgattgtttaatattatgcgttataatttttttattgtcggttacggcggtattatttagcgttattaatatcgttttttacgtagtcgaagtattggtcgaaatttttatcgcgtagttgttcgacgtattatcgtaaattatgtcgttgatatcgtcgattatattgttgatcgttatcgagatggttttataacgtttatttattagttatgttatttcggcggcggtt

SEQ ID NO: 32988 - DNA, 768 bp, Artificial Sequence
  chemically treated genomic DNA (Homo sapiens) CpG-island No: 32988
aaccgccgccgaaataacataactaataaataaacgttataaaaccatctcgataacgatcaacaatataatcgacgatatcaacgacataatttacgataatacgtcgaacaactacgcgataaaaatttcgaccaatacttcgactacgtaaaaaacgatattaataacgctaaataataccgccgtaaccgacaataaaaaaattataacgcataatattaaacaatcgattaccaacctatatacgttaacaaaccattcgatacaacaaacgaatcgacaaattatcgaaattataacgaacaaaaccaaataaacgccaaattttaaaaatcgtaccgaatacgatactaacgcatcttatccgacctacgaattatttaattcgttaatattattaaattttataaaccgaataaaacgttttcgccgcatccgacacccgaaacctaatacgacgctaacgcgtcttatcaaacctacaaaccgaaccgtaaccgaataaaacgtttacgccgcatccgacatctcaatatcaaatcttacatacgccgctttcgcaaccatcgtcctaaattaacgacaccaaatcgtcttatacgtcttcaacgccgccgccgatattctaattaatacaatattttaaccccgaatttataaacgataaacaaatctttcaacaactactacatcgacacttttcctaacgaaaaacgtaacgaatcgtaattaatattaacaaaaatcgactaatcgataaatttc

SEQ ID NO: 32989 - DNA, 782 bp, Artificial Sequence
  chemically treated genomic DNA (Homo sapiens) CpG-island No: 32989
gattggtttatgtgttaagcgttgtatgttttgtacggtggatttttatgatggattttcggtgttatttaattcgtttgaattgttgatgcgcgatcggatgcgttaattattggaatgggcgaacgattattacgatttggtgattgtcgatacgtcgtcgatgttggcggtgagtgatgtcgcggtcgtggggcgttttgttggtttagtttgttggtagtatattacggtttagatcggttatcgattatatgcggttttatggtcgtaatttagagtattgagtagcgtgcgggcgttacggtagcgagatcggcggagtacgttacgatcgtcgtcggcggcggagcgaaagagtagggtacggcgatacgcggcgtagacggagcgagagagttagtcgcgacgggacgagcgcgcgacgcgttagttaagaaggcgaatatcgacgattaaggcgcgcggcggtcgagagtagagggaacggagagggcggaatcgtagacgatacggagaggagatacgacgaaggtaacgacgtagcggcgattacgtcgacgtacgtcgacgtcgatcgaggtcgcgatcgacgagcggacgagattagcggtaggtagtacgaggtacgataatatatagatcgacggaggcgacgatcggacgcgcgacgagcgagtacgagtaggaaaaaagtagatcgatcggcgcgcgtacgttaatacgagcgtaggcggcgcgacgcggagttacggcgggttcgaaatagtagtatatagtat

SEQ ID NO: 32990 - DNA, 782 bp, Artificial Sequence
  chemically treated genomic DNA (Homo sapiens) CpG-island No: 32990
atactatatactactatttcgaacccgccgtaactccgcgtcgcgccgcctacgctcgtattaacgtacgcgcgccgatcgatctacttttttcctactcgtactcgctcgtcgcgcgtccgatcgtcgcctccgtcgatctatatattatcgtacctcgtactacctaccgctaatctcgtccgctcgtcgatcgcgacctcgatcgacgtcgacgtacgtcgacgtaatcgccgctacgtcgttaccttcgtcgtatctcctctccgtatcgtctacgattccgccctctccgttccctctactctcgaccgccgcgcgccttaatcgtcgatattcgccttcttaactaacgcgtcgcgcgctcgtcccgtcgcgactaactctctcgctccgtctacgccgcgtatcgccgtaccctactctttcgctccgccgccgacgacgatcgtaacgtactccgccgatctcgctaccgtaacgcccgcacgctactcaatactctaaattacgaccataaaaccgcatataatcgataaccgatctaaaccgtaatatactaccaacaaactaaaccaacaaaacgccccacgaccgcgacatcactcaccgccaacatcgacgacgtatcgacaatcaccaaatcgtaataatcgttcgcccattccaataattaacgcatccgatcgcgcatcaacaattcaaacgaattaaataacaccgaaaatccatcataaaaatccaccgtacaaaacatacaacgcttaacacataaaccaatc

SEQ ID NO: 32991 - DNA, 782 bp, Artificial Sequence
  chemically treated genomic DNA (Homo sapiens) CpG-island No: 32991
gtgttgtgtgttgttgtttcgggttcgtcgtggtttcgcgtcgcgtcgtttgcgttcgtgttggcgtgcgcgcgtcggtcggtttgttttttttttgttcgtgttcgttcgtcgcgcgttcggtcgtcgttttcgtcggtttgtgtgttgtcgtgtttcgtgttgtttgtcgttggtttcgttcgttcgtcggtcgcggtttcggtcggcgtcggcgtgcgtcggcgtggtcgtcgttgcgtcgttgttttcgtcgtgtttttttttcgtgtcgtttgcggtttcgtttttttcgttttttttgttttcggtcgtcgcgcgttttggtcgtcggtgttcgtttttttggttggcgcgtcgcgcgttcgtttcgtcgcggttggttttttcgtttcgtttgcgtcgcgtgtcgtcgtgttttgttttttcgtttcgtcgtcggcggcggtcgtgacgtgtttcgtcgatttcgttgtcgtgacgttcgtacgttgtttagtgttttgggttgcggttatgaggtcgtatgtggtcggtagtcggtttaggtcgtagtgtgttattagtaggttgggttaatagaacgttttacgatcgcggtattatttatcgttagtatcggcggcgtatcgataattattagatcgtaatggtcgttcgtttattttagtaattgacgtattcgatcgcgtattagtagtttagacgggttaggtggtatcggggatttattatagaagtttatcgtatagggtatgtaacgtttggtatataggttagtt

SEQ ID NO: 32992 - DNA, 782 bp, Artificial Sequence
  chemically treated genomic DNA (Homo sapiens) CpG-island No: 32992
aactaacctatataccaaacgttacataccctatacgataaacttctataataaatccccgataccacctaacccgtctaaactactaatacgcgatcgaatacgtcaattactaaaataaacgaacgaccattacgatctaataattatcgatacgccgccgatactaacgataaataataccgcgatcgtaaaacgttctattaacccaacctactaataacacactacgacctaaaccgactaccgaccacatacgacctcataaccgcaacccaaaacactaaacaacgtacgaacgtcacgacaacgaaatcgacgaaacacgtcacgaccgccgccgacgacgaaacgaaaaaacaaaacacgacgacacgcgacgcaaacgaaacgaaaaaaccaaccgcgacgaaacgaacgcgcgacgcgccaaccaaaaaaacgaacaccgacgaccaaaacgcgcgacgaccgaaaacaaaaaaaacgaaaaaaacgaaaccgcaaacgacacgaaaaaaaaacacgacgaaaacaacgacgcaacgacgaccacgccgacgcacgccgacgccgaccgaaaccgcgaccgacgaacgaacgaaaccaacgacaaacaacacgaaacacgacaacacacaaaccgacgaaaacgacgaccgaacgcgcgacgaacgaacacgaacaaaaaaaaaacaaaccgaccgacgcgcgcacgccaacacgaacgcaaacgacgcgacgcgaaaccacgacgaacccgaaacaacaacacacaacac

SEQ ID NO: 32993 - DNA, 658 bp, Artificial Sequence
  chemically treated genomic DNA (Homo sapiens) CpG-island No: 32993
cgtgggtttggagtttgttggaagcggaacggtaaattcgaggtcgtgattgtagattagttaatttgttatgggttaatcgtttttttgttgttttagtcgcgtattatcgtatagttatggttttcgagatatttcggatcgttgcgtatttttggtagaatatttttgcgtgttagagttggaggtacgttttacggcgggtttattattacgttgttaagggtattgtttattatcggcgttttgcgatcggggcgatcgataatgattcgcgaatttagtatttgattgtcgttttgatagtagattagcgaataggtcggaatgttaattatgatttcggtagaaagttttgttggtagtaagcgtaatcgttggatgttgagagttaatatattagtacgttgggcgggcgttacgtttaattagttacgtgttgtcgggttaatagtattatttgtttttaatttttgttatgtttgaaaacgtttaacggtttttattagtttatattcgtaggcggcgcgaacggtaggcgtaggtttattacgagacgtcgtttgtttatttatcggtttagtttttgttgttttaatagtaatagcggatgggttgattatcgcgttagttggcgtgttatcgttaggtagagtaa

SEQ ID NO: 32994 - DNA, 658 bp, Artificial Sequence
  chemically treated genomic DNA (Homo sapiens) CpG-island No: 32994
ttactctacctaacgataacacgccaactaacgcgataatcaacccatccgctattactattaaaacaacaaaaactaaaccgataaataaacaaacgacgtctcgtaataaacctacgcctaccgttcgcgccgcctacgaatataaactaataaaaaccgttaaacgttttcaaacataacaaaaattaaaaacaaataatactattaacccgacaacacgtaactaattaaacgtaacgcccgcccaacgtactaatatattaactctcaacatccaacgattacgcttactaccaacaaaactttctaccgaaatcataattaacattccgacctattcgctaatctactatcaaaacgacaatcaaatactaaattcgcgaatcattatcgatcgccccgatcgcaaaacgccgataataaacaatacccttaacaacgtaataataaacccgccgtaaaacgtacctccaactctaacacgcaaaaatattctaccaaaaatacgcaacgatccgaaatatctcgaaaaccataactatacgataatacgcgactaaaacaacaaaaaaacgattaacccataacaaattaactaatctacaatcacgacctcgaatttaccgttccgcttccaacaaactccaaacccacg

SEQ ID NO: 32995 - DNA, 658 bp, Artificial Sequence
  chemically treated genomic DNA (Homo sapiens) CpG-island No: 32995
ttattttatttggcgatgatacgttaattgacgcggtagttagtttattcgttgttattgttgaaatagtagaaattaagtcgatggataagtaaacgacgtttcgtagtaaatttgcgtttgtcgttcgcgtcgtttacgaatatgaattggtggaagtcgttaaacgtttttaggtatggtaaggattgggggtagatggtgttattggttcggtaatacgtgattggttaaacgtaacgttcgtttagcgtgttggtgtgttggtttttaatatttagcgattgcgtttgttgttaatagagttttttatcgggattatggttaatatttcggtttattcgttggtttattattagaacggtaattaggtgttggattcgcgagttattgtcggtcgtttcgatcgtaaaacgtcgatgatgagtagtgtttttaataacgtagtggtaaattcgtcgtggaacgtatttttaattttggtacgtaaagatattttgttaaaagtgcgtaacgattcgggatatttcgaaagttatggttatacggtgatgcgcggttggaatagtagagaagcgattgatttatggtaggttgattggtttataattacggtttcgaatttatcgtttcgtttttagtaggttttaggtttacg

SEQ ID NO: 32996 - DNA, 658 bp, Artificial Sequence
  chemically treated genomic DNA (Homo sapiens) CpG-island No: 32996
cgtaaacctaaaacctactaaaaacgaaacgataaattcgaaaccgtaattataaaccaatcaacctaccataaatcaatcgcttctctactattccaaccgcgcatcaccgtataaccataactttcgaaatatcccgaatcgttacgcacttttaacaaaatatctttacgtaccaaaattaaaaatacgttccacgacgaatttaccactacgttattaaaaacactactcatcatcgacgttttacgatcgaaacgaccgacaataactcgcgaatccaacacctaattaccgttctaataataaaccaacgaataaaccgaaatattaaccataatcccgataaaaaactctattaacaacaaacgcaatcgctaaatattaaaaaccaacacaccaacacgctaaacgaacgttacgtttaaccaatcacgtattaccgaaccaataacaccatctacccccaatccttaccatacctaaaaacgtttaacgacttccaccaattcatattcgtaaacgacgcgaacgacaaacgcaaatttactacgaaacgtcgtttacttatccatcgacttaatttctactatttcaacaataacaacgaataaactaactaccgcgtcaattaacgtatcatcgccaaataaaataa

SEQ ID NO: 32997 - DNA, 519 bp, Artificial Sequence
  chemically treated genomic DNA (Homo sapiens) CpG-island No: 32997
atcgaggttagttgattacgatcgtcgagaaagattattcgcgtatgatcgggtaaggcgtcgattagtttcgatattataggtagatcgattattgacgttttatttattattagtatattaagatgtagcgggttatcggtatgatgacgtaaacgttggttattcggttgcgcgtttagtaatcggtgtaaagtgttggtatttttcggaatgcgttttttttgtttatcggttagcggtaattgtcgtaaagttttgtcgagagattcggttaagcgcgcggtagttttattcgttggtgtagttagacggatacggtagcgttcgtcgtcggttatttgaattaacgttgttagtaatttcgttacggtggtcgttttatcggtgttagggtcgtcggaaattatcgagattcgtcgcgttagcgttattgtcgtcgtaattttttgttagttaattttatcgtttattggaaaaagtttgtttagggtttgcgttagtagagttttattaatt

SEQ ID NO: 32998 - DNA, 519 bp, Artificial Sequence
  chemically treated genomic DNA (Homo sapiens) CpG-island No: 32998
aattaataaaactctactaacgcaaaccctaaacaaactttttccaataaacgataaaattaactaacaaaaaattacgacgacaataacgctaacgcgacgaatctcgataatttccgacgaccctaacaccgataaaacgaccaccgtaacgaaattactaacaacgttaattcaaataaccgacgacgaacgctaccgtatccgtctaactacaccaacgaataaaactaccgcgcgcttaaccgaatctctcgacaaaactttacgacaattaccgctaaccgataaacaaaaaaaacgcattccgaaaaataccaacactttacaccgattactaaacgcgcaaccgaataaccaacgtttacgtcatcataccgataacccgctacatcttaatatactaataataaataaaacgtcaataatcgatctacctataatatcgaaactaatcgacgccttacccgatcatacgcgaataatctttctcgacgatcgtaatcaactaacctcgat

SEQ ID NO: 32999 - DNA, 519 bp, Artificial Sequence
  chemically treated genomic DNA (Homo sapiens) CpG-island No: 32999
ggttgatgaagttttattggcgtaaattttggataaattttttttagtaagcgatgaaattaattggtaaaaagttgcggcggtagtggcgttgacgcggcggatttcggtgattttcggcggttttggtatcggtaaaacgattatcgtagcgaagttgttggtagcgttaatttaaatggtcgacggcgaacgttgtcgtattcgtttggttgtattaacgggtaaagttgtcgcgcgtttaatcgaatttttcggtaaggttttgcgatagttatcgttgatcgatgaataaaagaaacgtatttcggaagatgttagtattttgtatcgattgttgggcgcgtagtcgggtagttagcgtttacgttattatgtcggtaattcgttgtattttgatgtgttggtggtagatgaagcgttaatgatcgatttgtttatgatgtcgagattgatcgacgttttgttcgattatgcgcgagtgatttttttcggcgatcgtgattaattggtttcggt

SEQ ID NO: 33000 - DNA, 519 bp, Artificial Sequence
  chemically treated genomic DNA (Homo sapiens) CpG-island No: 33000
accgaaaccaattaatcacgatcgccgaaaaaaatcactcgcgcataatcgaacaaaacgtcgatcaatctcgacatcataaacaaatcgatcattaacgcttcatctaccaccaacacatcaaaatacaacgaattaccgacataataacgtaaacgctaactacccgactacgcgcccaacaatcgatacaaaatactaacatcttccgaaatacgtttcttttattcatcgatcaacgataactatcgcaaaaccttaccgaaaaattcgattaaacgcgcgacaactttacccgttaatacaaccaaacgaatacgacaacgttcgccgtcgaccatttaaattaacgctaccaacaacttcgctacgataatcgttttaccgataccaaaaccgccgaaaatcaccgaaatccgccgcgtcaacgccactaccgccgcaactttttaccaattaatttcatcgcttactaaaaaaaatttatccaaaatttacgccaataaaacttcatcaacc

SEQ ID NO: 33001 - DNA, 749 bp, Artificial Sequence
  chemically treated genomic DNA (Homo sapiens) CpG-island No: 33001
ggaagtcgttttggaacgtgtttttgaatatttcgtcggcggtttttttttaagtcgttttcggagtcgatttaggtttcggagtagatataggtatcgagcgtcgagggtatagtagtaggtcggttttgtttcgaagaagggtggttgagtttttggttttcggatttgtagttattgatggtcggattcggacgcggtaacgttaagttcgcgatttttagtttttaagttgcgagtttagaacggaaattatagtaattatcgttcgcgtcgcggtattttttcgtttttaatggaggcggagggtcgttcgttgtttaaaatgaattttttcgtttatttgagttcgtttttcgggagcgcggggtttaatttcgttataaggattacggattttcgtttcgtttcgtttgtaagtttcgtttggtttcgtttttttttgaaaagagtttagttgttaaggaattattttttttgtcgtcgttttagagatgtttttggaaaagcggaagggtacggagggttttggagttcgttgttggtatttgcgtggtgttatgagaacgtggcggggcggtgagtgacgtgagggggcgtgacggttaggtcgggagtagttgttcgcgcgggagaataggggttgcgtagggaaagcggttttgaaaaagagttttttggcgtcgggcggacgtttaatatatgtttgtcggttaagtataggataaggttaaagggaattaattaat

SEQ ID NO: 33002 - DNA, 749 bp, Artificial Sequence
  chemically treated genomic DNA (Homo sapiens) CpG-island No: 33002
attaattaattccctttaaccttatcctatacttaaccgacaaacatatattaaacgtccgcccgacgccaaaaaactctttttcaaaaccgctttccctacgcaacccctattctcccgcgcgaacaactactcccgacctaaccgtcacgccccctcacgtcactcaccgccccgccacgttctcataacaccacgcaaataccaacaacgaactccaaaaccctccgtacccttccgcttttccaaaaacatctctaaaacgacgacaaaaaaaataattccttaacaactaaactcttttcaaaaaaaaacgaaaccaaacgaaacttacaaacgaaacgaaacgaaaatccgtaatccttataacgaaattaaaccccgcgctcccgaaaaacgaactcaaataaacgaaaaaattcattttaaacaacgaacgaccctccgcctccattaaaaacgaaaaaataccgcgacgcgaacgataattactataatttccgttctaaactcgcaacttaaaaactaaaaatcgcgaacttaacgttaccgcgtccgaatccgaccatcaataactacaaatccgaaaaccaaaaactcaaccacccttcttcgaaacaaaaccgacctactactataccctcgacgctcgatacctatatctactccgaaacctaaatcgactccgaaaacgacttaaaaaaaaaccgccgacgaaatattcaaaaacacgttccaaaacgacttcc

SEQ ID NO: 33003 - DNA, 749 bp, Artificial Sequence
  chemically treated genomic DNA (Homo sapiens) CpG-island No: 33003
attggttagttttttttaattttattttgtatttggtcgataagtatgtgttgggcgttcgttcgacgttaagaagtttttttttaaagtcgttttttttgcgtagtttttgttttttcgcgcgggtaattattttcggtttggtcgttacgtttttttacgttatttatcgtttcgttacgtttttatgatattacgtaggtgttagtaacgaattttagaatttttcgtgttttttcgtttttttaaaggtatttttgggacgacggtaagaaaaatagttttttgataattgagttttttttaggaggaggcgggattaggcgggatttataggcggaacgaaacggaagttcgtggtttttgtaacgggattgggtttcgcgttttcggggggcgggtttagatgggcggagggatttattttaagtaacgggcggtttttcgtttttattgaaggcggggaaatatcgcggcgcggacggtagttgttgtggttttcgttttgagttcgtagtttaggagttgaagatcgcggatttagcgttgtcgcgttcgagttcggttattagtggttgtagattcggaggttaggagtttaattattttttttcggaatagggtcggtttgttgttgtgttttcgacgttcggtgtttgtatttatttcggggtttaggtcggtttcgggggcggtttaggagaaggtcgtcggcgagatgtttaaaaatacgttttagagcggttttt

SEQ ID NO: 33004 - DNA, 749 bp, Artificial Sequence
  chemically treated genomic DNA (Homo sapiens) CpG-island No: 33004
aaaaaccgctctaaaacgtatttttaaacatctcgccgacgaccttctcctaaaccgcccccgaaaccgacctaaaccccgaaataaatacaaacaccgaacgtcgaaaacacaacaacaaaccgaccctattccgaaaaaaaataattaaactcctaacctccgaatctacaaccactaataaccgaactcgaacgcgacaacgctaaatccgcgatcttcaactcctaaactacgaactcaaaacgaaaaccacaacaactaccgtccgcgccgcgatatttccccgccttcaataaaaacgaaaaaccgcccgttacttaaaataaatccctccgcccatctaaacccgccccccgaaaacgcgaaacccaatcccgttacaaaaaccacgaacttccgtttcgttccgcctataaatcccgcctaatcccgcctcctcctaaaaaaaactcaattatcaaaaaactatttttcttaccgtcgtcccaaaaatacctttaaaaaaacgaaaaaacacgaaaaattctaaaattcgttactaacacctacgtaatatcataaaaacgtaacgaaacgataaataacgtaaaaaaacgtaacgaccaaaccgaaaataattacccgcgcgaaaaaacaaaaactacgcaaaaaaaacgactttaaaaaaaaacttcttaacgtcgaacgaacgcccaacacatacttatcgaccaaatacaaaataaaattaaaaaaaactaaccaat

SEQ ID NO: 33005 - DNA, 1009 bp, Artificial Sequence
  chemically treated genomic DNA (Homo sapiens) CpG-island No: 33005
  misc_feature (260)..(260): n is either a, c, g or t
  misc_feature (308)..(309): n is either a, c, g or t
  misc_feature (368)..(368): n is either a, c, g or t
  misc_feature (394)..(394): n is either a, c, g or t
  misc_feature (404)..(404): n is either a, c, g or t
  misc_feature (573)..(573): n is either a, c, g or t
  misc_feature (686)..(686): n is either a, c, g or t
  misc_feature (989)..(989): n is either a, c, g or t
gtttatatttttttttacgttgacggttatttcgtaattatcgttttttattttttcgcgtcgttttattatttttcgttagtattttttaattatttttcgatttcgtttttttttgtaaatttattagtcgacgttttttttttttattttttttttattttttttcgttttcgttttcgttattttttttttttattcgtttttcgttttttttttattttatttattttataatcgttttttttttaattatttanttatttatttgacgttcgttttgttcgtttattcgttattaaattatnnatatttttcgggtacgttcgttttttttttttgatatattttttttatcgcggtatttnttcgatttttttattttcgttttcgnaaacgttcgngcgtcgcgttttattttttttatattttttatgttacgcgttttcgcgtttttttttttttttataatattatagtttttttttttcggtttttttttaatattattcgttcggtttcgttttatcgtatttttaaataataaaaattattcggtagtttcgtcgattngttttatatatacgttttatcgcgcgaattttcgaaattaattaatttatatttttttttacgggatttttcgttttttattataatatcgttaattattttcgtttcgtcgntcgtttattaatgaaaatatatagtgagagcgtcgtaggtttttcgttttttttataattagcggattattcgtacgcgttttttacgcgtcgaatatattttttatttatttttattatacgcgttcgtcgtttcgtttcgtattttattttttacgtttgtttacgtagttattttcgtcgttcgcgcgtttataacgcgatttaaatattttcgcgacggcggttcgttttttcgatttttttttcgttattcggattaatttatattattttcgtcgttttatttttcgttttaatcgntatatttatttattaacgtt

SEQ ID NO: 33006 - DNA, 1009 bp, Artificial Sequence
  chemically treated genomic DNA (Homo sapiens) CpG-island No: 33006
  misc_feature (21)..(21): n is either a, c, g or t
  misc_feature (324)..(324): n is either a, c, g or t
  misc_feature (437)..(437): n is either a, c, g or t
  misc_feature (606)..(606): n is either a, c, g or t
  misc_feature (616)..(616): n is either a, c, g or t
  misc_feature (642)..(642): n is either a, c, g or t
  misc_feature (701)..(702): n is either a, c, g or t
  misc_feature (750)..(750): n is either a, c, g or t
aacgttaataaataaatatancgattaaaacgaaaaataaaacgacgaaaataatataaattaatccgaataacgaaaaaaaaatcgaaaaaacgaaccgccgtcgcgaaaatatttaaatcgcgttataaacgcgcgaacgacgaaaataactacgtaaacaaacgtaaaaaataaaatacgaaacgaaacgacgaacgcgtataataaaaataaataaaaaatatattcgacgcgtaaaaaacgcgtacgaataatccgctaattataaaaaaaacgaaaaacctacgacgctctcactatatattttcattaataaacgancgacgaaacgaaaataattaacgatattataataaaaaacgaaaaatcccgtaaaaaaaaatataaattaattaatttcgaaaattcgcgcgataaaacgtatatataaaacnaatcgacgaaactaccgaataatttttattatttaaaaatacgataaaacgaaaccgaacgaataatattaaaaaaaaaccgaaaaaaaaaaactataatattataaaaaaaaaaaaaaacgcgaaaacgcgtaacataaaaaatataaaaaaaataaaacgcgacgcncgaacgtttncgaaaacgaaaataaaaaaatcgaanaaataccgcgataaaaaaaatatatcaaaaaaaaaaaacgaacgtacccgaaaaatatnnataatttaataacgaataaacgaacaaaacgaacgtcaaataaataantaaataattaaaaaaaaaacgattataaaataaataaaataaaaaaaaaacgaaaaacgaataaaaaaaaaaaataacgaaaacgaaaacgaaaaaaaataaaaaaaaaataaaaaaaaaaaacgtcgactaataaatttacaaaaaaaaacgaaatcgaaaaataattaaaaaatactaacgaaaaataataaaacgacgcgaaaaaataaaaaacgataattacgaaataaccgtcaacgtaaaaaaaaatataaac
